United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 32

SEQ ID NO: 135158 - protein, 177 aa, Glycine max
  Coding DNA Sequence Number=SeqID_18380
  Gene Ontology: Mol. function=RNA-directed DNA polymerase activity; Cellular component=intracellular; Biological process=RNA-dependent DNA replication
MKVLDQAFVEKDVTVNQLDSIVGNITACNNLSFSDEELPEEGRNHNLALHILVNCKSDALSNVLVDTGSSLNVMAKSTLDQLFYQGPPMRRSGVVVKAFDGSRKSVIGEVDLPITIGPSVFQITFQVMDIQAAYSCLLGRPWIHEAGAVTSTLHQKLKFVRNGRLITVSGEEAFVSA

SEQ ID NO: 135159 - protein, 110 aa, Glycine max
  Coding DNA Sequence Number=SeqID_18381
  Gene Ontology: Mol. function=sugar porter activity; Cellular component=integral to membrane; Biological process=carbohydrate transport
  Homolog annotation: Hit_ID=Q5K3W0; Match level="QueryCoverage=90%, HitCoverage=19%, E-value=4e-33, Identity=71%"; Hit description =Monosaccharide transporter
MNLSLKVVENISKAVKGGGFGTIFEEQYRPELVMVFAIPLSQQLTGINIVAFYAPNLFQSVGFGSDSALLSAVILGLVNLGSILVSTAVVDRFGRRFLFIAGGIQMLLCM

SEQ ID NO: 135160 - protein, 32 aa, Glycine max
  Coding DNA Sequence Number=SeqID_18382
MVSSSDKMTKEAEEERHDSVHNLLGARGVVRL

SEQ ID NO: 135161 - protein, 59 aa, Glycine max
  Coding DNA Sequence Number=SeqID_18383
RRHHWQHLGVRRLGRYSIHGAEGFRGERGEDNVVGGCGAKNRLMERWLRQLLTSAKERR

SEQ ID NO: 135162 - protein, 167 aa, Glycine max
  Coding DNA Sequence Number=SeqID_18384
  Gene Ontology: Mol. function=protein serine/threonine kinase activity; Cellular component=membrane; Biological process=protein amino acid phosphorylation
  Homolog annotation: Hit_ID=Q9FID9; Match level="QueryCoverage=70%, HitCoverage=13%, E-value=2e-10, Identity=35%"; Hit description =Receptor protein kinase-like protein
MRFNSVTCIAVTILFLSIHLQAYKYRPLEHFTISCGATRTSLNYYFPVTSGPKFVRLFFHPASYPSFPCTEAPLHCSVQLILLDSIDSSMETEAENTESIFREYVIQVNYDEMLTLSSTPSHPNSNAFINGIEILSIPSDLYYMSGNYTKFKSLGGDELVYIARARV

SEQ ID NO: 135163 - protein, 329 aa, Glycine max
  Coding DNA Sequence Number=SeqID_18385
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=90%, HitCoverage=60%, E-value=3e-33, Identity=42%"; Hit description =Receptor-protein kinase-like protein
  Subcellular localization annotation: CTP_CleavageSite=54; ConfidenceScore=5.15e-01
MDREHRLKLLSVQDGIVTANATTQSPTINKSPTPKLACPVLDSTTLSQSPQAPNSFASSSTLLTTLLFPAPTNPLLFNPTNSSSLMVSMPLSTLMLQTRKPSSENMLSMWIMIRGLSSASLRLNQTDPMLSSMELKHIESIAALETVYRIQVRGHEISPQSDTANTDGKMNITVNPDHVAPKELYRTAHNMGTNTTLNIISNLTWEFPVDAGFTYVLRFHFWELDPNLDIDGDRVFFIYIASHLVDDRADNNTQKKVYKGYFEGGFTPVTIKHLKLDSQQGANDIMNKIEMLSQLCHLHLVFLIGYCNENYEMILDYDFMACGTPRQHL

SEQ ID NO: 135164 - protein, 247 aa, Glycine max
  Coding DNA Sequence Number=SeqID_18386
  Gene Ontology: Cellular component=endoplasmic reticulum
  Homolog annotation: Hit_ID=Q1RY25; Match level="QueryCoverage=72%, HitCoverage=42%, E-value=7e-45, Identity=51%"; Hit description =Reticulon
MALIVDPMLKGKIALECFRKFCKIGVSCLSEDGMQRPSSMNDVILELDFALQLQENVEQCKNAAPQTASPRNPRKSRWRSELEIREEKDSTIVEEDEKPRTRRQTTRTKKEKPNSVPPSTPSPKSEEENGGDLDHVGQVVSDLIMWKDASKSTFWFGFCSLCLLSSCFTQGLNFSVLSALSQLGILLSGVSFFSNSICQRNEVEEKREIKLAEDDILCLAKLILPALNFAISRMRALFSGEPSMTLK

SEQ ID NO: 135165 - protein, 862 aa, Glycine max
  Coding DNA Sequence Number=SeqID_18387
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=91%, HitCoverage=90%, E-value=0.0, Identity=47%"; Hit description =Receptor-protein kinase-like protein
  Pfam annotation: Domain name=Pkinase; Domain location=513-785; Score =115.5; E_value=1.5e-31; Accession=PF00069.15; Description=Protein kinase domain
  Pfam annotation: Domain name=Pkinase_Tyr; Domain location=513-785; Score=135.1; E_value=1.9e-37; Accession=PF07714.7; Description =Protein tyrosine kinase
  Pfam module annotation: Pfam domain module=Pkinase::Pkinase_Tyr; Domain location=513-785::513-785
MRFLSINSVALFLFLLFSTHIQAYTPEDNFSISCGTTGTSFDGERTWTGDIHKKYLSGGQDDTVSTEATTQSPSVKQVPYTSVRLSRSQFNYSFPVTAGPKFVRLFFYPADYPSFPRTDASFTVQSNQFTLLKGFNTSLNADAGKTETIFGEYVVNVNDGGILLLSFTPSKPYSYAFINGIEVLSMPTDLYYTSATVDAVGFKFVGRNMQYTLRTSFALQTEYRIKAGGQEISAQNDTGLLRKWAGDEQDYLIKQNPENNDLPANTDGKMNITVNPDHVAPKELYRTARNMGTNTTLNIISNLTWEFPVDSGFTYMIRLHFCELDPNISDIKDRVFLIYIASQLAEDNADVMEWTQKQKGLPVHQNYAVLIPKNNNQKKVNLLLQMHPQTDDKTLYRDAFLNGLEIFKISEAKSNNLAGPNPDPVLTPHNNIPAPKGNSSSGSQMTIIGVIAGLVSGVVLISVVILFVVILWRKRTTAMKTKDRSTNKQNYSLPSDLCRRFSLIEIKAATQNFDEVFIIGVGGFGHVYKGYIDDSFTPVAIKRLKPGSQQGAREFLNEIDMLSQLRHLNLVSLIGYCNDNKEMILVYDFVRRGNLRDHLYNTDKPPLSWKQRLQICIGAALGLDYLHTGAKHMIIHRDVKTTNILLDDKWVVKVSDFGLSRIGPTGVDKSHVSTVVRGSFGYLDPEYYKRYRLTEKSDVYSFGVVLFEILCARPPLIHSAQIEQVSLANWVRCCNQSGTMSRIVDPTLKGKIAPECFKKFCETGMSCLLEDGRQRPSMNDVVWMLEFALQLQESAEQRENDGIVITEEVNEKREEISDDTFNINKSSSAVSVNVSTSSSSEEHSYAGIDILAWLRGMGKNKL

SEQ ID NO: 135166 - protein, 219 aa, Glycine max
  Coding DNA Sequence Number=SeqID_18388
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=95%, HitCoverage=36%, E-value=2e-14, Identity=39%"; Hit description =Receptor-protein kinase-like protein
MRLFRNWAGHDEQYLVTQNLWDNLMGDMDGKMNITVNPKYVAPKEIYKTSHGMCRNTNLNKSLNLTWEFPIHSFSVYMVKLHFCELDLNINDIGERMFIIYIGTELAGDSSVMKWSQKQKSLAVHRDYIIMISTNDIQKKGNFQVCSILFLNHQDNQHTQSLQPSHLCRRFSLIKINGSTNYFNKAFIANVGGFGHVYKGYIDSGSTPVVIKRLKLGSQ

SEQ ID NO: 135167 - protein, 130 aa, Glycine max
  Coding DNA Sequence Number=SeqID_18389
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=98%, HitCoverage=14%, E-value=9e-46, Identity=66%"; Hit description =Receptor-protein kinase-like protein
MTIVYEFMAHGNLHEHLYNTNNPSLLWKQCLQICIGTTRGLHYLHSSAKHMIIHHNMKTKNILLDDKWVAKVSDFGLSSIGPTGTFEAHINTIVKGNFGYLDSEYYICYRLTEKPDVYSFGVALLEILCT

SEQ ID NO: 135168 - protein, 68 aa, Glycine max
  Coding DNA Sequence Number=SeqID_18390
MVKQSTGLYALRCVKMGERRKSVKEVIPRNVMLCVVARKHRRKEHSECLLVKDDCDKSNGKYVQLTYF

SEQ ID NO: 135169 - protein, 106 aa, Glycine max
  Coding DNA Sequence Number=SeqID_18391
MTGNTRYHDDRKYAVISLLDGQTANFEYLETIQERAKVFGIPTTFSISLLGIKMAYSYFVHSQTFLFLALAHNISTTLGQLACYVNEEHPITNFINMRIKLAKVKP

SEQ ID NO: 135170 - protein, 322 aa, Glycine max
  Coding DNA Sequence Number=SeqID_18392
  Gene Ontology: Mol. function=protein serine/threonine kinase activity; Cellular component=membrane; Biological process=protein amino acid phosphorylation
  Homolog annotation: Hit_ID=Q6T9V1; Match level="QueryCoverage=56%, HitCoverage=98%, E-value=2e-66, Identity=67%"; Hit description =Resistance protein candidate
  Pfam annotation: Domain name=Pkinase; Domain location=114-321; Score=- 6.9; E_value=3.8e-08; Accession=PF00069.15; Description=Protein kinase domain
  Pfam annotation: Domain name=Pkinase_Tyr; Domain location=119-320; Score=-15.5; E_value=1.6e-11; Accession=PF07714.7; Description =Protein tyrosine kinase
  Pfam module annotation: Pfam domain module=Pkinase::Pkinase_Tyr; Domain location=114-321::119-320
MELTLVNPSYALETEHRINVGGKEISTRNNTGLFRVYTGHDENYLMTQNLKDNLPLDNSGRNITVNPYYMAPKELYRTTRDMSINTTLNKSPKLTLEFPIFGCCHMIKAATNNFVDAFIVGIGGFGHVYKGYINSGSTTVAIKHLKPGSKQGVHEFMSEIEMLLQLHHLHLTTLLGYCNDNTEMIIVYDFMARGNLRDHLYNSDNPPLSWKQRLQICIGIARGLHYLYAGMKHMIIHHDEKTTNILLDDKWVTKVSDFGFSSIRPTSMSKAHIVIVVKGSFGYLDPKYCNRQRLTEKSDMFNVSRPALICLFFSLCAYRLLC

SEQ ID NO: 135171 - protein, 183 aa, Glycine max
  Coding DNA Sequence Number=SeqID_18393
  Gene Ontology: Mol. function=transcription factor activity; Cellular component=nucleus; Biological process=regulation of transcription, DNA-dependent
  Homolog annotation: Hit_ID=Q0HA68; Match level="QueryCoverage=72%, HitCoverage=27%, E-value=2e-36, Identity=56%"; Hit description=DELLA protein
MNFAKKKNSLVVRCLMPPHLEHASNVIIHLRERHSLPQLPRSVSLLEVRTLHREPNNLRGLQRLRLRPCHRLQPRARALVASADTGTGTPSRQTATAEAHRHRAETRRAGVVRERAVRIPGESEGGACVPDLMAFSDPRQRHRGLLEPGVPCYEPPLQCRIVLFSSSLEDPWYDTIRTGHYHR

SEQ ID NO: 135172 - protein, 84 aa, Glycine max
  Coding DNA Sequence Number=SeqID_18394
  Gene Ontology: Mol. function=zinc ion binding; Cellular component =nucleus; Biological process=ubiquitin cycle
  Homolog annotation: Hit_ID=A0ELV2; Match level="QueryCoverage=58%, HitCoverage=68%, E-value=5e-14, Identity=53%"; Hit description=RBX1 -like protein
MATLDFDVPMVPADIIVDNCAIYRNHIMDLCIECQANQASATSEKCIVAWVRVLQSQLQGCYWAMVAAIFSLILLSEENGVIHS

SEQ ID NO: 135173 - protein, 181 aa, Glycine max
  Coding DNA Sequence Number=SeqID_18395
MPPEIEVDGRIYGDDEEIFANKTSRSGRRHRIGGGGMTKRKIEEIPDLRFGVRLGVSYEHDLSLSLSPVWETTTSFDTDMMGDYELQWRKEFQVHAFLVLPTCNPNQPMSTCGSTCRMPMCLVNNHFLLAFPPLCWPSFLQLLLPLSLHMLKGGGTSGCNMTHLLSLKPLNVQKSFLVGIS

SEQ ID NO: 135174 - protein, 495 aa, Glycine max
  Coding DNA Sequence Number=SeqID_18396
  Gene Ontology: Mol. function=phospholipase C activity; Cellular component=membrane; Biological process=intracellular signaling cascade
  Homolog annotation: Hit_ID=Q10JM3; Match level="QueryCoverage=65%, HitCoverage=85%, E-value=1e-138, Identity=71%"; Hit description =MAP3K-like protein kinase, putative, expressed
MGSLLFLLLVIVLPLCYCVDAACSNGNCKVNDECSSNGDCGAGLYCFSCPLGYLGSRCVRSSITDQFKLTNNSLPFNKYAFLTTHNAFAIDGEPSHTGVPRATITNQADSVTEQLKNGVRALMLDTYDFRGDVWLCHSFQGQCYDFTAFEPAIDTLKEIEAFLSANPAEIVTLILEDYVKTPKGLTKVFAKAGLMKFWFPVTRMPKRGGDWPLVSDMIAKNQRLLVFTSVRSKEQSEGIAYQWNYMVENQYGDGGRKAGSCPHRAESSPLDDKSKSLVLVNYFRSTPFKPIACEDNSGGLIDMLQTCHGAAANRWANYLAVDYYKRSEGGGSFQAVDTLNGKLLCGCNDVHALDLLHKLAQHRKHSNELLEMFHPTLPGSEYHILCSHRVTKSPYSCRCSANSSIETTSFIDGLCIPILSQKTHPNLGLARRPKPSSGKPKVRKLGLDGHASGIAVDIALVHMVESPNVDDEGLIKVSGGGFDLDEEKQRQWLDG

SEQ ID NO: 135175 - protein, 37 aa, Glycine max
  Coding DNA Sequence Number=SeqID_18397
MWHLTAYVCVYYDGQICNTNEGTTFISNNTKTFMVDK

SEQ ID NO: 135176 - protein, 279 aa, Glycine max
  Coding DNA Sequence Number=SeqID_18398
  Gene Ontology: Mol. function=heat shock protein binding; Cellular component=integral to membrane; Biological process=protein folding
  Homolog annotation: Hit_ID=Q1SHY3; Match level="QueryCoverage=89%, HitCoverage=86%, E-value=5e-96, Identity=73%"; Hit description=Heat shock protein DnaJ
  Pfam annotation: Domain name=DnaJ; Domain location=20-89; Score=93.4; E_value=6.8e-25; Accession=PF00226.21; Description=DnaJ domain
MKLMGVYLIGVLFLVLHDMVLGVEKTASQQEIKKAYYKLALRLHPDKNPGDEMLAVVIDHLLQEAKAKFQQLQNVIAILGDEEKRAVYDQTGFVDDAELAGDVVQNLKEYFRAMYKKVTEADIEEFEANYRGSDIEKNDLIDLYKKCNGNMNRLFCSMLCSDPKLDSHRFKDIIDEVIAAGELKETKAYKKWTKKISEIKPPTSPLRRRAKSSKKQPEKELYAIISQRKHERKDHFDSMFSSLISKYGGGQMPEPSEEEFEAAQRKVESGRSSKKLKRK

SEQ ID NO: 135177 - protein, 133 aa, Glycine max
  Coding DNA Sequence Number=SeqID_18399
  Gene Ontology: Mol. function=protein-tyrosine kinase activity; Cellular component=integral to membrane; Biological process=protein amino acid phosphorylation
  Homolog annotation: Hit_ID=Q69FA2; Match level="QueryCoverage=50%, HitCoverage=22%, E-value=4e-11, Identity=48%"; Hit description =Serine-threonine kinase
MIKFPALGIDLGLRIYEIIEKVPRFVQEGSVFIDRKQAGGDCEYLVKWAFDNESKGVPEKIVDSSLLGKIAPACWEVFIEIVQRCLASVEERPWMGEVEVVLEIFALLLQERVDAVKLISTINLKPRRSSKTE

SEQ ID NO: 135178 - protein, 90 aa, Glycine max
  Coding DNA Sequence Number=SeqID_18400
  Homolog annotation: Hit_ID=Q1SFG1; Match level="QueryCoverage=41%, HitCoverage=4%, E-value=5e-09, Identity=76%"; Hit description=AAA ATPase
MSSKLVRCDDKANKSGRKGMEMKKQGVFEERRELLKGVSGVFRLRVLTALMGAIQGVPKIKEGYNPATWMLEVTSAGIEASLKIFQTKGY

SEQ ID NO: 135179 - protein, 111 aa, Glycine max
  Coding DNA Sequence Number=SeqID_18401
  Gene Ontology: Mol. function=transcription factor activity; Biological process=regulation of transcription, DNA-dependent
  Homolog annotation: Hit_ID=Q5PH14; Match level="QueryCoverage=84%, HitCoverage=37%, E-value=5e-25, Identity=49%"; Hit description =Putative transcriptional regulator
MACRCAIAHQAFRSVALRLSGYGRAQLALRGESAACAGSQSAAGRRNPARLAIAAAAGGAGVGNRAGLPAGRIVRGHGAGPPGAPAAGQRRAGGAGVAAAVSGQPVLRQLV

SEQ ID NO: 135180 - protein, 75 aa, Glycine max
  Coding DNA Sequence Number=SeqID_18402
MRSSGSSRIFSEGPLLPEDFRKTSSGNFPEEVVHPEEFRKTPTSGRSFKLPEDLSGRTPSSGMFPEEPLLPEVIL

SEQ ID NO: 135181 - protein, 86 aa, Glycine max
  Coding DNA Sequence Number=SeqID_18403
MVKCLVKLQTRFREDPTVNKGWVAFLPRQLQTKFREDPTVNEGWAVFLPRQLHVAFSRSFIKRPPLEASSRSFLVASLRSFLKRLL

SEQ ID NO: 135182 - protein, 73 aa, Glycine max
  Coding DNA Sequence Number=SeqID_18404
  Homolog annotation: Hit_ID=Q6ICY4; Match level="QueryCoverage=79%, HitCoverage=14%, E-value=5e-07, Identity=50%"; Hit description=Metal tolerance protein C2
MSLNVAYSTTEWLFGLFTGCVGLVLDAVHLTFGCGLLTFLLFVMAASRKKADQEYTYGTVGEGCLDSSSGNNP

SEQ ID NO: 135183 - protein, 138 aa, Glycine max
  Coding DNA Sequence Number=SeqID_18405
MNENTIHGAPKRGREWRIALSNHYAWLEIRGQRMHERKRNSWGSEKRVENGELHEAITTHDSKLVVGGRMNENAIHGDPKKGGEWRIALSNHYAWLQTRGWRMLERKRNSWGSEKGLRMENCTKQSLRMTPNSRVEDA

SEQ ID NO: 135184 - protein, 274 aa, Glycine max
  Coding DNA Sequence Number=SeqID_18406
  Gene Ontology: Mol. function=transporter activity; Cellular component= membrane; Biological process=transport
  Homolog annotation: Hit_ID=Q7CKH8; Match level="QueryCoverage=94%, HitCoverage=55%, E-value=4e-62, Identity=50%"; Hit description =Putative outer membrane protein, efflux pump
  Pfam annotation: Domain name=OEP; Domain location=57-245; Score =101.9; E_value=1.9e-27; Accession=PF02321.8; Description=Outer membrane efflux protein
MMLTLPLLLTGCLSLDPHYQRPAAPVPANLPQGEAGGNRALSYPDVAWRDYVQDARLRQVVALGLNGSRDLREAIANIASARALYGEQRSALFPTINATADGSRGRALTGSGNATALSQSYEAAAGVSAFELDLFGKNASLSRAAFETYLANSEAAKSTRLTLIADIVTDWVAVAAERSNLAVAQQTMASAKRSLDVTRNNQQHGIASLVDVASAETVYQQARSDAASYATSAAQAKNALDLAVGQSVPESLLPSGIEALGGIMRDLPAGVSSQ

SEQ ID NO: 135185 - protein, 137 aa, Glycine max
  Coding DNA Sequence Number=SeqID_18407
  Homolog annotation: Hit_ID=Q9AVH2; Match level="QueryCoverage=34%, HitCoverage=16%, E-value=3e-20, Identity=97%"; Hit description =Putative senescence-associated protein
MARHKVTRTHTHTQSRRHKGEEGLGRPVRPGTHLVSTRQAKRERADERILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 135186 - protein, 98 aa, Glycine max
  Coding DNA Sequence Number=SeqID_18408
MASRKRKAPSTPTKVRFDKSRFTSQEAWERYTDVIVPRKLLPERNVVVDYTEFDEFKEELERPLFAFRRPDPQELAAKLCIPGRRFELNVDGKPLKIL

SEQ ID NO: 135187 - protein, 241 aa, Glycine max
  Coding DNA Sequence Number=SeqID_18409
  Gene Ontology: Mol. function=transcription factor activity; Cellular component=intracellular; Biological process=regulation of transcription, DNA-dependent
  Homolog annotation: Hit_ID=P03024; Match level="QueryCoverage=97%, HitCoverage=74%, E-value=5e-95, Identity=70%"; Hit description=HTH -type transcriptional regulator galR
  Pfam annotation: Domain name=Peripla_BP_1; Domain location=1-230; Score=-25.1; E_value=5e-05; Accession=PF00532.11; Description =Periplasmic binding proteins and sugar b
MVKAVEQVSYQTGNSLLIGNGYHNEQKEPPGDRTADPPPLCPAWSSSTAFIPGFEKRCVALDDRYGAWLATRHLIQQGHTRIGYLCSNHPISDAEDRLQGYYDALRENGLPCNDRLVAYGEPDESGGEQAITELLGRGRNFTAVASYNDSMAAGAMGVLNDNGIEVPAEISLIGFDDVLVSRYVRPRLTTVRYPIITMATQAAELALALAEQRQPPEITHLFSPTLVRRHSVASPAEAQSE

SEQ ID NO: 135188 - protein, 82 aa, Glycine max
  Coding DNA Sequence Number=SeqID_18410
MVIDQSLYFKLTQLSSDGVPFEGTLDDDWKFDISVSDARRLVCTNQADMTGRLLAGSLAFEFCIMHYLIVRILLPRSSNIAQ

SEQ ID NO: 135189 - protein, 52 aa, Glycine max; identical to SEQ ID NO: 124036
  Coding DNA Sequence Number=SeqID_18411

SEQ ID NO: 135190 - protein, 37 aa, Glycine max
  Coding DNA Sequence Number=SeqID_18412
MGSTWLMGLILLKSLLVKVIGGRLHVFGRILPRLGRT

SEQ ID NO: 135191 - protein, 95 aa, Glycine max
  Coding DNA Sequence Number=SeqID_18413
MDISEDTDIPIILERPFMLTASCIVDMGKRKLELGFEDQKIDFDLFVEDKLAPEHNVCLQVMEGVFSLSASLTLSASLVMRYATSLKRIAPNPCI

SEQ ID NO: 135192 - protein, 47 aa, Glycine max
  Coding DNA Sequence Number=SeqID_18414
MECPRAPPRYAHVAFESYPQKNGGLREPSRGYGYHCVIKWSSSLEVR

SEQ ID NO: 135193 - protein, 286 aa, Glycine max
  Coding DNA Sequence Number=SeqID_18415
  Gene Ontology: Mol. function=DNA binding
  Homolog annotation: Hit_ID=Q1RUD8; Match level="QueryCoverage=98%, HitCoverage=61%, E-value=3e-37, Identity=34%"; Hit description=IMP dehydrogenase/GMP reductase
GLDATSLKELGRLMGPLQRQAFRKVYGKILDLTAAEVFMEAVVSLAQYYEQPLRCFTFGDFQMVSTVEEFEEILGCPLGGRKPYLFSEFLPSLSKIAAVARDMASQEKWVPFADILALLIFGVVLFPNMDGLVDLAAIDAFLAYHHSKESPVAAILADLFDTFDRRCEKNSAQIVCCLPALCVWLVSHLFQQDIRHPCSLQSYRSCVKKRRVDWDQHLAGIGGSTINWFPRWKEGKEGVLFSCGDYLNVPLMGTRGCINYNPALAIRQLGYPMRGAPTEESLSPFL

SEQ ID NO: 135194 - protein, 66 aa, Glycine max
  Coding DNA Sequence Number=SeqID_18416
  Pfam annotation: Domain name=zf-CCHC; Domain location=43-60; Score =21.6; E_value=0.00027; Accession=PF00098.13; Description=Zinc knuckle
MKFDGSWNQGAGKKFVKKHGKGQGPIEINDGSVQIQKKASKGNNCHFCGKSGHFHKDCPKCKSWFE

SEQ ID NO: 135195 - protein, 86 aa, Glycine max
  Coding DNA Sequence Number=SeqID_18417
  Homolog annotation: Hit_ID=Q2HUH8; Match level="QueryCoverage=81%, HitCoverage=18%, E-value=8e-13, Identity=49%"; Hit description =Histidine triad (HIT) protein; Homeodomain-like
MKSRWQKINVGVQKFKGHYKQAVDLKKNGYTKNDVMIHAYAIWKKDKGSNFTSEHAWRLLKDKPKCRITLFGTDYSAKLGITPGFD

SEQ ID NO: 135196 - protein, 67 aa, Glycine max
  Coding DNA Sequence Number=SeqID_18418
MGQKAAKRKIKRKEAAMSSSIVDLSIMKVAINEKIVVNKRIAEAKETENIAVLYEILVKNTSTMSEE

SEQ ID NO: 135197 - protein, 151 aa, Glycine max
  Coding DNA Sequence Number=SeqID_18419
  Gene Ontology: Mol. function=transition metal ion binding; Cellular component=chromatin; Biological process=chromatin assembly or disassembly
MQNSGVTLRAESQHFASVHDVNPCVASTPYVGFIDEIWELNYMKFTVCVFKCKWVDSNNDLKKLGYHNDPFIMAEQARQVFYVQDPCDERWCMVLQCKTICVNVEDDDSYMDTYVSPLSTQITPNIVGEEEADDIHANRNDHDERELINIV

SEQ ID NO: 135198 - protein, 87 aa, Glycine max
  Coding DNA Sequence Number=SeqID_18420
  Subcellular localization annotation: CTP_CleavageSite=29; ConfidenceScore=5.73e-01
MASPPGSPPLPPPSPPPPLPPPSDASASLSAMKWTRKATCLRSLSTRPPGAERPVVHVDPAIGKADGPHRKKLRTYLGIVARDKVDV

SEQ ID NO: 135199 - protein, 101 aa, Glycine max
  Coding DNA Sequence Number=SeqID_18421
  Subcellular localization annotation: CTP_CleavageSite=23; ConfidenceScore=5.13e-01
MALAVKTQRAILLLRAQRAALTFAAQRMNSAGLRSILYCRVNRRFIHSAQFQQPEVNMIRIVKLAAVVALVSALSGCLFPPPGGGGGWGGPGGGGPGHGYQ

SEQ ID NO: 135200 - protein, 381 aa, Glycine max
  Coding DNA Sequence Number=SeqID_18422
  Gene Ontology: Mol. function=transporter activity; Cellular component= outer membrane; Biological process=nutrient import
  Homolog annotation: Hit_ID=Q9HYJ7; Match level="QueryCoverage=99%, HitCoverage=37%, E-value=7e-33, Identity=29%"; Hit description=Haem uptake outer membrane receptor HasR
MRQDFVQNGHMQRNGEMYVDSELLSEVEVERGVVRGVHGTGAMAGSVDFRTLDFGDVLREGRDIGLRLRATSGAGHQGNGVNFLGSAAGAASAGEHLQVLAAISRRSVGDYRIGTHKGADDDSNTAFLSKGVKAEYNDVKFSGQTQESYLFKSRWQLNKAQSVQFNYVGTRVDYSYVGDASNTLQENGSPWRKLGISRAQSDSYSLDYRLAPEGSTWIDLNIKLYGVDTRVSNYTNPTYPRTVHGLVLDPADVREHVDEYWDKGTCEDPNRTGYARDICRQYGAGRNNQIRTKTQGVLLTNTSRFNLGAETLLSVNYGAEYFSDRAISKTRWDYKGRDVVPIGTTGQSLLNPQGRRSMGSVFTDLTLQNDFYTVSASLRYE

SEQ ID NO: 135201 - protein, 49 aa, Glycine max
  Coding DNA Sequence Number=SeqID_18423
MEYDGRGNVCYYNMEQVHLVEEIEEYWTLLRQLEQTPKDESNNSSEDTS

SEQ ID NO: 135202 - protein, 80 aa, Glycine max
  Coding DNA Sequence Number=SeqID_18424
MSRWHAKHSCALSAPYEFQFLKSRGTGTWVATFAPKPLQPLIPKHFFVSTVCLLLLCILFASLQRQSKISDDRAKWTMSR

SEQ ID NO: 135203 - protein, 134 aa, Glycine max
  Coding DNA Sequence Number=SeqID_18425
MKYLYLFRAHWQLVVLCLGNNLVVWFCSLRKKSDAAIKGAVNSAMKSVTKTAEGKPPQHGPQWIEAKSHVQTGNYECGYYVMQWIWCIVSGGLKDDWIHWFSDRSALTEETMTTLRHKWAAYFIQMKKCEPRKN

SEQ ID NO: 135204 - protein, 59 aa, Glycine max
  Coding DNA Sequence Number=SeqID_18426
MWNIRIDASKEKEELKIRKIKPLAGAASSVVLKSKAELMQEQVTHQDRKVVLEQQIGFF

SEQ ID NO: 135205 - protein, 720 aa, Glycine max
  Coding DNA Sequence Number=SeqID_18427
  Gene Ontology: Mol. function=helicase activity; Cellular component =chloroplast thylakoid membrane; Biological process=protein amino acid phosphorylation
  Homolog annotation: Hit_ID=Q10C42; Match level="QueryCoverage=90%, HitCoverage=86%, E-value=1e-116, Identity=37%"; Hit description =Expressed protein
  Pfam annotation: Domain name=PPR; Domain location=125-159; Score=3.5; E_value=2.9; Accession=PF01535.11; Description=PPR repeat
  Pfam annotation: Domain name=PPR; Domain location=197-231; Score =12.2; E_value=0.27; Accession=PF01535.11; Description=PPR repeat
  Pfam annotation: Domain name=PPR; Domain location=232-266; Score =28.6; E_value=2.2e-05; Accession=PF01535.11; Description=PPR repeat
  Pfam annotation: Domain name=PPR; Domain location=267-301; Score =36.3; E_value=1.1e-07; Accession=PF01535.11; Description=PPR repeat
  Pfam annotation: Domain name=PPR; Domain location=302-336; Score =27.7; E_value=4e-05; Accession=PF01535.11; Description=PPR repeat
  Pfam annotation: Domain name=PPR; Domain location=368-401; Score =15.2; E_value=0.12; Accession=PF01535.11; Description=PPR repeat
  Pfam annotation: Domain name=PPR; Domain location=402-436; Score =22.2; E_value=0.0018; Accession=PF01535.11; Description=PPR repeat
  Pfam annotation: Domain name=PPR; Domain location=437-471; Score =23.3; E_value=0.00089; Accession=PF01535.11; Description=PPR repeat
  Pfam annotation: Domain name=PPR; Domain location=472-506; Score =12.1; E_value=0.28; Accession=PF01535.11; Description=PPR repeat
  Pfam annotation: Domain name=PPR; Domain location=507-541; Score=1.0; E_value=5.8; Accession=PF01535.11; Description=PPR repeat
  Pfam annotation: Domain name=PPR; Domain location=542-576; Score =11.9; E_value=0.29; Accession=PF01535.11; Description=PPR repeat
  Pfam annotation: Domain name=PPR; Domain location=577-611; Score =26.3; E_value=0.00011; Accession=PF01535.11; Description=PPR repeat
  Pfam annotation: Domain name=PPR; Domain location=646-680; Score =28.3; E_value=2.7e-05; Accession=PF01535.11; Description=PPR repeat
  Pfam annotation: Domain name=PPR; Domain location=90-124; Score=0.2; E_value=7.1; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=125 -159::197-231::232-266::267-301::302-336::368-401::402-436::437 -471::472-506::507-541::...
  Pfam module annotation: Domain location=542-576::577-611::646-680::90- 124
MAIKLPSSAHPTRFLRWVYLSSSCIADISETPGILKPKDSSEFDQNLNFLKNKLAPDNLIRALDRTSDLNSAVRIFKWASRQKSFHHTSNTYFRIILKLGMAGKVLEMRDFCEYMVKDRCPGAEEALVALVHTFVGHHRIKEAIAVLVNMNLGGYRPPIEVFNVLLGALVGRESRDFQSALFVYKEMVKACVLPTVDTLNYLLEVLFATNRNELALHQFRRMNNKGCDPNSKTFEILVKGLIESGQVDEAATVLEQMLKHKCQPDLGFYTCIIPLFCRENKVEEAVKLFKMMKDSDFVPDSFIYEVLVRCFCNNLQLDSAVSLINEMIEIGMPPKHNVLVDMMNCFCELGKINEAIMFLEDTQVHETAPFNTLLEGCCNAGEVLAANVLLETMSERNIADCQSWNILIRWLCENEETNKAYILLGRMIKSFVILDHATYSALVVGKCRLGKYEEAMELFHQIYARCWVLDFASYSELVGGLSDIKHSQDAIEVFHYMSMKRCSLHSLSFYKLIKCVCDSGQVNQAIRLWQLAYFCGISCCIATHTTIMRELSKSRRAEDLLAFLSQMLMVGSNLDLEAYCILFQSMSKHNKVKECVLFFNMMVHEGLIPDPDRLFDQLSFIANHSQLSMIPSAIDRISDGDILNPAMFGLLITALLKEGKEHEARRLLDLMLEKGWLPDATTHNLLIGSDVRERSQAMLFDNSASLDSVSYILAEGLGDA

SEQ ID NO: 135206 - protein, 62 aa, Glycine max
  Coding DNA Sequence Number=SeqID_18428
MGHLTQAQALFKPQGTRKGRIAERCFFFAKAVRQQRSLAPVSLYFEGQVDSDTTMQLDWVER

SEQ ID NO: 135207 - protein, 420 aa, Glycine max
  Coding DNA Sequence Number=SeqID_18429
  Gene Ontology: Mol. function=aspartic-type endopeptidase activity; Cellular component=lysosome; Biological process=sphingolipid metabolic process
  Homolog annotation: Hit_ID=Q948P0; Match level="QueryCoverage=85%, HitCoverage=71%, E-value=1e-161, Identity=75%"; Hit description =Aspartic proteinase 2
  Pfam annotation: Domain name=Asp; Domain location=38-307; Score =335.6; E_value=8.3e-98; Accession=PF00026.14; Description=Eukaryotic aspartyl protease
  Pfam annotation: Domain name=SapB_1; Domain location=332-370; Score =27.1; E_value=6.2e-05; Accession=PF05184.5; Description=Saposin-like type B, region 1
  Pfam annotation: Domain name=SapB_2; Domain location=271-305; Score =56.1; E_value=1.2e-13; Accession=PF03489.7; Description=Saposin-like type B, region 2
  Pfam module annotation: Pfam domain module=Asp::SapB_1::SapB_2; Domain location=38-307::332-370::271-305
MVRENLRLGRPVLGANDQYIGKPTDEGIVPLKNYLDAQYYGEIGIGTPPQKFNVIFDTGSSNLWVPSSKCYFSIACYTHHWYKSKKSKTYTKNGTSCKIRYGSGSISGFFSKDHVKVGDVVVKNQDFIEATREGSLSFVLAKFDGLLGLGFQEISVENAVPVWYNMVKQNLVSEQVFSFWLNGDPKVKNGGELVFGGVDPKHFKGEHIYVPVTKKGYWQIEMGDFFIGGLSTGVCEGGCAAIVDSGTSLLAGPTTVVTEINHAIGAEGVLSVECKEVVSEYGELLWDLLVSGVRPDDVCSQVGLCFKRTKSESNGIEMVTEKEQRELSTKDTALCTSCQMLVVWIQNQLKHKKTKEIVFNYVNQKETRYKHEREEAEAELKLQFRMVKELPQNTKRPELESVGASPPLQRRSSFPCAGVK

SEQ ID NO: 135208 - protein, 88 aa, Glycine max
  Coding DNA Sequence Number=SeqID_18430
MPFTIDCLLTYYIPWGFTSRAKLQYYEDTCLYLILETQHPVLEFLLTPEEYDERDNVCQYNVHQVHLVEAIEDRGDHLDMSPKENEEY

SEQ ID NO: 135209 - protein, 120 aa, Glycine max
  Coding DNA Sequence Number=SeqID_18431
MAFLGDEKNLAYELILALVSLWLLVDSIKKGKSQRKCPIEMKALQKGIQKVNEMKIKARENKLGPLREKEGEACHLARPGELGCFLQKASPSGELSGRPKWVWLLFAPSFLQNTPLAFFC

SEQ ID NO: 135210 - protein, 75 aa, Glycine max
  Coding DNA Sequence Number=SeqID_18432
MSDTMSRTSCPKILEVAVQCTKLQDPRCRIQCPGHPARKYWKLLYNARSCRIHDVGYDVQDIWPENTGHINLLYL

SEQ ID NO: 135211 - protein, 101 aa, Glycine max
  Coding DNA Sequence Number=SeqID_18433
  Homolog annotation: Hit_ID=Q2HTV0; Match level="QueryCoverage=34%, HitCoverage=2%, E-value=4e-09, Identity=85%"; Hit description=Zinc finger, RING-type; Transcription factor jumonji, jmjC; Zinc finger, C2H2-type
MSYDAAIEVRNHVSPEPEVEDAGVASLANPKACDKFGMQNDFKGSKVASKSENYEVYLQLFYFCFMFFRKQPDLINQLDTLGDILRGHKFQFLIITLHIYV

SEQ ID NO: 135212 - protein, 51 aa, Glycine max
  Coding DNA Sequence Number=SeqID_18434
MVVQCWFLLSRERWATGDGVLMPGLVEMGCLFCAIARSPPSTTYDGCLITQ

SEQ ID NO: 135213 - protein, 104 aa, Glycine max
  Coding DNA Sequence Number=SeqID_18435
AAGTPPPPRQVDSAGPLGVERYLQHLVHQQVANHHGQPQSAGAEFHPFCMPYPRAVWAEVALPGDWPDAQTGEEPAGSPRGADESLMDEDMTDLLGFLGGSGAT

SEQ ID NO: 135214 - protein, 214 aa, Glycine max
  Coding DNA Sequence Number=SeqID_18436
  Subcellular localization annotation: CTP_CleavageSite=32; ConfidenceScore=5.05e-01
MAEPSKKRKGTSSRSQRHSGAQETPIPSPIPSGSLFSSEEQRIRYTNLFSSRSIIDPKFIDMDFFSNESFECLQAFENSNLIPFMSLELPVYSELVKAFYSNLEIHEGTLMSEVYGTKMVIDQSLLYDLTQLPSEGVPFEGALIDDWKFDFSVHDARRLVCTNQADMTGRLLASSLAFESCILHYLIVCILLPRSSNLAQVSEEDLIVMWAFHK

SEQ ID NO: 135215 - protein, 143 aa, Glycine max
  Coding DNA Sequence Number=SeqID_18437
MSEVEEVQEQMKTDMKAMKEQMVTMMKAMMSMKKIMEVNAVAIAATSTIAEVDLTPPYGLNQINHPTSDMVGLEGKELGGMGGPHLVQKTSMPSHHMACLPTIHHPMWHTLPVRMSITLLPYSLKANNLNLIMHMPLNPWGDT

SEQ ID NO: 135216 - protein, 136 aa, Glycine max
  Coding DNA Sequence Number=SeqID_18438
MSDSGKLYIETVEIEDLKLSRNSNGHNFSLGCPIQAHNISRSSQLNMEAQGKFKWSSLLTRMSDSRAQYIEMLKIKHESTRQILTAITFDSDAQLMPIIYRVAQKLNNVSSRESQMVIIFHSDVRFRRIIYLDARN

SEQ ID NO: 135217 - protein, 75 aa, Glycine max
  Coding DNA Sequence Number=SeqID_18439
  Subcellular localization annotation: CTP_CleavageSite=24; ConfidenceScore=5.49e-01
MAPQILYMTTSHVNIYRKFQMPPKASSSSGRGGKTVSQGKEVLLALPEPVIKKTTSSSSGSPTQTGSSTQKQKIE

SEQ ID NO: 135218 - protein, 212 aa, Glycine max
  Coding DNA Sequence Number=SeqID_18440
  Gene Ontology: Mol. function=oxidoreductase activity; Biological process=electron transport
  Homolog annotation: Hit_ID=P29217; Match level="QueryCoverage=90%, HitCoverage=89%, E-value=1e-71, Identity=70%"; Hit description =Hypothetical protein yceH
  Pfam annotation: Domain name=DUF480; Domain location=3-173; Score =383.4; E_value=3.4e-112; Accession=PF04337.3; Description=Protein of unknown function, DUF480
MALSAQALRVIGCLLEKQVTTPDQYPLSLNGVVTACNQKSNREPVMNLSESEVQAQLDELVKKHLVTANSGFGQRVSKYEQRFCNSAFGNLQLNAAEVAVLTLLFLRGAQTPGELRTRSGRLHEFQDMAEVERTLEGLTTRDDGPMVVRLAREPGKRESRYMHLFGGEVADELSASHTASPESDDLAVRVAQLEAQVARLDAQLQQLLQREA

SEQ ID NO: 135219 - protein, 233 aa, Glycine max
  Coding DNA Sequence Number=SeqID_18441
  Gene Ontology: Cellular component=flagellum; Biological process =flagellum biogenesis
  Homolog annotation: Hit_ID=P0A1J7; Match level="QueryCoverage=57%, HitCoverage=90%, E-value=4e-29, Identity=52%"; Hit description =Flagella synthesis protein flgN
  Pfam annotation: Domain name=FlgM; Domain location=10-94; Score=82.4; E_value=1.4e-21; Accession=PF04316.4; Description=Anti-sigma-28 factor, FlgM
  Pfam annotation: Domain name=FlgN; Domain location=90-227; Score =89.7; E_value=8.9e-24; Accession=PF05130.3; Description=FlgN protein
  Pfam module annotation: Pfam domain module=FlgM::FlgN; Domain location=10-94::90-227
  Subcellular localization annotation: CTP_CleavageSite=28; ConfidenceScore=5.43e-01
MSIDRTQPLKPVSTVQTRDSSDNQAKVRQNSAPAASTSQNGAEVTLSPAQAQLMQPGSKDINTARVEQLKTAIRNGELKMDTGKIADALIADTRAFLEDKMQDVLSSLNVVMDEEQQQLSAGRINGNLLQRITEDKSALLTTLNYLDEMRRKTELSLGTKAPYRGHIDIARRWHSIQQHTQRLRDANQHNGMLLQHQMTFTEQALSVLKPHQTQSFYGPDGRGLGQATLSRKG

SEQ ID NO: 135220 - protein, 352 aa, Glycine max
  Coding DNA Sequence Number=SeqID_18442
  Gene Ontology: Cellular component=flagellum
  Homolog annotation: Hit_ID=UPI00005F7A63; Match level="QueryCoverage =55%, HitCoverage=87%, E-value=4e-48, Identity=50%"; Hit description =COG1843: Flagellar hook capping protein
  Pfam annotation: Domain name=DUF1078; Domain location=94-132; Score =32.2; E_value=1.8e-06; Accession=PF06429.3; Description=Domain of unknown function (DUF1078)
  Pfam annotation: Domain name=FlgD; Domain location=127-272; Score =129.3; E_value=1.1e-35; Accession=PF03963.4; Description=Flagellar hook capping protein
  Pfam annotation: Domain name=Flg_bb_rod; Domain location=7-38; Score =46.7; E_value=7.9e-11; Accession=PF00460.10; Description=Flagella basal body rod protein
  Pfam module annotation: Pfam domain module=DUF1078::FlgD::Flg_bb_rod; Domain location=94-132::127-272::7-38
MALLNIFDIAGSAMTAQSQRLNVSASNLANADSVTGPDGQPYVAKQVIFQTDAAQGAATGGVKVAGVVNDPTPAKLVYDPGNPLADQKGYVKMPNVDVVAETVNTMSASRSYQANVEVLNTVKSMMMKTLTMVGIKDNLDPTVLSSSSSTGSGNSAQDLQNQFLNMLVTQLKNQDPTNPMDNSQLTTQLTQINTLSGIEKLNTTLGSISGQISTSQSLQSSTLIGHGVMVKGSQVLVGSGTSTPFGVELGTASTATSVTIKDGNGSVVRSIDLGGLSAGVHTFSWDGKMDDGSAAPDGKYTVSLAASNGSTQLVAQPLNYAYVNGVSTVNNTAKLDLGTMGSATLDEIRQIL

SEQ ID NO: 135221 - protein, 228 aa, Glycine max
  Coding DNA Sequence Number=SeqID_18443
  Gene Ontology: Mol. function=structural molecule activity; Cellular component=flagellin-based flagellum part; Biological process =flagellum organization and biogenesis
  Homolog annotation: Hit_ID=P16323; Match level="QueryCoverage=95%, HitCoverage=93%, E-value=1e-82, Identity=73%"; Hit description =Flagellar basal-body rod protein flgF
  Pfam annotation: Domain name=DUF1078; Domain location=185-223; Score =11.0; E_value=0.0062; Accession=PF06429.3; Description=Domain of unknown function (DUF1078)
MGTASQTMGATVCHRQQPRQRLDAGLSRSAQCAAHGAGQRLVAAYTYAGGCFDAGCRYVAGLARLHRASARCGAYTRNGNMQISPTGQLTIQGNPVMGDGGPIAVPQGAQLTIAADGSITAINAGDAPNATVQLGRLKLVRATGQELTRGDDGMFRPSAATQAQRGAALPNDATVQVMPGVLEGSNVKPVETMVDMIANARRFEMQMKVISNVDENEQRANQLLNMSS

SEQ ID NO: 135222 - protein, 101 aa, Glycine max
  Coding DNA Sequence Number=SeqID_18444
  Gene Ontology: Mol. function=oxidoreductase activity, acting on CH-OH group of donors; Biological process=electron transport
  Homolog annotation: Hit_ID=Q9LW56; Match level="QueryCoverage=90%, HitCoverage=12%, E-value=4e-23, Identity=61%"; Hit description =Similarity to long chain fatty alcohol oxidase
MGFKVESVAINSSADDYCGSCYYGCRTRDKKGTDSTWLVDSVGNGAVILTGCKAERFILENVKNGMKKKKCLGVIAAASWRNKCKPPIIYAKTHCIIPSSR

SEQ ID NO: 135223 - protein, 176 aa, Glycine max
  Coding DNA Sequence Number=SeqID_18445
MERSMIDAASGGALAEARNLIEKMASNSQQFSARSDAIVIRGVHEVATNSSSSAETKKLEGKLDVLVNLVNQLAMNKKSAPVARLCGLCSSADHHTDLCPSVQQSEAIEQPEAYVANIYNRPPQPEQQNQPQQNNYDLRWSNPSQQQQQQPYFQNVVGPSRPYVPPPIQQQQQQQQ

SEQ ID NO: 135224 - protein, 107 aa, Glycine max
  Coding DNA Sequence Number=SeqID_18446
  Gene Ontology: Mol. function=structural molecule activity; Cellular component=flagellin-based flagellum; Biological process=ciliary or flagellar motility
  Homolog annotation: Hit_ID=P0A1J5; Match level="QueryCoverage=91%, HitCoverage=17%, E-value=3e-19, Identity=50%"; Hit description =Flagellar hook-associated protein 1
  Pfam annotation: Domain name=Flg_bb_rod; Domain location=5-35; Score =35.2; E_value=2.3e-07; Accession=PF00460.10; Description=Flagella basal body rod protein
  Subcellular localization annotation: CTP_CleavageSite=31; ConfidenceScore=5.48e-01
MSSIINSAMSGLSAAQAALSTTSNNISNYTVAGYSRQTILLSQANSTLQGSNYYGNGVNVTGVQREYDEFITGQLRGNSANYSAVNSQYNQISNIDDLLSTVDHQPV

SEQ ID NO: 135225 - protein, 415 aa, Glycine max
  Coding DNA Sequence Number=SeqID_18447
  Gene Ontology: Mol. function=structural molecule activity; Cellular component=flagellin-based flagellum; Biological process=ciliary or flagellar motility
  Homolog annotation: Hit_ID=P0A1J5; Match level="QueryCoverage=99%, HitCoverage=76%, E-value=2e-93, Identity=45%"; Hit description =Flagellar hook-associated protein 1
  Pfam annotation: Domain name=DUF1078; Domain location=375-413; Score =57.7; E_value=3.7e-14; Accession=PF06429.3; Description=Domain of unknown function (DUF1078)
MLSYAQGLVNQFQTTAQYLTSMQNSVNTDIKASVEQINTYSSQIADLNTQIAKLTTGGGSAPNDLLDQRDQLVNNLNGLVGVSVSQQDGNYIVSMGNTTLVNGSKTTSLIAMPSSSDASRITVGYVDKQAGNVEIPEKTLTTGSLGGLLAFRTQDLDNAQNQLGQLAAAFTTSFNQVHSQGYDSKGNTGINFFNIGSPTVVTNSKNTSAATVSASWTDTGAMKASNYSVSYDGSNWSVTRLSDNVKVTPTMGSDGAGNTTMSFDGLSLTVNGTANAKDSFLVKPVQDVISGMSVAINSELQIAAASAAGGASDNRNAQKVLDLQDAKLINGNATLAQGYASMVSTVGNKTKNLETAATTQKGVVTQLTERQQSVSGVNLDEEYANLSKYQQFYMANAQVLQTINTIFDALMSIRG

SEQ ID NO: 135226 - protein, 107 aa, Glycine max
  Coding DNA Sequence Number=SeqID_18448
HDSIIPHGSPYDLYEIYIQPSHHEIYQELKHHHSCTLCNGVHKMLSNHVSFSAAPLRAFSRGTSPSNSSHNLSQCKKLGPVTTRPSILMPRYSATSSSVMVHSPHGR

SEQ ID NO: 135227 - protein, 144 aa, Glycine max
  Coding DNA Sequence Number=SeqID_18449
  Gene Ontology: Mol. function=RNA-directed DNA polymerase activity; Biological process=RNA-dependent DNA replication
  Homolog annotation: Hit_ID=Q8H6Q8; Match level="QueryCoverage=84%, HitCoverage=43%, E-value=3e-24, Identity=46%"; Hit description=CTV.20
MDLNGKIITNDDNEEIPNAVNTLIFTIAQYFIGDLSLWKDRSAELLSNLKCRTLADFRWYRDTFLSRVYTREDSQQPFWKEKILVDLPRSLGDKIRDKFCSQSVNEDIPYNSLSYGQLISYVQKVVLKIFQDDKIQRQLAKEKA

SEQ ID NO: 135228 - protein, 90 aa, Glycine max
  Coding DNA Sequence Number=SeqID_18450
QEPEPTAEHTPAAEDELTSPEPFSFAFDSVVAQEEVPSPEPIPKPSPAPISEDTLPSVPALEQEQPISQDPPATPALDLNEHAEDHPQED

SEQ ID NO: 135229 - protein, 206 aa, Glycine max
  Coding DNA Sequence Number=SeqID_18451
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=2e-31, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MKLEAEEGTEMKLQLKAEKWNMNSREQGLHVLTFRGLHVLAIRGLHTLAFRGLHALAFRGLHALTFRGLHVLTFRGLHVLAFRGLHVLAFRGLHPLAFRGIHVRTFRGLHALAFSGLDALAFRGLHALPFRGLHVLTFKGLHILAFRGLHILVFRGLHALAIRGLHALAIRGLHTLTIRGPHVLAFIRLHALTFRGLHVLAFRGLH

SEQ ID NO: 135230 - protein, 151 aa, Glycine max
  Coding DNA Sequence Number=SeqID_18452
MASRKRKAIASVSEADNVLARNILPERNVKLYINEFDDFRRELIRRYWHKPLTNLTEGNIDVAIVKEFYANLYVPKDKSPKQVRVRGHLIKFDVDSLNTFLETPVVVEQGESLPSYSRFARLRPDPQELVARLCIPERDLYLMPRVCRGSS

SEQ ID NO: 135231 - protein, 89 aa, Glycine max
  Coding DNA Sequence Number=SeqID_18453
MTDPFSEDRDGNSYPGSRFMVVCGLGSKACRTAGHDICQGVGLASGSGIKGMSHIISMTHATMMIRKFYAKLVMHAPTWTLKHQVFMVM

SEQ ID NO: 135232 - protein, 99 aa, Glycine max
  Coding DNA Sequence Number=SeqID_18454
MAMQNMQFQQETRASIQSLTNQMEQLATQLNQQQSQNSDRLPSQSIQNPKNCQGPQPVASSSSTNEPAQPHSTPEKDDDKNLKKAAYPSSIPSKSNFQK

SEQ ID NO: 135233 - protein, 184 aa, Glycine max
  Coding DNA Sequence Number=SeqID_18455
  Gene Ontology: Mol. function=protein dimerization activity
  Homolog annotation: Hit_ID=Q1S735; Match level="QueryCoverage=70%, HitCoverage=26%, E-value=2e-32, Identity=51%"; Hit description =Probable transposase [imported]-Arabidopsis thaliana-related
  Pfam annotation: Domain name=zf-C2HC_plant; Domain location=1-49; Score=35.3; E_value=2.2e-07; Accession=PF07567.3; Description =Protein of unknown function, DUF1544
MTKEGQKTGMVCIYYDQIVRGGGINRFNGHLAGEKGQVEICKKVPAKVCYKMKQNLDGNKSQRRKNEERDNSYPPSEIRVKTSASIGTYFPPRTTLGAQPTLKSVMKNKQVIQKCDLAIAKWFLDAFVPFNAANSTYFQHMVDALCSMIQDTRLQDMQQVTAPPMYIHNIEQMKHGHHQCTNNG

SEQ ID NO: 135234 - protein, 74 aa, Glycine max
  Coding DNA Sequence Number=SeqID_18456
MVAVGGGGLDDEGMSSALSLFLEAIYPAKPITCRNDVRLALPKPRLVVLHSKSFTNSTKLWELSEMGHSAQSLP

SEQ ID NO: 135235 - protein, 105 aa, Glycine max
  Coding DNA Sequence Number=SeqID_18457
  Gene Ontology: Mol. function=fructose-2,6-bisphosphate 2-phosphatase activity; Cellular component=6-phosphofructo-2-kinase/fructose-2,6 -biphosphatase 1 complex; Biological process=fructose 2,6 -bisphosphate metabolic process
  Homolog annotation: Hit_ID=O81398; Match level="QueryCoverage=49%, HitCoverage=10%, E-value=9e-22, Identity=92%"; Hit description =Fructose-6-phosphate 2-kinase/fructose-2,6-bisphosphatase
MYKQIWTSTLQRTILTATPIIGFPKIQWRALDEINAGVCDGMAYAEIKKNMPEEYEYVCRLVYRNGNPYGIAEGIVFSMPCRSKVITKSKELVMVSFQVYWMLIY

SEQ ID NO: 135236 - protein, 79 aa, Glycine max
  Coding DNA Sequence Number=SeqID_18458
MAWVLLIVVLGYLVHVLDNVIDTVYICYAIDRDRGEVCKQDIHEVYVQLPISRSLRQSVTTRTLEAQVYTVNQRDLLEN

SEQ ID NO: 135237 - protein, 55 aa, Glycine max
  Coding DNA Sequence Number=SeqID_18459
  Subcellular localization annotation: CTP_CleavageSite=20; ConfidenceScore=5.06e-01
MAAFRRHLPTMLGSWICTKPAMENQKQRRPTKCTINVKFLVFMTTCSRDFCMLSL

SEQ ID NO: 135238 - protein, 63 aa, Glycine max
  Coding DNA Sequence Number=SeqID_18460
MSKGSSFTTSDIGLGNQISQTLGGKVQRLLPEKGIYFNCDEKFRQGHKCASKVFLLIVEEDDD

SEQ ID NO: 135239 - protein, 174 aa, Glycine max
  Coding DNA Sequence Number=SeqID_18461
MKRSNGEALLVRGRMVFKELHDPKDLAQRIETIKMRYFKLRVVRVGRGRSCLWYRKQRSWGLWMGFDVGNFLEKLIELVGHGCLSGGKGQLVGGIKRARIQGLGNLPSTKRNDLPVKPPIRACVVILLHSHLLIIAPPDLDLKIGCLGTKYVVPQMRRMPWMVGGGIPNFKERV

SEQ ID NO: 135240 - protein, 63 aa, Glycine max
  Coding DNA Sequence Number=SeqID_18462
MECLPKRKTCRCRHQRLFEENVRKTKKGSVNFENKGSRVVYAWGRVLPLLLCILRCDEEFRPT

SEQ ID NO: 135241 - protein, 63 aa, Glycine max
  Coding DNA Sequence Number=SeqID_18463
MEDARGEALAAQQHWFRSLLVIDYMSNKPSGNRLQDVVIDYMLPVLVESITLSGNRLPEHKLG

SEQ ID NO: 135242 - protein, 130 aa, Glycine max
  Coding DNA Sequence Number=SeqID_18464
  Gene Ontology: Mol. function=transition metal ion binding; Biological process=DNA integration
MDRTWIKVPRISEVYQNGVKEFLQFAEQNAPVLAAKYFCPCVKCVNGRHQLLNGIRSHLICEGFSPSYTNWIWHGELPHVSTIPQPEAVDVQTRDRMQDMIRDLGQKVFRDAHAHYYEKLQTDSKKPLYV

SEQ ID NO: 135243 - protein, 153 aa, Glycine max
  Coding DNA Sequence Number=SeqID_18465
DRAHKTPSGSEEVQQGPGVSSFGYGPLSILQGARSPNEESHPQRHSVDPEKSNRALGFPALGSRPQDTQWTRRSPTGSWGCQALITNLYQFYGVPVAPSKGIRPPTNRAFIKKYCVSRQAQGETPQQPGDGQQQATDAPPSPLEFTSANPQKG

SEQ ID NO: 135244 - protein, 223 aa, Glycine max
  Coding DNA Sequence Number=SeqID_18466
MALELSTDVTLFEVQYCLIYFAFVSTSELPIKFKTIPSFLTDPIQTLIVMTYPNVNCHQSNSKMNLQMAERIFIAAFTSLRSQLFILVLEQPSTSKKRRRDMEDRQNASFNREFEFKEEDNLVHGIIVMTHSFLNLYAVILLMIRILVLVPVFPLLDLLTFIHKSATVYWAKTESQMKMQETVAGEINFDDDSAKKVIMAAVEYAKTYPRCEENQKFFALFSI

SEQ ID NO: 135245 - protein, 137 aa, Glycine max
  Coding DNA Sequence Number=SeqID_18467
  Subcellular localization annotation: CTP_CleavageSite=41; ConfidenceScore=5.22e-01
MGLDVNVTWLLVSLWQNINSSSDQPTTFPFHFTRFCINFSSLAREVDRDSEGRWREAGVVTRITLPWLVLSRGSHATPTPSPSLASIVTRILAASCDFYAAMLLGETRGRAMAMKEVAVLQRDRGGIAELVRRRYGR

SEQ ID NO: 135246 - protein, 1856 aa, Glycine max
  Coding DNA Sequence Number=SeqID_18468
  Gene Ontology: Mol. function=ubiquitin-protein ligase activity; Cellular component=intracellular; Biological process=protein modification process
  Homolog annotation: Hit_ID=Q1T683; Match level="QueryCoverage=95%, HitCoverage=96%, E-value=0.0, Identity=74%"; Hit description=HECT
  Pfam annotation: Domain name=Arm; Domain location=218-258; Score =10.2; E_value=0.65; Accession=PF00514.13; Description=Armadillobeta -catenin-like repeat
  Pfam annotation: Domain name=Arm; Domain location=260-301; Score=5.2; E_value=2.7; Accession=PF00514.13; Description=Armadillobeta-catenin -like repeat
  Pfam annotation: Domain name=Arm; Domain location=302-340; Score=0.9; E_value=9.5; Accession=PF00514.13; Description=Armadillobeta-catenin -like repeat
  Pfam annotation: Domain name=Arm; Domain location=343-381; Score =20.1; E_value=0.0078; Accession=PF00514.13; Description =Armadillobeta-catenin-like repeat
  Pfam annotation: Domain name=HEAT; Domain location=223-260; Score =19.6; E_value=0.012; Accession=PF02985.12; Description=HEAT repeat
  Pfam annotation: Domain name=HEAT; Domain location=348-383; Score =17.1; E_value=0.063; Accession=PF02985.12; Description=HEAT repeat
  Pfam annotation: Domain name=HEAT; Domain location=550-586; Score =6.0; E_value=8; Accession=PF02985.12; Description=HEAT repeat
  Pfam annotation: Domain name=HECT; Domain location=1509-1856; Score =293.8; E_value=3.3e-85; Accession=PF00632.15; Description=HECT -domain (ubiquitin-transferase)
  Pfam module annotation: Pfam domain module=Arm::Arm::Arm::Arm::HEAT::H EAT::HEAT::HECT; Domain location=218-258::260-301::302-340::343 -381::223-260::348-383::550-586::1509-1856
  Subcellular localization annotation: CTP_CleavageSite=59; ConfidenceScore=5.61e-01
ELIDCGLAGFCMETRSRKRAEASSAAPSSPSSGPTTRSSKRARLSSSSSASAAVNTRSRASNTKEPLPPKNPPPPLPPMDSANESSGSRRDRRNNKENSSDKGKEKEHDVRIRDRDAALNMDGSGGDEDDDNDNDSEGGVGILHQNLTSASSALQGLLRKLGAGLDDLLPSSAMGSASSSHQSGRLKKILFGLRADGEEGRQVEALTQLCEMLSIGTEESLSTFSVDSFVPVLVGLLNHESNPDIMLLAARALTHLCDVLPSSCAAVVHYGAVSIFCARLLTIEYMDLAEQSLQALKKISLEHPTACLRAGALMAVLSYLDFFSTGVQRVALSTAANMCKKLPSDAADFVMEAVPLLTNLLQYHDSKVLEHASVCLTRIAEAFASSPDKLDELCNHGLVTQATSLISNSSSGGGQASLSTPTYTGLIRLLSTCASGSPLGAKTLLLLGISGILKDILSGSGVSSNASVSPALSRPPEQIFEIVNLANELLPPLPHGTISLPIISNMFLKGPIVKKSPSGSSGKQEDTNGNVPEISAREKLLNDQPELLKQFAMDLLPVLIQIYGSSVNGPVRHKCLSVIGKLMYFSTAEMIQSLLSVTNISSFLAGVLAWKDPHVLLPALKIAEILMEKLPGTFSKMFIREGVVHAVDQLILASNSTNISTQASPAEKDNDSISGASSRSRRYRRRSGNSNPDGNPLDDLKTPVSVNVGSPPSSVDMPTLNSSIRLSVSTAAKAFKDKYFPSDPGAAEVGITDDLLHLKNLCMKLNAGDDEQRTNGKGESKTSGFGPEEYLIGIIANMLKELGKGDGVSTFEFIGSGVVAALLNYFSCGYFSKDRPLEAHLPKLRQQALTRFKLFIAVALPSTIEVGTVAPMTVLVQKLQNALSSLERFPVVLSHSSRSSSGSARLSSGLSALSQPFKLRLCRAQGEKSLRDYSSNVVLVDPLASLAAIEEFVWPRIQRSESGQKSTVATGNSESGTTPAGAGVSSPTTRRHSTRSRSSVNIGDTSRKEITQDKSTSSSKGKGKVVLKPAQEEARGPQTRNATRRRAALDKDAQMKPVNADSTSEDEDLDISPVEIDEALVIEDDDISDDEDDDHEDVLRDDSLPVCSPDKVHDVKLGDLAEESNVAPATSDGQANAASGSSSKAGTVRGSDSTDFRSGYNSSSRGAMSFAAAAMAGLGSANSRGIRGGRDRLGRPLFGSSNDPPKLIFTAGGKQLNRHLTIYQAIQRQLVLDDDERFAGSSDYVSSDGSRLWGDIYTITYHRAENQTDRTPPGGSTSNASKSCKSGSVSNSSSEAKLHQTSVLDSILQGELPCELEKSNPTYNILALLRVLEGLNQLASRLRAQVVTDSFAEGKILDLDELSVTSGARVPTEEFISSKLTPKLARQIQDALALCSGSLPSWCYQLSKACPFLFPFETRRQYFYSTAFGLSRALYRLQQQQGADGHGSTNEREVRVGRLQRQKVRVSRNRILDSAAKVMELYSSQKAVLEVEYFGEVGTGLGPTLEFYTLLSHDLQKIILEMWRSGSSEKYQMKIDGDEKKMKRSEGSFVGDGELVQAPLGLFPRPWSANADASEGTQFFKVIEYFRLLGRVMAKALQDGRLLDLPMSVAFYKLVLGQELDLHDILFIDAELGKTLQELNALVCRKHYIQSTGGSYTDTFANLHFRGAPIEDLCLDFTLPGYPEYILKPGDEIVDINNLEEYISMVVEATVKTGIMRQMEAFRAGFNQTETLADHIKFDHGYTAKSPAIVNLLGIMGEFTPEQQRAFCQFVTGAPRLPPGGLAVLNPKLTIVRKLSSSAANASSNGNGPSELADDDLPSVMTCANYLKLPPYSTKEIMYKKLLYAISEGQGSFDLS

SEQ ID NO: 135247 - protein, 73 aa, Glycine max
  Coding DNA Sequence Number=SeqID_18469
MDSKANTHIGFNYAPPNTLELEKDCGRDTKEQHKNPYCCKGTNQMGIKLIHIDQIAKHIVKAKFESETETKES

SEQ ID NO: 135248 - protein, 842 aa, Glycine max
  Coding DNA Sequence Number=SeqID_18470
  Gene Ontology: Mol. function=beta-galactosidase activity; Cellular component=beta-galactosidase complex; Biological process =carbohydrate metabolic process
  Homolog annotation: Hit_ID=Q1T694; Match level="QueryCoverage=94%, HitCoverage=96%, E-value=0.0, Identity=74%"; Hit description=D -galactoside/L-rhamnose binding SUEL lectin; Galactose-binding like
  Pfam annotation: Domain name=Gal_Lectin; Domain location=762-841; Score=111.7; E_value=2.1e-30; Accession=PF02140.8; Description =Galactose binding lectin domain
  Pfam annotation: Domain name=Glyco_hydro_2_N; Domain location=442 -582; Score=-57.2; E_value=0.047; Accession=PF02837.8; Description =Glycosyl hydrolases family 2, sugar binding domain
  Pfam annotation: Domain name=Glyco_hydro_35; Domain location=51-358; Score=560.6; E_value=1.5e-165; Accession=PF01301.10; Description =Glycosyl hydrolases family 35
  Pfam annotation: Domain name=Glyco_hydro_42; Domain location=72-375; Score=-256.5; E_value=0.063; Accession=PF02449.6; Description=Beta -galactosidase
  Pfam module annotation: Pfam domain module=Gal_Lectin::Glyco_hydro_2 _N::Glyco_hydro_35::Glyco_hydro_42; Domain location=762-841::442 -582::51-358::72-375
MSILKVLLITITFSLVIAATSAHEDEKKMTTSNSHEDEGGEKKTVTYDGRSLIINGRRELLFSGSIHYPRSTPEEWAGILDKARQGGINVVQTYVFWNIHETEKGKYSIEPQYDYIKFIKLIQKKGMYVTLRVGPFIQAEWNHGGLPYWLREVPEIIFRSNNEPFKKHMKKYVSTVIKTVKDANLFAPQGGPIILAQIENEYNHIQRAFREEGDNYVQWAAKMAVSLDIGVPWIMCKQTDAPDPVINACNGRHCGDTFSGPNKPYKPAIWTENWTAQYRVFGDPPSQRSAEDIAFSVARFFSKNGSLVNYYMYHGGTNFGRTSSAFTTTRYYDEAPLDEYGMQREPKWSHLRDVHRALSLCKRALFNGASTVTKMSQHHEVIVFEKPGSNLCAAFITNNHTKVPTTISFRGTDYYMPPRSISILPDCKTVVFNTQCIASQHSSRNFKRSMAANDHKWEVYSETIPTTKQIPTHEKNPIELYSLLKDTSDYAWYTTSVELRPEDLPKKNDIPTILRIMSLGHSLLAFVNGEFIGSNHGSHEEKGFEFQKPVTLKVGVNQIAILASTVGLPDSGAYMEHRFAGPKSIFILGLNSGKMDLTSNGWGHEVGIKGEKLGIFTEEGSKKVQWKEAKGPGPAVSWYKTNFATPEGTDPVAIRMTGMGKGMVWINGKSIGRHWMSYLSPLGQPTQSEYHIPRTYFNPKDNLLVVFEEEIANPEKVEILTVNRDTICSFVTENHPPNVKSWAIKSEKFQAVVNDLVPSASLKCPHQRTIKAVEFASFGDPAGACGAFALGKCNAPAIKQIVEKQCLGKASCLVPIDKDAFTKGQDACPNVTKALAIQVRCE

SEQ ID NO: 135249 - protein, 67 aa, Glycine max
  Coding DNA Sequence Number=SeqID_18471
MGIADQKINFDLFHEDKHLLSQSVCSERVTFRAKRINPYSLAERASLSEPCALSPKTSLEFHLLELG

SEQ ID NO: 135250 - protein, 125 aa, Glycine max
  Coding DNA Sequence Number=SeqID_18472
MASRKRKATASQPQEPYDTTRFISEVSWERYSQNVHPRNILPERNIILYITEYDEFRWELKRRCWHKALNRKSDGHIDVALVKEFYANLYDPEDKSPKTRIDPQELASKLCIPGSGFVLNVEGAP

SEQ ID NO: 135251 - protein, 121 aa, Glycine max
  Coding DNA Sequence Number=SeqID_18473
MALVTGPFLGRIASALAEALWLRKLHLPPKEKVGLLARPPKLHKPWWRLYNIDPIRSEFRVEVPAGAGTDDGGREVGGAEVEAGVEEGVDVDASNGPLALALRVPGNTIVGSSRFQQFFFT

SEQ ID NO: 135252 - protein, 404 aa, Glycine max
  Coding DNA Sequence Number=SeqID_18474
MASKKRKNIGSRPTAQYETRRFSSLDAWTRYTDNVLGRHILSERKIEIYHTELDEFKVELERCNFHKRLTNLVDNNIDLALVKEFYANLYSSEQVKVRGHLVRIDADSLNTFLETPVVLAKGETLPVYSRYYRLPTDIREIEAALCIPGRGVLSYFNLAPTFHTSDLTVDRARLIFGLVSQMDMNVGALISSHITSMAQSNSSRLGFPALITTLCKSRGVSSDNLVFERLSPIINLAYIRKNCWNPDDLTVTIRGARRTRTRPAEAPSTSIAPPPACTLAAPSAPASANFQHLEAMLQSIHQGQIILLQSLQMVAPPDSIPSVEQFNEWVAWPRIQSSLHREDEGPTAQVPQQMEDESSKTTTPEPLVRRKKADETQEAAATFEKSLEATSEPSEPVADTTSHQ

SEQ ID NO: 135253 - protein, 239 aa, Glycine max
  Coding DNA Sequence Number=SeqID_18475
  Gene Ontology: Mol. function=catalytic activity; Biological process =metabolic process
  Homolog annotation: Hit_ID=Q9SNJ6; Match level="QueryCoverage=99%, HitCoverage=37%, E-value=1e-71, Identity=59%"; Hit description=EST AU070346(S12172) corresponds to a region of the predicted gene
MDNLQKCQANYTALTPLTFLMRAAACYANRTSVIHEGTRFTWAQTYERCRRLAFSLRALNIARNDVVSVLAPNIPAMYEMHFAVPMAGAVLNTINTRLDAKNIATILRHSEAKVFFVDYEYVSKAKEALRLLMDDNNNNNLKKGVPKPTNQPHSTTFSLPLVIVIDDINTPTRIRLGELEYEQMVHHGNPNYFPEGIQDEWTPIALNYTSGTTSEPKGVVYSHRGAYLSTLSLILGWEM

SEQ ID NO: 135254 - protein, 377 aa, Glycine max
  Coding DNA Sequence Number=SeqID_18476
  Gene Ontology: Mol. function=catalytic activity; Cellular component =nucleus; Biological process=metabolic process
  Homolog annotation: Hit_ID=Q84P19; Match level="QueryCoverage=89%, HitCoverage=56%, E-value=1e-120, Identity=62%"; Hit description=Acyl- activating enzyme 11
  Pfam annotation: Domain name=AMP-binding; Domain location=1-259; Score=5.9; E_value=7.5e-08; Accession=PF00501.18; Description=AMP -binding enzyme
MGSEPVYLWTLPMFHCNGWTFTWGVAARGGTNVCLRTTAARDIYRNIVVHNVTHMCCAPIVFNIILEAKQSERIDIKVINGKRKSPVEILTGGAPPPASLLEQIESLGFHVTHAYGLTEATGPALVCEWKKEWNMLPKKEQAQLKARQGVSVLTMADVDVKNLETMESVARDGRTMGEIVLKGSGIMMGYFKDHKASSKAFGKNGDWFKTGDVGVIHPDGYLEIKDRSKDVIISGGENISSVEVESLLYKHPRVLEAAVVAMPHPRWGETPCAFVSLRKNNNNSSSSKIDDVTEAEIIAYCRKNLPHFMVPKVVKFMEELPKTSTGKIQKFELRVMAKVFVQTKNNTTTVNKKSCQVSQNSIVGGYNNEQVLAASRL

SEQ ID NO: 135255 - protein, 76 aa, Glycine max
  Coding DNA Sequence Number=SeqID_18477
  Gene Ontology: Mol. function=nucleotide binding; Cellular component =membrane; Biological process=small GTPase mediated signal transduction
  Homolog annotation: Hit_ID=Q9SBU1; Match level="QueryCoverage=57%, HitCoverage=22%, E-value=6e-16, Identity=93%"; Hit description=GTP binding protein
DSFTRAKKWVQELQKQGNPNMVMALAGNKADLEDKRKVTAELSRIIIIISNNIMLLNAQIIEKRMMEGVKDSGPKH

SEQ ID NO: 135256 - protein, 226 aa, Glycine max
  Coding DNA Sequence Number=SeqID_18478
  Gene Ontology: Mol. function=nucleotide binding; Cellular component =intracellular; Biological process=small GTPase mediated signal transduction
  Homolog annotation: Hit_ID=Q6KCN0; Match level="QueryCoverage=99%, HitCoverage=100%, E-value=4e-91, Identity=76%"; Hit description =Small GTPase Rac4
  Pfam annotation: Domain name=Miro; Domain location=8-150; Score=49.7; E_value=9.6e-12; Accession=PF08477.3; Description=Miro-like protein
  Pfam annotation: Domain name=Ras; Domain location=8-208; Score=219.5; E_value=7.6e-63; Accession=PF00071.12; Description=Ras family
  Pfam module annotation: Pfam domain module=Miro::Ras; Domain location= 8-150::8-208
  Subcellular localization annotation: CTP_CleavageSite=73; ConfidenceScore=5.48e-01
MSASRFIKCVTVGDGAVGKTCMLISYTSNTFPTVSATTNKPSHFSVLFCFYLTGPNRVADAKDYVPTVFDNFSANVVVDGSTVNLGLWDTAGQEDYNRLRPLSYRGADVFLLAFSLISRASYENVAKKWIPELRHYAPGVPIILVGTKLDLRDDKQFFQDHPGAVPITTAQGEELRKLIGAPIYIECSSKTQQNVKAVFDAAIKVVLQPPKQKKKKRKGQKACSIL

SEQ ID NO: 135257 - protein, 103 aa, Glycine max
  Coding DNA Sequence Number=SeqID_18479
  Gene Ontology: Cellular component=membrane
  Homolog annotation: Hit_ID=Q5VQN0; Match level="QueryCoverage=97%, HitCoverage=17%, E-value=3e-24, Identity=67%"; Hit description =Exostosin family protein-like
MQIAVFISSIDAVKPGWLLKYLKGIRPAHIKAMQQNLVKYSRHFLYSSPAQPLGPEDLVWKMESWLLFSGCYGATDGWQGGEHQASHQKITTCSGRIKKSVYL

SEQ ID NO: 135258 - protein, 657 aa, Glycine max
  Coding DNA Sequence Number=SeqID_18480
  Gene Ontology: Mol. function=protein serine/threonine kinase activity; Cellular component=membrane; Biological process=protein amino acid phosphorylation
  Homolog annotation: Hit_ID=Q10PA1; Match level="QueryCoverage=99%, HitCoverage=98%, E-value=1e-125, Identity=40%"; Hit description =Protein kinase family protein, putative, expressed
  Pfam annotation: Domain name=APH; Domain location=311-483; Score= -7.0; E_value=0.018; Accession=PF01636.13; Description=Phosphotransfer ase enzyme family
  Pfam annotation: Domain name=Pkinase; Domain location=309-580; Score =82.9; E_value=1e-21; Accession=PF00069.15; Description=Protein kinase domain
  Pfam annotation: Domain name=Pkinase_Tyr; Domain location=309-580; Score=25.5; E_value=4.9e-14; Accession=PF07714.7; Description =Protein tyrosine kinase
  Pfam module annotation: Pfam domain module=APH::Pkinase::Pkinase_Tyr; Domain location=311-483::309-580::309-580
MTVEKRIVLVGIRIDGYSRQLLNWALVKVAEPGDCVIAVHVVKNSDYVSKNKTLIDGYLEVYDGLCGVKKVGLTGQIFTGSSIKNILVREAKKHAALALVVGGRAATAKYCAKRLPPTTNVLAIQDSRILFRSCTNKQLPGGLILDPRPSLTIIEENLSDRIIQSAICDSIMEIEESTPIKNSLELKDEEKSKSTRSISVEQKLGWPLLRRANSGMSQTLLHTRDMSVVQWVMTLPDRSPHNKSSSSSSTEENPFERRSISDIEYESSTNSSPASVDIIPNGLEEILNLNSLDCKRFSLEVLKSCTSQFSSENLVGKGGSNRVYKGVLPDGKAIAVKVMQSSKEAWKDFALEVEIISSVEHKSIAPLLGICIENNSLISVYDYFPKGSLEENLHGKNKDESILSWEVRFNVALRIAEALDYLHREALKPVVIHKDVKSSNILLSQGFEPQLSDFGLAVWGPTTSSFLTQDVVGTFGYLAPEYFMYGKVSDKIDVYAFGVVLLELISGREPISSAAFKGQESLVVWAKPIMESGNVKGLLDPNLEGKFVEAQLQRMVLAASLCITRAARLRPKLNQILKILKGDERVECFLNSQGDGDQEDSENQENIDDEVYPNSSAELHLSLALLGVDDDSTSHSSTDHSYSEHLKEQWSRSSSFN

SEQ ID NO: 135259 - protein, 399 aa, Glycine max
  Coding DNA Sequence Number=SeqID_18481
  Gene Ontology: Mol. function=transferase activity; Cellular component= membrane
  Homolog annotation: Hit_ID=Q5VQN0; Match level="QueryCoverage=88%, HitCoverage=66%, E-value=1e-151, Identity=73%"; Hit description =Exostosin family protein-like
  Pfam annotation: Domain name=Exostosin; Domain location=102-397; Score=144.8; E_value=2.3e-40; Accession=PF03016.6; Description =Exostosin family
MTIFLFLLAFSLLLFLFSLSPLRTPSPTQHFHVSDAETSFLASLDHFLLAHAQTSLKDDDTAPRDEPQNDDMTKKLDDAVFHSEMDRLLSDPYYPVSLPLRVYVYDMPPKFTHDLLWLFKNTYRDTSNLTSNGSPVHRLIEQHSIDYWLWADLIAPQSERLLTSVVRVHRQEEADLFYIPFFTTISFFLMEKQQCKALYREALKWITDQPAWKRSGGRDHILPVHHPWSFKSVRRYVKNAIWLLPDMDSTGNWYKPGQVYLEKDLILPYVPNVDLCDAKCLSETNPKRSTLLFFRGRLKRNAGGKIRSKLGAELSGVDGVVIEEGTAGDGGKEAAQRGMRKSLFCLSPAGDTPSSARLFDAIVSGCIPVIISDELELPFEGILDYRKCGQVAIGLSVGL

SEQ ID NO: 135260 - protein, 172 aa, Glycine max
  Coding DNA Sequence Number=SeqID_18482
  Gene Ontology: Mol. function=kinase activity; Cellular component =intracellular; Biological process=intracellular protein transport
  Homolog annotation: Hit_ID=Q6YUH7; Match level="QueryCoverage=55%, HitCoverage=24%, E-value=9e-26, Identity=59%"; Hit description =Putative target of myb1
MSENLMGKVNALGERLKIATSEALHEPEWAGILHICDFINADQLNTAELAWGESTIELRYLPVYAETYKSLKSRGIGFPSRDNESLAPVFTPRSATASADADVSLAHLMQHDDIHVQSFTSEQIKETFDVARNSIELLSVFFNAAGCVKESSIPDVHRIVETGIMKQCFSRP

SEQ ID NO: 135261 - protein, 337 aa, Glycine max
  Coding DNA Sequence Number=SeqID_18483
  Gene Ontology: Mol. function=DNA binding; Cellular component=nucleus; Biological process=regulation of transcription
  Homolog annotation: Hit_ID=Q84PP2; Match level="QueryCoverage=96%, HitCoverage=98%, E-value=1e-144, Identity=79%"; Hit description =Transcription factor MYB101
  Pfam annotation: Domain name=Myb_DNA-binding; Domain location=17-64; Score=57.3; E_value=5.2e-14; Accession=PF00249.21; Description=Myb -like DNA-binding domain
  Pfam annotation: Domain name=Myb_DNA-binding; Domain location=70-115; Score=53.0; E_value=9.8e-13; Accession=PF00249.21; Description=Myb -like DNA-binding domain
  Pfam module annotation: Pfam domain module=Myb_DNA-binding::Myb_DNA -binding; Domain location=17-64::70-115
MGRTPFACSSDENGLKKGPWTPEEDRILVDYIQKHGHGSWRALPKLAGLNRCGKSCRLRWSNYLRPDIKRGKFSEEEQQLIINLHSVLGNKWSAIAGHLPGRTDNEIKNFWNTHLKKKLLQMGLDPVTHRPRSDHLNLLSNLQQLLAATNIVSNILTNTWDSTHNALRLQSDAKLQLLQNILQVPTSNLDLLNPFGPSDGFLNEVLGLNQSNKLQNLYNNGSSTDGFPSQNQPNIQSFEAPHQQQTLPNGGSINRSSMKSEKLDAPYSSSTAFVNSLPNLVSASPEYCSTHVMQMENKVNPNEFSDPSSTSTNNFEMWGDFMYEEVSDAYWKDLKIE

SEQ ID NO: 135262 - protein, 129 aa, Glycine max
  Coding DNA Sequence Number=SeqID_18484
EIADGVNKSAQALQAAEAGIRQIGSVAQQQTVSMIQERASLPVISLQPAVAGAARKTSRAVGRATKSLLNIISGRQDATAEYDDDVTYMYYELGPDDPPYAAKFYDCCGAEDPEASGCTTNFHVSYDED

SEQ ID NO: 135263 - protein, 111 aa, Glycine max
  Coding DNA Sequence Number=SeqID_18485
MHRMCGESEFVPQSTTGCGESEWVLFLVFHNAPKLEKLIIPPRINCGLRSYTGSMTMFISKEESLWKIIYVAFENGEWDVQNISNSLASHIFCRIMATIPPRLTHGDDTIA

SEQ ID NO: 135264 - protein, 80 aa, Glycine max
  Coding DNA Sequence Number=SeqID_18486
MVWSDSLGEGAEEQYATNGNADDLELEEMKRKWGCLSVKVEECWYNGEEEARVLARREFMLILNHTTHPSVHFSSRPRMT

SEQ ID NO: 135265 - protein, 336 aa, Glycine max
  Coding DNA Sequence Number=SeqID_18487
  Gene Ontology: Biological process=electron transport
  Homolog annotation: Hit_ID=Q8S9W7; Match level="QueryCoverage=93%, HitCoverage=53%, E-value=1e-116, Identity=62%"; Hit description=FAD binding domain containing protein-like
MYEFADLTWYPSRHTVVYRYDSRVPLNASGDAVYDFIGFQANSILVSESVRAAEKLLESTRNANGKCLTASTTLGLKKLVGNGLKNNGQIFTGYPVVGYQGKMQTSGSCLYSSRFDTACAWDPRIKGLFFYESTAIFPASKFGDFAGDVRKLRDLKPENFCGVDNYNGLLIRFIKASSAYLGQPEDSVVVDFNYYRGNDPSNPRLNQDVWEEVEQLAFFKHGAKPHWAKNRNIAFLGVNQKYPKFNMFIAAKKQMDPLNVFSSEWSDEILYGQELSEKVDGCALEGLCICSEHRHCSPQKGYYCSHGLVYKEARIVVPINRSENKCHFVNVDLHVN

SEQ ID NO: 135266 - protein, 226 aa, Glycine max
  Coding DNA Sequence Number=SeqID_18488
  Gene Ontology: Mol. function=oxidoreductase activity; Cellular component=nucleus; Biological process=electron transport
  Homolog annotation: Hit_ID=Q8LE44; Match level="QueryCoverage=81%, HitCoverage=37%, E-value=2e-71, Identity=69%"; Hit description =Putative amine oxidase
MTNAFDWFKHILKWSDSYVGGAIASRIEGQHRGALPSVIVIGAGISGLAAARSLYDASFKVTVLESRDRLGGRIHTDFSFGCPVDMGASWLHGVCNENPLAPLIRGLGLSLYRTSGDNSVLYDHDLESYMLFNIDGKQVPQQMVIEVGDTFKKILEETGKVRDEHTEDISVSQAISIVLDKHPDLRQQGLAHEVLQWFICRMEAWFAADADMISLKTWDQASANLS

SEQ ID NO: 135267 - protein, 118 aa, Glycine max
  Coding DNA Sequence Number=SeqID_18489
  Gene Ontology: Mol. function=nucleotide binding; Cellular component =membrane; Biological process=small GTPase mediated signal transduction
  Homolog annotation: Hit_ID=Q9SBU1; Match level="QueryCoverage=98%, HitCoverage=47%, E-value=2e-42, Identity=79%"; Hit description=GTP binding protein
  Pfam annotation: Domain name=Miro; Domain location=12-118; Score= -1.8; E_value=0.0081; Accession=PF08477.3; Description=Miro-like protein
  Pfam annotation: Domain name=Ras; Domain location=12-117; Score=8.4; E_value=6.7e-10; Accession=PF00071.12; Description=Ras family
  Pfam module annotation: Pfam domain module=Miro::Ras; Domain location= 12-118::12-117
MATIGHNNLNAKLVLLGDMGAGKSSLVLRFVKGQFLEFQTIIENVRNSGWSQPDLIMEAMMESTIGAAFFSQTLAVNDATVKFEIWDTAGQERYHSLAPMYYRGAAAAIIVYDITSSV

SEQ ID NO: 135268 - protein, 80 aa, Glycine max
  Coding DNA Sequence Number=SeqID_18490
MNMWKRLGLEAKGCCVGCIVKGQYGGFGWNRDGRGLFKDVGVVKSGKRPCKGFGDSCVVGQSIVVERVCLSRKGCESYEN

SEQ ID NO: 135269 - protein, 246 aa, Glycine max
  Coding DNA Sequence Number=SeqID_18491
  Homolog annotation: Hit_ID=O65161; Match level="QueryCoverage=15%, HitCoverage=18%, E-value=7e-10, Identity=67%"; Hit description =Ascorbate peroxidase
  Subcellular localization annotation: CTP_CleavageSite=57; ConfidenceScore=5.14e-01
MLLSLSLSLTFFLCTSWKLSLSQSSKVLHHHHLQSPSFTQREILCLNKFWAFGGNVVAMDNDSCGVGFMAELSNESSCKTVIDVLEMLVRMDPSDIGIRLLEPLKAEFPILSYADFYPVTGGPEVPFHPGREVNLEYFVRVVFNINDDGEFCPKKFQFFRTNTFTEKVASSRCGVFKARLQLLSGCRAIKRRDIYGAWEQYLGLEHDDSAPKKSYAVNQEINCCFVEWMCKLRCNINKRLCSSIVS

SEQ ID NO: 135270 - protein, 207 aa, Glycine max
  Coding DNA Sequence Number=SeqID_18492
  Subcellular localization annotation: CTP_CleavageSite=51; ConfidenceScore=5.40e-01
MAEPSKKRKGVATSSAVIGTRSHETSKSQTSQIPPSISSPTLFSSEEQRIRYNSLFSSRSIIDPKFVDLAFFDDEVFDCFQAFQNSCLIQFISMKLPFYPELVEAFYSNLEIQEDSLIFEVYGIKMVIDQSLFFELTQLSSDGVPFEGTLDDEWNFDFSVSDARRMLCTNQTDMTGRLLVGSLAFECRIMHYLIMRILLPRSSNLAQ

SEQ ID NO: 135271 - protein, 51 aa, Glycine max
  Coding DNA Sequence Number=SeqID_18493
  Homolog annotation: Hit_ID=Q1RU67; Match level="QueryCoverage=92%, HitCoverage=28%, E-value=9e-07, Identity=58%"; Hit description=C2
MRTSNDNTLIRDGIISLDEGKIKQEISDMLQNIERAELEVEVELECVPFTQ

SEQ ID NO: 135272 - protein, 67 aa, Glycine max
  Coding DNA Sequence Number=SeqID_18494
MLLWFNLLIRSNNWFFLHQVISGSTVVNTLVKGCKQRYEHTLHDIVQFPCLELNEMSLQCWDKLQIV

SEQ ID NO: 135273 - protein, 91 aa, Glycine max
  Coding DNA Sequence Number=SeqID_18495
MAKKNDHSLSLRAIGHDHLQMEKRCGMTIICLHMSSGSPPLDGKKVCGMTIICLRMSSGSPTLDDKRRKMTIICLCVASETIVFGWRKGAE

SEQ ID NO: 135274 - protein, 235 aa, Glycine max
  Coding DNA Sequence Number=SeqID_18496
  Gene Ontology: Biological process=electron transport
  Homolog annotation: Hit_ID=Q8S9W7; Match level="QueryCoverage=88%, HitCoverage=35%, E-value=2e-46, Identity=46%"; Hit description=FAD binding domain containing protein-like
  Pfam annotation: Domain name=FAD_binding_4; Domain location=58-207; Score=46.4; E_value=9.4e-11; Accession=PF01565.13; Description=FAD binding domain
MGGWLYWYLGILIHTLQFSCSVRTVHGLIPQSPIQCSSSGCTLRNSYGAWGDRKDCSALNVTYPTTEEQLRSAVSYAVRNNLKVKVVTRFSHTIPKLSCPHENNNNNINSSTATLLISTEKYDSRIEIDAARMTATVDAGVGLRQLINAVEEAGFSLVAAPYWEGVTVAGLISTGAHGSSWWGKGGSVHDHVVGVSVVVPASKSEGYAKILRLEGQDPMLNAAKVSLGVLGAISK

SEQ ID NO: 135275 - protein, 390 aa, Glycine max
  Coding DNA Sequence Number=SeqID_18497
  Gene Ontology: Mol. function=ribokinase activity; Biological process =D-ribose metabolic process
  Homolog annotation: Hit_ID=Q8L993; Match level="QueryCoverage=98%, HitCoverage=70%, E-value=1e-134, Identity=65%"; Hit description =Carbohydrate kinase-like protein
  Pfam annotation: Domain name=PfkB; Domain location=19-364; Score =22.0; E_value=2.4e-07; Accession=PF00294.14; Description=pfkB family carbohydrate kinase
MVDDNFLKNLGLEKGTRKVVNHEERGRVLQAMDGCSYKAAAGGSLSNTLVALARLASRSQKVPAINVAMTGSVGSDLLGGFYREKLRRANVQFLSAPMKDGTTGTVIVLTTPDAQRTMLAYQVQYTTNVIFQQDILGILKFLLPLLANSMSSINSVDANISVLRFQGTSSTVNYDASLASAVSKTNILVVEGYLFELPDTIKAITKACEKARTNGALVAITASDVSCIERHFDDFWCQITHMEIIGNCVDLVFANGDEARALCNFEAKESAASAARYLSHFVPLASVTDGPTGSYIGVKGEAVYIPPSPCVPVDTCGAGDAYASGILYGLLRGISDLRSIGSLAAKVAATVVGQQGTRLRISDAVKLAESFEFQLDSSSSVGTDHNISSV

SEQ ID NO: 135276 - protein, 195 aa, Glycine max
  Coding DNA Sequence Number=SeqID_18498
  Gene Ontology: Mol. function=amino acid transporter activity; Cellular component=integral to membrane; Biological process=auxin mediated signaling pathway
  Homolog annotation: Hit_ID=Q8L883; Match level="QueryCoverage=77%, HitCoverage=31%, E-value=3e-66, Identity=78%"; Hit description=Auxin transporter-like protein 5
MGDNARDVEASKVQGLILTGNPFITFGFACTPLYFVWEKAIGMHECKSLCKRALVRLPVVIPIWFLAIIFPFFGPINSTVGSLLVSFTVYIIPALAHIFTFRSPSSRQNAVEQPPKFVGRWVGTFIINTFVVVWVLVVGFGFGGWASMVNFIRQIDTFGLFTKCYQCPPPLLPPMPPHQLNATAPSPLHHPHHAH

SEQ ID NO: 135277 - protein, 126 aa, Glycine max
  Coding DNA Sequence Number=SeqID_18499
MGELNAPKIDNTNIKTSTSTNETRNIFSGESLGGSRKRISKKLAVEAVLLGESPMAKPARYDPSGSIVSPPVTELEPEPVTVLYTTPLSAPVYTTAPSDPVPVTVPDPGDVVVEVMGLVVVSREDF

SEQ ID NO: 135278 - protein, 126 aa, Glycine max
  Coding DNA Sequence Number=SeqID_18500
DSEWYDIPGIDELYAQVISQDLSASVVWLLATVTSLCPKFASGHPNVAAIFGIVTCVIGNMFNEGGNRESTFIIPWAVVLGSGACECQLIPEVSAFWQWSFKIPYCVETTLSNNAPYKGYDTRVVL

SEQ ID NO: 135279 - protein, 124 aa, Glycine max
  Coding DNA Sequence Number=SeqID_18501
  Gene Ontology: Mol. function=protein binding; Cellular component =anchored to membrane; Biological process=response to biotic stimulus
  Homolog annotation: Hit_ID=Q8LBL4; Match level="QueryCoverage=53%, HitCoverage=19%, E-value=3e-31, Identity=88%"; Hit description =Putative thaumatin-like protein
MESNAFSHNCCAATATLLDLGHKLDAFFISFRKKSSGARYGSISIHLSHCSPTPREARVRLFGALSTAAAARMAHPPRVGPPFTRRCSRLLALGRIATHTMTLRVRLRVPASIIPLPSVLPLQG

SEQ ID NO: 135280 - protein, 209 aa, Glycine max
  Coding DNA Sequence Number=SeqID_18502
  Gene Ontology: Mol. function=peptidyl-prolyl cis-trans isomerase activity; Cellular component=membrane; Biological process=protein folding
  Homolog annotation: Hit_ID=O49605; Match level="QueryCoverage=84%, HitCoverage=79%, E-value=1e-85, Identity=84%"; Hit description =Peptidyl-prolyl cis-trans isomerase
  Pfam annotation: Domain name=Pro_isomerase; Domain location=33-200; Score=326.9; E_value=3.6e-95; Accession=PF00160.11; Description =Cyclophilin type peptidyl-prolyl cis-
MWDLNKSLSLAVAAIVVEIIEEKPEEEPEITHRVFLDIDIDKQRLGRIVIGLYGQVVPKTVENFRALCTGEKGKSENGIKLHYKGTPFHRIISGFVIQGGDIVHHDGKGSESIFGGTFPDENFKIKHSHAGVVSMANSGPDSNGSQFFLTTVKARWLDGEHVVFGKVVQGMDIVYVIEGGAGTYSGKPRKKVVIADSGEIPKIHWDEET

SEQ ID NO: 135281 - protein, 199 aa, Glycine max
  Coding DNA Sequence Number=SeqID_18503
  Homolog annotation: Hit_ID=Q9FM71; Match level="QueryCoverage=24%, HitCoverage=6%, E-value=3e-15, Identity=75%"; Hit description =Arabidopsis thaliana genomic DNA, chromosome 5, P1 clone:MDF20
MTCLVFLRHDNEICIHGYPSKLIPILLGNRVDRVRVRDYGISDFFNWGRERGQGCHYLSHTRPDYERTGRGREYPILDGYEDGGIGQQTQGGVVGIVGNGGLVRQGQGGVGDGGNDVGNNVRVVSNVNIGGVRGASGGGYGATTASYGGTILFVGDLHWWTTDAKLETKLNKYGSVKEVNFFNEKVSGKSMGYCHVKFF

SEQ ID NO: 135282 - protein, 149 aa, Glycine max
  Coding DNA Sequence Number=SeqID_18504
  Homolog annotation: Hit_ID=Q9SDZ0; Match level="QueryCoverage=29%, HitCoverage=14%, E-value=2e-16, Identity=100%"; Hit description =Isoflavone reductase homolog 2
  Subcellular localization annotation: CTP_CleavageSite=70; ConfidenceScore=5.66e-01
MLCRLATLLSQSRTFCSLLAATSVFCVAVPSSLSPTTYSIAVFAHCSDSALAFHITSLLSSARVHNCLVSFFARASLFLIAFHILCQRDLYDHQSLVSAIKQVDVVISTVGHLQLADQDKIISAIKEAGNVKLWSGNSILLLNNRDGKD

SEQ ID NO: 135283 - protein, 388 aa, Glycine max
  Coding DNA Sequence Number=SeqID_18505
  Gene Ontology: Mol. function=N-acetyltransferase activity; Biological process=metabolic process
  Homolog annotation: Hit_ID=UPI00001628AD; Match level="QueryCoverage =99%, HitCoverage=58%, E-value=5e-37, Identity=46%"; Hit description =DNA binding / N-acetyltransferase/ RNA binding / protein binding / zinc ion binding
  Pfam annotation: Domain name=PHD; Domain location=360-388; Score =10.7; E_value=0.0048; Accession=PF00628.19; Description=PHD-finger
MSPLVEFERGDRKFGLCVDVDYEKAWWEGVIFDDHCDGMEKRSVFFPDLGDEMQVGIHRLRITKDWHEVTGEWEQQGNLVFLDLVEERKRKSFVAVSAKQIWYDVRIKNGIEKIREWTCNMKYLWRNLVMEVINDYLSLTVNEVILVLNLPWSLLNEAPEPESVEAMASVDLSVTFPDKEIVVQKEPVPPVKEVLPKLQKEIGPGNIYLLSTEQIGHYGWKNYKNILKFQNPDIFPPTISSSLVEDEVEDVPKFCPEAVEQYYRSGDLVCRSAGNRKRKSLGNSKANIPKCQSNGLAPRVKGRHRKVCTFADGKITRDGIKCNCCMGIYSFVGLENHASGSSTCRPSAGIFLEDVENDYICSVCHYGGELILCDKCSSSFHKTCLGLE

SEQ ID NO: 135284 - protein, 128 aa, Glycine max
  Coding DNA Sequence Number=SeqID_18506
MKTKSDFEFQTWAKRAVPLSEANRFEKPNVSLAHLALQFAKREGQKLLKTLSASSFLPNSCILAFFLSTSSMHLQHTTIQMASRKRKTRASTDDIPSPSTPAPPTASAGPDAQSSQITTTMLQSLFQG

SEQ ID NO: 135285 - protein, 594 aa, Glycine max
  Coding DNA Sequence Number=SeqID_18507
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=97%, HitCoverage=97%, E-value=1e-173, Identity=51%"; Hit description =Protein kinase
  Pfam annotation: Domain name=DUF26; Domain location=197-251; Score =65.1; E_value=2.2e-16; Accession=PF01657.8; Description=Domain of unknown function DUF26
  Pfam annotation: Domain name=DUF26; Domain location=80-134; Score =78.7; E_value=1.8e-20; Accession=PF01657.8; Description=Domain of unknown function DUF26
  Pfam annotation: Domain name=Pkinase; Domain location=326-547; Score =73.7; E_value=5.7e-19; Accession=PF00069.15; Description=Protein kinase domain
  Pfam annotation: Domain name=Pkinase_Tyr; Domain location=326-547; Score=14.7; E_value=2.3e-13; Accession=PF07714.7; Description =Protein tyrosine kinase
  Pfam module annotation: Pfam domain module=DUF26::DUF26::Pkinase::Pkin ase_Tyr; Domain location=197-251::80-134::326-547::326-547
  Subcellular localization annotation: CTP_CleavageSite=54; ConfidenceScore=5.15e-01
MFLLNNHVDVTFLLFLWLFGIGSSSASIYNANYCPNNTSYNSNLTFETNLKVLLASMVSNVSLSDGYYFTAMGMGTTSVANGLLLCRGDVSTATCHDCISTAATEITRRCPNKTESIIWYDECMLRFTNRYFAPTSVVPRANLMDGNNISASDLDSFNRTLFGLLNDLIEEAANSRLARKFATGQREFAGHSPENTVYALTECEPDLTTTQCEECLRNAVSTLPSCCGGKQGARALLSYCNARHELFRFYHTSDTSGNKKSVSRVVLIVVPVVVSIILLLCVCYFILKRSRKKYNTLLRENFGEESATLESLQFGLVTIEAATNKFSYEKRIGEGGFGVVYKGVLPDGREIAVKKLSKSSGQDSHRSKQLNWSERYKIIEGIAQGISYLHEHSRLKVIHRDLKPSNVLLDSNMNPKISDFGMARIVAIDQLQGKTNRIVGTYGYMSPEYAMHGQFSEKSDVFSFGVIVLEIISAKRNTRSVFSDHDDLLSYTWEQWMDEAPLNIFDQSIKAEFCDHSEVVKCIQIGLLCVQEKPDDRPKITQVISYLNSSITELPLPKKPIRQSGIVQKIAVGESSSGSTPSINEMSVSIFIPR

SEQ ID NO: 135286 - protein, 119 aa, Glycine max
  Coding DNA Sequence Number=SeqID_18508
MSHSFSPNYQHTISPSQSISINTQALYNIYIKTQSYMQCGTMLVKNFVGRLGVHDKTNHTLASQENQSGSECFAKMLQPYEINIGLKEHSNRVTLKAYTLKSSSGPLPPDSEVQPKKIF

SEQ ID NO: 135287 - protein, 100 aa, Glycine max
  Coding DNA Sequence Number=SeqID_18509
  Subcellular localization annotation: CTP_CleavageSite=77; ConfidenceScore=5.67e-01
LVGSDELYQFLALLTSMSQLKGSSNVFNSVPSNKTAVVNTASCNTAVDNAASCKSVSCTTVPCNFVSCASPVVNTASCMAVSFSTWHSRLGHPSVNAMKV

SEQ ID NO: 135288 - protein, 68 aa, Glycine max
  Coding DNA Sequence Number=SeqID_18510
MCLIVNQYSWKVMREEVLKRAAVRGGRGRGTVAVEDHVVDVDDDVFDLQDKGVEAALALWRVKEREEE

SEQ ID NO: 135289 - protein, 136 aa, Glycine max
  Coding DNA Sequence Number=SeqID_18511
MAKSNSSDIDINGSPNDEVSFLSKKLNKMLKKKDKYKNFSRKKDKYEKDENSFHQYIYILGRQRIKGFLLVLRQRLLTIHDERKVYVLDLKAHEGIIPFGGSSKEQIIAMAGKIGNTTRNIAIYDRDSRTVVWELA

SEQ ID NO: 135290 - protein, 125 aa, Glycine max
  Coding DNA Sequence Number=SeqID_18512
  Gene Ontology: Mol. function=transcription factor activity; Cellular component=nucleus; Biological process=regulation of transcription, DNA-dependent
  Homolog annotation: Hit_ID=Q1S689; Match level="QueryCoverage=76%, HitCoverage=16%, E-value=6e-17, Identity=69%"; Hit description =Pathogenesis-related transcriptional factor and ERF
  Pfam annotation: Domain name=AP2; Domain location=52-92; Score=9.5; E_ value=4.8e-05; Accession=PF00847.10; Description=AP2 domain
MERILLITNNQTPRPHLIPPKPEPLKLHPKSPLTLLDRELQSTVVVFDLIEGIGGRGGGYDKEEKAARAYDLAALKYRGTTTTTNFRQGLNAHEPEKEEGGGNELTTSSTPSSGGLRGQGIFHEL

SEQ ID NO: 135291 - protein, 64 aa, Glycine max
  Coding DNA Sequence Number=SeqID_18513
MYAFKDPNRSSQLQLMQSIGASKEYQEPVQRSILIKKQLCLVMTSMEVILFKEVDTRYIICAFT

SEQ ID NO: 135292 - protein, 311 aa, Glycine max
  Coding DNA Sequence Number=SeqID_18514
  Gene Ontology: Mol. function=transcription regulator activity; Cellular component=nucleus; Biological process=regulation of transcription
  Homolog annotation: Hit_ID=Q1SJ77; Match level="QueryCoverage=81%, HitCoverage=64%, E-value=6e-82, Identity=69%"; Hit description=Helix- loop-helix DNA-binding
  Pfam annotation: Domain name=HLH; Domain location=213-277; Score=5.7; E_value=0.036; Accession=PF00010.16; Description=Helix-loop-helix DNA- binding domain
MDQAPGGLRGSVHDGATLESIQFNEEIQGIMAPVPAPENANSFTALLELPPTQAVELLHSPESDSARKPPNCHVSANQKPYLPNSFGSNLTFPSNAALIERAAKFSVFAGENSPLPPEEACLVPAGTGSVSNLDRVKNEPQETDSNPCSSSRLGCISDPAVENNNQRTAKRKEREKKLTVKGSSKKSKSIADETSGDGEKLPYVHVRVRRGQATDSHSLAERARREKINARMKLLQELVPGCDKEGLEGTPLVYPSPYFSPDPKKSLEAHRLSFKMQYCVPSNQIELSLHTLNPDKKDGLFTDKQALNIAN

SEQ ID NO: 135293 - protein, 123 aa, Glycine max
  Coding DNA Sequence Number=SeqID_18515
MTNLLGFLLERRCVKMKKKKECTKLGVREKMQAVQLFLANSSLIPIKHRPQIPLVGLNSTRTALKKTYKQLGLRTTKSLELSGTWTFLSLEISKHAKASRIAQTPLQNLITGLNRWLCLCLHA

SEQ ID NO: 135294 - protein, 630 aa, Glycine max
  Coding DNA Sequence Number=SeqID_18516
  Gene Ontology: Mol. function=protein kinase activity; Cellular component=integral to membrane; Biological process=protein amino acid phosphorylation
  Homolog annotation: Hit_ID=Q9M2R4; Match level="QueryCoverage=99%, HitCoverage=96%, E-value=1e-177, Identity=53%"; Hit description =Receptor-like protein kinase
  Pfam annotation: Domain name=LRRNT_2; Domain location=4-45; Score =58.3; E_value=2.5e-14; Accession=PF08263.3; Description=Leucine rich repeat N-terminal domain
  Pfam annotation: Domain name=LRR_1; Domain location=120-142; Score =17.5; E_value=0.05; Accession=PF00560.23; Description=Leucine Rich Repeat
  Pfam annotation: Domain name=LRR_1; Domain location=145-167; Score =5.1; E_value=31; Accession=PF00560.23; Description=Leucine Rich Repeat
  Pfam annotation: Domain name=LRR_1; Domain location=169-190; Score =8.5; E_value=7.4; Accession=PF00560.23; Description=Leucine Rich Repeat
  Pfam annotation: Domain name=LRR_1; Domain location=48-70; Score=2.5; E_value=99; Accession=PF00560.23; Description=Leucine Rich Repeat
  Pfam annotation: Domain name=LRR_1; Domain location=72-94; Score =10.1; E_value=3.7; Accession=PF00560.23; Description=Leucine Rich Repeat
  Pfam annotation: Domain name=LRR_1; Domain location=96-118; Score =18.8; E_value=0.019; Accession=PF00560.23; Description=Leucine Rich Repeat
  Pfam annotation: Domain name=Pkinase; Domain location=325-627; Score =33.3; E_value=1.5e-10; Accession=PF00069.15; Description=Protein kinase domain
  Pfam annotation: Domain name=Pkinase_Tyr; Domain location=314-624; Score=29.4; E_value=2.8e-14; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::Pkinase::Pkinase_Tyr; Domain location=4 -45::120-142::145-167::169-190::48-70::72-94::96-118::325-627::314-624
MTSLNSDGLSLLALKAAVDADPTGVLTSWSETDVTPCHWPGISCTGDKVTQLSLPRKNLTGYIPSELGFLTSLKRLSLPYNNFSNAIPPSLFNARSLIVLDLSHNSLSGSLPNQLRSLKFLRHLDLSDNSLNGSLPETLSDLTSLAGTLNLSFNHFSGGIPATLGNLPVAVSLDLRNNNLTGKIPQMGTLLNQGPTAFSGNPGLCGFPLQSACPEAQKPGIFANPEDGFPQNPNALHPDGNYERVKQHGGGSVAVLVISGLSVAVGAVSLSLWVFRRRWGGEEGKLVGPKLEDNVDAGEGQEGKFVVVDEGFELELEDLLRASAYVVGKSRSGIVYKVVGVGKGLSSAAANVVAVRRLSEGDATWRFKEFESEVEAIARVRHPNVVPLRAYYFARDEKLIITDFIRNGSLHTALHGNGGPSNSLPPLSWAVRLKIAQEAARGLMYIHEFSGRKYIHGNIKSTKILLDDELHPYVSGFGLTRLGLGPTKSATMAPKRNSLNQSSITTAMSSKVAASLNHYLAPEVRNTGGKFTQKCDVYSFGIVLLELLTGRMPDFGAENDHKVLESFVRKAFKEEKPLSDIIDPALIPEVYAKKQVIVAFHIALNCTELDPELRPRMKTVSENLDHIKIQ

SEQ ID NO: 135295 - protein, 455 aa, Glycine max
  Coding DNA Sequence Number=SeqID_18517
  Gene Ontology: Mol. function=protein serine/threonine kinase activity; Cellular component=membrane; Biological process=protein amino acid phosphorylation
  Homolog annotation: Hit_ID=Q1T3J0; Match level="QueryCoverage=97%, HitCoverage=94%, E-value=1e-46, Identity=38%"; Hit description =Protein kinase
  Pfam annotation: Domain name=DUF26; Domain location=168-223; Score =54.1; E_value=4.7e-13; Accession=PF01657.8; Description=Domain of unknown function DUF26
  Pfam annotation: Domain name=DUF26; Domain location=56-110; Score =71.3; E_value=3.2e-18; Accession=PF01657.8; Description=Domain of unknown function DUF26
  Pfam annotation: Domain name=Pkinase_Tyr; Domain location=271-406; Score=-155.2; E_value=0.006; Accession=PF07714.7; Description =Protein tyrosine kinase
  Pfam module annotation: Pfam domain module=DUF26::DUF26::Pkinase_Tyr; Domain location=168-223::56-110::271-406
  Subcellular localization annotation: CTP_CleavageSite=50; ConfidenceScore=5.59e-01
AIDQGTKAYYNCTRNSTFAAYSSYRSNVKTLLDFLSSNSTNNARFYNTTVSSKDTVYGSFLCRIDTTPKHCQECVTQAAKLISSLCKNATEAIVWYQVCYVRYSDRRFFSTVEESPKLSFMNDKDYVGNVGLFNNIVWDMMNDLRSEAASAANKSADKSVNIIDNEKVYGYAWCLPYLSKENCSWCLSDAIAEIPTGCCRGKSGGTIIYPSCGVRYESYQFHKAQIRGGSVTPPPLPSSPSPFASPVGNDSTTLETLRFELAKIEAATNRFAKENMIGKGGFGEVYRGILLDGQEIAVKRLTGSSRQGAVEFKNEVQSDVFSFGVMVLEIINGKRKGCSSESDGIDDIRRHAWTKWTEQTPLELLDPNIGGPYSGEEVIKCIHIGLLCVQEDPNDRPTMATVVFYLNSPSINLPPPREPGYFKRDRIQDNKTTHKELDNISDSINGISLTNFFPR

SEQ ID NO: 135296 - protein, 458 aa, Glycine max
  Coding DNA Sequence Number=SeqID_18518
  Gene Ontology: Mol. function=protein serine/threonine kinase activity; Cellular component=membrane; Biological process=protein amino acid phosphorylation
  Homolog annotation: Hit_ID=Q1T3J0; Match level="QueryCoverage=93%, HitCoverage=71%, E-value=5e-58, Identity=34%"; Hit description =Protein kinase
  Pfam annotation: Domain name=DUF26; Domain location=199-252; Score =54.0; E_value=5e-13; Accession=PF01657.8; Description=Domain of unknown function DUF26
  Pfam annotation: Domain name=DUF26; Domain location=80-134; Score =78.5; E_value=2.1e-20; Accession=PF01657.8; Description=Domain of unknown function DUF26
  Pfam annotation: Domain name=Pkinase; Domain location=343-455; Score=- 82.6; E_value=0.0012; Accession=PF00069.15; Description=Protein kinase domain
  Pfam annotation: Domain name=Pkinase_Tyr; Domain location=343-458; Score=-131.0; E_value=0.0002; Accession=PF07714.7; Description =Protein tyrosine kinase
  Pfam module annotation: Pfam domain module=DUF26::DUF26::Pkinase::Pkin ase_Tyr; Domain location=199-252::80-134::343-455::343-458
  Subcellular localization annotation: CTP_CleavageSite=87; ConfidenceScore=5.03e-01
MSLLVLIIFIHFFFSFFSFAIIEAIDLHYLNHSCSSNKTFTPISFYNSNLQTLLTSLSSHATTAQFFNSTTGGGDTGETIYGSFMCRGDVTNHTCQECVKTATQQITLRCPNSKDALIWYHECLVRYSNSCFFSTMEEWPRFDLLDYYNVTKNSTKEGSYGWLLAKTLSDAVGEAANAGPEGTMKFATKNATLSGSQSLYTLVQCTPDLSSKDCSKCLGDIMRDIPLCCLGKCAMVLYPSCTLMFGLSRFYRDVVALGVVGSNIGTQEPEPSGNKNSSSRPIVIVVILLILATLSFLQCYFLRRRARKRHYNILLRENFGRESVTLEGLQFELAIIKTATNNFSLENKIGKGGFGEVYKGILPCGRHIAVKRLSTSSQQGTQQNSISWSKRYKIIEMIARGVLYLHEYSRLKIIHRDLKPSNILLDEHMNPKISDFGMARIVEIDQDRGKTKRIVGTW

SEQ ID NO: 135297 - protein, 666 aa, Glycine max
  Coding DNA Sequence Number=SeqID_18519
  Gene Ontology: Mol. function=protein serine/threonine kinase activity; Cellular component=mitochondrion; Biological process =protein amino acid phosphorylation
  Homolog annotation: Hit_ID=Q9M0X5; Match level="QueryCoverage=98%, HitCoverage=98%, E-value=0.0, Identity=51%"; Hit description =Receptor protein kinase-like protein
  Pfam annotation: Domain name=DUF26; Domain location=196-250; Score =86.7; E_value=7.1e-23; Accession=PF01657.8; Description=Domain of unknown function DUF26
  Pfam annotation: Domain name=DUF26; Domain location=83-139; Score =69.5; E_value=1e-17; Accession=PF01657.8; Description=Domain of unknown function DUF26
  Pfam annotation: Domain name=Kdo; Domain location=324-507; Score= -82.2; E_value=0.038; Accession=PF06293.4; Description=Lipopolysacchar ide kinase (Kdo)
  Pfam annotation: Domain name=Pkinase; Domain location=341-612; Score =178.0; E_value=2.4e-50; Accession=PF00069.15; Description=Protein kinase domain
  Pfam annotation: Domain name=Pkinase_Tyr; Domain location=341-612; Score=129.6; E_value=8.7e-36; Accession=PF07714.7; Description =Protein tyrosine kinase
  Pfam module annotation: Pfam domain module=DUF26::DUF26::Kdo::Pkinase: :Pkinase_Tyr; Domain location=196-250::83-139::324-507::341-612::341 -612
  Subcellular localization annotation: CTP_CleavageSite=74; ConfidenceScore=5.65e-01
MAWNSSFKLIFLFVLVNFLSFATPKAQQVPTFLAQDCPSNGTTANSTFQINIRTLFSSLSSNATANNVFYNSTVAGANPSDTVYGLFMCRGDVPFQLCGQCVINATQKLSSDLQCSLSKQAVIWYDECMVRYSNRSFFSTVDTRPAIGLLNSANISNQANFMRLMFDTMNETADEAAIGAKKYATKQANISGFQTLYCLVQCTPDLSTQGCRSCLSDAIGLLPWCCEGKQGGRILNPSCNVRYDLYPFYRTNVSAPPASVPPTDSSNSGGGGSEISPGTIVAIVVPITVAVLLFIVGIWLLSKRAAKKRNSAQDPKTETEISAVESLRFDFSTIEAATDKFSDANKLGEGGFGEVYKGLLPSGQEVAVKRLSKNSGQGGTEFKNEVEVVAKLQHKNLVRLLGFCLEGEEKILVYEFVANKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLILEIISGKRNSSFYETDVAEDLLSYAWKLWKDEAPLELMDQSLRESYTRNEVIRCIHIGLLCVQEDPIDRPTMASVVLMLDSYSVTLQVPNQPAFYINSRTEPNMPKGLKIDQSTTNSTSKSVNDMSVSEVDPR

SEQ ID NO: 135298 - protein, 274 aa, Glycine max
  Coding DNA Sequence Number=SeqID_18520
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=83%, HitCoverage=33%, E-value=3e-39, Identity=38%"; Hit description =Receptor protein kinase-like protein
  Pfam annotation: Domain name=DUF26; Domain location=198-252; Score =74.5; E_value=3.4e-19; Accession=PF01657.8; Description=Domain of unknown function DUF26
  Pfam annotation: Domain name=DUF26; Domain location=79-133; Score =76.7; E_value=7.4e-20; Accession=PF01657.8; Description=Domain of unknown function DUF26
  Pfam module annotation: Pfam domain module=DUF26::DUF26; Domain location=198-252::79-133
  Subcellular localization annotation: CTP_CleavageSite=53; ConfidenceScore=5.38e-01
MLLLIHLFILGFFNFSTTTEATDLNSNYLNHSCSSNKTFTPNSAYQSNLQTLLASLSSHATTAQFYNTTAGGGDVGETIYGSFMCRGDVTNHTCQECFKTATQQITLRCPHSKEALIWYHECLVRYSNRCFFSTVEEWPRFSFMDYNVTSSTKEEGSYGFWLLSKTLSDAVGEAANAGPAGTMKFATKNATLSGAQEVYTLVQCTPDLSSQDCSKCLGDIMRDIPLCCLGRIGGMVLYPSCTLMFGLRHFYRDVVALIGSNGTQESEPSDSALV

SEQ ID NO: 135299 - protein, 94 aa, Glycine max
  Coding DNA Sequence Number=SeqID_18521
MEDKFMDDLMIDERAFHLQTSESDIPQLPVKAKPDPYHSKQRLPNENLRSLLSYLSSNATAIKQFYNTTVAGRNHSDTVYGMFFCWGDVPLSPL

SEQ ID NO: 135300 - protein, 779 aa, Glycine max
  Coding DNA Sequence Number=SeqID_18522
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=99%, HitCoverage=82%, E-value=8e-83, Identity=44%"; Hit description =Protein kinase
  Pfam annotation: Domain name=DUF26; Domain location=448-502; Score =78.5; E_value=2.1e-20; Accession=PF01657.8; Description=Domain of unknown function DUF26
  Pfam annotation: Domain name=DUF26; Domain location=562-616; Score =79.9; E_value=7.9e-21; Accession=PF01657.8; Description=Domain of unknown function DUF26
  Pfam annotation: Domain name=Pkinase; Domain location=131-315; Score=- 57.1; E_value=3.7e-05; Accession=PF00069.15; Description=Protein kinase domain
  Pfam annotation: Domain name=Pkinase_Tyr; Domain location=131-298; Score=-65.4; E_value=1.8e-08; Accession=PF07714.7; Description =Protein tyrosine kinase
  Pfam module annotation: Pfam domain module=DUF26::DUF26::Pkinase::Pkin ase_Tyr; Domain location=448-502::562-616::131-315::131-298
MAISTLGDGKQGAQSLLPGCNLRYELYPFYNVSAVSIQSELTPPPPPPSSGKISISIIVAIVVPIVVAIILFVVGVYFLRKRASKKYNTFAQDSSNLSFSVVAIVPVVDDLIDVESLQFDLAMVEAATEGFSDENKIGQGGFGVVYKGVFPNGQEIAVKRLSVTSLQGAVEFRNEAALVAKLQHRNLVRLLGFCLEVIDFPEQTDIDTSQAESLHCVFACGYMSPEYAMHGHFSVKSDVFSFGVLVLEIVSGKKNTDFYQSNHADDLLSHAWKNWTEKTPLEFLDPTLRDLGFVVNVLNTMHLQTGDIANVEVHLGDGVTGRHVGHGEIWVVEVRFGGEVVRSGGMDGVKAVKGGGCEGIRDNFGEMCISKSSSTHLLLLSLFNLLTSASQAAPTYSAHACSDEGSHYRPNTTFETNLNILLSSLVSNATLHHGFYRTNVSLGTSDEVKGLFLCRGDVTPSLCLDCVTAAAKNITNFCTNQTQSIIWYDECMLRYSNSSTLDNIVPSVGMKNEQSVSDSDYARFNDVLASTLNDLKQEALNSSSSGKKFATKEANFTSSMKLYTLAQCTPDLSTSDCNTCFSSSIGGFPNCCDGKRGARVLLPGCSVRYELASPSAAVKLCLGDLLVMGSNPETASLHMQGASKKYNTFVQDSSNLSFSVLAIVPVADDLTDVGDVESLQFDLATVEAATDRFSDENKIGQGGFGVVYKGVFPNGQEIAVKRLSVTSLQGAVEFRNEAALVAKLQHRNLVRLLGFCLEGQEKILIYEYIPNKSLDRFLF

SEQ ID NO: 135301 - protein, 122 aa, Glycine max
  Coding DNA Sequence Number=SeqID_18523
MHIVVRHGEASEIQKRLSQTGTTENIQKRMHRILQITKFVPIGRQSYSSKIALPAQIFSYEIVKRYPLLSGLTLKTDSRIHSLSLIRLYPLPSGLKTNRKQGPRCRISKKEKQIRETGRKTL

SEQ ID NO: 135302 - protein, 868 aa, Glycine max
  Coding DNA Sequence Number=SeqID_18524
  Gene Ontology: Mol. function=protein serine/threonine kinase activity; Cellular component=membrane; Biological process=protein amino acid phosphorylation
  Homolog annotation: Hit_ID=Q1T3J0; Match level="QueryCoverage=97%, HitCoverage=97%, E-value=1e-87, Identity=41%"; Hit description =Protein kinase
  Pfam annotation: Domain name=DUF26; Domain location=193-247; Score =85.7; E_value=1.5e-22; Accession=PF01657.8; Description=Domain of unknown function DUF26
  Pfam annotation: Domain name=DUF26; Domain location=396-450; Score =89.0; E_value=1.5e-23; Accession=PF01657.8; Description=Domain of unknown function DUF26
  Pfam annotation: Domain name=DUF26; Domain location=509-560; Score =84.0; E_value=4.6e-22; Accession=PF01657.8; Description=Domain of unknown function DUF26
  Pfam annotation: Domain name=DUF26; Domain location=81-135; Score =73.2; E_value=8.5e-19; Accession=PF01657.8; Description=Domain of unknown function DUF26
  Pfam annotation: Domain name=Pkinase; Domain location=647-814; Score=- 26.6; E_value=5.6e-07; Accession=PF00069.15; Description=Protein kinase domain
  Pfam annotation: Domain name=Pkinase_Tyr; Domain location=647-814; Score=-8.3; E_value=5.9e-12; Accession=PF07714.7; Description =Protein tyrosine kinase
  Pfam module annotation: Pfam domain module=DUF26::DUF26::DUF26::DUF26: :Pkinase::Pkinase_Tyr; Domain location=193-247::396-450::509-560::81 -135::647-814::647-814
  Subcellular localization annotation: CTP_CleavageSite=59; ConfidenceScore=5.13e-01
MPPCKYFAIPSILFFLLSFLIFPTKAAPIYSSHACTDSSKYQPNSTFQTNLDLLLSYLSSNATQGVHFYKTTVGSETPNAVKGLFLCRRDTLTAVCHDCVNAAAKDLTRRCPVEKEAIIWYDVCMVRYSNQNYLNNIVPAVDMSDSKSVAGADLDRFNEVLAGLLNALATKAANSEDEKFETGEVNLTSSVTLYGLVQCTPELSLFDCNMCFRSAIASVPNCCDGKQGARVLLPGCNIRYQVYPFYNSTKILATPVVKSRPSGRSRVEVILTFVIPIVAAMVLFTFGICHVMRKQAKSLKQLWRKTTLKRGTEMLNLKSSSSHLLLLFLFTLVTIASEAAAPIYSAHACTDDGPFYQPNTTYQTNLKLLLSSLVSNATLHQGFFLTNISLGNPDEVKGLFLCRGDVTPSVCHDCVAAAATNITDLCTNQTESVIWYDQCMLRYSNLSFLNNIVPGVNLNSEQNVSDSNNTGFINFLASTLNGLAQEAVNSLSGKKFATKEANFTSSMKVYTLAQCRPDLSTFDCNMCFTSAISNLGDGKRGARSLLPSCNVRYELYPFYNVSAVSSHPAPDLPPPPSSGKNSISIIVPIVVPIVVVIVLFIVGVCFLRKRASKKYNTFVQDSIVDDLTDVESLQFDLATIEAATNGFSDENKIGQGGFGVVYKGILPNRQEIAVKRLSVTSLQGAVEFRNEAALVAKLQHRNLVRLLGFCLEGREKILIYEYITNKSLDHFLFGVTVSLIKEQPRCRGGYMSPEYAMRGQFSVKSDVFSFGVLVLEIVSGKKNTDFYQPNQADDLLSYENPSDRPSMATIALMLNSYSVTLSMPRQPASFLRGRNPNRLNQGLDSDQSTTCSIPWSVNEVSITDIYPR

SEQ ID NO: 135303 - protein, 656 aa, Glycine max
  Coding DNA Sequence Number=SeqID_18525
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=88%, HitCoverage=87%, E-value=1e-161, Identity=51%"; Hit description =Protein kinase
  Pfam annotation: Domain name=DUF26; Domain location=196-251; Score =80.0; E_value=7.6e-21; Accession=PF01657.8; Description=Domain of unknown function DUF26
  Pfam annotation: Domain name=DUF26; Domain location=79-132; Score =69.5; E_value=1.1e-17; Accession=PF01657.8; Description=Domain of unknown function DUF26
  Pfam annotation: Domain name=Pkinase; Domain location=333-604; Score =186.2; E_value=7.9e-53; Accession=PF00069.15; Description=Protein kinase domain
  Pfam annotation: Domain name=Pkinase_Tyr; Domain location=333-604; Score=145.5; E_value=1.4e-40; Accession=PF07714.7; Description =Protein tyrosine kinase
  Pfam module annotation: Pfam domain module=DUF26::DUF26::Pkinase::Pkin ase_Tyr; Domain location=196-251::79-132::333-604::333-604
  Subcellular localization annotation: CTP_CleavageSite=69; ConfidenceScore=5.66e-01
MITKSKQSLTLFLLCTLLLTIAETSASVFNNVSCTSNKTFTPNSTFNTNLNTLLSYLSSNVTNNVRFFNATVGKDSNTVYGLYMCRGDVPFALCRECVGFATQTIPSSCPTSKEAVIWYNECLLRYSYRFIFSKMEEWPRHKINIPLGDPVVLHSNGFYTALGSIFDELPNKAALDLSESNGYAVKQENASGSVTLYGLAQCTPDLAAGDCKLCVADAVAEFVKSCCGGSIGASVLFPSCIVRYETYPFYQHSGTSAPTMIQRGRNIGTEVLVIVVVLLVVLAMLFGFGYCFIRIKARKKRKASDRENFGPELTVLESLEFDLATIEAATNKFSEDRRIGKGGYGEVYKGILPNGEEVAVKRLSTNSKQGGEEFKNEVLLIAKLQHKNLVRLIGFCQEDREKILIYEYVPNKSLDHFLFDSQKHRQLTWPERFKIVKGIARGILYLHEDSRLKIIHRDIKPSNVLLDNGINPKISDFGMARMVATDQIQGCTNRVVGTYGYMSPEYAMHGQFSEKSDVFSFGVMVLEIISGKKNSCSFESCRVDDLLSYAWNNWRDESPYQLLDSTLLESYVPNEVEKCMQIGLLCVQENPDDRPTMGTIVSYLSNPSFEMPFPLEPAFFMHGRMRRHSAEHESSSGYYTNHPSSSSVNKMSTTAF

SEQ ID NO: 135304 - protein, 490 aa, Glycine max
  Coding DNA Sequence Number=SeqID_18526
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=95%, HitCoverage=37%, E-value=6e-22, Identity=29%"; Hit description =Receptor protein kinase-like protein
  Pfam annotation: Domain name=DUF26; Domain location=199-251; Score =26.1; E_value=3.2e-06; Accession=PF01657.8; Description=Domain of unknown function DUF26
  Pfam annotation: Domain name=DUF26; Domain location=325-379; Score =66.7; E_value=7.5e-17; Accession=PF01657.8; Description=Domain of unknown function DUF26
  Pfam annotation: Domain name=DUF26; Domain location=81-141; Score =57.8; E_value=3.6e-14; Accession=PF01657.8; Description=Domain of unknown function DUF26
  Pfam module annotation: Pfam domain module=DUF26::DUF26::DUF26; Domain location=199-251::325-379::81-141
  Subcellular localization annotation: CTP_CleavageSite=100; ConfidenceScore=5.45e-01
MASLKLVYIFTLLSFINFVTTKAQHGRGYSFPDCSSSITTPNSPYQLNLRRLLSYLSSNATSSRQFYNTTVTSRNHSDSTVYGMFWCGGDVPTQLCSECVANATKSIFSDPDSYPNCSLSTDARIWYDYCMIRFSNSSFFSTVDSGLISAGCDPFDVSNQTNWVSVLSKTINEAADEAANSTVKYATKEARISGGFQSLYCEAQCTPDLSPQDCRKCLNVAITYSQQSCQGFLDYYSLSCTIMCNSYPFYRPGTAPAPKGLVPALTNSSNVTDHSQDPAAYLSHNCSINKITTDITFLSNLKTLLSFLSSNSTIKTSFKTTVSTIGGLFMCLGDLSLTLCQLCVQDAIQRISSECPSSKEAIIWYNHCLLRYNDTPSYSTLNTSSPSYRDFHTLNTTKPNQLQSFFTWTLANTLYKVQYETDDSTIKNYAKKEEKLNDHQTLYTLAQCTPDLRDKYYILAALSSLDCPHFTQMLPKMRLAGQLQVMFPPF

SEQ ID NO: 135305 - protein, 678 aa, Glycine max
  Coding DNA Sequence Number=SeqID_18527
  Gene Ontology: Mol. function=protein serine/threonine kinase activity; Cellular component=membrane; Biological process=protein amino acid phosphorylation
  Homolog annotation: Hit_ID=Q9LZU4; Match level="QueryCoverage=95%, HitCoverage=96%, E-value=1e-146, Identity=47%"; Hit description =Protein kinase-like
  Pfam annotation: Domain name=DUF26; Domain location=195-249; Score =93.0; E_value=9.3e-25; Accession=PF01657.8; Description=Domain of unknown function DUF26
  Pfam annotation: Domain name=DUF26; Domain location=82-138; Score =70.3; E_value=6.2e-18; Accession=PF01657.8; Description=Domain of unknown function DUF26
  Pfam annotation: Domain name=Pkinase; Domain location=356-624; Score =144.6; E_value=2.6e-40; Accession=PF00069.15; Description=Protein kinase domain
  Pfam annotation: Domain name=Pkinase_Tyr; Domain location=356-624; Score=118.7; E_value=1.6e-32; Accession=PF07714.7; Description =Protein tyrosine kinase
  Pfam module annotation: Pfam domain module=DUF26::DUF26::Pkinase::Pkin ase_Tyr; Domain location=195-249::82-138::356-624::356-624
  Subcellular localization annotation: CTP_CleavageSite=59; ConfidenceScore=5.60e-01
MAWNSSFKLLFLFVFVSFLCFATTKAQGPNFLYQDCPSNQTTANSTFQINIRTLFSSLSSNATTNNVFYNSTVTGTNPSDTVYGLFMCRGDVPFQLCGQCVINATQKLSSDLQCSLSKQAVIWYDECMVRYSNHSFFSTVDTRPAIGLLNSANISNQANFMRLMFDTMNETADEAAIGAKKYATKQANISGFQTLYCLVQCTPDLSTQGCRSCLSDAIGLLPRCCEGKQGGRILNPSCNVRYELYPFFRTNTIASSPAPTPTPSVSVPPTPTTSSNSGGSGGISSGTIVAIVVPIAVAVVIFVVGIWILCKRAAKKRNSEQDPKNMPFLFLAGTEISAVESLRFDFSTIEAATQKFSEANKLGEGGFGEGLLPSGQEVAVKRLSKISGQGGEEFKNEVEIVAKLQHRNLVRLLGFCLEGEEKILVYEFVVNKSLDYILFDPEKQKSLDWTRRYKIVEGIARGIQYLHEDSRLKIIHRDLKASNVLLDGDMNPKISDFGMARIFGVDQTQANTNRIVGTYGYMSPEYAMHGEYSAKSDVYSFGVLVLEILSGKKNSSFYETDVAEDLLSYAWKFWKDETPLELLEHSLRESYTPNEVIRSIHIGLLCVQEDPADRPTMASVVLMLSSYSVTLPVPNQPALFMHSRTESNMLKWVQIDQSITKSTTKSVNEMSLSGDIPR

SEQ ID NO: 135306 - protein, 42 aa, Glycine max
  Coding DNA Sequence Number=SeqID_18528
MKSKRASMSKRGRVQTKEQAEREGSNEGARSKQSRVQSNLES

SEQ ID NO: 135307 - protein, 137 aa, Glycine max
  Coding DNA Sequence Number=SeqID_18529
  Gene Ontology: Cellular component=nucleus; Biological process=cell division
  Homolog annotation: Hit_ID=Q9FIV2; Match level="QueryCoverage=91%, HitCoverage=31%, E-value=2e-51, Identity=65%"; Hit description =Similarity to pre-mRNA splicing factor
  Pfam annotation: Domain name=WD40; Domain location=54-94; Score=16.2; E_value=0.12; Accession=PF00400.22; Description=WD domain, G-beta repeat
  Pfam annotation: Domain name=WD40; Domain location=98-137; Score =31.8; E_value=2.4e-06; Accession=PF00400.22; Description=WD domain, G-beta repeat
  Pfam module annotation: Pfam domain module=WD40::WD40; Domain location=54-94::98-137
MQQSSMICTDNTEQVYVEAYTCPCVRRHPFDSTFVAQSNGNYVAIFTTNPPYRLNKCKRYEGHVVSGFPVKCNFSLDGKKLASGSSDGSIYLYDYQSSKVVKKIKAHDQACIDVAFHPVIPNVIASCSWDGSILVFE

SEQ ID NO: 135308 - protein, 67 aa, Glycine max
  Coding DNA Sequence Number=SeqID_18530
MPAIVLKDLDSSLAGSRKLFVEPKNLVVGCTGDTNSNLSCFHRVKLLILLINHTEVEAKAEAANSTN

SEQ ID NO: 135309 - protein, 257 aa, Glycine max
  Coding DNA Sequence Number=SeqID_18531
  Gene Ontology: Cellular component=nucleus; Biological process=mRNA processing
  Homolog annotation: Hit_ID=Q9FIV2; Match level="QueryCoverage=74%, HitCoverage=49%, E-value=4e-41, Identity=47%"; Hit description =Similarity to pre-mRNA splicing factor
  Pfam annotation: Domain name=WD40; Domain location=158-196; Score =25.3; E_value=0.00022; Accession=PF00400.22; Description=WD domain, G-beta repeat
  Pfam annotation: Domain name=WD40; Domain location=79-114; Score=7.6; E_value=4.7; Accession=PF00400.22; Description=WD domain, G-beta repeat
  Pfam module annotation: Pfam domain module=WD40::WD40; Domain location=158-196::79-114
MSQVSIERMTKMRHNLLNIICPLEVNIWLWHGYLLKTTTLTFFLFINLGSILDADIHHNILSLLKSKAKGHQSPNLISEKLSATLYGHTKAVNAIHWSSSHELAYSSPPCICWDGSCGLHMECMEQKSEESMCAKLPQCSSQRCEMVSARALPTFLWGLETQVFREDQIVGVIKFHPDNSNLFLSGGSKGQVKLWDARTGKIVHNYNRNLGPILDVEFTMNGKQFISSSDVSQSNASENAIIVWDVSREIPLSNQVR

SEQ ID NO: 135310 - protein, 160 aa, Glycine max
  Coding DNA Sequence Number=SeqID_18532
  Gene Ontology: Mol. function=nucleic acid binding; Biological process= RNA-dependent DNA replication
  Homolog annotation: Hit_ID=Q1S982; Match level="QueryCoverage=75%, HitCoverage=26%, E-value=1e-16, Identity=39%"; Hit description =ValRS/IleRS editing
VEQTLLDYLTQVGIANNILLPTLGAAANFELRHGFLQMIESNQFHGTDSEDPVAHLKRFLQLTGTINVQNMPTEYRDIGNLVQEQDSLGEAWERFQELLRSCPRQGFSPQRIVQIFYGGVSSHNRTSLDAACGGNLMLKQPRSLKICPLTPTTIMGIGGL

SEQ ID NO: 135311 - protein, 207 aa, Glycine max
  Coding DNA Sequence Number=SeqID_18533
MVILWNFVQWNSVVGNASREINGAPLVLINGQEGTIGSHAHITVGVHRVALAVPRGYLESDHRRQFQAEHHATVSPIALELRPALTTNGQRRPTKIAVHFRRVLGLLIKRARYVELVDVEPGPVGPEAEPEDEGDEAHNEKKAQEGGTDHLGDAGCEAFVDTVGIVPHRVVPVQFNGLRVRTLDVVNGYPNNVKLTFTTLKDWEQTS

SEQ ID NO: 135312 - protein, 401 aa, Glycine max
  Coding DNA Sequence Number=SeqID_18534
  Gene Ontology: Mol. function=transcription regulator activity; Cellular component=nucleus; Biological process=regulation of transcription
  Homolog annotation: Hit_ID=Q1SJ81; Match level="QueryCoverage=97%, HitCoverage=99%, E-value=2e-64, Identity=44%"; Hit description =Aldehyde dehydrogenase; Helix-loop-helix DNA-binding
  Pfam annotation: Domain name=HLH; Domain location=326-374; Score =41.2; E_value=3.7e-09; Accession=PF00010.16; Description=Helix-loop -helix DNA-binding domain
  Subcellular localization annotation: CTP_CleavageSite=38; ConfidenceScore=5.10e-01
MDSNSRYHVQQQHQQPNSGLLRFRSAPTANFKQQGEVAANTNGNAWEGSEPFLRFLNSGDTHDTTSSPTLREFVDNKVSNNSKPAKESSASSPLSRMNSQQGYSASMLPSRSTVTSAMMLGSMGIDQSAKSFDSNSLRQSSFPAGHFSNNISFQNGYDAMKGVGNYSGVNGNDGELSLSMNRMKNHISFSSISPSSSLGMLSPTSKMGTEGIRVTRPEDGRQGSCNGDARYYGPGFPYASWNEPSHPKRQRSSNDELLFDSQFQLVFFMQICWRTQNGEPGNQVQRLSHHLSLPRTSSEMFAMDNLLQFSDSVPCKIRAKRGFATHPRSIAERVRRTRISERIRKLQELVPTMDKQTSTAEMLDLALDYIKDLQKQFKTLSDKRAKCKCINMQKSEADRVA

SEQ ID NO: 135313 - protein, 359 aa, Glycine max
  Coding DNA Sequence Number=SeqID_18535
  Gene Ontology: Mol. function=oxidoreductase activity; Cellular component=proton-transporting two-sector ATPase complex; Biological process=response to gibberellin stimulus
  Homolog annotation: Hit_ID=Q2HSM4; Match level="QueryCoverage=92%, HitCoverage=98%, E-value=1e-126, Identity=67%"; Hit description=2OG -Fe(II) oxygenase
  Pfam annotation: Domain name=2OG-FeII_Oxy; Domain location=191-290; Score=146.9; E_value=5.5e-41; Accession=PF03171.10; Description=2OG -Fe(II) oxygenase superfamily
  Pfam annotation: Domain name=Phage_fiber_C; Domain location=195-247; Score=-1.1; E_value=0.08; Accession=PF06820.3; Description=Putative prophage tail fibre C-terminus
  Pfam module annotation: Pfam domain module=2OG-FeII_Oxy::Phage_fiber _C; Domain location=191-290::195-247
MEHSISNPPLHEAYKILLSKTNGENGFDDQFLVEECELPLIDVSRLAESGDEVRREECKSEIFKASQEWGFFQVVKHGISNGVFSGLKLEQEKIFKQPFEKKTKENKFFNFSAGSYRWGSLNATCIRQLSWSEAFHIPLTDMLGSGGSDTFSATIQQFATQVSILSKTLADILAEKMGHKSTFFEENCLPRSCYIRLNRYPPCPLASEVHGLMPHTDSAFLTILHQDQVRGLQMLKDGKWIAVKPNPDALIIIIGDLFQAWSNGVYKSVEHRVVTNPKLERFSVAYFFCPSDDTVIESCSTEPSLYRNFSFGEYRQQVREDVHNLGYKIGLPKFLLSTGDKIVCMNMYHEFNFPTSTGT

SEQ ID NO: 135314 - protein, 69 aa, Glycine max
  Coding DNA Sequence Number=SeqID_18536
MVETWSLASASVFYGGDRARCWIALDRCHTTSSVFLSCHAIQYLQCGEDDGSPNTESDRSQFVTDPHFM

SEQ ID NO: 135315 - protein, 149 aa, Glycine max
  Coding DNA Sequence Number=SeqID_18537
  Pfam annotation: Domain name=ubiquitin; Domain location=5-74; Score =29.5; E_value=1.2e-05; Accession=PF00240.13; Description=Ubiquitin family
MDLSLVMENDKTLCMEVGFFDSFQEIKEKIEKFTGIPTYRQTLLFNGQVLRNEAIIFNTDISEASRVHFLLDADFGNHHDEITDMHIPSGEELEELMRWNPDGSVTPMTVTENALPPRNPEFTPSPPPPLHETEITPGGSVSDERNPKE

SEQ ID NO: 135316 - protein, 189 aa, Glycine max
  Coding DNA Sequence Number=SeqID_18538
  Gene Ontology: Mol. function=monooxygenase activity; Cellular component=membrane; Biological process=electron transport
  Homolog annotation: Hit_ID=Q1SJ88; Match level="QueryCoverage=88%, HitCoverage=42%, E-value=3e-42, Identity=44%"; Hit description=E -class P450, group I
  Subcellular localization annotation: CTP_CleavageSite=49; ConfidenceScore=5.13e-01
MDAAVPYHTKHKQPSPPALFNGPYWRFIKKLCMTQLLSSSQVAHFVHVREQEINSLLKNVMVCSNEGRVMDLSFELTALTNNILCRMAMSTSCLDRVDDAAEVLGLVREFLGKFDYFGYGKKLVRIVDKFDKVLERILEEHEVKNTGHDGYSVSRYFPSGLQWAMAEIMNNPGVFEKVKPEINTVVGTN

SEQ ID NO: 135317 - protein, 215 aa, Glycine max
  Coding DNA Sequence Number=SeqID_18539
MPESRDRRITVVDLAAAIARRRASFIYIDSPPLRTPQRTAAIGRGRASGSPGSQNTPPSTARRGRGRVPSRNVLPAWYPRTPLRDITVVVQAIERRRARSGEAEGQRIGSTDPASDRLVTEPSEPASADSAVKSPKSVGVKLRTPFGSKVPKIFLDISELPEDDESETLTPQKKLLNNIDQVEEAVREELKKLKRTPSAKKAEREKRVRTLMSMR

SEQ ID NO: 135318 - protein, 236 aa, Glycine max
  Coding DNA Sequence Number=SeqID_18540
  Homolog annotation: Hit_ID=Q2L3S3; Match level="QueryCoverage=34%, HitCoverage=41%, E-value=5e-07, Identity=40%"; Hit description =Polyubiquitin-like protein
MDEVSELPPRLRWRRQALEKKKKGMSDLVAAPEKTQPTNEWSPPEWTTIVLEVKVPACKERIPIEMDVNDTVLKLKEKVLEQKEMYPVPVERVVLQTHKTHVELLDQQLLNDCPVFDFPSNEIDVYLKPPQRPPRPVVLKVTVLPLNSKEKIEMEVKAEDKVAVLREKLELVHRTVRFRLPTRGRYFFVHKLSLMDESISFRCHNVRNGDSIGTYWATDHNDVAKEDDDNDVDTIG

SEQ ID NO: 135319 - protein, 277 aa, Glycine max
  Coding DNA Sequence Number=SeqID_18541
  Pfam annotation: Domain name=ubiquitin; Domain location=193-277; Score=5.2; E_value=0.078; Accession=PF00240.13; Description =Ubiquitin family
  Pfam annotation: Domain name=ubiquitin; Domain location=55-125; Score= 49.5; E_value=1.1e-11; Accession=PF00240.13; Description=Ubiquitin family
  Pfam module annotation: Pfam domain module=ubiquitin::ubiquitin; Domain location=193-277::55-125
MVVKDKAENEESPLVWALLWAIGGPVAEELSRNYISRREGWLVTHTVTVIEMEIKFQIQRGHSFNLEIDPSETIRDVKEKVLNSQNIPIARQIILYHYELLPDDLIVSQCDLQHGGCLVLQISHDPAAPSPMSDSDSDFLPQSQPTPDMQMSKLIPNPYDPLGKRPMTLDISSASNKKVEEKLEDSRSRIVTLSLKAHKYWTHRFPMEANLDETVLKLKKYILADLRILAGFEMDNVPVERMVLHSHSTGVELLDHQLLRDCAVSDNHEIDLSLKEP

SEQ ID NO: 135320 - protein, 448 aa, Glycine max
  Coding DNA Sequence Number=SeqID_18542
  Pfam annotation: Domain name=ubiquitin; Domain location=12-82; Score =46.9; E_value=6.8e-11; Accession=PF00240.13; Description=Ubiquitin family
  Pfam annotation: Domain name=ubiquitin; Domain location=192-267; Score=14.0; E_value=0.01; Accession=PF00240.13; Description =Ubiquitin family
  Pfam module annotation: Pfam domain module=ubiquitin::ubiquitin; Domain location=12-82::192-267
MEVILEILGGNSFFIDVGPWFFIEVGPLDTVLDVKEKVQNLHNIPISYQTFLFNGEILQDDLQVSTSGIDRGSRIGLLVAPPDDANLAPPQPTLTPPWHTRPFGMPEFPPSLHLNILPHVYDPFGYGMPNIPEFSSLTELRPMPQMPQQLPSSSTEEMPVPSNSNEFEEPLPDLTEASPPSETAVRVTLNVKVPEIQDRIPIEMEFEDTVLKVKEKIVAREEMRGVPVERIALQSHSAGVELLDHQVLQDCCSVLENNEIDAFSKTCSEKRMVNVKLPMSQNRIRIEVEVDDTFRKLKEKIVALEGMQGVPVERILLYPCSPIPQSVLNPIFYVYLKSSVPVAGGGSSSASSGKMTVYLKPNGLPKCYPLQVNAVDNVSALGQQLGLLLQNHPLRLPPNEVFFMVYKGEWMNEQESFEWHGIRDCTKIATFVGCVNDSITPIFRPNIR

SEQ ID NO: 135321 - protein, 348 aa, Glycine max
  Coding DNA Sequence Number=SeqID_18543
  Homolog annotation: Hit_ID=Q4A2B5; Match level="QueryCoverage=28%, HitCoverage=3%, E-value=6e-07, Identity=41%"; Hit description =Putative membrane protein
  Pfam annotation: Domain name=ubiquitin; Domain location=244-316; Score=4.0; E_value=0.1; Accession=PF00240.13; Description=Ubiquitin family
  Pfam annotation: Domain name=ubiquitin; Domain location=37-106; Score= 31.8; E_value=2.5e-06; Accession=PF00240.13; Description=Ubiquitin family
  Pfam module annotation: Pfam domain module=ubiquitin::ubiquitin; Domain location=244-316::37-106
MDHWGPTFKKLYKASMHERWFPKPILTHTIIMKIKFHVRPGAKVFSLKVLRSEKIRDVKEKVQNSQRIPIFRQIFLYDDKLLQDEWTVSQCYLYDGAFVLLQVSPENPPSPVFPPWDPSLQLIPPQGFNYPLAIPGYPSSSEVIPMPQPASQTLPRLPTFRPHPSPSHMVPNPLPPPASQTLPWLPTFRPHPSPSHMVPNPLPPPASQTLPWLPTFRPQPSPSNMVPNPLPPPSSTVTLNVKVPRLQDRIPFEMDKVETILHLKMKIAALQEMGGVPVERIVLQSPLMRSEWHDDQVLQNILFTGSADIDVFLRPSLPQQQPHHHHPRHAVPNPSCIVTRHKPASFYS

SEQ ID NO: 135322 - protein, 114 aa, Glycine max
  Coding DNA Sequence Number=SeqID_18544
MKNLEESPAPSDMQTSQVIPKPYDSSRIVTLSLKAHKYWKDRFPMEADLDDTVLKLKKFILASMKVLAGFEMEHVTVDRMVLHSHSTRVELLDHQLIRDCNVSENHEIDLSVRE

SEQ ID NO: 135323 - protein, 519 aa, Glycine max
  Coding DNA Sequence Number=SeqID_18545
  Gene Ontology: Mol. function=monooxygenase activity; Cellular component=membrane; Biological process=electron transport
  Homolog annotation: Hit_ID=Q1SJ90; Match level="QueryCoverage=99%, HitCoverage=100%, E-value=0.0, Identity=71%"; Hit description=E -class P450, group I
  Pfam annotation: Domain name=p450; Domain location=35-505; Score =406.3; E_value=4.5e-119; Accession=PF00067.12; Description =Cytochrome P450
MADYQGTIILFIIWLVSTIVVRAIVSKKQNKTNRPPSPLALPIIGHLHLLAPIPHQALHKLSTRHGPIMHLLLGSVPCVVASTPEAAKEFLKTHENSFSNRPQSFAVDYLTYGSQDFSFAPYGPYWKFMKKICMSELLGGHTLSQLLPVRRQETLRFLRLMLQRGKAAEAIDVGRELLRLSNNVVSRMIMSQTCSEDDSEAEEVRKLVQDTVHLTGKFNVSDFIWFLRKWDLQGFGKGLKEIRDRFDAIMERAIKKHEEERKKRREEGSGGEGHIKDLLDVLLDIHEDENSDIKLTKENIKAFILDVFMAGTDTAALTTEWALAELINHPHVMERARQEIDAVIGNGRIVEESDIANLSYLQAVVKETLRIHPTGPMIIRESSESSTIWGYEIPAKTQLFVNVWAIGRDPNHWENPLEFRPERFASEEGSGKGQLDVRGQHFHMIPFGSGRRGCPGTSLALQVVQANLAAMIQCFEWKVKGGIEIADMEEKPGLTLSRAHPLICVPVPRLNPFPNISNA

SEQ ID NO: 135324 - protein, 165 aa, Glycine max
  Coding DNA Sequence Number=SeqID_18546
  Gene Ontology: Mol. function=structural constituent of ribosome; Cellular component=ribonucleoprotein complex; Biological process =translation
  Homolog annotation: Hit_ID=P49200; Match level="QueryCoverage=99%, HitCoverage=100%, E-value=1e-39, Identity=60%"; Hit description=40S ribosomal protein S20-1
  Pfam annotation: Domain name=Ribosomal_S10; Domain location=23-160; Score=77.9; E_value=3.1e-20; Accession=PF00338.12; Description =Ribosomal protein S10pS20e
MATYAAMKPNKPGLEESQEQIHKIRITLSSKHVKNLEKVCGDLVRGAKDKRLRVKGPVRMPTKVLHITTRKSPCGEESQGESSDRKYLLGGEMSKMRNHGKELAYEKELCQLSFAISLSLQGLDCAKGKAWERVIDLYSSPDVVKQITSITIEPGVEVEVTIADA

SEQ ID NO: 135325 - protein, 152 aa, Glycine max
  Coding DNA Sequence Number=SeqID_18547
  Gene Ontology: Mol. function=protein binding; Cellular component =postsynaptic membrane
  Homolog annotation: Hit_ID=Q6YZ89; Match level="QueryCoverage=34%, HitCoverage=55%, E-value=4e-25, Identity=92%"; Hit description =Putative postsynaptic protein CRIPT
MVCEKCEKKLSKVIVPDKWKEGASNTTEGGGRKINENKLLSKKNRCYAYVECAYSDLEILVSRFPAQLCHCILGLMVCTNGCMLSGANFKTVPTCGLVYHRWTPYGNTKCTICKQQVHQNAKYCHTCAYSKGVCAMCGKQVLDTKFYKQSNV

SEQ ID NO: 135326 - protein, 157 aa, Glycine max
  Coding DNA Sequence Number=SeqID_18548
  Gene Ontology: Mol. function=protein binding; Cellular component =intracellular; Biological process=protein modification process
  Homolog annotation: Hit_ID=Q00Y36; Match level="QueryCoverage=96%, HitCoverage=86%, E-value=1e-68, Identity=90%"; Hit description=[J] KOG0003 Ubiquitin/60s ribosomal protein L40 fusion
  Pfam annotation: Domain name=ubiquitin; Domain location=1-53; Score =78.5; E_value=2e-20; Accession=PF00240.13; Description=Ubiquitin family
  Pfam annotation: Domain name=ubiquitin; Domain location=61-129; Score= 138.0; E_value=2.5e-38; Accession=PF00240.13; Description=Ubiquitin family
  Pfam module annotation: Pfam domain module=ubiquitin::ubiquitin; Domain location=1-53::61-129
TIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGLKSVIDRCYVKATMKFEQTEIIVVIN

SEQ ID NO: 135327 - protein, 83 aa, Glycine max
  Coding DNA Sequence Number=SeqID_18549
  Homolog annotation: Hit_ID=Q71KW4; Match level="QueryCoverage=64%, HitCoverage=24%, E-value=4e-12, Identity=61%"; Hit description =Desiccation-associated protein
  Pfam annotation: Domain name=PBD; Domain location=13-57; Score=38.6; E_value=2.2e-08; Accession=PF00786.18; Description=P21-Rho-binding domain
MGTVPVLKEREMEIGYPTDVKHVAHIGWDGPSGTGPSWMNDFKTAPDFSTSLGNLGELNDPNGMAVTASWSSQDKIVRLPKAI

SEQ ID NO: 135328 - protein, 176 aa, Glycine max
  Coding DNA Sequence Number=SeqID_18550
LKASSEEEAETPEESEEVQALKEELERVQAVKEKLKTKTIKVRKECEELRGVNVATTEALERETKRGQKEEWSRNKWLKAWMQELAWLPKIKTSSEEEAETPEESKVVQALKEELERVQVSQRALLRASEARLTGAFSKGGKMRGVATDVYLWKTSEKPKEADQNENSKFGSCIYA

SEQ ID NO: 135329 - protein, 125 aa, Glycine max
  Coding DNA Sequence Number=SeqID_18551
SYGVPITPIKVIRPPITRAFIEKCCTPRQAQGDAHQAVGAPPPPRQADPAGPLGMEQPTTVGRCRYMSVSTGSASISRGRVAWPGDWPDAQAGEEPAGSPGETDESRMDEDMTDLLGFLGGIGAA

SEQ ID NO: 135330 - protein, 456 aa, Glycine max
  Coding DNA Sequence Number=SeqID_18552
  Gene Ontology: Mol. function=protein dimerization activity; Cellular component=nucleus; Biological process=regulation of transcription, DNA-dependent
  Homolog annotation: Hit_ID=Q52MZ2; Match level="QueryCoverage=88%, HitCoverage=76%, E-value=1e-148, Identity=67%"; Hit description =TGA10 transcription factor
  Pfam annotation: Domain name=bZIP_1; Domain location=210-263; Score =20.9; E_value=0.0008; Accession=PF00170.11; Description=bZIP transcription factor
  Pfam annotation: Domain name=bZIP_2; Domain location=210-260; Score =17.1; E_value=0.013; Accession=PF07716.5; Description=Basic region leucine zipper
  Pfam module annotation: Pfam domain module=bZIP_1::bZIP_2; Domain location=210-263::210-260
MASSKTTNPITTTTQLEPLPPPQHRHHPHHLHQLQQQQHQHHYHQQIHDHQISFGLMQSSSSSSSIPGNYLGSKDSGAYDLGELDQAFFLYLDGQADPSSVQDQRQNSSSGMRPPTLNIFPSKPMHVEPSSSKSKANIELVSPQTSGSKRPSEPSMELANPRNETASAPQPPKPVKREGNRKGPTSSSEHEGPKTPDPKVAIDANICALKRCAQTLRRLAQNREAARKSRLRKKAYVQQLESSRIRLNQLEQELQRARTQGMFLGGGALLGGEQGLPVTMNTISTEAAMFDVEYARWQEENHRIVCELRAAVQEHLPENELRLFVDNCLAHYDQVMNLKSLVAKTDVFHLVSGMWKTPAERCFMWIGGFRPSELIKIIVSQIEPLTEQQILGICGLQQSTQEAEEALSQGLEALNQSLSDTITSDSLSYPPNMANYMGQMAVAMNKLSTLEGFVRQ

SEQ ID NO: 135331 - protein, 207 aa, Glycine max
  Coding DNA Sequence Number=SeqID_18553
  Gene Ontology: Mol. function=ATP-dependent helicase activity; Cellular component=intracellular; Biological process=RNA processing
  Homolog annotation: Hit_ID=Q1SQK6; Match level="QueryCoverage=94%, HitCoverage=16%, E-value=6e-31, Identity=53%"; Hit description =Helicase, C-terminal; Argonaute and Dicer protein, PAZ; Type III restriction enzyme, res ...
  Homolog annotation: Hit description=subunit; Ribonuclease III, bacterial
MTQKLRLESAVTKGIVGLCSKTIADCIEALIGAYYVGGGLTAALHVMQWLGMNVGHDSPLVHEAITRTLLRSNVPKAYYINSLELKLGYEFSTKGLLLEAMTHPSQQELEPGICYCYQALGDMVESIAGAMLVDTELDIENVWRIFEPLLSPIVTPDNLELPSLCKLNKLCDCLVYFIKETSTKEGEIHHVELQLQLEYFFFGRKRD

SEQ ID NO: 135332 - protein, 53 aa, Glycine max
  Coding DNA Sequence Number=SeqID_18554
MRRDVAVTWWSRATCATIRMLLRKHWVVGSDLDEGGDARCWCSGVGLDGARRR

SEQ ID NO: 135333 - protein, 411 aa, Glycine max
  Coding DNA Sequence Number=SeqID_18555
  Homolog annotation: Hit_ID=Q6H7Q8; Match level="QueryCoverage=90%, HitCoverage=61%, E-value=1e-96, Identity=52%"; Hit description =Tubulin-specific chaperone C-like protein
  Pfam annotation: Domain name=TBCC; Domain location=346-411; Score= -40.6; E_value=0.027; Accession=PF07986.2; Description=Tubulin binding cofactor C
MTEPTEPCTSSSLARDPTTVIHPRREPFEHGLLPIPRLIFSDPAQTLIPLKQKLLESSSNQRVDSAAISESLQISIEQARLVLDTLASVLHSDAEPLVAAKLGEIDSVGVDVHDLVLFLYIQSYKRLLPRTHKDSAAVADVWPSTSAFDGYLSALSPLQVDEEAHQLSYLQKHLANIVSLVAQPVEGEGEESLNRSGLPMKIMETLDCAFQVSGDVHGFAGWVLTMDRFEHLGFLIQFGDKGSEGNSFSQSSPFFANSDPDMPAVPVPAAQVHDWLLQNIAAALEYISERTSSKENGPASASDQDVAMTDACTTSVNKVSTSTRSASFIEGISKSSYVKHASDIKGSSVKVLNCHESAIYILAPLRYATVYGCSDATVVIGAVGKAMVPTIAHGAQCADGRNDRKLTYTDT

SEQ ID NO: 135334 - protein, 326 aa, Glycine max
  Coding DNA Sequence Number=SeqID_18556
  Homolog annotation: Hit_ID=Q6H7Q8; Match level="QueryCoverage=94%, HitCoverage=56%, E-value=2e-92, Identity=55%"; Hit description =Tubulin-specific chaperone C-like protein
  Pfam annotation: Domain name=TBCC; Domain location=255-325; Score= -32.3; E_value=0.0042; Accession=PF07986.2; Description=Tubulin binding cofactor C
RVDSAAISESLQIPIEHARLVLDTLASILHSDSELLVAAKLEEIDSVGVDVHDLVLFLYIQSYKRLLPRTHKDSAAVADVWPSTSAFDGYLSALSPLQADEEAHQLSYLQKHLANIVSLLAEPVEGEGEESLVLTMDRFEHLGFLIQFGDKGSEGNSFSQCSPFFANSDPDMPAVPVPAAQVHDWLLQNIVSALEYISERTSSKENGPASASDQDVAMTDASTVSVKVSTGTRGASFIEGISKSSYAKHASDIKGSSVKVLNCHESAIYILAPLRYATVYGCSDATIVLGAVGKEDDTDMMIAVKWACLQVTEISLGFIVLLGQFG

SEQ ID NO: 135335 - protein, 200 aa, Glycine max
  Coding DNA Sequence Number=SeqID_18557
  Gene Ontology: Mol. function=protein transporter activity; Cellular component=mitochondrial inner membrane; Biological process=protein transport
  Pfam annotation: Domain name=Tim17; Domain location=10-137; Score =50.3; E_value=6.3e-12; Accession=PF02466.9; Description =Tim17Tim22Tim23 family
MVDAAERRYLEDDDSSLMKTIKGATTGLVAGTIWGTVVATWYDVPRVERNVALPGLIRTIRMMGNYGLTFAAIGGVYIGVEQLVQNYRMKRDLVNGAVGGFVAGATILGYRDALALLMSCREANLLLALLWLARIDLLVVVCVCLCVYGGTGRSIKTALSAGSALAFTSAFLDFGDQTLKHDAGKEYAAYTTKKRPSTDA

SEQ ID NO: 135336 - protein, 368 aa, Glycine max
  Coding DNA Sequence Number=SeqID_18558
  Gene Ontology: Mol. function=DNA binding; Cellular component=nucleus; Biological process=regulation of transcription, DNA-dependent
  Homolog annotation: Hit_ID=Q9SNV3; Match level="QueryCoverage=95%, HitCoverage=98%, E-value=1e-76, Identity=47%"; Hit description =Squamosa promoter binding protein-homologue 5
  Pfam annotation: Domain name=SBP; Domain location=78-156; Score =193.5; E_value=5e-55; Accession=PF03110.5; Description=SBP domain
  Subcellular localization annotation: CTP_CleavageSite=78; ConfidenceScore=5.39e-01
TPHLITPSPMASDAKLSSSESLNGLKFGQKIYFEDVGFATPATSLTSSATTATTVTSSSSSSSRKGRGGSVQPAQPPRCQVEGCEVDLSNAKTYYSRHKVCGMHSKSPTVIVAGLQQRFCQQCSRFHQLPEFDQGKRSCRRRLAGHNERRRKPPPSSLLTSRYARLSSSAFDHSGRGGNFLMELASYPKLSLRNSLPTPRSSELAPGNQTSTLSWHGNSETSSDLFLQGSVGGTSFAGPGHPPGESYTGVTTSSCALSLLSNQTWGSRNPAPSLGLNNMVNFHGTPMTQPAASSHGASIHQLPNTPWCFKGIDSGNCSPEGVPDLGLGQISQPLSSQLHGELDLSQQGRRHYMDLEQSRAYESAHWSL

SEQ ID NO: 135337 - protein, 604 aa, Glycine max
  Coding DNA Sequence Number=SeqID_18559
  Gene Ontology: Mol. function=protein serine/threonine kinase activity; Cellular component=integral to membrane; Biological process=protein amino acid phosphorylation
  Homolog annotation: Hit_ID=Q9FG24; Match level="QueryCoverage=95%, HitCoverage=76%, E-value=1e-125, Identity=44%"; Hit description =Receptor-like protein kinase
  Pfam annotation: Domain name=Pkinase; Domain location=269-558; Score =19.2; E_value=1e-09; Accession=PF00069.15; Description=Protein kinase domain
  Pfam annotation: Domain name=Pkinase_Tyr; Domain location=269-558; Score=-19.6; E_value=2.9e-11; Accession=PF07714.7; Description =Protein tyrosine kinase
  Pfam module annotation: Pfam domain module=Pkinase::Pkinase_Tyr; Domain location=269-558::269-558
MIVEKPKRKVSAYKNIKNLLRDLSYNNFSGDLPFSFGSLRNLARLNIQDNLFSGILPQHFQSILNLWIGENKFYEADNSPPWSFPLDTVSVEHNTSSPPTTQANAIKNYSPPRVSEAPPRVSEDLPRVNEAPLRVSEHKKKRIGPGGIACMIGGGTLMATGVALFVATRLNKCREESPNSKSSESNHGSLHSHPISEAIGITSNALEERQSPQVPPINSASLLGPVGLPSLNHNNTEEPLRRSFSKRSRFTGRTKVYTVEELQLATNCFNEANVLGEGSLGPVYRAKFPDGKILAVKKINMAGMSFREEVKFLDIIGTISRLKHPNIVALNGYCLEHGKHLLVYDYVRNFTLNDALHNEAYKSLPWVHRLRIALGVAQALDYLHATFCPPVAHGNLKAVNVLLDENLMPRVCDCCLAILKPLISNQVEIPADEINIGEIVCVTPDHGQAGTSSRKRDVFAFGVLLLELLTGRKPFDGARPRDEQYLVKWAPPLLPYRASLEQLVDPRMERTFSSKALSRYADIISLCIQKCQGCVAELVEQDPVKQLRPPMSEVVESLEALYQKFNIEKSDVADGTEVDPFERSFHSTNICFMGSPPAVSHASA

SEQ ID NO: 135338 - protein, 133 aa, Glycine max
  Coding DNA Sequence Number=SeqID_18560
MVKVKVLIKECLFTHFQGRNIVVKYADSQKGKTGQPPFPAGVVPMAALPMNPGYMQQPGKANVSSRPPINYSYPQTVAPYSALPYPNPPTAPSPYPTQGQIPYPQVSAKKDRHGFLPTQPVGMNNYPYYYPKQ

SEQ ID NO: 135339 - protein, 307 aa, Glycine max
  Coding DNA Sequence Number=SeqID_18561
  Homolog annotation: Hit_ID=Q9FG25; Match level="QueryCoverage=69%, HitCoverage=69%, E-value=2e-23, Identity=30%"; Hit description =Arabidopsis thaliana genomic DNA, chromosome 5, P1 clone:MPH15
MEDRDRALHSHNFNHQNDTVPTNAMFLFRKPNVHKLIILKPWQNPRRFQSTKKRPSESASIVDADNMCRNSPSFLHGLLDTTIARWPHTSRRGVAPRMLTCVIASSPCILVGGVDLDFVRVVEKLKGVVGKDGENLLNVLDDQGCCNWRIVLHESGGSVLSLINFLFKFGLSVDRVALVLLEFPEIRVAKFLSNLRQCFLFLTMIEMEASEIGRILQSHCLVLGSFTFKKTNTLLTNLNVGKKQLYRVVRDDPLVMESRALGRRIQPFRNSYLEYELKDQKKKFMLKLGYVENSRKMNEAIRSMRMS

SEQ ID NO: 135340 - protein, 398 aa, Glycine max
  Coding DNA Sequence Number=SeqID_18562
  Gene Ontology: Mol. function=DNA binding; Biological process =regulation of transcription
  Homolog annotation: Hit_ID=Q9ZQT9; Match level="QueryCoverage=39%, HitCoverage=44%, E-value=1e-18, Identity=36%"; Hit description=WERBP- 1 protein
  Pfam annotation: Domain name=Myb_DNA-binding; Domain location=225 -276; Score=17.8; E_value=0.04; Accession=PF00249.21; Description=Myb- like DNA-binding domain
MYQYSSQLYGTEWESYMGISNLDKVVGSEQLSFEPTKSPFNIVTTPLQITPPGFCASAIKSLVSFQAQQQQQHAHHQHQIEVPAAWCFEFPKTTTTTDTHMVMNNICQASGDNFTTKQDRPSSQFTSSFLSSSGADCRSSSEKYCKIASYSEEKHSSIQPDSIQYYDLYSQEDDKLLRDDAATDEGPLEISFQRNQLDSCTKREKQAPHRTCGVACVASRRGKRRIKWTKDLHEPFMMIVNSLGGPEKAKPKAILDMMKSDLLSISHVKSHLQKCRSTIHMHKALQEVKRGRWNIREMKFDKVFGHTLPLCLSERSEKGQRTNGVSELQVKIHMQIEESRQLQLEIRRNICQQLKMQRNLHTLIQEQSQQLKVMLDYQKERTKLEKTPYTELEATVPK

SEQ ID NO: 135341 - protein, 124 aa, Glycine max
  Coding DNA Sequence Number=SeqID_18563
MHTVNHTAYKWEQYFYGPFSENASTPSKQKSHDDKRGQALAGTTNVTALRPRHSPLARIRLFTSIFCKSHYERIPCIGSPFRTMITKCTGSGLKTCHQLEPISFATQPLSFPHLEIACDGGGTA

SEQ ID NO: 135342 - protein, 81 aa, Glycine max
  Coding DNA Sequence Number=SeqID_18564
  Homolog annotation: Hit_ID=Q9LKA4; Match level="QueryCoverage=56%, HitCoverage=11%, E-value=9e-07, Identity=50%"; Hit description =Similarity to RNA-binding protein
MPHGMCPTRFTYGMPISISLYFQSSTLSLNSRNKTQNAFQEHGEIEEGAVIYDKVTGKSRGYGFITFKNMESTQQALRAPS

SEQ ID NO: 135343 - protein, 130 aa, Glycine max
  Coding DNA Sequence Number=SeqID_18565
  Gene Ontology: Mol. function=DNA binding; Biological process =regulation of transcription
  Homolog annotation: Hit_ID=Q9ZQT9; Match level="QueryCoverage=89%, HitCoverage=37%, E-value=4e-15, Identity=42%"; Hit description=WERBP- 1 protein
MQNKCIFIHGKSDKRTHTKDVHHLDVKTGIQIREALKLQLDAQRCLHEQLEIFNYHTFLVQIQRKLQLRIEEQGRQLKKMFDQQQKTSNDVSNTQNSTIEETSISHKDGENASEGANNNSFFPSKTSPSQ

SEQ ID NO: 135344 - protein, 188 aa, Glycine max
  Coding DNA Sequence Number=SeqID_18566
  Gene Ontology: Mol. function=structural molecule activity; Biological process=response to gibberellin stimulus
  Homolog annotation: Hit_ID=Q6YZ10; Match level="QueryCoverage=90%, HitCoverage=73%, E-value=7e-65, Identity=72%"; Hit description=27k vesicle-associated membrane protein-associated protein-like
  Pfam annotation: Domain name=Motile_Sperm; Domain location=1-100; Score=63.5; E_value=6.8e-16; Accession=PF00635.16; Description=MSP (Major sperm protein) domain
  Subcellular localization annotation: CTP_CleavageSite=31; ConfidenceScore=5.04e-01
EPGKQVRSAIAIKNTCKSHVAFKFQTTAPKSCYMRPPGGILAPGESIIATVFKFVEPPENNEKPIDQKSRVKFKIMSLKVKGEMDYVPELFDEQRDHVAVEQILRVIFLDPEHPCPALDKLKRLLAEAEAALEARKKPPEETGPRVAGEGLVIDEWKERRERYLARQQVEVVACLWCLDAIESMIGGT

SEQ ID NO: 135345 - protein, 186 aa, Glycine max
  Coding DNA Sequence Number=SeqID_18567
  Gene Ontology: Mol. function=DNA-directed DNA polymerase activity; Cellular component=mitochondrion; Biological process=DNA replication
  Homolog annotation: Hit_ID=Q6QZN8; Match level="QueryCoverage=74%, HitCoverage=17%, E-value=2e-25, Identity=54%"; Hit description=DNA -directed DNA polymerase
MTLFRSFCNIPVVAARNDVVAPAEVITIKAVGAFLLGPPEELRSTTSRSKSLPAQGSICTSIFQEEDCLYTDTDSIVLGNPLPEEDVSSSVLGKFKLEDKILEGFFLAPKCYSYTTEESDGNKKVYKYKGPGRNVITPEWYKEQYADPSRSLIKKVTYQFRPNWKELSVKNKESTTTLGKKVTYTF

SEQ ID NO: 135346 - protein, 48 aa, Glycine max
  Coding DNA Sequence Number=SeqID_18568
MKASISSPSLCRLGILSEQLKKKLEKSQGIARDAAIAVRRHGFLLPVD

SEQ ID NO: 135347 - protein, 104 aa, Glycine max
  Coding DNA Sequence Number=SeqID_18569
  Gene Ontology: Mol. function=transferase activity, transferring nitrogenous groups; Biological process=biosynthetic process
  Homolog annotation: Hit_ID=Q7VS82; Match level="QueryCoverage=99%, HitCoverage=25%, E-value=3e-42, Identity=81%"; Hit description =Probable aminotransferase
MAESLTRELDGRIAFSKPEGGMFFWARLTGEVDATRLLPYAIEHEVVYVPGKAFYADPAQADLHAMRMSFATMNEAQIAQGMQRLSRALDACEANQPVSISLAA

SEQ ID NO: 135348 - protein, 109 aa, Glycine max
  Coding DNA Sequence Number=SeqID_18570
MSRGSGDLGDVRWGAIAQNQAWPIPAQPGHSQPVRTCDVPKQASSWQSTNKGTKVHEAGRLVWRLASYLSCVLSEKFPLGLKIETERSVATGNRLPFVCNRLHNVICYW

SEQ ID NO: 135349 - protein, 166 aa, Glycine max
  Coding DNA Sequence Number=SeqID_18571
  Homolog annotation: Hit_ID=Q2RAM1; Match level="QueryCoverage=52%, HitCoverage=20%, E-value=2e-27, Identity=62%"; Hit description=SPRY domain containing protein, expressed
MRKEKIPHQAPFAIQAAQLLGRAIGAGLFAITPAGERGMCCKAIKLGSEISFFKNGICQGVAFKDLQGGRYYPAASMFTLPNEPNCTVKFNFGPDFECFPEDFNERPIPRPMSEVPYLGFDNKVENEESNEKGTELEFVIMVIAVSCVKLLSAHNSTQHTSRKHKV

SEQ ID NO: 135350 - protein, 133 aa, Glycine max
  Coding DNA Sequence Number=SeqID_18572
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=3e-17, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPSEDYTSAPSEDFTSSPSEDYTSSPSMYYASSSSEDYTSSPSEGYTPLPSEDYTSSPSEDYTSSPSVGYTSLPSEGYTSSPSEGYTPSPSEDYTSSSLEGCTPSPSEGCTPSALKGDTSSTSEGCTPPRL

SEQ ID NO: 135351 - protein, 345 aa, Glycine max
  Coding DNA Sequence Number=SeqID_18573
  Gene Ontology: Mol. function=DNA binding
  Homolog annotation: Hit_ID=Q1S0F5; Match level="QueryCoverage=83%, HitCoverage=60%, E-value=5e-33, Identity=32%"; Hit description=IMP dehydrogenase/GMP reductase
MGSNQAPLLKKRGCQFERIGAIDGSAPTPSFSQDLWEDLGSSYDRGLDGSHASLTQYYDQPLRCFRFWDFQLVQTVEEFEEILGCPLGGRKPYLFSGFYPSMARIAKQNRNGIVGIPRKHLEEKEKVLADQGEWTSFIDILALLIFKVILFPNVDGLVDLAAIDAFLAYHHSKESPVTAILVDLYDTFDRRCEKSDTRIVYCTPTLYVWLVSHLFRHESRPVCPMQGHYICAEKGEVNWEQLLASVVGASINWFPWWKKGGVGVLSSCKGFPNIPLMGMRGCINYNPVLAIRQLGYPMRGAPSEESIMPLIARGFSDHNARILQGVHKAWGAVQRKDKELRGSAN

SEQ ID NO: 135352 - protein, 120 aa, Glycine max
  Coding DNA Sequence Number=SeqID_18574
  Homolog annotation: Hit_ID=Q6CQF3; Match level="QueryCoverage=48%, HitCoverage=61%, E-value=7e-10, Identity=73%"; Hit description =Kluyveromyces lactis strain NRRL Y-1140 chromosome D of strain NRRL Y- 1140 of Kluyveromyces lactis
MTCVRVNGRVTRKAQGKLIGGIPLWIAPPTDPDLSVKGSSESIPVGTRKMVGRCGCSVEPRHGIESSKWAIFGKQNWRCGMNRKLGYGAQLRANLDPTKGVGRLRQQDGGHGSRNPLRSV

SEQ ID NO: 135353 - protein, 70 aa, Glycine max
  Coding DNA Sequence Number=SeqID_18575
MVIEGLQLGVKERKGNKTKNIKRKGRAQAWNAERSALRRGVCSPLVWISIYRCRNELWAFEGALSATPRA

SEQ ID NO: 135354 - protein, 98 aa, Glycine max
  Coding DNA Sequence Number=SeqID_18576
MKNGGKSSRNRPRKRLGSVTEAPRLGFSSRKQFFSLILSDSQIPGGVKEGGGCRPARPGELGCFHQKALPSVGTSWKAQVGLIAICTPSALFLLILFP

SEQ ID NO: 135355 - protein, 117 aa, Glycine max
  Coding DNA Sequence Number=SeqID_18577
MAPPRSIPLMDQFTEMVAWPGTQPSIHREDEGSTAQVPQHVEDELSDATIPEPFVIGEEVEETQPIADPSTPLLEMPEDPTTSVLAMDTSPPATPVLHLIDEEDVQTQDTPDQSQEF

SEQ ID NO: 135356 - protein, 45 aa, Glycine max
  Coding DNA Sequence Number=SeqID_18578
MKNTKVVVAGVSLSEACVLSENHSLSEASTRLASWENLEENLSSI

SEQ ID NO: 135357 - protein, 121 aa, Glycine max
  Coding DNA Sequence Number=SeqID_18579
  Gene Ontology: Mol. function=sequence-specific DNA binding; Cellular component=nucleus; Biological process=regulation of transcription
  Homolog annotation: Hit_ID=Q2HTS9; Match level="QueryCoverage=78%, HitCoverage=37%, E-value=5e-21, Identity=53%"; Hit description=DNA -binding WRKY; VQ
MFSKNPNINLLNNVIILSFLPRKHHKVLSPSILDFPTLVLSPITPLIPNPFNRSHFVNENGAIVVMETVEAAEKKSMKEKGFFLDPSPVSTPHDEKPRLLPFFPTTATVAMSPGSSSSSSS

SEQ ID NO: 135358 - protein, 100 aa, Glycine max
  Coding DNA Sequence Number=SeqID_18580
MNIKRREDIIDVFSKKRILMRHRESQGNRNTMAYITILNHNIQSTIQGMIHTLRAAAPLITCPPMPTPDRRFASSYDISWRRESSCEERVASSRTRFQEL

SEQ ID NO: 135359 - protein, 89 aa, Glycine max
  Coding DNA Sequence Number=SeqID_18581
MDGILISSVVLLADSRFTRPDMGFHPTKLNFVPSDADEAPLDVSICLHAFGIVGCGSFSGVKSCEREDPFHPGLFVGDAGGFQSPTREP

SEQ ID NO: 135360 - protein, 386 aa, Glycine max
  Coding DNA Sequence Number=SeqID_18582
  Gene Ontology: Mol. function=asparaginase activity; Cellular component=cytoplasm; Biological process=glycoprotein catabolic process
  Homolog annotation: Hit_ID=Q6DAX0; Match level="QueryCoverage=75%, HitCoverage=91%, E-value=1e-110, Identity=72%"; Hit description=L -asparaginase
  Pfam annotation: Domain name=Asparaginase_2; Domain location=77-384; Score=422.9; E_value=4.4e-124; Accession=PF01112.9; Description =Asparaginase
MRPAASASATLRQSLIGCSCCSIFCCASSREISPAVKGSMSISVGLKANAAYYGGICPLSHMRQKSIIHIKRVTVMAKAVIAIHGGAGAITRAAMSAEKEQHYRQQLAAIVSAGQQILASGGSALDAVTEAVRLLEECPLFNAGRGAVFTHQGTHELDASLMDGRTLDIGAVAGVSRIRNPILAARKVLEASPHVLLIGSGAEAFAAQQGLTPVEPDFFSTPERWEQLQRALGSEQMLLDHDGAAQESDPLDPDRKFGTVGAVALDLQGNLAAATSTGGMTNKQAGRVGDSPLAGAGCYANNATVAVSCTGTGEVFIRTLAAYDVSAQMEYGGRSLQQATASVIHDKVQELEGSGGLIAVDAHGNVALPFNSERHVPRIRLCGRRG

SEQ ID NO: 135361 - protein, 464 aa, Glycine max
  Coding DNA Sequence Number=SeqID_18583
  Gene Ontology: Mol. function=protein serine/threonine kinase activity; Biological process=protein amino acid phosphorylation
  Homolog annotation: Hit_ID=UPI00000483A9; Match level="QueryCoverage =92%, HitCoverage=41%, E-value=1e-154, Identity=61%"; Hit description= kinase
  Pfam annotation: Domain name=Pkinase; Domain location=301-464; Score=- 10.4; E_value=6.1e-08; Accession=PF00069.15; Description=Protein kinase domain
  Pfam annotation: Domain name=Pkinase_Tyr; Domain location=301-464; Score=-24.6; E_value=5.8e-11; Accession=PF07714.7; Description =Protein tyrosine kinase
  Pfam module annotation: Pfam domain module=Pkinase::Pkinase_Tyr; Domain location=301-464::301-464
MAMLISTIEQVGVSSFDFILPYAKISTYTSPPYYDFAMKCGGPQITSSNGVVFEMDNQTLGPATYFVTDTHRWAVSNVGLFTGSNNPQYKITVSNQFTQTVDPELFQTARLSASSLRYYGLGLENGFYNITLQFAETVILDNSEWKSLGRRIFDIYIQGTLVLKDFNIKKEAGGISFSVVLKKFRVEVLENYLEIHLFWAGKGTCCIPVQGTYGPLISAISAIPDFKPTVSNKPPSNKRNRAGLIVGIVVGVGAVSFLVVLAFFYVIRKRKRHDDDEELLDIDTKPYTFSYSELKNATNDFNIGNKLGEGGFGPVHKGTLDDGRVIAVKQLSVQSNQGKNQFIAEIATISAVQHRNLVNLYGCCIEGNKRLLVYEYLENKSLDHAIFGNCLNLSWSTRYVICLGIARGLTYLHEESRIRIVHRDVKSSNILLDLEFIPKISDFGLAKLYDDKKTHISTRVAGTM

SEQ ID NO: 135362 - protein, 65 aa, Glycine max
  Coding DNA Sequence Number=SeqID_18584
MDGDFDGRGVHPGVLEGRDGVITVVDAAIEDGDRGGIVDEEGLLVGVGGKVDKVEIKFSMSPMST

SEQ ID NO: 135363 - protein, 129 aa, Glycine max
  Coding DNA Sequence Number=SeqID_18585
MGCDLSMIERRFGVKHLDSFNTTSVDMMICQVWKCRYGGGESDPKEVLGVDNTGDFEGSVSIVSDTIDSIGIFNINQQIPSSKKAERKRKEHAGESGDGGGNENKKEPLKEVIKGDTVERLGPRDEYRG

SEQ ID NO: 135364 - protein, 128 aa, Glycine max
  Coding DNA Sequence Number=SeqID_18586
  Gene Ontology: Mol. function=protein serine/threonine kinase activity; Biological process=protein amino acid phosphorylation
  Homolog annotation: Hit_ID=UPI00000483AA; Match level="QueryCoverage =97%, HitCoverage=11%, E-value=2e-24, Identity=49%"; Hit description =ATP binding / protein kinase/ protein serine/threonine kinase/ protein-tyrosine kinase
AWQLHENNNVTDLVDPRLLSDFNDEEVKRIVGISLLCTQTSPILRPSMSRVVAMLLGDIEVSTVTSRPGYLTDWKFDDEISFMTEVATKGSDTSFYNSSASFSIVGGADYSPIDASKPILHETLSESS

SEQ ID NO: 135365 - protein, 434 aa, Glycine max
  Coding DNA Sequence Number=SeqID_18587
  Gene Ontology: Mol. function=transition metal ion binding; Cellular component=mitochondrion; Biological process=DNA integration
MPSHLGDEESSKSEGGPKTCRHNSLPIKITLTTPPVLSKPDTTKKLIVYLSISVEAISMVMVQEEGSEQRPIYFVSQVLQDPEMRYQVMKKVDLTLVNVTCRLCQYFQSLRITVQTDFPIAKMLRKPELDERTKKYHLGVGRCMWTTPPIDMEVELGLFWKDPMAWTWHNHYASASKPPTIRPKILEYLKHEILLADKSKARKFRMQAARYTLVIGELYRRGFSSPLLKCLDRDQANYICELHEVPPMPKTLKSDTLIGQRVTSIGLPLVVHYLGNGYSRDLCHSSEAKEVLASDCRLFHQMGEGRATIKHHIPSDLKVLGIKHRMTSVDHPQTNEQVEAANKVILGELKKRLNGAKGRWAEELAEVLWAYGHYFVETQNNEALQVNLDLIEQVREDAVIMIEACKWGPSMESLRRRPKGPVRWEVNGQLGGTL

SEQ ID NO: 135366 - protein, 56 aa, Glycine max
  Coding DNA Sequence Number=SeqID_18588
MDDQEGPWPRKVTSIALWRKCFPKASIIRSYPGYCPMYYKYKKTDSVMKYHIAQER

SEQ ID NO: 135367 - protein, 92 aa, Glycine max
  Coding DNA Sequence Number=SeqID_18589
MNTDLLTGLSQIDDKETRYSDQDTTKAFINESSQEAGLHASSSLPPMIINNPTLRNPFQVQMEECLVTLYSLSKSLKVTELGTWWYKECHLG

SEQ ID NO: 135368 - protein, 130 aa, Glycine max
  Coding DNA Sequence Number=SeqID_18590
MAEFPPVEIGTRGTVGSLLMQEIEYFSRLEFNFKDWSQENKSQNINMGSSVSTDSRPTIVSRVESTKKRRRSSKLPSSYQRCVLWSMYLTTSLEKPNFLREFGIGVLGTKHGYLMGMLAIKFCFEANAGA

SEQ ID NO: 135369 - protein, 59 aa, Glycine max
  Coding DNA Sequence Number=SeqID_18591
MRSLTETFWLTISRLNKQVCGNADFEPLAKPILWLSDPSAKRSSLWLSVKNILEADEFS

SEQ ID NO: 135370 - protein, 159 aa, Glycine max
  Coding DNA Sequence Number=SeqID_18592
MEGFKGNEGTVAVGTTGTIGLLMTRELDQMSSVPHQEVYSTSKSQISVSRGSARPKRPQPRKSFEASSSRSSNIINHLSPGIGLKTKLNGKHTHQIPMLGSQNLPLEASPVTKKKDKKKKSKIVEVVDIKCGYVDKTWATPIPNSLKKLGFSKLFKSVT

SEQ ID NO: 135371 - protein, 99 aa, Glycine max
  Coding DNA Sequence Number=SeqID_18593
  Gene Ontology: Mol. function=ATP-dependent helicase activity; Cellular component=nucleus; Biological process=regulation of transcription, DNA-dependent
  Homolog annotation: Hit_ID=Q1S5T4; Match level="QueryCoverage=63%, HitCoverage=8%, E-value=9e-23, Identity=85%"; Hit description =Helicase, C-terminal
MDIMFLISSVSIYYGSQSDIQAACIPLALSGRDICGSAITGSRKTAAFALPTLERLLFRPKRMRAIRVLILTPTRESWQSTEYVVCGVPTSIYGFASWQ

SEQ ID NO: 135372 - protein, 157 aa, Glycine max
  Coding DNA Sequence Number=SeqID_18594
  Gene Ontology: Mol. function=RNA-directed DNA polymerase activity; Biological process=RNA-dependent DNA replication
MAEMGKLDHLEERLRAIKGGEDYAFANLEKLFLVPNIITPPKFKVLNFDKYKGTTCPKNHLKMYCRKMGTYAKDEELLIHSFQESLTGVAVTWYTNLEPSRVHSWKDLMVAFVRKYQYNFDMVPDRMQQQNMCKKGHRSFKEYAQRWRDLAVQVAPQ

SEQ ID NO: 135373 - protein, 127 aa, Glycine max
  Coding DNA Sequence Number=SeqID_18595
  Gene Ontology: Mol. function=phosphoenolpyruvate carboxykinase (ATP) activity; Cellular component=cytosol; Biological process =gluconeogenesis
  Homolog annotation: Hit_ID=UPI000016293F; Match level="QueryCoverage =95%, HitCoverage=18%, E-value=7e-46, Identity=74%"; Hit description =ATP binding / GTP binding / phosphoenolpyruvate carboxykinase (ATP)/ phosphoenolpyruvate carboxykinase
MLAEKMQKHGANGWLVNTGRSGGSYGCGNRIKLSYMRKIIDAIHSGSLLDAKYKKTEIFGLESPNKVEGVPSEILEPENTWLDKQAYKDTLLELAGLFNKIFETFTIGENNQMIEEILAAGPIIGDA

SEQ ID NO: 135374 - protein, 37 aa, Glycine max
  Coding DNA Sequence Number=SeqID_18596
MVMAFIYSMFKQDYLMQEKIISALDIKMPSKELESYC

SEQ ID NO: 135375 - protein, 120 aa, Glycine max
  Coding DNA Sequence Number=SeqID_18597
MNLIKEKLLGMRQIKKLLLKFKERYLQMVAKTWSKEEISQKRRTMTVMGLETIMRKRNPILVVGVTKSQQDSDSVKALKCFAYERIEPTSEEELGVQDKDSRTIEAKVVEKIRVEEAENL

SEQ ID NO: 135376 - protein, 122 aa, Glycine max
  Coding DNA Sequence Number=SeqID_18598
MDASKFQHHESWLDSRIIASLKLASKDDIKTTNKGIKRSNISPQNRGVENVNRDVGQSMNNSFHLLSSKTTSRITSKAQPYLIFRPFFSSSVPMAMVFKFNPSNLVESRAEAQGIDNLTLTN

SEQ ID NO: 135377 - protein, 363 aa, Glycine max
  Coding DNA Sequence Number=SeqID_18599
  Gene Ontology: Mol. function=RNA-directed DNA polymerase activity; Cellular component=chromatin; Biological process=chromatin assembly or disassembly
  Pfam annotation: Domain name=Chromo; Domain location=266-320; Score =36.4; E_value=9.9e-08; Accession=PF00385.14; Description='chromo' (CHRromatin Organisation MOdifier
  Pfam annotation: Domain name=zf-H2C2; Domain location=5-46; Score =8.9; E_value=0.024; Accession=PF09337.1; Description=His(2)-Cys(2) zinc finger
  Pfam module annotation: Pfam domain module=Chromo::zf-H2C2; Domain location=266-320::5-46
MEEFHATPQGGHSGFYRTYRRLASNLFWKGMKGDIMRFVQDCDVCQHHKYLTKALGGLLQPLPISDQVWEDISLDFISGLPRSKGFEAILVVVGKLSKYSHFIPLRHPYPIQDIAEIFVKEVIRLHGVPNSIPKGWVIWLPWAESWFNTTYQDSIGITPFEVVYERKPPMMVKSIQGEVKVEIVQRELQDRDEALRQLKNYLARAQDRMKTQVIERIGEVAYKLKFPTSSKIHPVFHVSWRKKEHGDYKVESALPSGLEDDREGEIEPELVLATRSIMKRGKRVNQWLVQWNGKNVDEATWEDELTLKSQFPEMSLEDKTLLQGEGVDRNQICNGPLEPLVHKMQKGPREWLVYSRRKKRGVE

SEQ ID NO: 135378 - protein, 83 aa, Glycine max
  Coding DNA Sequence Number=SeqID_18600
MHAIVDLFEIPEQFHNLQATVSDVTSFAITHGFSFMDAFLHLNTSGNCLRSTQITVACSPKALSIWLKAPKLFPVTWYLPPYG

SEQ ID NO: 135379 - protein, 271 aa, Glycine max
  Coding DNA Sequence Number=SeqID_18601
MDVKTAFLNGDLEKNVSNDLGLLHETKKFLSRNFEVKDMGEVQEAKNKLDVPKDAEEKLCDETKGHKLDITSDTDVQILDDTKSNRRSGTSTMDDEAIKLSGSNRRPHYEITKNSKRGNAKANMETDNLDSIQEPKSETQLNTVPRKRGRNKTWEISQSRKARNCSSPYPSSEKPTSRKDKLHRMPKTVSETLVCMQKSENIAKAVQSRRTQNIGTDFLANDTSKVHEALASKPKADENTNAASVNNNYPDAGAISSAISSKTRSEKQVHK

SEQ ID NO: 135380 - protein, 296 aa, Glycine max
  Coding DNA Sequence Number=SeqID_18602
  Gene Ontology: Mol. function=cation transporter activity; Cellular component=membrane; Biological process=cation transport
  Homolog annotation: Hit_ID=Q84ND4; Match level="QueryCoverage=99%, HitCoverage=68%, E-value=1e-111, Identity=70%"; Hit description =Cation diffusion facilitator 10
  Pfam annotation: Domain name=Cation_efflux; Domain location=124-296; Score=-34.1; E_value=4.9e-07; Accession=PF01545.11; Description =Cation efflux family
MSESGRGHHGATAETGRREQFMTENVAGDSSSSLSWRLNVKEFQLPRLSHSHDHHHQHLPSYFTFRDLLRKPKKQRKVAEYYKKQERLLEGYNDMDTMTETGCFPGSLTEDEMKQLARSESLAVNVSNAANLVLFAAKVYTSIESRSLAVIASTMDSLLDLLSGFILWFTAYAMRNPNQYHYPIGKKRMQPVGIIVFASVMATLGLQILIESGRQLISKSKPEMDPHELKWVIGIMASVTVVKFILMVYCRRFKNEIIRAYAQDHFFDVITNSVGLVAAMLAVKYSWWIDPMGAII

SEQ ID NO: 135381 - protein, 152 aa, Glycine max
  Coding DNA Sequence Number=SeqID_18603
MASRKRRASTSRPQELYDTSRFVSKNILTERNVELAYSHYDEFLRELERRIWHRALTRQPDNHIDLALVKEFYPNLYDLEDRSPRQCKVQGKLIKFDATTLNEFLEAPVVLEPGERYSVYSQFCHTHLDPQELAAKLCIPGQGFVLNAEGAP

SEQ ID NO: 135382 - protein, 134 aa, Glycine max
  Coding DNA Sequence Number=SeqID_18604
  Subcellular localization annotation: CTP_CleavageSite=65; ConfidenceScore=5.44e-01
MDRVRSRKANARATSDASTSASAPTPAPVPAPVLPALVSIPVGPSMQSTDAIVLMLQSLHHNLCPTQAPGDAEDTPADTTIDQAVEDDMPEARDTEETLAATPIEIIEEGGAIDTDIDEDYVENVTAVQGTWDP

SEQ ID NO: 135383 - protein, 114 aa, Glycine max
  Coding DNA Sequence Number=SeqID_18605
MEDAPVSLASLARKRVGCDSWRLRWGLFLIHDVGYNVQDILPKNTGIAKSIEAAGFTMSDTMSRTSCPKILELLKALKLQDPRCRIRCPGHLARKYWTYKSVISLTDYCAVSKR

SEQ ID NO: 135384 - protein, 204 aa, Glycine max
  Coding DNA Sequence Number=SeqID_18606
  Gene Ontology: Mol. function=monooxygenase activity; Cellular component=endoplasmic reticulum; Biological process=electron transport
  Homolog annotation: Hit_ID=Q6J540; Match level="QueryCoverage=98%, HitCoverage=37%, E-value=2e-81, Identity=71%"; Hit description =Cytochrome P450
MATDIMSSGYVTIAIVPFGEQWKKMRRIVVNELFSPLRHQWLQGKRNGEADNIMFYVYNKCKNVNNGGLVNVRDVAQHYCCNVTRKLIFNTRYFGKGREDGGPGLEEVEHVNTIFTLLKHVYAFSVSDYIPCLRILDLDGHKSKVKKGMRTMKKYHDPIIEKRMKQWNDGSKTVEEDLLDVLISLKDVNNNPTLTLKEIKALTI

SEQ ID NO: 135385 - protein, 103 aa, Glycine max
  Coding DNA Sequence Number=SeqID_18607
MPPPKKEWKRQGSSLGMNEWLILESSIAELLLRRKSLTCEGAWLGGFGGEEWAIPLTHLEGLRSELVMQKNRVEKREDCLFIQARRDMSFITVTFMTSFKLDH

SEQ ID NO: 135386 - protein, 244 aa, Glycine max
  Coding DNA Sequence Number=SeqID_18608
  Gene Ontology: Mol. function=monooxygenase activity; Cellular component=integral to membrane; Biological process=electron transport
  Homolog annotation: Hit_ID=Q6J540; Match level="QueryCoverage=100%, HitCoverage=28%, E-value=5e-43, Identity=61%"; Hit description =Cytochrome P450
ACVREAFRLHPVVPFNPPHVSTNDTMVGNYFIPKGSHVLLSRHGLGRNLKVWNNEPHKFKPERHIKNDGSMIVLSEPDLKFISFGTGRRGCPAIVLGSTMTVMLLARLVHAFSWSAPPNVSSVNLVKANNGVMLLEPLVWYNSTANLGFATATSGSARNILMVNTLGGAFQVKPWSNLANNITVIVVSSVIPGQPCLPVSNDINLKWFCQNYIRSISTLKVAFWLELEGFIIPHFWVSPKTTYA

SEQ ID NO: 135387 - protein, 116 aa, Glycine max
  Coding DNA Sequence Number=SeqID_18609
  Gene Ontology: Mol. function=transferase activity, transferring glycosyl groups; Biological process=pyridine nucleotide biosynthetic process
  Homolog annotation: Hit_ID=Q1SHA1; Match level="QueryCoverage=75%, HitCoverage=18%, E-value=2e-32, Identity=66%"; Hit description =Nicotinate phosphoribosyltransferase related
MDGFLDYLRRIDCFDVEVYAIPEGSVVFPMVPILRIEGPIAVISTNDARHHFVVGKTKTLLEFGLRRAQGPDGGVGASKYSYIGAFDATREEKFIKLCVYLAVIMPRVFLETTMPI

SEQ ID NO: 135388 - protein, 64 aa, Glycine max
  Coding DNA Sequence Number=SeqID_18610
MDANIQMMEDFFILIQVLYLPEFRGRVIYASQANYFPDAYAIEPMWGALESLPYVGCTVTNWIN

SEQ ID NO: 135389 - protein, 36 aa, Glycine max
  Coding DNA Sequence Number=SeqID_18611
MTNEGEPKVEKSMANKDKKAMLEKAYSAIMLSVSDK

SEQ ID NO: 135390 - protein, 98 aa, Glycine max
  Coding DNA Sequence Number=SeqID_18612
  Subcellular localization annotation: CTP_CleavageSite=76; ConfidenceScore=5.51e-01
MRPLASFWLILCFFFASLCFLFASIKPSPSLLSGQSFFLCEFYNLSSVRRSCCILGGLRGTPRINSLAAKPVYIVDASNPMPSTIIFAKSLPDVSKIK

SEQ ID NO: 135391 - protein, 51 aa, Glycine max
  Coding DNA Sequence Number=SeqID_18613
MKHTYRRTKQQNPRNRESVGKAVADNNDILNFGEAGERSPTGGLANASHVK

SEQ ID NO: 135392 - protein, 53 aa, Glycine max
  Coding DNA Sequence Number=SeqID_18614
MEKDATLGALSARRDNDLAGRAGCMLGEHISDLSSSRICQLVKQADLPRLASH

SEQ ID NO: 135393 - protein, 36 aa, Glycine max
  Coding DNA Sequence Number=SeqID_18615
MSASGSSSAFSGRTIRQCHYGRRAAIRTARTRRNPG

SEQ ID NO: 135394 - protein, 155 aa, Glycine max
  Coding DNA Sequence Number=SeqID_18616
  Gene Ontology: Mol. function=monooxygenase activity; Cellular component=endoplasmic reticulum; Biological process=electron transport
  Homolog annotation: Hit_ID=Q6J540; Match level="QueryCoverage=94%, HitCoverage=37%, E-value=6e-35, Identity=44%"; Hit description =Cytochrome P450
MVQGTPSRATVSISLMINQPKLLQKAIEVLDNVVGKKRLVQESDIPKLNFVKACAKETVVANYLIPKDSYVLLSIRGLGRNPKVWNEPLKFKPERHLKNDGSDVTPWLPWSAPPNVSTINLAESKRNMFLAEPLVAVAKPGLATELYTMKLSEHL

SEQ ID NO: 135395 - protein, 59 aa, Glycine max
  Coding DNA Sequence Number=SeqID_18617
MIVLSSTSKHALESSLSLDERCNFESEIKSHIELGSEHIFTKLSRHHLFSCSLLEPSDK

SEQ ID NO: 135396 - protein, 67 aa, Glycine max
  Coding DNA Sequence Number=SeqID_18618
  Subcellular localization annotation: CTP_CleavageSite=39; ConfidenceScore=5.81e-01
HPKGTPPTKHHPFVPPIFVSRSKSRSRMRRQSVTSCVAVAAMSSGCSWTSSSRGRQGRSEPECEGAP

SEQ ID NO: 135397 - protein, 205 aa, Glycine max
  Coding DNA Sequence Number=SeqID_18619
MVNAQQNPHPAMQMLSSVEAFDLNIYKSCFGYFGFRERERCTHLDFTYSFQQNFRAKLKTHLNLKRCYKEEDKSTELCYKESEKKGFDQLWDCKSGSGRKKKSPYTHHPSLIKIWIAAVYNSQNTNAFNSQQQQQQQPQCLMEMSLQRTSSENNSGRNREEQEPSNKETTMEAPASGDDDQDLEEGFKRRRHTRHTHHQISEMES

SEQ ID NO: 135398 - protein, 414 aa, Glycine max
  Coding DNA Sequence Number=SeqID_18620
  Gene Ontology: Mol. function=protein binding
  Homolog annotation: Hit_ID=Q1PED9; Match level="QueryCoverage=64%, HitCoverage=71%, E-value=2e-21, Identity=31%"; Hit description=F-box family protein
  Pfam annotation: Domain name=F-box; Domain location=27-74; Score =34.0; E_value=5.2e-07; Accession=PF00646.23; Description=F-box domain
  Pfam annotation: Domain name=FBD; Domain location=331-380; Score =24.6; E_value=0.00035; Accession=PF08387.1; Description=FBD
  Pfam annotation: Domain name=LRR_2; Domain location=177-202; Score =16.2; E_value=0.095; Accession=PF07723.3; Description=Leucine Rich Repeat
  Pfam module annotation: Pfam domain module=F-box::FBD::LRR_2; Domain location=27-74::331-380::177-202
MIEEGLSTCKAKFQKLNNKVNVDGHKDWIGNLPNEIIQHILSLLPTKDAVKTSVLSRRWHSQWMFVRNLDFAEFPPNMNQKRKLFMDFVDRVIALRKPLDLNLFALVCEVFTDASRINSWVCAAVKHNVQHLLLVLDQIHLEPLELPHCLFTCDTLRKAFIVADILLNLPSSIHFSNLKLLTLQYVVFPGYESTQRLFSGLPVLEELTLDSCCWLNVEIVTIALPMLKKLDIKENLADQDNCQFFIIAENLNSFYYIGTLRNDYWIYNSVSLDWGLMGLCSTDDIGESSRLREVAQRAGRLLRGISCAKELLLTPYAFEGVCLSGNHEEGSWILDPVPSCFSRYLKLIRISQFCGTDGELQVVKSLLKHAEILLQMDIICHHEKFSDGLARERDVLEKLQMLPRASTYCTINIS

SEQ ID NO: 135399 - protein, 372 aa, Glycine max
  Coding DNA Sequence Number=SeqID_18621
  Gene Ontology: Mol. function=protein kinase activity; Cellular component=integral to membrane; Biological process=protein amino acid phosphorylation
  Homolog annotation: Hit_ID=Q5ZBB1; Match level="QueryCoverage=64%, HitCoverage=32%, E-value=1e-44, Identity=39%"; Hit description=Dual -specific kinase DSK1-like
  Pfam annotation: Domain name=Fer4; Domain location=122-145; Score =3.8; E_value=0.094; Accession=PF00037.17; Description=4Fe-4S binding domain
  Pfam annotation: Domain name=Pkinase; Domain location=168-369; Score=- 17.7; E_value=1.7e-07; Accession=PF00069.15; Description=Protein kinase domain
  Pfam annotation: Domain name=Pkinase_Tyr; Domain location=175-370; Score=-33.1; E_value=1.9e-10; Accession=PF07714.7; Description =Protein tyrosine kinase
  Pfam module annotation: Pfam domain module=Fer4::Pkinase::Pkinase _Tyr; Domain location=122-145::168-369::175-370
MHRRPQGEEKSSGKLIINDCIMDQTIFNQLSEFEEQMPSTFHWEGITTQKISVNHMISPTKGDQLSQDQEEEINFIEMKIGLIPKPISGMIDQTKVDQLVQDKTQTQRRCHDDLLDGRQGEIILENSKSSACSICKSRCPNNAWKKDFNYEELLEATEGFSIENSLSEREDEPTFEGLLERQVKIVVKKYQVTTSHQEMILKSEVQLFISARHKNVVMLLGLCTNKSRLMIVYEQVCNGSLEQYLTRGSCQPLTWKQRLKVAMGTARGLKYLHGNNIIHGNIKPSNILLTHDFEPRIGDFDFGKVKHGPKKSSKDKSVWNSGYAIPEYVENGKVSNKTDVYSFRVVLLELISGRRATDKLPGGKSLVSWDEP

SEQ ID NO: 135400 - protein, 647 aa, Glycine max
  Coding DNA Sequence Number=SeqID_18622
  Gene Ontology: Mol. function=sequence-specific DNA binding; Cellular component=nucleus; Biological process=regulation of transcription, DNA-dependent
  Homolog annotation: Hit_ID=Q38887; Match level="QueryCoverage=99%, HitCoverage=93%, E-value=0.0, Identity=60%"; Hit description =Meristem L1 layer homeobox protein
  Pfam annotation: Domain name=START; Domain location=167-386; Score =199.9; E_value=6e-57; Accession=PF01852.10; Description=START domain
MKSKESAWSRARIGAFANQTQQERYENNLLRVENDKLRAENRRYRNALANALCPSCGGPTALGEMSFDEQQLRIENARLKEEIASMSGPAAKHAGKSGSNSYCNMPSQNQMPSRSLDLGVGNNNKNNNFVAVAQAQPAAMVGEIYGGNDPLRELPLFSCFDKTLIGEIGLVAIEEINRLSLSGDPLWVPGNYGSEVVNEDEYLRVFPRGIGPTLLGARTESSRQTAIVIMHHMKLVEMLMDVNQWSNMFCGIVSRAVTHEVLSTGETIRYDGACQVMSAEFQVPSPLVPTRDNYFIRFCKKHQGQSWAVVDFSMDHLRPGAITKIRRRPSGCIIQELPNGYSKVIWVEHVEVDDSEVHNLYKNLVDSTLAFGAKRWVAAIDRTCERLASAMATNIPQGALCVITSHESRKSMMKLAERMVLSFCTGVGASTANAWTPLPSGLEDVRVMTRKSVDDPGRPPGIVLSAATSLWLPVPARRVFEFLRSENTRNQWDILSTGAQVNELAHIANGRDHGNCVSLLRVNTQNVGQNNMLILQESFIDATGSFVIYAPIDVAAINVVLGGGNPDYVALLPSGFAVLPDGPGLNGGPGPICEAGSGGGCLLTVAFQILVDSAPTSKISVGSVTTVNSLIKRTVEKIRDAVSLDGN

SEQ ID NO: 135401 - protein, 189 aa, Glycine max
  Coding DNA Sequence Number=SeqID_18623
  Gene Ontology: Mol. function=binding; Cellular component =mitochondrial inner membrane; Biological process=transport
  Homolog annotation: Hit_ID=Q01GI9; Match level="QueryCoverage=91%, HitCoverage=21%, E-value=7e-21, Identity=37%"; Hit description=[C] KOG0764 Mitochondrial FAD carrier protein
  Pfam annotation: Domain name=Mito_carr; Domain location=73-172; Score= 54.2; E_value=4.2e-13; Accession=PF00153.17; Description =Mitochondrial carrier protein
PLDTASSRMQTSEFGKSKGLWKTLSEGTWSEAYDGLGISILLTTNPSIQLKQRILKGKISNRTGTKSSPEALSAFYAFMLGAVSKCAATILTYPAIRCKVMIQAAESEDDKSTEAERKAQRTISGALYTIWKREGILGFFKGLQAQILKTVLSSALLLMVKEKIAKSTWILMLVIGRYLSVNSPKLKAV

SEQ ID NO: 135402 - protein, 93 aa, Glycine max
  Coding DNA Sequence Number=SeqID_18624
MQQGQTYITIIGFPDPNYGVKAVNENKLPSLIMSSPLAPLYISQRPLSFTFVSPKAKFYIPNRRKFSIYFKNKILPSKLVLLSINPLVEHNSC

SEQ ID NO: 135403 - protein, 91 aa, Glycine max
  Coding DNA Sequence Number=SeqID_18625
MKMHKTIKRAPKCPWIKFNFLKANTNRMKNEARMKNDVEIDCSRDLAQNKAFGMKVARLGELLLHFEATLLAKASWLLHHEIIWWPRRARG

SEQ ID NO: 135404 - protein, 224 aa, Glycine max
  Coding DNA Sequence Number=SeqID_18626
  Gene Ontology: Mol. function=nucleic acid binding; Cellular component= beta-galactosidase complex; Biological process=DNA integration
MVPKVLPCHRQLRNCQQKCTIQLLEETDFTSASLQAYPWIPTLNSRGCTGRLLNQLLYLTVDSPNARYHLFAVNKLSQFMSAPQTPHLQALLHISQYLTASPGQCILFPSQSATKLTAYVHADWGSFQVTRKLTTWFCVSLRGPFISWKSKKQATVAKSSAVAEYRSLACLPLATNPTANKRTKHVDIDCHFIKHHIISGFLNLVYLPSQQQLADVLTKALPSA

SEQ ID NO: 135405 - protein, 233 aa, Glycine max
  Coding DNA Sequence Number=SeqID_18627
  Gene Ontology: Mol. function=protein serine/threonine kinase activity; Cellular component=cell cortex; Biological process=protein amino acid phosphorylation
  Homolog annotation: Hit_ID=O22042; Match level="QueryCoverage=93%, HitCoverage=39%, E-value=6e-83, Identity=66%"; Hit description =Mitogen-activated protein kinase kinase kinase 3
  Pfam annotation: Domain name=Pkinase; Domain location=49-232; Score =73.3; E_value=7.9e-19; Accession=PF00069.15; Description=Protein kinase domain
  Pfam annotation: Domain name=Pkinase_Tyr; Domain location=49-227; Score=-65.1; E_value=1.8e-08; Accession=PF07714.7; Description =Protein tyrosine kinase
  Pfam module annotation: Pfam domain module=Pkinase::Pkinase_Tyr; Domain location=49-232::49-227
MQDFLGSLRRSLVFRPGGDDSPFAGIANKLGSAIRKSRIALEPPPPIRWRKGELIGSGGFGHVYMGMNLDSGELIAIKQVLIAPGSVFKENTQRYLGTAREEDSLNILLEFVPGGSISSLLGKFGSFPESVIKMYTKQLLLGLEYLHDNGIIHRDIKGANILVDNKGCIKLTDFGASKKVVELATINGAKSMKGTPHWMSPEVILQTGHTIERKDLSVVTWSYREILILYNSY

SEQ ID NO: 135406 - protein, 330 aa, Glycine max
  Coding DNA Sequence Number=SeqID_18628
  Gene Ontology: Mol. function=protein serine/threonine kinase activity; Biological process=protein amino acid phosphorylation
  Homolog annotation: Hit_ID=Q40541; Match level="QueryCoverage=75%, HitCoverage=42%, E-value=9e-25, Identity=34%"; Hit description =Protein kinase
MESEILAVVNSLFFLCSDSALFIICSIHSSPATIMDLIQYYAVQSGLDSVQGSTCTGLKDVCQIDSIQFSTVYHKADSYQRASNNDDDMCEMDEDDFFIDSSVKSKSLLASDDMKSFNPMCKPLDDRPCNFDETQYLEKNRPNLPFSSEALGTEDDDEVTESKIRDFLDAKALELKKLQTPLYEEFRSISNAAIAPAPIKVAKSKVMSDVSNVTSSIGRSASQAWRRFSMVGSANVASPGGSHTKYRSKLSGAHCRPLQEIQPSDLNQSKETLHNAELESSSVSSSFSERQRKWKEELVEELEWKRGKERADIATELGNVHNKMDLDLAP

SEQ ID NO: 135407 - protein, 73 aa, Glycine max
  Coding DNA Sequence Number=SeqID_18629
MPSAVHVSSTYEFGAMRTDCLVQFSVLAFFSEPHECHCLVLFMHPAPTSLEPREGIAFHCSPILHSPLFFGAP

SEQ ID NO: 135408 - protein, 95 aa, Glycine max
  Coding DNA Sequence Number=SeqID_18630
PFILEEEAGETQARQEAAATLERSLEDTSEPLAPVVDLSSPQHAAEPSTPILKIPEDPTTPVLTLNTSPSATPVLHLTDEEDVQTQDTQDQSHEF

SEQ ID NO: 135409 - protein, 280 aa, Glycine max
  Coding DNA Sequence Number=SeqID_18631
MVFLLLCSFSVSSEPHSSFSKSDLENDLDFYVASRSRLGGNFNAQNLIPEDVKDKSSLLSTRNKYSTKDEKCRSMPNSSKQMPSHYSNSTLQEELGAHNSWQFEERNPSVDKSSVAAPFCLDLEADFAVFGSKNKIVDPFSVFTTPELSNKVKASPSSGGFKKAAPLADSPPCSFTSEKFAFDCSTAFPNVGSWPTSPRLSPDFQTKGKKSEDKKENVRICSIFQKSYPKTTTQCLVEADSSDHVEEISSLLKKPDKQGNQLGLSAYACTDGIEGGMYMM

SEQ ID NO: 135410 - protein, 142 aa, Glycine max
  Coding DNA Sequence Number=SeqID_18632
  Gene Ontology: Mol. function=RNA-directed DNA polymerase activity; Cellular component=nucleus; Biological process=RNA-dependent DNA replication
  Homolog annotation: Hit_ID=Q1S4N5; Match level="QueryCoverage=49%, HitCoverage=13%, E-value=3e-16, Identity=53%"; Hit description =Peptidase M, neutral zinc metallopeptidases, zinc-binding site
MDTNSYDLGNGAKSIVNMKQVTSNRFEIFIDEDDVSTTKVDMEVVPNTPMDIQVNALGLDGFRPIFYQTYWDTAGNEVWDLVAQAFATREINPGLEETQVIPIPKVNNPTTLKDFHPISLCNGLLKTYPRFWSRELDLTWMS

SEQ ID NO: 135411 - protein, 174 aa, Glycine max
  Coding DNA Sequence Number=SeqID_18633
  Subcellular localization annotation: CTP_CleavageSite=57; ConfidenceScore=5.07e-01
MQVTRPYESLFIDVYASLLRCCFFFLASSSFPILPIVHILCYSLSSALRSLSSSPFMQQAFSSSLWFLIFFVVHWLDAFLFSFEIMVRTRDLGWALGRAIGKALGKREVSGDDNDVPNGKGLPHFPVEELNEEQKQPPVEQRVTNVEGFPDKPHDRSILRDFETCVALRAWNGE

SEQ ID NO: 135412 - protein, 85 aa, Glycine max
  Coding DNA Sequence Number=SeqID_18634
MRVHITLGSLQEVGFASWLITGHKRPSPFGFIARSGYNFLVVITGHKGPTFLEDSGNLRRVAWGLDVGTGCDRTGINPVLHSLFP

SEQ ID NO: 135413 - protein, 59 aa, Glycine max
  Coding DNA Sequence Number=SeqID_18635
MIMVRTRDLGWDLGRAIGKALGKKEVSGDDNDVPSGEGLSDFPIDSDKRCVLLRIRLLS

SEQ ID NO: 135414 - protein, 312 aa, Glycine max
  Coding DNA Sequence Number=SeqID_18636
LSLKLPSINNGSGVEAEKSQFLEFSMNLLTTTLRLSKPLNYGSALVKEFYPNLYDPEDRSPKQCKVQGKLIKFDATTLNEFLKTPVVLEPGERKDLTTLAETWSVLSYSNLAPTSHTSDFNMDKARLVYGLVMRMDMDVGSIISGQISQMAQSNSSRLGFPLLITTLCIARGVVPDSLTFKFFSPTINLAYIRKNCWNPDDPTITFPRSRKANARATSDASTSTLAPTPAPVPAPVPPTPVSIPVGPSMQSTDAIVLMLQSLHHDLCPTQAPGDAEDTPANTAADQAVEDDTPEAGDAEETLAATLIEITEE

SEQ ID NO: 135415 - protein, 92 aa, Glycine max
  Coding DNA Sequence Number=SeqID_18637
MDNRENRERRRSKEEEVATKERSRKGEGHFSPFTLDDLCPSKNVCCPKQHPKTRPTTFNTKLNAPLVGGTVELEYSWWNGGWHKAKWRVDAR

SEQ ID NO: 135416 - protein, 194 aa, Glycine max
  Coding DNA Sequence Number=SeqID_18638
  Gene Ontology: Mol. function=protein-tyrosine kinase activity; Cellular component=mitochondrion; Biological process=protein amino acid phosphorylation
  Homolog annotation: Hit_ID=Q9C5T0; Match level="QueryCoverage=80%, HitCoverage=23%, E-value=1e-40, Identity=56%"; Hit description =Receptor-like protein kinase 4
  Pfam annotation: Domain name=Pkinase_Tyr; Domain location=93-193; Score=-153.1; E_value=0.0045; Accession=PF07714.7; Description =Protein tyrosine kinase
  Subcellular localization annotation: CTP_CleavageSite=51; ConfidenceScore=5.67e-01
MNAPPSLTPQPFPSPPPSIPARFKKGMSKSGRTVIAIIMPIVSISTFVIFTCMYLTGRNRKNFESESEAEYEIEPTETLQLDFQTIIDATNNFADANKVGQGGFGPVYKGRLPNGKEVAIKRLSRGSGQGDIEFKNELLLVAKLQHRNLVRLLGFCLETGERILVYEFLPNKSLDYFIFGNTISACLPCISLFG

SEQ ID NO: 135417 - protein, 669 aa, Glycine max
  Coding DNA Sequence Number=SeqID_18639
  Gene Ontology: Mol. function=protein serine/threonine kinase activity; Cellular component=mitochondrion; Biological process =protein amino acid phosphorylation
  Homolog annotation: Hit_ID=Q9XED4; Match level="QueryCoverage=97%, HitCoverage=97%, E-value=1e-167, Identity=48%"; Hit description =Receptor-like protein kinase homolog RK20-1
  Pfam annotation: Domain name=DUF26; Domain location=192-246; Score =68.2; E_value=2.7e-17; Accession=PF01657.8; Description=Domain of unknown function DUF26
  Pfam annotation: Domain name=DUF26; Domain location=77-131; Score =51.4; E_value=3e-12; Accession=PF01657.8; Description=Domain of unknown function DUF26
  Pfam annotation: Domain name=Pkinase; Domain location=360-609; Score =126.7; E_value=6.4e-35; Accession=PF00069.15; Description=Protein kinase domain
  Pfam annotation: Domain name=Pkinase_Tyr; Domain location=360-609; Score=87.4; E_value=4.3e-23; Accession=PF07714.7; Description =Protein tyrosine kinase
  Pfam module annotation: Pfam domain module=DUF26::DUF26::Pkinase::Pkin ase_Tyr; Domain location=192-246::77-131::360-609::360-609
MVSPKVLSFFFLLFTLISQATAKPEYPYAVCITEGGDYAPNSTYQTNLNTVLSRIISTTQNDYGFYNSSYGQEPDRVYANGLCRGDVTPHACLTCLNNSHLLLLKQCPHQKRAIGGYAECMLHYSYRSVLGYYDSDFRVYLQSKTNVKDWDQYSYVLMKLLSRLKVKAATTDSYLNRKYASGNATIPGSQTIYAVVQCAPDLTVAQCNDCLDGAISEIPKCCNHMSGGVVIKFRCNFRYESSRFYEPTADTLTLQLSPQGSPSPSPTPASTTANYPESTYHGINYYNMARRKGNKSQAAIAKYVVPIVVFVGFLIFVCIYLRVRKPTKLFESEAKVDDEIEQVGSSLFDFDTIRVGTNNFSPANKLGQGGFGPVYKGMLFNEQEVAIKRLSSNSGQGEIEFKNEVLLMSRLQHRNLVRLLGFCFEREERLLVYEFLPNKSLDYFLFDPIKRAHLDWKTRYKIIEGIARGLLYLHEDSQRRIIHRDLKLSNILLDADMNPKISDFGFARLFNVDQTLFNASKIAGTYGYMAPEYARHGKLSMKLDVFSFGVIILEIAWTNLRKGTTANIIDPTLNNAFRDEIVRCIYIGLLCVQEKVADRPTMASVVLMLESHSFALPVPLQPAYFMNNSCLSDIQFLGCSSAETGSNEQRSNSADVSANEASISSLYPR

SEQ ID NO: 135418 - protein, 675 aa, Glycine max
  Coding DNA Sequence Number=SeqID_18640
  Gene Ontology: Mol. function=protein serine/threonine kinase activity; Cellular component=mitochondrion; Biological process =protein amino acid phosphorylation
  Homolog annotation: Hit_ID=Q9XED4; Match level="QueryCoverage=98%, HitCoverage=100%, E-value=0.0, Identity=57%"; Hit description =Receptor-like protein kinase homolog RK20-1
  Pfam annotation: Domain name=DUF26; Domain location=193-247; Score =105.0; E_value=2.2e-28; Accession=PF01657.8; Description=Domain of unknown function DUF26
  Pfam annotation: Domain name=DUF26; Domain location=80-134; Score =76.7; E_value=7.2e-20; Accession=PF01657.8; Description=Domain of unknown function DUF26
  Pfam annotation: Domain name=Pkinase; Domain location=344-614; Score =162.7; E_value=9.1e-46; Accession=PF00069.15; Description=Protein kinase domain
  Pfam annotation: Domain name=Pkinase_Tyr; Domain location=344-614; Score=137.6; E_value=3.5e-38; Accession=PF07714.7; Description =Protein tyrosine kinase
  Pfam module annotation: Pfam domain module=DUF26::DUF26::Pkinase::Pkin ase_Tyr; Domain location=193-247::80-134::344-614::344-614
MAMVSRMPIFLCILVILISISQSNAQPGFLYHFCINDKGNYSANSTYQNNLNTLLSNLSSNTQIDYGFYNFSYGQESDRVNAIGLCRGDVKPDACRICFNDSKVLLTQLCPNQKEAIGWYDNCMLRYSNRSIFNTMEALPSFSMRNHGNTTDVDQFNQVLRTLLYSLVGQGSSGDSRHKFAAANVSGPGFETIYGLVQCTPDLSEQECTSCLVDAISEIPRCCDSKKGGRVVRPSCNFRYETYPFYTPTNVAIPQAPAPKVSALPPSSTDTLSPEGKSNTSLIVIAIVVPIIAFVILVILILIYLRMRRSREHIEVELENDDEIRSAETLQLDFSTIVAATNNFSDANELGQGGFGPVYKGTLSNGKEVAVKRLSRNSLQGDIEFKNEVLLVAKLQHRNLVKLLGFCLERSERLLVYEFVPNKSLDFFIFDQNRRAQLDWEKRYKIIGGIARGLVYLHEDSRLRIIHRDLKASNILLDAEMHPKISDFGMARLFEVDQTQGNTSRIVGTFGYMAPEYAMHGQFSVKSDVFSFGVLILEIVSGQKNSWVCKGENAGDLLTFTWQNWRGGTASNIVDPTITDGSRNEIMRCIHIALLCVQENVADRPTMASVVLMLNSYSVTLPLPSLPAFFIDSRSFPAIQSEEYNPMAAGASDESNARSVQESINEASITEPFPR

SEQ ID NO: 135419 - protein, 400 aa, Glycine max
  Coding DNA Sequence Number=SeqID_18641
  Gene Ontology: Mol. function=protein serine/threonine kinase activity; Cellular component=anchored to membrane; Biological process=protein amino acid phosphorylation
  Homolog annotation: Hit_ID=Q1T3J0; Match level="QueryCoverage=72%, HitCoverage=51%, E-value=9e-76, Identity=45%"; Hit description =Protein kinase
  Pfam annotation: Domain name=DUF26; Domain location=198-252; Score =65.8; E_value=1.4e-16; Accession=PF01657.8; Description=Domain of unknown function DUF26
  Pfam annotation: Domain name=DUF26; Domain location=81-135; Score =72.6; E_value=1.3e-18; Accession=PF01657.8; Description=Domain of unknown function DUF26
  Pfam module annotation: Pfam domain module=DUF26::DUF26; Domain location=198-252::81-135
  Subcellular localization annotation: CTP_CleavageSite=55; ConfidenceScore=5.22e-01
MFLSNKHVDVTFLLFLFMFEIGSSSAAPVYNANYCPNNTSYNSNVTFQTNLRVLLASLVSNVSQSDGSYNSAMGMGTTSVASGQFLCRGDVSPATCQDCIASAATEITRLCPNKTESIIWYDECTLRFTNRYFAPTSIDPGARLSDDKNISASDLDSFNQTLFGLLNELVEEAANSQSARKFATGESEFAGSSPERTVYALTECEPSLTIAQCEECLQNAVSTLPSCCGGKQGARALLAWCNVRYELFQFYNTSGSSAPSSESDTLESLQFGLPTVEAATKKFSHENRIGEGGFGEVYKVPVLRQLWNSHHSHSVVQPRKRPLGGMIIACYATQIAQYSRPWNLTLRTFCGFNNATDMDQFNEGLRGIVDGLRSKAASGNSLKKYAAGSAAGPSFQAEFS

SEQ ID NO: 135420 - protein, 454 aa, Glycine max
  Coding DNA Sequence Number=SeqID_18642
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=98%, HitCoverage=77%, E-value=1e-132, Identity=51%"; Hit description =Protein kinase
  Pfam annotation: Domain name=DUF26; Domain location=55-109; Score =68.6; E_value=2e-17; Accession=PF01657.8; Description=Domain of unknown function DUF26
  Pfam annotation: Domain name=Pkinase; Domain location=184-405; Score =60.8; E_value=4.5e-15; Accession=PF00069.15; Description=Protein kinase domain
  Pfam annotation: Domain name=Pkinase_Tyr; Domain location=184-405; Score=11.5; E_value=3.5e-13; Accession=PF07714.7; Description =Protein tyrosine kinase
  Pfam module annotation: Pfam domain module=DUF26::Pkinase::Pkinase _Tyr; Domain location=55-109::184-405::184-405
LSDDRNISASDLDSFNRTLFSLLNDLAEEAANSQSAKKFATGQSRFDGSSPQRTVYALAECAPTETSTQCEECLKNAISTLPSCCGGKQGARALLAHCDVRYELFLFYNTSGTSGNKKSVSRVILIVVPVVVSVFLLCGVCYFILKRSRKRYKTLLRENFGEESATLEALQFGLATIEAATNKFSYERRIGEGGFGVVYKGIFPDGREIAVKKLSRSSGQDPYKSKQLSWSERYKIIEGITQGISYLHEHSRLKVIHRDLKPSNVLLDSNMNPKISDFGMARIVAIDQYQGRTNRIVGTYGYMSPEYAMHGQFSEKSDVFSFGVIVLEIISAKRNSRSAFPDHDDLLSYAWEQWMDEAPLNIFDQSIKAEFCDHSEVVKCIQIGLLCVQEKPDDRPKMAQVISYLNSSITELPLPKKPINSRQSGIVQKIAVGESSSGSTPSINEMSVSIFIPR

SEQ ID NO: 135421 - protein, 93 aa, Glycine max
  Coding DNA Sequence Number=SeqID_18643
MCSVGGTNVEELDDDDDEDEPITVEDEVHAGLNKEFTHENVEHAEHETDSYMGGFEANNGQQPYIRMKFESNKNVGLSYACYAKSVGFGGSIE

SEQ ID NO: 135422 - protein, 127 aa, Glycine max
  Coding DNA Sequence Number=SeqID_18644
  Homolog annotation: Hit_ID=Q1T2G4; Match level="QueryCoverage=39%, HitCoverage=21%, E-value=1e-10, Identity=64%"; Hit description =Regulator of chromosome condensation, RCC1
MGEWEIPIGENASHLVYAALLLPESVGALEMIAENFNIHQGLQNLMHMHNFIKGLDLQVVENVEEAGFVLAHGTKILGNADVNAHSMKLEDMDRILDPYVSKGTPTVVTNPNYVNVEQEGIFRKEGS

SEQ ID NO: 135423 - protein, 88 aa, Glycine max
  Coding DNA Sequence Number=SeqID_18645
  Gene Ontology: Mol. function=nucleic acid binding
MDLDLALRMERPTSTPKASNERFIPEAFQGSISEGENAKKFIDEIEPYSTKNEKAETSNFLAKLISIKYKGKSNTREYIRKFLTWHLN

SEQ ID NO: 135424 - protein, 93 aa, Glycine max
  Coding DNA Sequence Number=SeqID_18646
MEWYLWHLVRQQAANHRGQVQTLGCLYQLSLCLQSQGFAPFACPTPDQFRAEVAWPGDWPEAQAGEAPDGAGDAHMDEEMTDLLDLLGGSGAT

SEQ ID NO: 135425 - protein, 146 aa, Glycine max
  Coding DNA Sequence Number=SeqID_18647
VAVSPAKPPPKPDPEVDDPLYLTTLTISELFLRPYQVTWDATVFGVFNPDFPLYIKLEDLSEIAHGGQCLNISVLQLWILHLTETCMRAGNSDIYGFLEPQSIQRSRQSQFESESYIKTWMQSSKRDVYLGAYLNGPDNYLKGIIN

SEQ ID NO: 135426 - protein, 199 aa, Glycine max
  Coding DNA Sequence Number=SeqID_18648
  Gene Ontology: Mol. function=NADH dehydrogenase (ubiquinone) activity; Cellular component=integral to membrane; Biological process=ATP synthesis coupled electron transport
  Homolog annotation: Hit_ID=UPI00003CC695; Match level="QueryCoverage =97%, HitCoverage=39%, E-value=4e-66, Identity=63%"; Hit description =COG1008: NADH:ubiquinone oxidoreductase subunit 4 (chain M)
  Pfam annotation: Domain name=Oxidored_q1; Domain location=1-104; Score=-84.0; E_value=0.0025; Accession=PF00361.10; Description=NADH -Ubiquinoneplastoquinone (comple
MKKLIAYSSISHMGFVTLGFFMFGQLALEGAMVQMISHGFISSAMFLSVGVLYDRVHSREISAYGGVVNKMPVFAAFAVLFAMANSGLPGTSGFVGEFMVILAAVKFNFWVAFFAATTLIFGAAYTLWMTKRVFFGNVTNHHVAELSDLNKREFLILGILAVLVIGFGVYPEPLTEVMQATSTEFLKHMAISKLPVTGY

SEQ ID NO: 135427 - protein, 44 aa, Glycine max
  Coding DNA Sequence Number=SeqID_18649
  Gene Ontology: Mol. function=ATP binding; Cellular component =mitochondrion
  Homolog annotation: Hit_ID=Q2PMM5; Match level="QueryCoverage=77%, HitCoverage=1%, E-value=6e-13, Identity=100%"; Hit description =Protein ycf2
MDTNFWLLLSIGNRSEKVSKNMKFRYLYPVEVRNHGVPEMSAIE

SEQ ID NO: 135428 - protein, 119 aa, Glycine max
  Coding DNA Sequence Number=SeqID_18650
MVSRYTLNEIATKYEHIPYAGKNPTRCGCVMRSTHGLPCAYSIENIIDVKADGNCGYRAIAALLGMGEETWSLVYNYLHKELTSWSEEYINLLDSCLRPDVTCYCGCVILTGKCCESCK

SEQ ID NO: 135429 - protein, 298 aa, Glycine max
  Coding DNA Sequence Number=SeqID_18651
  Gene Ontology: Mol. function=monooxygenase activity; Cellular component=intracellular
  Homolog annotation: Hit_ID=Q2KA73; Match level="QueryCoverage=97%, HitCoverage=66%, E-value=2e-79, Identity=52%"; Hit description =Putative monooxygenase protein
MATSSSRRIRLGLFVQPVGQHVSGWRLTENLGDPTDIDWLITIAKKAEAGKFDLFFVGDALATSMYRLPSTMARLEPLTLLSALAVNTKRIGLAATASTTFSDPFTMARSFSSLDHISRGRAAWNVVTSFSTDVARNFSRSDMPNHAERYARAREFLDVTYKLWDGWQAGAVQPNKETGQYFIDDKIQPINHVGEHFQVQGPLNITRSPQGRPVIIEAGSSSDGQKLAAETAEVIFTASASLEEAQSFYRSQKDQVIAAGRNPDHVVIMPGVMPIVGRTREEAKALWKELNTLVDIDN

SEQ ID NO: 135430 - protein, 169 aa, Glycine max
  Coding DNA Sequence Number=SeqID_18652
MKFSKNDKSKDEGRTKAIRKTIYETICPYVLPHDDLLQSNTSQNSHDSDSSITRVVDTEFFNNLALVEGASVKVVRRQVVVVLVVGVTVNDRGKIDEDKWMHDNVISEEVDMNEENEDEPGVYQQVDCSDAFNNFSAEWRRKKDDWRCHFKDNMSQEEAHHHRKPWIRA

SEQ ID NO: 135431 - protein, 129 aa, Glycine max
  Coding DNA Sequence Number=SeqID_18653
MEGRKRRSPFLMWRIPKHSADWLAKLKVVSEESFEAPKEDEEVQALKSELGKVKLAKEKPSWPLHTFGRSVPGYGKRMQLPQEPLNKKPRGLARKSMAGIIFAELYGVAIVNSSCEGKRGTSREHIAWF

SEQ ID NO: 135432 - protein, 251 aa, Glycine max
  Coding DNA Sequence Number=SeqID_18654
MEAMKEQMATMMEAMMSMKKIMEANAVAVSATSAVAKVNPMPPSGLNQINHPIPNMVGLEGKELGGTGGPHLVRKTSMPSRHMPCLLIIHHRLILIESQQPQSNHAHVSQPMGETHEMPHHNLADFEPCLGYATEGQAVGEMGKLDHIEERLKVVEGSGGYAFDNLEELFVVPNIITPPMFKVLDFDKCKGTTCPKNHLKMYCRKMGAYAKDEELLIHFFQKSLTGVVVTWYINLEPSQVHSWKNPNGCLH

SEQ ID NO: 135433 - protein, 117 aa, Glycine max
  Coding DNA Sequence Number=SeqID_18655
MYQYSFEGHDTDMSASEHSYGGVAETHPHFSWPTMTPSQQHDAPMATPNAPLAPQWNVPGAIPDMGDLLGVDLRHEFSAEAEQQGRRQWARRNPDREAQRWDRPCGTGSRHHGHHND

SEQ ID NO: 135434 - protein, 156 aa, Glycine max
  Coding DNA Sequence Number=SeqID_18656
  Subcellular localization annotation: CTP_CleavageSite=69; ConfidenceScore=5.10e-01
MGQPYTLFLFAGFQQGPYNQQGQWRTHPGNQFNKDQNGPSNRPIQQGPNIFQRTTKLEETLTQFMQVTMSNHKSTESALKNLEVQVGQLVKQITDKSSNSFVANTEHNPKEECKAVMTRSKRFVEVEDEDSVVHKKKTVDKKGIDGDAILSRKGIG

SEQ ID NO: 135435 - protein, 232 aa, Glycine max
  Coding DNA Sequence Number=SeqID_18657
  Gene Ontology: Mol. function=transporter activity; Biological process= transport
  Homolog annotation: Hit_ID=Q1XPJ7; Match level="QueryCoverage=93%, HitCoverage=53%, E-value=1e-46, Identity=41%"; Hit description=Outer membrane efflux protein
MEKKVIYNQEQQKLYRGQISSIEKLTKSYQNQLNLGNISKSEYVRLKAQEIEFKKKLISLQQEIAEQQVELKALLILPATSYLVITDHLSIPEKELSELELPNWLNMAKENRPDIQITKNKEKYAQKNLELQRALRTPDIALSMGYDRGGNIMKDFVGLGISFDLPVFDRNKGNIQEAKLEVTKSNFETRKNILKSENEIVSVFQNYTRTQKISEELDGSDESNFGWSIGQS

SEQ ID NO: 135436 - protein, 343 aa, Glycine max
  Coding DNA Sequence Number=SeqID_18658
  Gene Ontology: Mol. function=oxygen transporter activity; Cellular component=flagellin-based flagellum; Biological process=flagellum organization and biogenesis
  Homolog annotation: Hit_ID=UPI00005F8D0B; Match level="QueryCoverage =98%, HitCoverage=72%, E-value=6e-96, Identity=57%"; Hit description =COG1345: Flagellar capping protein
  Pfam annotation: Domain name=Flagellin_IN; Domain location=129-186; Score=40.1; E_value=7.6e-09; Accession=PF07196.3; Description =Flagellin hook IN motif
  Pfam annotation: Domain name=FliD_C; Domain location=223-343; Score= -9.4; E_value=9.1e-06; Accession=PF07195.2; Description=Flagellar hook-associated protein 2 C-
  Pfam annotation: Domain name=FliD_N; Domain location=10-107; Score =90.8; E_value=4e-24; Accession=PF02465.8; Description=Flagellar hook- associated protein 2 C-
  Pfam module annotation: Pfam domain module=Flagellin_IN::FliD_C::FliD_ N; Domain location=129-186::223-343::10-107
MASVSNLNAGTNLGLSDLYDQLQTAEQANLTPITTQQTSYKAKLSAWGIVQTALQKVQTAAAALKDTSAIASTKVSSTNTAFTATLANDAAAGNFSVEVTQLAKTQSLLSKSATSKDADLGDSSQASRTITITQPGQKDPMTITLSKDQTSLTDIKDAINKQQGSVTASIIKSDDNTYYLALTSRDTGTTNEMTVSTDDSALAQYIGFTKGGGSNGMTEQVEAADAKLSINGVAITRSSNTITDAPEGVTLSLTKTNTGSPETLSVTKDNAPMIAAVQAYVDAYNSLQTTIGNQTKYTAVDQGSTSQDSSNGDLIGDGTLRNIQTSLRSKLSTSAQSGGSISL

SEQ ID NO: 135437 - protein, 179 aa, Glycine max
  Coding DNA Sequence Number=SeqID_18659
MLSFDFRHVTELHGLRNDGCQVPRSGQTRVASQQTNGPRTKLGYDNEILAPKFGSTNSNSRALLEHKISCSSLLLPSFISFFLQALIHGLLWCDVSSLSSFSILLPFIFQEAKESIDEEDPSPTSSNGAYINLSNTFLNGLIQKEVYVEQPSGFESETLPHHVFKLNKSLYGLKQALRA

SEQ ID NO: 135438 - protein, 62 aa, Glycine max
  Coding DNA Sequence Number=SeqID_18660
YPTNLKWSPKRRKTYSNIYKEKWTQPWPMGSEIYPEVHENPRAFFSSSSPILLEPLAHGSGD

SEQ ID NO: 135439 - protein, 120 aa, Glycine max
  Coding DNA Sequence Number=SeqID_18661
MVRVWTNPLQCQPHHNLSRNVPLLQHFSDCYFTFVATSKGFKNFSLGKGVVVEVNCSDDDQRRSLRYGLSGLEMYVDYNEELSTIVLDLLEIIGFNHHIEESKWSDEVSGGNGFELEVMT

SEQ ID NO: 135440 - protein, 164 aa, Glycine max
  Coding DNA Sequence Number=SeqID_18662
MERSMIDAASGGALGDMTPAEARNLIEKMASNSQQFSARNDVIVIRGVHEVALNSSSSVETKKPEGKLDALVNLQNQPQQNNYDLSSNRYNPGWRNHPNLRWSSPSQQQQQQQPYFQNAAGPSRPYVPPPIQHQQQQQQPQMTMRKKLCKTCSFNKRPEPPFRA

SEQ ID NO: 135441 - protein, 165 aa, Glycine max
  Coding DNA Sequence Number=SeqID_18663
  Homolog annotation: Hit_ID=Q9SE03; Match level="QueryCoverage=16%, HitCoverage=20%, E-value=5e-07, Identity=88%"; Hit description =Copper chaperone homolog CCH
MGPTYSDMGCKLALEDKKRVAFRRKQRHEHVDATRHAKPCNCSSLASQQQKACVCCFIKLPCRICHQALRCARKWACYGSKNNRAGFVNSLAFAKSGEFLVAGVGHVKIFSNCVLLTVVLKVGMSCQGCAGAVNRILGKMEGIFIPASYLYYHIQNENDLVIVAM

SEQ ID NO: 135442 - protein, 70 aa, Glycine max
  Coding DNA Sequence Number=SeqID_18664
MVVEEAKSTMGTNAEEEKMVIVRFGDLQTMRRVRTGKRLLMKKKQMAAAAEAEKSLPVSPAGGPQPLPLL

SEQ ID NO: 135443 - protein, 97 aa, Glycine max
  Coding DNA Sequence Number=SeqID_18665
  Gene Ontology: Mol. function=DNA binding
  Homolog annotation: Hit_ID=Q1SFS3; Match level="QueryCoverage=96%, HitCoverage=25%, E-value=1e-09, Identity=41%"; Hit description =Lambda repressor-like, DNA-binding
MAEVSTEAIASLTQYYDQSLRCFTFGDFQLTPTVEKFEEILGCPLGGRKLTKEMFGNKGENLGKSRRMGPVHGRPSALDFRSGPLSKCRWVGGPGSD

SEQ ID NO: 135444 - protein, 108 aa, Glycine max
  Coding DNA Sequence Number=SeqID_18666
MGYPSYVVLGGDRAMVQVDSPHPQITHKSTIPSCPPLTELTYSHVALSSFLSTPGSHPRSLKIRPRAQTSSVALSGWLAKPEDWLSERVKISTSQTCPINLKLRGNDY

SEQ ID NO: 135445 - protein, 83 aa, Glycine max
  Coding DNA Sequence Number=SeqID_18667
MGVQIATRPTWAFQKIPPEGGGKLLPHFPINRGRSEGKKCSSLLDKNNLTKHFVHKELHRSDFLIAIKEYIGARETPSLTAKR

SEQ ID NO: 135446 - protein, 43 aa, Glycine max
  Coding DNA Sequence Number=SeqID_18668
MATPMSNACYLDKDETGQSIDIKKYKDFKQIPKNLTLVLLKES

SEQ ID NO: 135447 - protein, 206 aa, Glycine max
  Coding DNA Sequence Number=SeqID_18669
  Pfam annotation: Domain name=Transposase_23; Domain location=121-191; Score=6.2; E_value=0.00024; Accession=PF03017.5; Description =TNP1ENSPM transposase
DVRKKAQAIQKQNIAPHVLSHGGYEYLEKKLMDEKKKKKLEEVAQSGSTDTVIDPPSPIKRHVKWKLARTKKIDHMTFKVAKETADKIGLALPPEPKVGPLAARVSTKESYVDPSGNDPDTGDSDKCKLYINEYPPRLVALGRVYEGSTIVHNIPLLHDQVKVGVEEVSDADAPILVPTKEVKVIGQTLNTFLSWPTHLVKRLSEQ

SEQ ID NO: 135448 - protein, 403 aa, Glycine max
  Coding DNA Sequence Number=SeqID_18670
  Gene Ontology: Mol. function=translation elongation factor activity; Cellular component=intracellular; Biological process=translational elongation
  Homolog annotation: Hit_ID=UPI00005F742B; Match level="QueryCoverage =88%, HitCoverage=52%, E-value=1e-164, Identity=79%"; Hit description= COG0480: Translation elongation factors (GTPases)
  Pfam annotation: Domain name=EFG_C; Domain location=273-360; Score =166.8; E_value=5.4e-47; Accession=PF00679.14; Description=Elongation factor G C-terminus
  Pfam annotation: Domain name=EFG_IV; Domain location=162-271; Score =186.3; E_value=7.3e-53; Accession=PF03764.8; Description=Elongation factor G, domain IV
  Pfam annotation: Domain name=GTP_EFTU_D2; Domain location=7-74; Score= 80.0; E_value=7.4e-21; Accession=PF03144.15; Description=Elongation factor Tu domain 2
  Pfam module annotation: Pfam domain module=EFG_C::EFG_IV::GTP_EFTU _D2; Domain location=273-360::162-271::7-74
MSDPYVGQLTFVRVYSGVLRKGDSVWIAVKGRKERIGRIVQMQANDRIEIDEIRAGDIAACVGLKEVTTGETLCDPDAVITLERMEFPDPVISLSIEPKTKGDQEKMGLALQRLAAEDPSFRLHTDEESGQTIISGMGELHLEIIVDRLKREFGVEANIGRPQVTYRETIRKTVREVEGKFVRQSGGKGQRPEAVSPFEDATKGGVVPREFIPSVEKGIREALNSGVLAGYPVVDIKATLTFGSYHDVDSSEMAFRMAAIFGFKAAAKQADPVILEPVMQVEVETPEEYAGGVMGDLSSRRGTLQGMDERFGARIIRAEVPLAEMFGYATTLRSMSQGRATYSMEFAHYAEAPRNVAEAIIAARAHAVTPSAAASSSQRLTSSNQSRCGTEKPASRLAFITSL

SEQ ID NO: 135449 - protein, 80 aa, Glycine max
  Coding DNA Sequence Number=SeqID_18671
MDILVPHPLTNACLLIQLSPECGCKPLVYLLKRPALLSVDFQDCSIRDYSSCTLVGVPKFVFLEKRVVKNMMLDKWPQLP

SEQ ID NO: 135450 - protein, 87 aa, Glycine max
  Coding DNA Sequence Number=SeqID_18672
MSHNNSFQNCPMYGVACQCYDSTSDSPQISASPYQLDFTLYASGSYNAQWNAPGLLHDKHTLCSSRILRKMEVEEPWLGWSSSLEVR

SEQ ID NO: 135451 - protein, 301 aa, Glycine max
  Coding DNA Sequence Number=SeqID_18673
  Gene Ontology: Mol. function=protein binding; Cellular component =integral to membrane; Biological process=protein amino acid phosphorylation
  Homolog annotation: Hit_ID=Q9ZTJ6; Match level="QueryCoverage=99%, HitCoverage=80%, E-value=3e-43, Identity=35%"; Hit description=Hcr2 -5D
  Pfam annotation: Domain name=LRR_1; Domain location=113-135; Score =15.7; E_value=0.17; Accession=PF00560.23; Description=Leucine Rich Repeat
  Pfam annotation: Domain name=LRR_1; Domain location=137-159; Score =14.7; E_value=0.34; Accession=PF00560.23; Description=Leucine Rich Repeat
  Pfam annotation: Domain name=LRR_1; Domain location=17-39; Score =10.2; E_value=3.5; Accession=PF00560.23; Description=Leucine Rich Repeat
  Pfam annotation: Domain name=LRR_1; Domain location=190-212; Score =1.6; E_value=1.4e+02; Accession=PF00560.23; Description=Leucine Rich Repeat
  Pfam annotation: Domain name=LRR_1; Domain location=214-236; Score =12.3; E_value=1.4; Accession=PF00560.23; Description=Leucine Rich Repeat
  Pfam annotation: Domain name=LRR_1; Domain location=238-260; Score =11.6; E_value=1.9; Accession=PF00560.23; Description=Leucine Rich Repeat
  Pfam annotation: Domain name=LRR_1; Domain location=262-285; Score =8.1; E_value=8.7; Accession=PF00560.23; Description=Leucine Rich Repeat
  Pfam annotation: Domain name=LRR_1; Domain location=41-63; Score =16.6; E_value=0.09; Accession=PF00560.23; Description=Leucine Rich Repeat
  Pfam annotation: Domain name=LRR_1; Domain location=65-87; Score =12.8; E_value=1.2; Accession=PF00560.23; Description=Leucine Rich Repeat
  Pfam annotation: Domain name=LRR_1; Domain location=89-111; Score =23.1; E_value=0.00099; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=113 -135::137-159::17-39::190-212::214-236::238-260::262-285::41-63::65 -87::89-111
GNEIQGPIPVGIRNLTLLQNLDLSQNSFSSSIPDCLYGLHRLKYLDLRGNNLHGTISDALGNLTSLVELHLLYNQLEGTIPTSLGNLTSLVELDLSNNQLEGTIPPSLGNLTSLVRLDLSYSQLEGNIPTSLGNLTSLVELDLSYSQLEGNIPTSLGNVCNLRVIGLSYLKLNQQVNELLEILAPCISHGLTRLAVQSSQLSGNLTDHIGAFKNIVLLDFSNNSIGGALPRSFGKLSSLRYLNLSINKFSGNPFESLGSLSKLSSLYIDGNLFHGLVKEDDLANLTSLTEFGASGNNFTLK

SEQ ID NO: 135452 - protein, 405 aa, Glycine max
  Coding DNA Sequence Number=SeqID_18674
  Gene Ontology: Mol. function=zinc ion binding
  Homolog annotation: Hit_ID=Q1SXX9; Match level="QueryCoverage=61%, HitCoverage=20%, E-value=4e-69, Identity=56%"; Hit description=Zinc finger, RING-type
MFGCFLSLPHFAVFALPAQTFLVALASFVSADFCISFEILKLKDWPPSNLFEEQLPRHCAEFISSLPFKEYTDPHKGSLNLAVKLPNGSLKPDLGPKTYIAYGFPQELGRGDSVTKLHCDMSDAVNVLTHIAEVKLDSDQLTVIEKLKQKHLEQEKRELLGDDQDGETNVDMVNNSSSTINALDRQSSVEVMEQEGGLCDGIEVDQFHQPSGSNEVAIANEDGISYGSELIEVDKVKINQGDLLFGGDASDGALWDIFRRQDVPKLQEYLKKHFREFRHVHCCPLKQLDHANELSNSLKESANINTVRASLIVEECTRLGLMYLCIAPGSRPSPVAVAAESHKLITCISCFDERSLAYHAVGYGRGSHIPAVAITSSGTAVSNLLPAGKIHFWSPYNAQSAILVS

SEQ ID NO: 135453 - protein, 271 aa, Glycine max
  Coding DNA Sequence Number=SeqID_18675
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=4e-37, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYSSSPSEDYESSPFEDYKSSPSEGYIGLHILTFRGLHVLPIRGLHAFAFRELHVLLSRGLHVLPFRGLHSFAFRGIHVIAFGGLHILTFRGLHVLAFGGLHVLAFIGLHVLAFRGLHTLAMRGLHNLAFRGLHALTCRGLQVLAFKGLHVLTFRGLQVLPFRGLHIPIIRGVHVLPIRGIHALTFRGLHVLLFRGLHALPSRGLASSPSEGYTLSPSEGYTSSSSKGYTPSPPKGYMSSPSGGNTPSASEEYTSNIQRTTCPHL

SEQ ID NO: 135454 - protein, 127 aa, Glycine max
  Coding DNA Sequence Number=SeqID_18676
VKLPAFIVDHRVVPGDMSRGSGDLGDVRRAPGSQQIKETKTTKQGGLWWLASCEFCVICGLWPLVIDYQGLEKRSQETMGAPGNRLPACVIDYTEGWVTGNRLPEMKSLKILLLMSCSGYEMHCAAA

SEQ ID NO: 135455 - protein, 454 aa, Glycine max
  Coding DNA Sequence Number=SeqID_18677
  Gene Ontology: Mol. function=1-deoxy-D-xylulose-5-phosphate reductoisomerase activity; Cellular component=chloroplast; Biological process=isoprenoid biosynthetic process
  Homolog annotation: Hit_ID=Q1H145; Match level="QueryCoverage=71%, HitCoverage=81%, E-value=1e-109, Identity=63%"; Hit description=1 -deoxy-D-xylulose-5-phosphate reductoisomerase
  Pfam annotation: Domain name=CTP_transf_1; Domain location=1-139; Score=75.0; E_value=2.3e-19; Accession=PF01148.10; Description =Cytidylyltransferase family
  Pfam annotation: Domain name=DXP_redisom_C; Domain location=277-365; Score=201.4; E_value=2.1e-57; Accession=PF08436.3; Description=1 -deoxy-D-xylulose 5-phosphate reduct
  Pfam annotation: Domain name=DXP_reductoisom; Domain location=135 -263; Score=255.5; E_value=1.1e-73; Accession=PF02670.7; Description =1-deoxy-D-xylulose 5-phosphate reductoisomerase
  Pfam module annotation: Pfam domain module=CTP_transf_1::DXP_redisom _C::DXP_reductoisom; Domain location=1-139::277-365::135-263
MMSLWMSLIAAKEVNPYVLLVIISTIWLADSAAYFAGKQFGRHKLAPAISPGKTWEGVLGALLAVAIYAIGLKLLGAVSTWWILPGLWIVTIAGVYGDLFESFFKRRANLKDSGQFLPGHGGLLDRVDGVNLQLVTILGSTGTIGQQTLDVISQHPARYGVFALTAHSNVDSMLQQCVRYQPQYAVMQDNDAAQLLRQRVQAENLDIKVLTGVEGLIEVAAHPDANIVMAAIVGAAGLLPALAAAKAGKKILLANKETLVMAGQLFMDAVKQGQATLLPIDSEHNAIFQAMPRAPYDDLAEVGVNQIILTASGGPFRCYSQAQLQEVTPALALKHPNWVMGAKITIDSSTLMNKGLEVIEAHWLFDARPDQIEVVVHPQSVIHSMVSYVDGSILAQLGNPDMRTPIAYGLGYPERIASGVKQLSLIDVAKLEFEAPDIQRFPCLRLAYDALSVG

SEQ ID NO: 135456 - protein, 101 aa, Glycine max
  Coding DNA Sequence Number=SeqID_18678
MRIPFLQAKVQKGLRLCFNGVFYRGNPILISGPKQIWVSRCRSRDELPYHSATTRWALKHPVYGIVILRLGVYTDRPDVSKLCSFISSMNSSILISVHSGK

SEQ ID NO: 135457 - protein, 54 aa, Glycine max
  Coding DNA Sequence Number=SeqID_18679
MVDVDVVKEQVPQNLEPTKCDGWDCLTYCDENNYGLNGIQDARKFVKRLIQKQH

SEQ ID NO: 135458 - protein, 77 aa, Glycine max
  Coding DNA Sequence Number=SeqID_18680
  Subcellular localization annotation: CTP_CleavageSite=36; ConfidenceScore=5.01e-01
MKMKANKTRNELKVSDSNTYRLKNKERMKNGRRTVKNGGKSSQICSRKCLGSVTEALRLDFSSRKRVFYPKQLKCIA

SEQ ID NO: 135459 - protein, 82 aa, Glycine max
  Coding DNA Sequence Number=SeqID_18681
MCQGIGLRPNFHIIPQGMCNNDDLETTCKISHGHSQVGTQASRLWHCDTTVGNLHKQTQRFQIMFFHQFNESIHSYLGYSGK

SEQ ID NO: 135460 - protein, 155 aa, Glycine max
  Coding DNA Sequence Number=SeqID_18682
  Gene Ontology: Mol. function=damaged DNA binding; Biological process =mismatch repair
  Homolog annotation: Hit_ID=Q1XBQ8; Match level="QueryCoverage=63%, HitCoverage=8%, E-value=8e-43, Identity=84%"; Hit description=DNA mismatch repair protein
MDVNDLNGAHLPSKSFLSGANQIEVLCEEVESAITVTFVGCRFLKRLCDVQTRINAHRLQMCRKLSTVQLTERLDYSNLPGLNPNMKNGSLKEGTLNWEMLQFKPKFPRQVLLCRVGEFYEAWGINVCILVEYEVLNPFGGLQSDSIPRAGCPVV

SEQ ID NO: 135461 - protein, 158 aa, Glycine max
  Coding DNA Sequence Number=SeqID_18683
MGSRKPRGPKDLLNMKIVKKSRSKQPIRIVRRGIYCASEIRKQKNHRGSNKKSNESHKSTESREEFVIPGDIPELDSLVVYEKELRSDFFSNVAAGCLEPSRERKKKNSHKSRNKDESHDLVKSITDFVIPGDVPAIDSLMIFDNNFFSDFFTNIPVF

SEQ ID NO: 135462 - protein, 69 aa, Glycine max
  Coding DNA Sequence Number=SeqID_18684
MEHGVPAILPVYEYMLLINFGLNTALWRRQAQGPTQARSRKRLFMSGLKEGRGIWTEVKASSITDRDPT

SEQ ID NO: 135463 - protein, 303 aa, Glycine max
  Coding DNA Sequence Number=SeqID_18685
MVFLAILCFRFSGSHRHLLFERGEVWKVCDFVRVSITIIVRRWNANTFAVLDSTGPTEEQTVRLKIHHGGMFIYQPFTLYINGQIEEEEWGPKKSTEQRVIDTSSKKLNDVEDDDVVVIDGVEAQVKAVAEGEVKAVVEGEIMAEGQVDQQALVEVQVEVEVQVGEQGLVEVQVEPVGETNVQAQMEAEAEGEVGVQGEMEAEAEGEASVQGDDVEAEEDDDDDSSEYSEVSDSDFEENWDWTEYHDPETFTQTANPKVKFPQFKVLENDEDAKFEVGLQFSIKKEILEAIKTFAIISKKNLK

SEQ ID NO: 135464 - protein, 181 aa, Glycine max
  Coding DNA Sequence Number=SeqID_18686
MIRTRDVGHTLAMIIDRGRQDEDDVVDVPQRCRPIASARRQRVHQMIKDVPHMIEDVPHMAEDAPEMTADVQATVAKDLGRDGAEGSHADDAEGFPGGSRDPSVLTSFADHERPELKLVSHGRKVTLIGRPVSEIEGLVAATGLSPLIGCSAVTGDPGLISAFLERWHVTPSTPHIYTNKE

SEQ ID NO: 135465 - protein, 62 aa, Glycine max
  Coding DNA Sequence Number=SeqID_18687
FRSVLRLYADYIAKAEAAATIPVATFMPKIPLGAILAIVDLVVVAVSKFKVVLRSLLESQLC

SEQ ID NO: 135466 - protein, 152 aa, Glycine max
  Coding DNA Sequence Number=SeqID_18688
EVQEQMKADMEATKEQMATMMEAMMSMRKMMEVNTATLVVASTTTEVDPTHPPGFNQINHPASDMVGQGGKELESVDSPHFVQVQNKHSFPPYDLPPNYTPPNVAHISNENVENSAPMPVESHQPQSDHAHAQSNRGAQRAPGAKRAANCRR

SEQ ID NO: 135467 - protein, 84 aa, Glycine max
  Coding DNA Sequence Number=SeqID_18689
MTNFARCFQIIIVTRALWNNMEVRPETDTLTPEFFLPQISRSSFHDKSPRRDPTLDYFGPWPIKRILILSLEAKDSGISSRDSK

SEQ ID NO: 135468 - protein, 62 aa, Glycine max
  Coding DNA Sequence Number=SeqID_18690
MKKIREPSDQINFRQDCHSRSFSTGDIPPHMNKEEKTETPSFLSKNTTLEKILLVHDRTFDL

SEQ ID NO: 135469 - protein, 234 aa, Glycine max
  Coding DNA Sequence Number=SeqID_18691
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=3e-25, Identity=34%"; Hit description= UPI00006A17C9 related cluster
IVLNLILKSPFASIASYHHDHHQNTKDNCIYIHALALRGLHLLPFRGLHVIAIRGLHVLDFRGLHVLTFRALHALPFRGLHIFSFRGLHVLPFREDNTSSPSEDNTSLPSESYTSSPSEDYTSSLSEGYSPSPLEDYTTSPSEGYTPSPSEDYTSLPSEGCTPSPSEDYTSSPSEGNTSSHLESYTSSPSEDYMSSPSEDCKSSSSEGYTSLPSEGYVPSASEDYMSSPLEDYT

SEQ ID NO: 135470 - protein, 105 aa, Glycine max
  Coding DNA Sequence Number=SeqID_18692
MSFICCVDPAHLQKFAINLLANFLGGLKNLTYVRIEVDESNIPATDFGTTMHCPVEAPLELVGLGSSSSIDSFASLKMNDNGMEKEEREETPLQGEDESRRSSPP

SEQ ID NO: 135471 - protein, 209 aa, Glycine max
  Coding DNA Sequence Number=SeqID_18693
MKAFRLTHKNRIAIGGGPSPSISPPNRTLWCFLLAKNLRGKDNKHKYKKRSHCEHRSGSGELLGQKDVESKGLETCLVNADTLVKSRDGEIIRLRAALVVVEKEKEKTTTEKGRIQQKAFDDVYDTHEVSFNHCLRQVLLLCQVSDPSVFDINKDIYHGELMSIDDIANDGTPMLERSMLKVPRSMIRIMETLGIKRTWVLRFLCTIFM

SEQ ID NO: 135472 - protein, 163 aa, Glycine max
  Coding DNA Sequence Number=SeqID_18694
  Homolog annotation: Hit_ID=P93736; Match level="QueryCoverage=39%, HitCoverage=5%, E-value=2e-17, Identity=59%"; Hit description=Valyl -tRNA synthetase
MPSFHDLEQKWLPKVGALLELQWWRKKKRMATEAWLHGKTKADSVGNTPSYLEEAIATSLFVMQNKVMEQCQKGTTNSIAMTGMLAFKTIGRTSASALAGLYRGSENNKMSLGVFSRRNDVVESMIKPQWYVNCNDLAKQAFLAAVDEENKRIEIIPKQYLAD

SEQ ID NO: 135473 - protein, 105 aa, Glycine max
  Coding DNA Sequence Number=SeqID_18695
ISGQGGLAEAQLLLRRAPEVVLPSPIPTRTEPAPTESQPPVVDPPASLEVEILSPPLAPPAPPLILILDDSDAEAVAPSNSPAYYLEDVLCMSSVVAHSKASGTV

SEQ ID NO: 135474 - protein, 175 aa, Glycine max
  Coding DNA Sequence Number=SeqID_18696
  Homolog annotation: Hit_ID=P76578; Match level="QueryCoverage=77%, HitCoverage=8%, E-value=2e-38, Identity=58%"; Hit description =Hypothetical lipoprotein yfhM precursor
MARCVKRLLFSVLIGGALLGGAQPSLQAADTPAPQAATHALAVIDLSELQLDGAAALVLTFNRALDGQQDFNHWISLTDDSSGKVDGGWELAQNGKVLRFRHPQPARKLTVTVNAGLKAADGSTLASPFSQTLTTRDIQPMVGFASRGSLLPLRLTQGLPVLALNVNQIDVDFFR

SEQ ID NO: 135475 - protein, 279 aa, Glycine max
  Coding DNA Sequence Number=SeqID_18697
  Gene Ontology: Mol. function=3-mercaptopyruvate sulfurtransferase activity; Cellular component=mitochondrial inner membrane; Biological process=sulfate transport
  Homolog annotation: Hit_ID=P31142; Match level="QueryCoverage=98%, HitCoverage=98%, E-value=2e-94, Identity=60%"; Hit description=3 -mercaptopyruvate sulfurtransferase
  Pfam annotation: Domain name=Rhodanese; Domain location=158-272; Score=81.5; E_value=2.7e-21; Accession=PF00581.10; Description =Rhodanese-like domain
  Pfam annotation: Domain name=Rhodanese; Domain location=7-129; Score =106.9; E_value=6.1e-29; Accession=PF00581.10; Description=Rhodanese -like domain
  Pfam module annotation: Pfam domain module=Rhodanese::Rhodanese; Domain location=158-272::7-129
MTAMFVSADWLNEHYHEERLQVLDARMLPPGQEAVRDITAEYLAGHLPDAPFFNIEALSDHTSPYPHMMPRAETFAVAMRELGISQDKHLVVYDEGNLFSAPRAWWMLRAFGCEQVSILAGGLQGWKAAGFSLATGPVDLPEGEFDAQYDSSQVKRLTDVLLISHEGGAQIVDARAANRFNAEVDEPRPGLLRGHIPHSLNMPWNNLVANGELKPAAELRDLFAKAGIKLDQPIVASCGSGVTAVVVILALTALGVSDVTLYDGSWGEWGSRDDLPIEK

SEQ ID NO: 135476 - protein, 208 aa, Glycine max
  Coding DNA Sequence Number=SeqID_18698
MTTLTQIWMMLLLSNIPPDDHNADLPPTEVSVGLCHRDIGIAPTRHPVNPEKSNRALGFPALVTGLCHSYRVPVPPTRGRAHKTPSGPREVQQGPGVSSSGYGPLSFLQGARPPNKDCARKTPPVDPKKSNRVLGFLALITGLCQFYGVPVAPSKFIRPPINRAFIKKYCALRQAQGETPQQPRDGRQRATNALPQPLEFTSAHPQKG

SEQ ID NO: 135477 - protein, 97 aa, Glycine max
  Coding DNA Sequence Number=SeqID_18699
MKIKKRTKEKKGRIPDQRSKGSEKGKEATLDQRKKEDRKSPKPDCPSESFLTDNIPLHMKKEEKTETPSSLSKNADLERILLVSPMFPLRVRLKARS

SEQ ID NO: 135478 - protein, 72 aa, Glycine max
  Coding DNA Sequence Number=SeqID_18700
MKPYGLCNNAPFDLWNVAELLRIVQLCFLSTSGMSRNLADCLTMGVKYLEVIKKRLHATKQWSPDEIRVMFK

SEQ ID NO: 135479 - protein, 156 aa, Glycine max
  Coding DNA Sequence Number=SeqID_18701
  Gene Ontology: Mol. function=DNA binding; Cellular component=nucleus; Biological process=DNA integration
  Homolog annotation: Hit_ID=Q8RUQ2; Match level="QueryCoverage=98%, HitCoverage=16%, E-value=7e-37, Identity=43%"; Hit description =Putative retroelement
MAMNEEMESLQKNQTWDLVELPKGRRITRCKWIFKKKFGLSTEEVICYKAHLVAKGYGFKVKGKENFVSILKRPFYGLKLSPRQWYKRFDEFIVSHRCTRSPYDSCVYHSKVEDDMFIASQNLLAIQKLKSLLNGKFEMKDMGTAEKILGIKIKRD

SEQ ID NO: 135480 - protein, 190 aa, Glycine max
  Coding DNA Sequence Number=SeqID_18702
  Gene Ontology: Mol. function=nucleic acid binding; Biological process= DNA integration
MGALLKEQGIWAPLSDQSSKIDKSMLELQEEKRNFYDEINLQQVTSEKVVVWPVNEARESGHWKRDCPKKANKDFLAAIVHNGSSSESYLVLAIGCSYHICPHRDWFMTHEKKYGGNILMGNDASCMSISIGSVQINMHDSVFRTLTEVHHIPELKKNLFSMGVIDSKGFSCWVEGRVMQIRGKKKFVIM

SEQ ID NO: 135481 - protein, 297 aa, Glycine max
  Coding DNA Sequence Number=SeqID_18703
  Gene Ontology: Mol. function=RNA-directed DNA polymerase activity; Biological process=RNA-dependent DNA replication
MSEEEDKVKERIKADIEALKEKMATMMKAMMSMKKIMEVNAAAVAATSVVSEVDPAPPSGLNQINHPISDMVGQRGKELGSTGSPHFVQVQNKHAFPPYCLPPNYTPPNVAHTPNENVNDSTSILIESQQPQSNHAPIPQPLGGTHEIPHNNLANFEPGLEYATEGKEVDGEDYALANMEDLCLVPDVVIPPKFKVPDFNKYKGTTCPKNHLKAYCRKMGAYAKDEKLLMHFFQENLIGAVVTWYTNLEPSRVHSWKDLMISFIRQYQYNSDMALDRMQLQNMGKKEHESFKEYAQR

SEQ ID NO: 135482 - protein, 95 aa, Glycine max
  Coding DNA Sequence Number=SeqID_18704
MPKMAPKKLTTERVKKTIAGKGSSTTPPVDFEFDEHHFHSEEHQRCFELIKDWSFLKERRVQLAKGKYLEFTIEITRETGDNLGNPCPNMTLKLS

SEQ ID NO: 135483 - protein, 81 aa, Glycine max
  Coding DNA Sequence Number=SeqID_18705
MRIKRSFKVVMGPRTRLVVSLKTRKGKQGSKGLSKELIQGKSIWLEAYKNKIASIISKYACELGSINKNQAKAIVQAINGA

SEQ ID NO: 135484 - protein, 68 aa, Glycine max
  Coding DNA Sequence Number=SeqID_18706
MSGFTRNSPQISASPHQLDLAPYASEPYHAQWNAPGLFHDKHTLRLSRIFGEMEVVFVIGSAVDRLCG

SEQ ID NO: 135485 - protein, 170 aa, Glycine max
  Coding DNA Sequence Number=SeqID_18707
  Gene Ontology: Mol. function=DNA binding; Biological process=DNA integration
  Homolog annotation: Hit_ID=Q1S9T4; Match level="QueryCoverage=96%, HitCoverage=12%, E-value=3e-74, Identity=80%"; Hit description =Integrase, catalytic region
MHTLSLSTPDDQWYMDTGATSHMTANGGNLTSYFNLSNNITVGSGQNIPVIGCGHASLPNSLHPLKLPNVLHAPKLIKNLISVRKFTIDNDVSVEFDPFGFSVKDFQTGILLMRCNSSGDLYPIATRPPNTTLPPSTFAALSTELWHNRLGHPGATILSSLHRDNFLQLV

SEQ ID NO: 135486 - protein, 77 aa, Glycine max
  Coding DNA Sequence Number=SeqID_18708
  Homolog annotation: Hit_ID=P21865; Match level="QueryCoverage=98%, HitCoverage=8%, E-value=2e-15, Identity=56%"; Hit description=Sensor protein kdpD
MAKSLGSALTPQDIAATSQRVIEVTLQARSQLLLPDEQGELQSAGESTIGTPPDLGIAKWSYSKGQPAGAGTDTLPA

SEQ ID NO: 135487 - protein, 257 aa, Glycine max
  Coding DNA Sequence Number=SeqID_18709
  Gene Ontology: Mol. function=transcription factor activity; Biological process=regulation of transcription, DNA-dependent
  Homolog annotation: Hit_ID=Q6CZC1; Match level="QueryCoverage=67%, HitCoverage=63%, E-value=2e-57, Identity=64%"; Hit description=LysR -family transcriptional regulator
  Pfam annotation: Domain name=LysR_substrate; Domain location=8-201; Score=18.4; E_value=5e-05; Accession=PF03466.10; Description=LysR substrate binding domain
MAKKEVSHTQQHHELSIGASASLWEAYLTPWLQTLYENRESLFLEARIAQRHLLVEQLHERQLDLLITTEAPKMDELTSQQIGHISLALFRARKTEKREKYDYIKLEWGADFHQHESYLSSDDVPVLTTTSAHVTRELLHTTGACAFLPDFWHGIYSDLMVIPDTPVAVRPLYAFPTLAWGGPTLPSALRRFTSEFGMGSGGTTALLPPGKFCFRPRLSRSDCVAPLAPLSHILVYAPSRRLACRLVTAQNPLDVIR

SEQ ID NO: 135488 - protein, 100 aa, Glycine max
  Coding DNA Sequence Number=SeqID_18710
  Gene Ontology: Mol. function=DNA binding; Cellular component =chromatin; Biological process=DNA integration
MPHGLYSPSLIPDFPWIDLSMDFLLGFPQTRNGKDSIFVVVDRFSKITHFMPCDEDFNSRLNSLKEGRDDGNQTRNKDIEAIQGLGGTMTRAHAKKEKEY

SEQ ID NO: 135489 - protein, 56 aa, Glycine max
  Coding DNA Sequence Number=SeqID_18711
MESPTIATYPSVGGRRRAHGCVFQGRKAHGVTTNVYSGETSNKSKSVCGLRTLSVK

SEQ ID NO: 135490 - protein, 62 aa, Glycine max
  Coding DNA Sequence Number=SeqID_18712
MESTLIWQDAKRMNTKCSIECEEDEEMCTIRRYISIEVFGFWKFRRQSDSRVSGDMKRVGSV

SEQ ID NO: 135491 - protein, 213 aa, Glycine max
  Coding DNA Sequence Number=SeqID_18713
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=99%, HitCoverage=53%, E-value=1e-112, Identity=79%"; Hit description =Photosystem II 44 kDa reaction center protein precursor
  Pfam annotation: Domain name=PSII; Domain location=1-213; Score =125.2; E_value=1.8e-34; Accession=PF00421.9; Description=Photosystem II protein
WIVSVDDLEDIIGGHVWLGSICILGGIWHILTKPFAWARRALVWSGEAYLSYSLGALSVFGFIACCFVWFNNTAYPSEFYGPTGPEASQAQAFTFLVRDQRLGANVGSAQGPTGLGKYLMRSPTGEVIFGGETMRFWDLRAPWLEPLRGPNGLDLSRLKKDIQPWQERRSAEYMTHAPLGHLWHAGRARAAAAGFEKGIDRDFEPVLSMTPLN

SEQ ID NO: 135492 - protein, 45 aa, Glycine max
  Coding DNA Sequence Number=SeqID_18714
MIHAPGHVRDFLFFIIVEFNSTGYSTTPNWKMSLRPILGSNYMSH

SEQ ID NO: 135493 - protein, 333 aa, Glycine max
  Coding DNA Sequence Number=SeqID_18715
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=96%, HitCoverage=97%, E-value=1e-103, Identity=54%"; Hit description=SRG1 protein
  Pfam annotation: Domain name=2OG-FeII_Oxy; Domain location=184-284; Score=144.9; E_value=2.1e-40; Accession=PF03171.10; Description=2OG -Fe(II) oxygenase superfamily
MEEINKNPSGTSLLVPSVLELAKENLTTVPQRYIQPQHQDMVLISEEDHSTLEIPVIDMHRLLSVESGSSELDKLHLACKEWGFFQLVNHGVNSSLVEKVRLETQDFFNLPMSEKKKFWQTPQHMEGFGQAFVTIYSYLMEFIKRDTLEAYSQEIKDLAIVIIGLMGKALKIQEREIRELFEDGIQLMRMNYYPPCPEPEKVIGLTPHSDGIGLAILLQLNEVEGLQIRKDGLWVPVKPLINAFIVNVGDILEIITNGIYRSIEHRATVNGEKERLSFATFYSPSSDGVVGPAPSLITEQTPPRFKSIGVKDYFKGLFSRKLDGKAYIEVMRI

SEQ ID NO: 135494 - protein, 316 aa, Glycine max
  Coding DNA Sequence Number=SeqID_18716
  Gene Ontology: Mol. function=RNA-directed DNA polymerase activity; Cellular component=chromatin; Biological process=chromatin assembly or disassembly
  Pfam annotation: Domain name=RnaseH; Domain location=138-256; Score= -32.8; E_value=0.066; Accession=PF00075.14; Description=RNase H
MNLIFRPFLRRFVIVFFDDILIYSGTFEDHLRHLDMTFQVEYLGHLVSGRGVEPMADKVAAIVNWPRPQSTRAVRSFLGLAGFYRRFIRGYAMIAEPLVRLTTMETFQWTSQAQQAFENLKVALATAPVLALPDFQIPFTMETDASGSGMGAVLSQKGHPIAYFSKPFSPKLLTASTYVRELFAITSAVKKWRQYLLGHQFTIITDHRSLKELLTQVIQTPEQHTYMARLMGFDYQIQYRLGAHNLAADALSRSSENGPPEYSASQFLILSVPCLTFLDELKQQVATNQQYSQQRQAIIDFPDSHSDFTIHQDLIL

SEQ ID NO: 135495 - protein, 455 aa, Glycine max
  Coding DNA Sequence Number=SeqID_18717
  Gene Ontology: Mol. function=O-methyltransferase activity; Biological process=lignin biosynthetic process
  Homolog annotation: Hit_ID=Q9SCP7; Match level="QueryCoverage=55%, HitCoverage=72%, E-value=1e-101, Identity=73%"; Hit description =Caffeic acid O-methyltransferase-like protein
  Pfam annotation: Domain name=Dimerisation; Domain location=28-79; Score=20.2; E_value=0.00066; Accession=PF08100.2; Description =Dimerisation domain
  Pfam annotation: Domain name=Methyltransf_2; Domain location=88-293; Score=110.9; E_value=3.6e-30; Accession=PF00891.8; Description=O -methyltransferase
  Pfam module annotation: Pfam domain module=Dimerisation::Methyltransf_ 2::Retrotrans_gag; Domain location=28-79::88-293::328-418
MEKEESTEQRKQARLAIMELANMISVPMALNAVVRLNVADAIWQGGANNPLSAAEILPRLLPAGGGDAENLQRLLRMLASYGVFYEHLSAGERKYSLTDVGKTLVTDEQGLSYAHYVLQHHQDALMRAWPMVHEAVVDPTKEPFERANGEPAYGYYLKHPEMNDLMVRAMSGVSVPFIRAMLEGYDGFQGVEKLVDVGGSGGDCLRMILEKHPTIKEGINFDLPEVVAKAPQIPFVTHVGGDMFKFIPQGDAIFMKEAPGPRSPGRPQSFNQATTLFGGIRQRYDPQDRGTSSACFLDCILSLANSNPITTSLTCNTNSSFKIRDKLIVASFYMEGRALAWFQWMNTTNQFPSWPAFLEALRTRFAPSQFEDPSGALCKLTQSGIVAQYLADFEDLANRTIGLPTPFLLSCFISGLTPEIRREVQANKPATLVQAAGLARLQEEKFADMRTPSRL

SEQ ID NO: 135496 - protein, 435 aa, Glycine max
  Coding DNA Sequence Number=SeqID_18718
  Gene Ontology: Mol. function=RNA-directed DNA polymerase activity; Cellular component=chromatin; Biological process=chromatin assembly or disassembly
  Pfam annotation: Domain name=Methyltransf_2; Domain location=236-412; Score=-80.8; E_value=0.00043; Accession=PF00891.8; Description=O -methyltransferase
  Pfam annotation: Domain name=rve; Domain location=56-212; Score =105.1; E_value=2.1e-28; Accession=PF00665.16; Description=Integrase core domain
  Pfam annotation: Domain name=zf-H2C2; Domain location=1-38; Score =21.0; E_value=0.00057; Accession=PF09337.1; Description=His(2) -Cys(2) zinc finger
  Pfam module annotation: Pfam domain module=Methyltransf_2::rve::zf -H2C2; Domain location=236-412::56-212::1-38
MGGHAGVAKTIARLSENFTWSGLRADVVTYVANCVECQVTKYETKCIAGLLCPLPVPFRPWEDLSLDFVVGLPPFQGKTVLLVIVDRFSKGIHLGILPQAHTAHMVAQLFIDIVVKLHGIPRSLVSDRDPLFISGFWQELFKLSGTHLRMSSAYHPQSDGQTEVMNKVIEGYLRAFVHRRPTSWGKFLPWVELSHNTSWNSSTGSTPYEITYGRKPFSFPDHIAGSSRIDYSPEITQGTSFHEENLRCKATRENDYHRHKEKDTWEVLVQWHGLSPDESSWEDWEQLKQDHHLKDKVILQGPKEVDSSVTTEATSEGQFGESINKGGVQLVKTKRKWVLTTWTDEECKHIMQNCHKALPEGGKLIACEPVLPEDSDESHRTRALLEGDIFVMTIYRAKGKHRTEEQFRQLAIDAGFPRFRAFHVDHFYTVLEFQK

SEQ ID NO: 135497 - protein, 237 aa, Glycine max
  Coding DNA Sequence Number=SeqID_18719
  Gene Ontology: Mol. function=RNA-directed DNA polymerase activity; Cellular component=chromatin; Biological process=RNA-dependent DNA replication
MTLNSMSKMSSKCRLGYVSQMHADLMITLEEIKLGKTLCSSQFVKQLINCQYGKAVLDGEGIQCPVIDAEAPGSIMLPDEEDRRRKGTVTRLYQSFLKHGLDLQLNLLLLEVRIPDIIFGEQGLNGETEKKRWSSELRRDHLAAVSGATWPARELSEIWAGGSWVMMLGGSKAGIREGAGDPSPSEKQSLQGKGASMPEVGFGVGTAEVVKEEGWLGIRGEVVVGWETKGAGEVVRG

SEQ ID NO: 135498 - protein, 360 aa, Glycine max
  Coding DNA Sequence Number=SeqID_18720
  Homolog annotation: Hit_ID=Q1S8G7; Match level="QueryCoverage=81%, HitCoverage=69%, E-value=5e-33, Identity=35%"; Hit description =Cyclin-like F-box; FBD
MDESSDSNVVGSSTCKEKLSKKVKAKEGAESIMNKLPEQLINAVRTSVLSKKWAYHWTSITKLDLDDSVFYYPKRKTGGKQYFMNFVYRALLLTKNPSIESFSLVMTNKYDVYMFNTWISGILNRNVKNLHICSHFEVPFNAHTSDSLFDSEVLEELVLKMICTIPVVKTFLHFGHLKCLRLCSVVFDLESSSSEDLTLSLPVLEVFETKNCTWFNAESVTLRVPLLESVLIEHDPAAVFYELDSLPIKISASRLTKFTFCSYCYMAQHVLLLDPSSAHNASADITIRCDEDSDSVSETGSYASLLLRQFSEVKYLKFDGAEPYPCICKEAVSGFEPMTNKSPRHNFTAAPGFALSVEIK

SEQ ID NO: 135499 - protein, 454 aa, Glycine max
  Coding DNA Sequence Number=SeqID_18721
  Gene Ontology: Mol. function=protein binding
  Homolog annotation: Hit_ID=Q1S8G7; Match level="QueryCoverage=96%, HitCoverage=97%, E-value=1e-46, Identity=31%"; Hit description =Cyclin-like F-box; FBD
  Pfam annotation: Domain name=F-box; Domain location=24-71; Score =43.8; E_value=5.8e-10; Accession=PF00646.23; Description=F-box domain
  Pfam annotation: Domain name=FBD; Domain location=373-424; Score =45.1; E_value=2.4e-10; Accession=PF08387.1; Description=FBD
  Pfam module annotation: Pfam domain module=F-box::FBD; Domain location=24-71::373-424
MKEPQTSMHSIRGTSRESNYEGQDIFSDLPDVIIGRILSILPTKEAVRTSILSKRWRNLWKFVTKLHFQDIEPYRRNKIDKFHFLDFVYGVLFHLNNSRIQSFSLYLSEKYDPNHVNRWLANILNRGVTELSINSEKDLSISSYSILESQPLEKLVLKMKLGFFTVPTFVYLSSLIFLKLSGIIVICNTPSNDSKNLTLNFPVLRECEIVNCSWLNVEGVTLEVPLLEVLSIKHTRSLSPDFHSITKVCAPHLRELSYTGHGHLLRDPTLLDLSATHISSAYIYPWHSKRETEEKTVLFVCELLKQLNNNVDCLKIRWPKDLVLAHYDLPVPTFGMLSCLELGNVNGEILLIFLRNTPCLKTLILQELWQFDEELLNPENVPSCFTSNLEEVKFRKIKGVQHELRFAKFVMEYAQVLKRASFSPKRNMHGWIFEKVKKKILSFKRSDSFSLIEF

SEQ ID NO: 135500 - protein, 112 aa, Glycine max
  Coding DNA Sequence Number=SeqID_18722
MVLVWWVAAQHFDDGGWIVGNRTGGYGGQVVLWALRWCRRHDNVRVGHRWYMTMLVRVVSMSLKAQGCRSLEAKGSNWLLAGNLRQRAMEAMQKLTNPRVPQRERLMLLRVR

SEQ ID NO: 135501 - protein, 249 aa, Glycine max
  Coding DNA Sequence Number=SeqID_18723
  Gene Ontology: Mol. function=ATP binding; Cellular component=cytosol; Biological process=translation
  Homolog annotation: Hit_ID=Q1SEY8; Match level="QueryCoverage=94%, HitCoverage=65%, E-value=5e-43, Identity=61%"; Hit description=Heat shock protein Hsp70
  Pfam annotation: Domain name=HSP70; Domain location=1-248; Score= -246.8; E_value=1.3e-06; Accession=PF00012.10; Description=Hsp70 protein
MVGSTVKNVEAYLETPVKNAVITVPAYFNDSQRKATIDAGAIAGVSVMRIINEPIAAAIAYGLEKRTNSLLMLRCTRAVCMMLSLLVAVLGFPKCSSYCKTFSNVKICARASTLALLCVGIKNFPVKRTHEYVTVKDNQFAVKIMVYEGERTRASDNHLLGIFRISVLPPAPRGLRLYICFAIDENGLLSVSAEEKITCSKNQITISNGRERLLAVEIRRMIQEAHNYRVQDMKFLRIATAKNDLDYCV

SEQ ID NO: 135502 - protein, 193 aa, Glycine max
  Coding DNA Sequence Number=SeqID_18724
  Homolog annotation: Hit_ID=Q71KW4; Match level="QueryCoverage=27%, HitCoverage=24%, E-value=8e-12, Identity=61%"; Hit description =Desiccation-associated protein
  Pfam annotation: Domain name=PBD; Domain location=13-72; Score=41.5; E_value=2.9e-09; Accession=PF00786.18; Description=P21-Rho-binding domain
MGAVPVVKEREMEIGYPTDVKHVAHIGWDGPSGTGPSWMNDFKTAPDFSTSLGNLGELSDPNAMAVTTSWSSQVFPCAVTVTVTLSYYAFLEGENFEVSTGSQPTSNIYKGIPSAGVSHAPKKSKKKKTKSASPSELVSASSRHSRATKSKATYSDREATPSSESLSASSRHSRATKSKATYSDREATPISQK

SEQ ID NO: 135503 - protein, 257 aa, Glycine max
  Coding DNA Sequence Number=SeqID_18725
WYGENGVFDDIGSKTFVMLEEWPQWSCVKSKLTKGVPWVLKGCLPRVDLGQKRGSPRVNLRFNEPWTGDMFALGFNKPGSPRTNLGFFEPFGELTNDASVLDVGKTYQGWTLGLMSLWSCDHGSLRLVDSSTLGPEDDNFGCLCLVVGLRMFDRGDEVLNALPRQEVLLGLRFELGSIIGDNGVWEAMPSYEALGFILDVAPGRACRPWIFIINGVLFFLRYDCNRMEKEKDDWRSHFKEKMSLKEAHHHRKPWIRV

SEQ ID NO: 135504 - protein, 142 aa, Glycine max
  Coding DNA Sequence Number=SeqID_18726
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=20%, E-value=4e-66, Identity=88%"; Hit description=DNA -directed RNA polymerase beta' chain
MDSSLIEWKELGEEGSPDNENEWEDRKGGRRKNFLVRRIELAKHFLRTNIEPEWMVLCLLPVLPPELRPIIQIDGGKLMSSDINELYRRVIYRNNTLIDRSTTSRSTPGELVMCQEKLVQEAVDTLLDNGIRGQPMRDGHNK

SEQ ID NO: 135505 - protein, 92 aa, Glycine max
  Coding DNA Sequence Number=SeqID_18727
MIESFILYRILEMGFEYFAPIKVFISVRWSSSKRRQLVAIIGGRGWWRRSAPVSLSELSKGVAVKPCKRGSGTYGRNLKVIQRLTSQRLGFC

SEQ ID NO: 135506 - protein, 108 aa, Glycine max
  Coding DNA Sequence Number=SeqID_18728
  Gene Ontology: Mol. function=transition metal ion binding
MIHDLEQESFQQAHAPMYDALKSDSKKPLHLGCNKSLAMLSVMLSLDEDECSNGESTKKGPPMKVLWYLLIIRRFKHLFANGDETKDITWHEDGRNCDGILHHTADSF

SEQ ID NO: 135507 - protein, 50 aa, Glycine max
  Coding DNA Sequence Number=SeqID_18729
MVKTPLRHFTEHLVDALLGTNNKGMGAMWLAPSFQNTTRPKAIPYNPPIQ

SEQ ID NO: 135508 - protein, 209 aa, Glycine max
  Coding DNA Sequence Number=SeqID_18730
  Homolog annotation: Hit_ID=Q47522; Match level="QueryCoverage=22%, HitCoverage=59%, E-value=4e-22, Identity=100%"; Hit description=LacZ protein
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPHMEDYERLGNIALKINKGFAVSAPLLTGIAALGSVFSGDGLVPALAGALATVVNAFEHGGQVGMGELTHINCVALTARFPVGKPVVPAALMNRPTRGERRFAYWALFRFLAH

SEQ ID NO: 135509 - protein, 121 aa, Glycine max
  Coding DNA Sequence Number=SeqID_18731
MTKSKGKDPLEGLGGPKTRARARKAKEALQQVLSILFEYKPKFQGVKSKVVSGSLLKSAVKLLYKLNHFINKDKLSFIQKIRVYLFYLSESDSPKFLSDSRTPWLYQRTFTTFVCCPRWKE

SEQ ID NO: 135510 - protein, 110 aa, Glycine max
  Coding DNA Sequence Number=SeqID_18732
  Homolog annotation: Hit_ID=Q1SM26; Match level="QueryCoverage=56%, HitCoverage=15%, E-value=9e-07, Identity=41%"; Hit description =Nucleic acid-binding, OB-fold
MDLKENCTYVMHNFKELKNNGQYRVCDHQFKLVFIGVTVVRQCVLRDIPFRKYRFAGFADVVAGQFEPGLLVDVIGVVEEVVFHQVSGKGRRVVFKLKDLRLAELGIEAR

SEQ ID NO: 135511 - protein, 159 aa, Glycine max
  Coding DNA Sequence Number=SeqID_18733
  Homolog annotation: Hit_ID=Q1T493; Match level="QueryCoverage=95%, HitCoverage=31%, E-value=9e-13, Identity=25%"; Hit description =Nucleic acid-binding, OB-fold, subgroup
QQLLSCTLWDDYCLQFLEFLDDYEGSYPTSINNSFKASKLIINQPVMEIQEFNERLAELGIEARSGFKSHGEGSTQLSGSIQLSSKESFFGKAEGKTIADINTISEEIVCVTVGTITRIVLDNHSWCYTSCIQCHKKSDAEMTPFTCACGKYNKEVVLR

SEQ ID NO: 135512 - protein, 109 aa, Glycine max
  Coding DNA Sequence Number=SeqID_18734
MAPKQIFAKRSRKDAAAEGTSAAPEFDSHHFRDDEYTDFQEKIARRHWMPLATPMAKFDPEVVLEFYANVWPIEEGVWDMRSWVRGQWIPFDADALSQLLGDPLVLEEG

SEQ ID NO: 135513 - protein, 81 aa, Glycine max
  Coding DNA Sequence Number=SeqID_18735
GEELAAQLAQASWWLIPEATCSPRRAADFPPDRPLAQSGKPVKRKSIRDIRCISKSLGAWKAIKVDDRDGLRMPPDSVVSG

SEQ ID NO: 135514 - protein, 85 aa, Glycine max
  Coding DNA Sequence Number=SeqID_18736
MENWRTALGNQFASLQTRWWRMHEQRLAMNSLGSEEKGRMENWRTALGNQFAGRQTRRIKVENGELANSARRSIRGAPDSLVEDA

SEQ ID NO: 135515 - protein, 95 aa, Glycine max
  Coding DNA Sequence Number=SeqID_18737
MDRGMTLTDAPRSSIAFSNLLFPIMQGGNGRGIRGCDSEWRLLSLAEIAYSGWSFASLTLLRKVEEEPQLLIVFVVTAAVAAATLEEEHMACLDQ

SEQ ID NO: 135516 - protein, 88 aa, Glycine max
  Coding DNA Sequence Number=SeqID_18738
KTSWFAQVVDVFHAVAIFNIWVNINGNSTKAIMSPSIFELLILKQLGINGHLRKSIRIMDVIWHPLSDAILTRKGPVTRAMSKRLQED

SEQ ID NO: 135517 - protein, 156 aa, Glycine max
  Coding DNA Sequence Number=SeqID_18739
MVGYAPSSFVDLVFAGKRIEAGLKIGKFDHPTLMSEKAGANEEDENEGETLDMTAIPTRSNFPSAQQCHYSANNSLSPNHPQRPSLNQPQSLSTALPMMSTTFSTNQNTNQKGILQQKACRIHPKFRYHMLNLLPYLLDNSMVAITPTKVPQPPFF

SEQ ID NO: 135518 - protein, 302 aa, Glycine max
  Coding DNA Sequence Number=SeqID_18740
RLSNLVDSSIDLALVKEFYANLYNPEGPCPKQVKIRGHLIKIDEDSLNTFLEIPVVLAEGESLPAYSSYCRMPTDIREIEAALCIPGRGFVLNAEGHPGKILKKDLTTLAQVWSVLSYSILAPTSHTSDLTLDRARLIFGLVSQLDMNVGALIFGQITSMAQSNSSRLGFPTLITEELLEPADLAVTIRGARRARARPAEAPSISTAPPPAHTLAASSTLSSTNFQCLEAMLRSIHQGHIILLQSLQLDEGLTAQVPQYREDESSETSTLEPLIRRKRAVETQEAATTSEKSLEATSEPSEP

SEQ ID NO: 135519 - protein, 179 aa, Glycine max
  Coding DNA Sequence Number=SeqID_18741
  Gene Ontology: Mol. function=nucleic acid binding; Biological process= DNA integration
  Homolog annotation: Hit_ID=Q2HSF6; Match level="QueryCoverage=86%, HitCoverage=10%, E-value=3e-10, Identity=29%"; Hit description =Glycoside hydrolase, family 1; Zinc finger, CCHC-type; Polynucleotidyl transferase, Ribonuclease H fold
  Pfam annotation: Domain name=zf-CCHC; Domain location=60-77; Score =11.2; E_value=0.014; Accession=PF00098.13; Description=Zinc knuckle
MFKQGMTTKESDKEDLNEIEEDDDFSFFVKRFNKFLGNKGNQTRINFNSKKRGEDSSFFPKFYECNQPGHLRVDCLSFKRRMKKSDWKTFKDKKAKKTYITWEDNDMDSSGDSENEIVNLSLMAKNYESEEDDFLKKSWYIDSGWSKHITGDASKFTHISPKNSGHVTTTKVKFLELEK

SEQ ID NO: 135520 - protein, 374 aa, Glycine max
  Coding DNA Sequence Number=SeqID_18742
  Gene Ontology: Mol. function=catalytic activity; Cellular component =membrane; Biological process=signal transduction
  Homolog annotation: Hit_ID=UPI00003CD24C; Match level="QueryCoverage =99%, HitCoverage=97%, E-value=1e-101, Identity=47%"; Hit description= COG2206: HD-GYP domain
  Pfam annotation: Domain name=HD; Domain location=131-253; Score=99.3; E_value=1.2e-26; Accession=PF01966.12; Description=HD domain
MFIHKLEVWWIKDKRIRNQMLITDKRQIALIRNEGIQQVWIDPERSVRAPATPQPKKDIPQTPFFREMDQAQCIFNQGKPQVLAMFNEARMGQGLDLAFTLELVDEIAGSITREPTALLSVARLKNHDDYTYLHSMAVCGLMISLGKKMGLDEQQLRRVGMGGLLHDVGKAAVPLTILNKPDKLTDEEFTIMRQHPIVGAQMLMEAHADEDLLDIALHHHEKFDGSGYPHRLQGEEISLYARMAAVCDVYDAVTSDRPYRKGWTPAEAMHNMLSWRGHFDSALLHAFVRTIGIYPVGSLVRLASGRVALVVQAGEKSLLKPKVHVFWSLHSQREVKPEALDLGDSFCTDTITGAEDSGLWHNVDLNRIWALESA

SEQ ID NO: 135521 - protein, 313 aa, Glycine max
  Coding DNA Sequence Number=SeqID_18743
  Gene Ontology: Mol. function=transferase activity; Cellular component= Golgi apparatus; Biological process=protein modification process
  Homolog annotation: Hit_ID=UPI0000685FC3; Match level="QueryCoverage =99%, HitCoverage=99%, E-value=1e-121, Identity=67%"; Hit description= glutathione S-transferase
  Pfam annotation: Domain name=GST_C; Domain location=156-275; Score =27.1; E_value=6e-05; Accession=PF00043.15; Description=Glutathione S- transferase, C-terminal domain
MLVNGKWSAEWHPVQATDKQGGFVRQTSSFRHWISADGSSEFAAEPDRYHLYVALICPWASRTLIARSLKGLEHIVSVSVVEPQLGAQGWRFGDYPGADRDPLNNAEYLHQLYTRADADFTGRATVPVLWDKKTQTIVNNESADILRMFNSGFGDLADNRLDLYPEDLRPEIDALNATIYPRLNNGVYRTGFATTQVSYQQAFNEVFEQLDELEQRLKDGRTFLLGERLTEADIRLFVTLIRFDVAYHGLFKCNLRRLRDYPLLDRYLKSVLAVSGVRQTVNIDHIKQGYYSIKALNPNGIVPAGPDLADYGF

SEQ ID NO: 135522 - protein, 283 aa, Glycine max
  Coding DNA Sequence Number=SeqID_18744
  Gene Ontology: Mol. function=protein dimerization activity; Cellular component=nucleus; Biological process=regulation of transcription, DNA-dependent
  Homolog annotation: Hit_ID=UPI00003CC80C; Match level="QueryCoverage =96%, HitCoverage=70%, E-value=3e-52, Identity=41%"; Hit description =COG3146: Uncharacterized protein conserved in bacteria
  Pfam annotation: Domain name=DUF482; Domain location=1-283; Score =350.8; E_value=2.3e-102; Accession=PF04339.3; Description=Protein of unknown function, DUF482
MPLLHLSSLAEITAAEWDALLPDNQPFLRYAFLLGLEESGSVRAENGWQPDYLLWREDGRLRAALPGYRKRNSWGEYVFDHAWADACQRAGIAYYPKWLGAIPFSPVTGARLLGDEAAIIPMLEALPDALQRHGLSGAHINFTTPHANALLATQPDWLARLGVQYHWHNRGYRDFHDFLDTLMSRKRKQLRKEREQVASSGFAFNWYRGDELREDQWDFVYTCYANTYAVRGQRPYLTRTFFSLLAERMPQAIRVVIATLQQQPAAMAFCLVDDDTLYGRYWG

SEQ ID NO: 135523 - protein, 304 aa, Glycine max
  Coding DNA Sequence Number=SeqID_18745
MSRTRRLHSLQRAAFRHGEIIGIQLRRTGKGRQLLPLFIHLFGIPVRARKVSRAGGGDIRLRIKHIQRRFTLNLHHHHIAVQPVAAVAFQQMKLPAGIINDTRGILRDELLKFLRLHARSQRQIVGTENARGAAAGIKTRATRQRTVRILCQQIEMGENRRAPREGCQLAPLAEQRVRVGMQMPEVLCLGGKFTVILHKVRALCRIFHFKQHQVLIDALAAQTAKQRPAPAGIAGEMHAFFAHEGFQLFCGNARFGVDGDIKKAINRLGHNRFHARRRVPLRGKGGLFQLGVDDGFYHHAAGGG

SEQ ID NO: 135524 - protein, 480 aa, Glycine max
  Coding DNA Sequence Number=SeqID_18746
  Gene Ontology: Mol. function=protein-N(PI)-phosphohistidine-sugar phosphotransferase activity; Cellular component=1-2nm peptidoglycan -based cell wall; Biological process=phosphoenolpyruvate-dependent sugar phosphotransferase system
  Homolog annotation: Hit_ID=P36672; Match level="QueryCoverage=91%, HitCoverage=93%, E-value=0.0, Identity=72%"; Hit description=PTS system trehalose-specific EIIBC component (EIIBC-Tre) (EII-Tre) [Includes: ...
  Homolog annotation: Hit description=Trehalose-specific phosphotransfer ase enzyme IIB component (EC 2.7.1.69) (PTS system trehalose-specific EIIB component); Trehalose permease IIC component (PTS system trehalose-specific EIIC component)]
  Pfam annotation: Domain name=PTS_EIIB; Domain location=10-43; Score =52.2; E_value=1.7e-12; Accession=PF00367.11; Description =phosphotransferase system, EIIB
  Pfam annotation: Domain name=PTS_EIIC; Domain location=111-405; Score= 110.7; E_value=4.2e-30; Accession=PF02378.9; Description =Phosphotransferase system, EIIC
  Pfam module annotation: Pfam domain module=PTS_EIIB::PTS_EIIC; Domain location=10-43::111-405
MKTISREIINDLIDRVGGRENILSLSHCITRLRFVLQDVDKADPEAIRATSGVKGCFNSAGQFQVIIGTEVDTYYKALVEALNISETSKEQIKSAARSQMKWHEALLSHFAEIFFPLLPALISGGLILGFRNVLGDIAVADDKTLVQLYPGVKGLYDFLWLIGEAIFFYLPVGICWSVVRKLGGTPILGIVLGITLVSPQLMNAYLIGSQVPEVWNFGWFSIDRVGYQAQVIPALLAGLALAKIELALKRIVPAYLTLVVVPVCALLLSVFLAHSLIGPFGRLIGDGIAFAVRHLMTGSFAPIGAALFGFLYAPMVITGVHQTTLAVDLQMIQSMGGTPVWPLIALSNIAQGAAVVGIIVANKDRAERDLTVPAAISAWLGVTEPAMYGVNLKYRYPMLCAMIGSALAALLCGLNGVMANGIGVGGLPGILSIQPQYWTVYSLAILVAILVPLLLTIIITKRKAATAIISQAEVQHEQAR

SEQ ID NO: 135525 - protein, 193 aa, Glycine max
  Coding DNA Sequence Number=SeqID_18747
  Gene Ontology: Mol. function=lysine permease activity; Cellular component=membrane; Biological process=amino acid transport
  Homolog annotation: Hit_ID=Q6D1Y8; Match level="QueryCoverage=92%, HitCoverage=91%, E-value=4e-58, Identity=61%"; Hit description =Putative membrane protein
MDRFGKTVCQLLLRYGDVDYTGSEQSVTGHVRRQFWLPTHAADAVWHPARLCVTDAAGERGAGAAIALDGVGAVAADGGGMLLSAVAVVENLPRRCAAAARTSASDDPAGRRVFPGGESQSLADGHQRGADVRQQQRCAGGAARLCRPQPAVHFNLGSAGRPAAPSPADCVETSGVQHANGAVAGGDHRLDAV

SEQ ID NO: 135526 - protein, 282 aa, Glycine max
  Coding DNA Sequence Number=SeqID_18748
  Gene Ontology: Mol. function=transferase activity, transferring nitrogenous groups; Cellular component=intracellular; Biological process=regulation of transcription, DNA-dependent
  Homolog annotation: Hit_ID=Q6D1Y9; Match level="QueryCoverage=99%, HitCoverage=57%, E-value=1e-118, Identity=73%"; Hit description =Putative aminotransferase
MSASVNDPSTQKLELIEQVFAAQNHPDYTNISLACPQDSELFPAAKLGRITASLIRRDNDIIGRYALPPGSERLREEIARRSLHTGLNLTVADITLTHGCMEALQLALRAVTKPGDCVGLESPTYFFLFPLLASLGLKALEIPTDPQNGLSLDALEMLLQEQRIQALIAMPGAQNPLGYVMPLENKKRLAKLVNTYHIPLLEDGLYDELQFDWPLSPPVKAFDRDGWVIYCTSFTKTVAPDFRVGWTAAGRFHPAIARLKAVSSMTESKLLSETLAEFLASG

SEQ ID NO: 135527 - protein, 585 aa, Glycine max
  Coding DNA Sequence Number=SeqID_18749
  Gene Ontology: Mol. function=malate dehydrogenase (acceptor) activity; Cellular component=membrane; Biological process =tricarboxylic acid cycle
  Homolog annotation: Hit_ID=P33940; Match level="QueryCoverage=85%, HitCoverage=91%, E-value=0.0, Identity=67%"; Hit description =Malate:quinone oxidoreductase
  Pfam annotation: Domain name=DAO; Domain location=27-467; Score=-5.2; E_value=1.1e-05; Accession=PF01266.14; Description=FAD dependent oxidoreductase
  Pfam annotation: Domain name=Mqo; Domain location=22-512; Score =1190.0; E_value=0; Accession=PF06039.5; Description=Malate:quinone oxidoreductase (Mqo)
  Pfam module annotation: Pfam domain module=DAO::Mqo; Domain location =27-467::22-512
MSNTAVNLALAAAGMESTHLQERKDVDVLLIGAGVMSATLGTWLQDLEPDWSIEMVERLDDVAVESSNGWNNAGTGHAALAELNYTPERADGSIDIAKAVAINESFQISRQFWAYHVQKGNLRNPASFIHSTPHMSFVWGDANVDFLRKRFQALQKSTLFRGMNYSEDRDQIAQWIPLVMNGRDRKQKVAATWTDMGTDVNFGEVTRQLIAALEKKAHFRLRLRQEVRDIKRLSDGRWQVNLHNLASGESRVLTARQLFIGAGGAALPLLQKTGIPEVKGYAGFPVGGSFLVTENPDVVAQHMAKVYGKASVGAPPMSVPHVDTRVLDGKQVLLFGPFATFSTKFLKQGSLLDMFGAMNSSNLLPMMQVGLKSFDLVKYLVDQVLQSDDDRMEALRAYVPQAKQEDWKLVTAGQRVQIIKNDEKEGGVLRLGTEVVTSADGSISALLGASPGASTAAPIMLELMAKVFPEQMRSPEWQTKIRAVIPSWGRKLNGDVALTEKVLAETSRVLQLDYAPVITPEAANDEGRETAHVVGKKRAFVSGTIHCTLRDKSRRYIRVRRTASLTDQPPYCAPAYRAIQRRGIS

SEQ ID NO: 135528 - protein, 288 aa, Glycine max
  Coding DNA Sequence Number=SeqID_18750
  Gene Ontology: Mol. function=catalytic activity; Cellular component =cellular_component; Biological process=biosynthetic process
  Homolog annotation: Hit_ID=Q6D2T4; Match level="QueryCoverage=95%, HitCoverage=97%, E-value=6e-75, Identity=50%"; Hit description =Hypothetical protein pab
  Pfam annotation: Domain name=PhzC-PhzF; Domain location=8-284; Score =195.0; E_value=1.8e-55; Accession=PF02567.7; Description=Phenazine biosynthesis-like protein
  Pfam annotation: Domain name=Pro_racemase; Domain location=24-287; Score=-210.1; E_value=0.0039; Accession=PF05544.2; Description =Proline racemase
  Pfam module annotation: Pfam domain module=PhzC-PhzF::Pro_racemase; Domain location=8-284::24-287
MRKGANMQVAFKQVDVFSTGAFSGNPLAVIMDARGLSDAQLAAIARWTNLSETTFVLPPQDATADYRVRIFTPGGELPFAGHPTLGTAHALLEAGWPLKTAGKIVQECGVGLVEVQIGADGTLAFAAPDASLTPFSDALMSSALHSDAFDLSQTPAVADMGIRWLLIPMSSAQAVLEVVTQADDLLRLQQHAGVNGIALFGPLPQDAEAQYEVRALLVENGSLVEDPVTGSANACLARYLAAQGQRQDYCARQGSAIQRAGRIVVRFAGETIWIGGQTLTLIDGTIEV

SEQ ID NO: 135529 - protein, 235 aa, Glycine max
  Coding DNA Sequence Number=SeqID_18751
  Gene Ontology: Mol. function=oxidoreductase activity; Cellular component=membrane; Biological process=metabolic process
  Homolog annotation: Hit_ID=Q2SKG5; Match level="QueryCoverage=99%, HitCoverage=93%, E-value=4e-79, Identity=64%"; Hit description=Short- chain alcohol dehydrogenase-like protein
  Pfam annotation: Domain name=KR; Domain location=3-176; Score=-96.0; E_value=0.086; Accession=PF08659.1; Description=KR domain
  Pfam annotation: Domain name=adh_short; Domain location=2-159; Score =30.4; E_value=5.5e-08; Accession=PF00106.15; Description=short chain dehydrogenase
  Pfam module annotation: Pfam domain module=KR::adh_short; Domain location=3-176::2-159
NGALKLAAKGVDILFTWRGHAEEAQAVVKEIEALGARAVALQLDVGDSKQFDDFAARVKATLNETWQRHSFDYFVNNAGHGHYKLLAETSEDEFDALVNVHFKGPYFLTQKLLPLIADGGRILNISSGLTRMTLPGSGTYAAMKGAMEVLTRYQAKELGERHIRVNILAPGAIETDFGGGRVRDTKDLNAHIASVTALGRVGLPDDIGDAISAILSDETGWITAQRIEASGGQAL

SEQ ID NO: 135530 - protein, 247 aa, Glycine max
  Coding DNA Sequence Number=SeqID_18752
  Gene Ontology: Mol. function=transferase activity; Cellular component= eukaryotic translation elongation factor 1 complex; Biological process=translational elongation
  Homolog annotation: Hit_ID=Q4ZTI4; Match level="QueryCoverage=82%, HitCoverage=99%, E-value=2e-74, Identity=62%"; Hit description =Glutathione S-transferase, N-terminal:Glutathione S-transferase, C- terminal
  Pfam annotation: Domain name=GST_C; Domain location=111-208; Score =8.7; E_value=0.029; Accession=PF00043.15; Description=Glutathione S -transferase, C-terminal domain
  Pfam annotation: Domain name=GST_N; Domain location=12-87; Score =46.4; E_value=9.6e-11; Accession=PF02798.10; Description=Glutathione S-transferase, N-terminal domain
  Pfam module annotation: Pfam domain module=GST_C::GST_N; Domain location=111-208::12-87
MNRLTILPAESAMLKILGRNSSINVRKVLWLCSELDIAWEHEPWGEDPQSLHSPQFMALNPNAMVPVIIEDDFVMWESNAILRYLANSNGGEWLYPDNPRARAPVDQWMDWQATELNTSWRYAFMSLVRNSPAHQDPRLLAAAVKGWSHTMGILNQQLEKTGRYVAGRNFTLADIPVGLAVNRWFETPLDHPDFPAVQTYYERLTEREGYTTWGRNGQRAGAFQCPGVTLIKRIAAGETQRMAIAIA

SEQ ID NO: 135531 - protein, 1021 aa, Glycine max
  Coding DNA Sequence Number=SeqID_18753
  Homolog annotation: Hit_ID=Q6D950; Match level="QueryCoverage=37%, HitCoverage=99%, E-value=1e-138, Identity=70%"; Hit description =Probable transporter
  Pfam annotation: Domain name=BPD_transp_1; Domain location=270-462; Score=-20.1; E_value=0.07; Accession=PF00528.12; Description=Binding- protein-dependent transport s
  Pfam annotation: Domain name=LysR_substrate; Domain location=9-208; Score=78.1; E_value=2.8e-20; Accession=PF03466.10; Description=LysR substrate binding domain
  Pfam annotation: Domain name=MFS_1; Domain location=269-776; Score= -14.5; E_value=0.0015; Accession=PF07690.6; Description=Major Facilitator Superfamily
  Pfam annotation: Domain name=Ribonuclease_BN; Domain location=267 -532; Score=107.6; E_value=3.6e-29; Accession=PF03631.5; Description =Ribonuclease BN-like family
  Pfam annotation: Domain name=Sugar_tr; Domain location=609-974; Score= -9.4; E_value=1.4e-06; Accession=PF00083.14; Description=Sugar (and other) transporter
  Pfam module annotation: Pfam domain module=BPD_transp_1::LysR _substrate::MFS_1::Ribonuclease_BN::Sugar_tr; Domain location=270 -462::9-208::269-776::267-532::609-974
MDSLFQHDPATLSGKLRVDMSVAMATGFILPRLPEFLQHYPGVEIELSSSDRQVDVIREGFDCVLRVGELKDSGLIARKIGSHALINCASPGYLSRFGMPVRLDDLGQHAMVHYTQQLGQPSPGFEYFDGKQCHYVQTGGVVTVNSTETYRAACTGDWRAAAAGIRPAGRSAAPFPGQTDADFPALSSPSQRGAPRAGVYGVAESGCRRSMTDKTTKASAAEAKPLIDIKTGNKTVDGSIRRVSRFAAWFQAIPAVAHFLRALERFNDRLGSQFGAAITYFSFLSLIPILMVSFAAVGFVLASNQDLLSELINKIVNSISDPTLATTLKNTVNTAIQQRATVGLTGLLLALYSGINWMGNLREAVRAQSRDVWERTPDDQEKWWKKYLRDLVSLLGLMLALVITLSLTSIAGAAQAAIVNALGLGDIEWLRPAMTIIALSISIFANYLLFLWIFWILPRHKPRKKALLRGTLLAAIGFEVIKFVMTLTLPKLATSPSGAAFGSVLGLMAFFYFFARLTLFCAAWIATAKYKDDPEISKNQQETLKGHFYLALLQRITPEKPRFPFPSAADCRNSEIILFFAAKARFMQASISETPDQPHDGTPVNSRSKVVVASLVGTAIEFFDFYIYATAAVIVFPHIFFPQGDATVATLQSLATFAIAFVARPIGSALFGHFGDRVGRKATLVASLLTMGVSTVLIGLLPGYQTIGVAAPLLLALARFGQGLGLGGEWGGAALLATENAPAKKRALYGSFPQLGAPIGFFFANGTFLLLSWLLTDEQFMNWGWRVPFVLSAVLVIIGLYVRVSLHESPVFAKVQKEKKQLRHRAGAGWSRLFAQQLPVDADGGGHRFWRDGADCRPAGGPFWPSQNDDHHYADDHRLCADVPAAARLRLADSGDGLPADRPEYYGSDIRPDGRAAARTVPDRTPYIATWLNANYGLQAVGFYLASMAVLTLIALIACKETRHQTLYEAADVSALIHQHRADTPSPAGGRGNRLVRADVAALIHQHRADAPSPVYGRGPG

SEQ ID NO: 135532 - protein, 155 aa, Glycine max
  Coding DNA Sequence Number=SeqID_18754
  Gene Ontology: Mol. function=nucleoside-triphosphatase activity; Cellular component=membrane; Biological process=chlorophyll biosynthetic process
  Homolog annotation: Hit_ID=Q1CNN2; Match level="QueryCoverage=99%, HitCoverage=30%, E-value=8e-53, Identity=68%"; Hit description =Magnesium chelatase family protein
MSLSKVLTRAALGVQAPLVTIEVHISNGLPALTLVGLPETTVKEARERVRSAIINSGFTFPAKRVTINLAPADLPKEGGRYDLPIAIAILAASEQLPGDKLAHYEFLGELALNGALCGVQAAIPAAMAALQAGRQMILAEHNQQDVGLIQQGETL

SEQ ID NO: 135533 - protein, 1473 aa, Glycine max
  Coding DNA Sequence Number=SeqID_18755
  Homolog annotation: Hit_ID=P05791; Match level="QueryCoverage=39%, HitCoverage=100%, E-value=0.0, Identity=85%"; Hit description =Dihydroxy-acid dehydratase
  Pfam annotation: Domain name=Aminotran_4; Domain location=594-872; Score=459.1; E_value=5.7e-135; Accession=PF01063.9; Description =Aminotransferase class IV
  Pfam annotation: Domain name=ILVD_EDD; Domain location=923-1467; Score=1187.3; E_value=0; Accession=PF00920.11; Description =Dehydratase family
  Pfam annotation: Domain name=TPP_enzyme_C; Domain location=374-522; Score=242.9; E_value=6.8e-70; Accession=PF02775.11; Description =Thiamine pyrophosphate enzyme, C-term
  Pfam annotation: Domain name=TPP_enzyme_M; Domain location=186-321; Score=214.9; E_value=1.8e-61; Accession=PF00205.12; Description =Thiamine pyrophosphate enzyme, centra
  Pfam annotation: Domain name=TPP_enzyme_N; Domain location=1-170; Score=358.6; E_value=9.8e-105; Accession=PF02776.8; Description =Thiamine pyrophosphate enzyme, N-term
  Pfam module annotation: Pfam domain module=Aminotran_4::ILVD_EDD::TPP_ enzyme_C::TPP_enzyme_M::TPP_enzyme_N; Domain location=594-872::923 -1467::374-522::186-321::1-170
MTGAQWVVQALRAQGVDTVFGYPGGAIMPVYDALYDGGVEHLLCRHEQGAVMAAIGYARATGKTGVCIATSGPGATNLITGLADAMMDSVPVVAITGQVSSAFIGTDAFQEIDVLGLSLACTKHSFLVESLDDLPSVMAEAFAIAQSGRPGPVLVDIPKDIQIASGDLTPHLLPVEEALSHSPQHIAEARALMAQAQKPMLYIGGGVGMAQAVPALRAMAQETGIPMVSTLKGLGSAEASSDLYLGMLGMHGTKAANLAVQSCDLLIAVGARFDDRVTGKLDTFAPHASVIHIDVDPAELNKLRRAHVSLQGDLNQVLPALSMPLQIDGWRTEVKAMNAEFAWRYDHPGEAIYAPLLLKQLSDRKPDSAVVTTDVGQHQMWAAQHMRFSAPENFITSSGLGTMGFGLPAAVGAQVARPDDTVICVSGDGSIMMNIQELGTIKRKQLPVKILLLDNQRLGMVRQWQQLFFDGRYSETILTDNPDFLTLASAFDIPGQRISRKDQVDAAIDALLNSEGPYFLHVAIDEHENVWPLVPPGASNANMMEKTVCAMNMASAVNAENINIEMTVASQRSVDLLSSQLSKLMDVAYFIWFNGEMVKWEDAKVSVMSHALHYGTSVFEGVRCYDSHKGPVVFRHREHMQRLHDSAKIYRFPIKASVDELMEACREVIRVNKLKSAYIRPLAFVGDVGLGVNPPDGFTTDVIIAAFPWGAYLGAEALEQGINAMVSSWNRVAPNTLPTAAKAGGNYLSSLLVGSEARRHGYQEGIALDTQGYISEGAGENLFEVKDGILFTPPFTSSALPGITRDAIIKLAKDLGIEVREQVLSRESLYLADEVFMSGTAAEITPVRSVDGIQVGQGKRGPVTTKIQQAFFGLFTGETEDKYGWLDQSMPKYRSATTTHGRNMAGARALWRATGMTDDDFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDKIIKLDLVDAMIQGANPNVSDADSEQIERSACPTCGSCSGMFTANSMNCLTEALGLSQPGNGSLLATHADRKDLFINAGKRIVNLTKQYYEQDDARVLPRNIASKAAFENAMTLDIAMGGSTNTVLHLLAAAQEGEIDFNISDIDRLSRKVPHLCKVAPSTQKYHMEDVHRAGGVIGILGELDRAGLLHTDVRNVLGLNLRETLDQYDIMLTKDEAVKKMFRAGPAGIRTTQAFSQDCRWDTLDDDRQEGCIRTREHAFSQDGGLAVLYGNMAEDGCIVKTAGVDKEILTFKGPAKVYESQDDAVEAILGGKVVAGDVVVIRYEGPKGGPGMQEMLYPTTYLKSMGLGKSCALITDGRFSGGTSGLSIGHASPEAANGGTIALEARGEAAYTPHGRVRQVSFALRAYASLATSADKGAVRDKSKLGG

SEQ ID NO: 135534 - protein, 43 aa, Glycine max
  Coding DNA Sequence Number=SeqID_18756
MVDDNDDTAGVLHDDTAGVIHDDNQLRESKLKGAIVLRKLHSM

SEQ ID NO: 135535 - protein, 180 aa, Glycine max
  Coding DNA Sequence Number=SeqID_18757
  Gene Ontology: Mol. function=helicase activity
  Homolog annotation: Hit_ID=Q2R1R7; Match level="QueryCoverage=98%, HitCoverage=9%, E-value=8e-20, Identity=33%"; Hit description=AT hook motif-containing protein, putative
MDNHEHANHRDTAQAKIKNKRIRQHKVNDQAQNIDFNIRDSSEDERSESTQVSSPENQNYMSSANDPAINREGYSDLGDQLMQCSHCNANMWYDERVSKDKRTTNPRLSLCCGNGKVELPLLQNPPKYLYQLLYDHDTSDSKNYQQNIRTYSMMFAFTSVGIKFDKSINHSRGPPTIRIQ

SEQ ID NO: 135536 - protein, 106 aa, Glycine max
  Coding DNA Sequence Number=SeqID_18758
  Subcellular localization annotation: CTP_CleavageSite=72; ConfidenceScore=5.21e-01
MSPCFSYIAGTISNITDTASSEQRRKQISTNLHFSRTSFNIHVSLHIRVAAVIQQSRTETAPNVTVTCRLISCQRKPHGTVDNMTVLTSNPLGKMNADNSGGGDLY

SEQ ID NO: 135537 - protein, 88 aa, Glycine max
  Coding DNA Sequence Number=SeqID_18759
MKLCFKERRTTKFLSSSRCKIAPLIPSFHESVPYINYDLPSVMVYLQTLLVTFPNLRLDSADGSCFFLLTNIGFASYDTCQHLTLCPG

SEQ ID NO: 135538 - protein, 107 aa, Glycine max
  Coding DNA Sequence Number=SeqID_18760
MTRPTEFMDVADSDFLGNKEFDEEDSEFETDFEKYFVYSTAKNRFFGRKRPLRVILGSGLSMLFCFFYTPSYMTCFESFICVSKITLNMLTWGMFGSAFRKMHPNRP

SEQ ID NO: 135539 - protein, 296 aa, Glycine max
  Coding DNA Sequence Number=SeqID_18761
  Gene Ontology: Mol. function=RNA-directed DNA polymerase activity; Biological process=RNA-dependent DNA replication
MEAMKDQMTSMMEAMLSMKQMMENNVVAVATTSTVAEVDPTHPSAINQTSQPALVMVGQGGEVLGSIGGPYMGQNRNSFPYDLPPNYTPPNAVHLPNKNANHSVPIPLEGQQPQLGHAPFAQPVGEACEEPRDHALGDIEPYPMYAIEGPAFSGMPQPNATGAPQHRPLQPLHFSVGRLPPAMEEREKLDLIEERLRAIEGIGDYPFADMAKLCLVPDIIISPKFKVSDFNKYKGTTCPKNHLKMYYRKMGAYSRDENLLMHFFQESLVGAAVTRYTNLEAFRICSWKDLMVAFIK

SEQ ID NO: 135540 - protein, 115 aa, Glycine max
  Coding DNA Sequence Number=SeqID_18762
MGGFGVAETVMVGSRGGGICSGGGYLGFGLGRRMFEKKTTSKTKKKKRKTKWKRNRRVRISHPHRRAYGFRSVSRLSFSSINYSVLMLIMLLLMKIGGPEVKASRGCFEDTQEAS

SEQ ID NO: 135541 - protein, 125 aa, Glycine max
  Coding DNA Sequence Number=SeqID_18763
  Gene Ontology: Mol. function=monooxygenase activity; Cellular component=membrane; Biological process=electron transport
  Homolog annotation: Hit_ID=Q10LX2; Match level="QueryCoverage=76%, HitCoverage=21%, E-value=1e-18, Identity=50%"; Hit description =Cytochrome P450 family protein, expressed
MTNREAWKLEKEVKKLILQGVKERKETSFEKDLLQMVLEGARNSNLSQEATNRFIVDSCKNIYLAGYETTVVATAWYLMLLASNQNWHDRVRAEVLEICRDSIPNFTMLCKMKQKLKCQCTLGLY

SEQ ID NO: 135542 - protein, 123 aa, Glycine max
  Coding DNA Sequence Number=SeqID_18764
REFAKCNLQWLSARKNLEEDELSSSLSAPLQVIKRTASYHPLSETSVLSQNPLMRAKLSRSVLSARARTKATYLSLKSDLQREYGTFLEKLWMHEAFEKQHFIQHVQHLTNIQCTSSMAQNTS

SEQ ID NO: 135543 - protein, 198 aa, Glycine max
  Coding DNA Sequence Number=SeqID_18765
  Gene Ontology: Mol. function=protein serine/threonine kinase activity; Cellular component=integral to membrane; Biological process=protein amino acid phosphorylation
  Homolog annotation: Hit_ID=Q9M0A8; Match level="QueryCoverage=54%, HitCoverage=17%, E-value=2e-19, Identity=50%"; Hit description =Receptor-like kinase homolog
MGYIGKDLSPTGIVIVVLIICTILGFPLAIIVSLGSGPWDQLFGGGNSLTFVVAAISALISGLITVLAIPRSGAQKARSHVNYENFGTHTCPPALQIDWKAANVLLDDCFRLLLEILALHQCDANVLLDDYCLQADSHVTNTICGIVGHIAPEYLSTSQSSDKTNVFGFGILLLELITVITTLEFGKTINQKGAMLEW

SEQ ID NO: 135544 - protein, 86 aa, Glycine max
  Coding DNA Sequence Number=SeqID_18766
  Gene Ontology: Cellular component=integral to membrane
  Homolog annotation: Hit_ID=P0ACY6; Match level="QueryCoverage=95%, HitCoverage=56%, E-value=1e-21, Identity=62%"; Hit description =Hypothetical protein yeaL
  Pfam annotation: Domain name=DUF441; Domain location=1-86; Score =60.1; E_value=7.2e-15; Accession=PF04284.3; Description=Protein of unknown function (DUF441)
  Subcellular localization annotation: CTP_CleavageSite=74; ConfidenceScore=5.27e-01
MAPLASGTLPASSLLKSFANWQSIVAIIVGVFVAWLGGRGVSLMSVQPSVIGGLLIGTVIGVAFFRGVPVGPLIAAGIVSLFVTTK

SEQ ID NO: 135545 - protein, 267 aa, Glycine max
  Coding DNA Sequence Number=SeqID_18767
  Gene Ontology: Mol. function=protein binding
  Homolog annotation: Hit_ID=Q6D153; Match level="QueryCoverage=60%, HitCoverage=12%, E-value=7e-67, Identity=79%"; Hit description =Putative membrane protein
  Pfam annotation: Domain name=DUF490; Domain location=1-167; Score= -7.9; E_value=9.9e-07; Accession=PF04357.3; Description=Family of unknown function (DUF490)
  Pfam annotation: Domain name=UPF0131; Domain location=163-262; Score =119.7; E_value=8.1e-33; Accession=PF03674.5; Description =Uncharacterised protein family (UPF0131)
  Pfam module annotation: Pfam domain module=DUF490::UPF0131; Domain location=1-167::163-262
DLIVRKGQLMFSGPPDQPLLNIEAIRNPESTEDDVTAGVRVTGLADAPKLEVFSDPAKSQQEALSYLLRGQGLSSSGADGNAMTSMLIGMGVAQSGQLVGKIGEAFGVSNLALDTQGVGDSSQVVVSGYVLPGLQVKYGVGIFDSLATLTLRYRLMPKLYLEAGNSHWMTNAQWLGDHQIEGFALYNLGHYPGVVEGDGTVYCEVYRIDASTLGELDALRSKNGEYKRQLIQTPYGSAWLYVYQRSIAGRTRIASGDWLRRDDAAEA

SEQ ID NO: 135546 - protein, 570 aa, Glycine max
  Coding DNA Sequence Number=SeqID_18768
  Gene Ontology: Mol. function=ligase activity, forming carbon-nitrogen bonds; Cellular component=integral to membrane; Biological process =peptidoglycan-based cell wall biogenesis
  Homolog annotation: Hit_ID=P37773; Match level="QueryCoverage=74%, HitCoverage=93%, E-value=0.0, Identity=85%"; Hit description=UDP-N -acetylmuramate:L-alanyl-gamma-D-glutamyl-meso- diaminopimelate ligase
  Pfam annotation: Domain name=Mur_ligase; Domain location=6-107; Score= 112.0; E_value=1.7e-30; Accession=PF01225.15; Description=Mur ligase family, catalytic domain
  Pfam annotation: Domain name=Mur_ligase_C; Domain location=315-396; Score=27.7; E_value=4e-05; Accession=PF02875.11; Description=Mur ligase family, glutamate ligase domain
  Pfam annotation: Domain name=Mur_ligase_M; Domain location=110-295; Score=25.5; E_value=6.4e-08; Accession=PF08245.2; Description=Mur ligase middle domain
  Pfam module annotation: Pfam domain module=Mur_ligase::Mur_ligase _C::Mur_ligase_M; Domain location=6-107::315-396::110-295
MDLFMRIHILGICGTFMGGLAMLARSLGHEVTGSDANVYPPMSTLLQQQGIELTEGYDASQLDPAPDLVIIGNAMTRGNPCVEAVLERNIPYLSGPQWLHDFVLRDRWVLAVAGTHGKTTTAGMAAWILEACGLEPGFIIGGVPGNFDVSAKLGKSPFFVIEADEYDCAFFDKRSKFVHYCPRTLILNNLEFDHADIFDDLRAIQKQFHHLVRIVPGQGKILLPEHDHNIKQVMAMGCWSEQESVGDNGRWQAKKLVPDASRWEAWLDGEKVAEVNWALVGEHNMHNGLMAIAAARHVGVKPCDAGEALNSFINARRRLELRGEVNAIKVYDDFAHHPTAILATLAALRSKVGGTARILAVLEPRSNTMKMGVSKNELAPSLGRADEVFLFQPHHIPWQVADVADACIQPAHWSADIDTLVEMVAKAAQPGPRGDLPSSQPSPASGRRGRPVRTSHPALVLSYLSTLLQLPQHCALHSLSRLRERVRVRAGKPSAADLRFSQLAQVLENLAGGFWRLTGGFLFLRVADHTAQLLTVGVRIEIQHFRHRIIAGIDKPIAQLLQLMEQRNLL

SEQ ID NO: 135547 - protein, 747 aa, Glycine max
  Coding DNA Sequence Number=SeqID_18769
  Homolog annotation: Hit_ID=Q1STQ3; Match level="QueryCoverage=15%, HitCoverage=64%, E-value=9e-15, Identity=39%"; Hit description =Bromodomain
  Pfam annotation: Domain name=Bromodomain; Domain location=113-200; Score=54.0; E_value=4.9e-13; Accession=PF00439.15; Description =Bromodomain
MKFQDEIEWMGRRRSSRIIALEEKKLKERERKLALALERKNKSMNHDKQKGKATIEVQDDLRDFSEHEEGSTKKGHKSKEFYQLISSIKELERHSENVSTSGSNDSSLNGVSLKNILQIIIDFLQREDPNELLAQPISFDVVENYYEIVKQPMDFGTIRAKIHESLYTNLEQFKRDVFLMLSNATDVYPTTSKYHQVAENISRDAKCVFEALAEPQNFDSELSLDKTCPTRKPQNGKLGTSRRVSPKVASMETRSSFNLHRKNVTHVMVPEIEKRHMYWPTSKPLISEVLCASNPNIQLKTNSIKYKESLLRFVQDLGPTAKRVAAKKLEALRDQQLCNVDTPTPQTQPTVLNAQTLALAIPFLNRSLTTIPGSAAQGNKIFNNNNVGGVNIKDVPYQGNKTNTNDSWNAYVATLLSNRFLNNDKGESSSGRIENFNTLSPRVYPTTSVISGPSISLPESSSLVPQSRIRNFMSSMPSNNLSQISHAHKPRPEDIINLSDLSLVSQQRPENFISYMPSNNLSQISHAHKPRPEDIINLSDLSLVSQQRPENFISYMPSNNLKQISLTQEPNNLSQFSRAHEPRPEDIINLSDLSLVSKARPENFVSCMPCNNLKQFSLAREPRPEDFVNLSDLSLVSQPRPRDSMYAMPSNNSIDPSLMPRPWQANSMYCLNSTSVSPLPLPNQGMSVSSTSDSSSMNHSTSTMLHGIHDQVLHNATPYTPFDMQVQNQYSSYFQLDETSGGWRQRL

SEQ ID NO: 135548 - protein, 165 aa, Glycine max
  Coding DNA Sequence Number=SeqID_18770
  Gene Ontology: Mol. function=cytochrome-c oxidase activity; Cellular component=integral to membrane; Biological process=electron transport
  Homolog annotation: Hit_ID=Q75HA3; Match level="QueryCoverage=54%, HitCoverage=39%, E-value=2e-18, Identity=53%"; Hit description =Expressed protein
MQEAQKQFLVCSLEEERLLHGRDACPQLFIVNMVVICWDLGPRLELSSQLLAPHWSDAQADFYRLFSSRSGNDSLAFSSFRRSGIRFTPWAVHVFYYPIFAKWPRTDLHTNGTWILLVLRAPNFTSGMALLCSSGGWYCIIYFWSQFYSIIVPEGIAYGHIGFAS

SEQ ID NO: 135549 - protein, 180 aa, Glycine max
  Coding DNA Sequence Number=SeqID_18771
MWGRWWWRAGGGFLRQRVSSIGSVSHGYGEKLHPLDPPLLGLRGVVEVMCGGRRTPLSVVLNQIKRGVSTSTGNGGVSNGNNGTTEDSISFSEAKKLMRLVNVESLKMKLGMEGKEVICYSELLEACESVGIARSPEEAAAFARVLDEAGVVLLFRDKVYLHPDKNIACACGAHEKRDRI

SEQ ID NO: 135550 - protein, 166 aa, Glycine max
  Coding DNA Sequence Number=SeqID_18772
  Gene Ontology: Cellular component=integral to membrane
  Homolog annotation: Hit_ID=Q9FJV7; Match level="QueryCoverage=79%, HitCoverage=45%, E-value=3e-20, Identity=36%"; Hit description =Arabidopsis thaliana genomic DNA, chromosome 5, P1 clone:MFO20
  Pfam annotation: Domain name=DUF607; Domain location=1-147; Score =178.5; E_value=1.6e-50; Accession=PF04678.4; Description=Protein of unknown function, DUF607
MPSRVVDLVRRAVPLVLTADNDPMREELKKLQDKKEEIDVLAHTQARRILWSGLGFGVITVGFFFRLTFWEFSWDVMEPIAFFTTTTGLVIGYAYFLFTSRDPTYQDFMKRLFLSRQRKLFKRQNFDIERFKELQCKCKTPLHASTVLKNRIGVELDLEDALHRDH

SEQ ID NO: 135551 - protein, 185 aa, Glycine max
  Coding DNA Sequence Number=SeqID_18773
  Homolog annotation: Hit_ID=Q1S7C5; Match level="QueryCoverage=62%, HitCoverage=9%, E-value=4e-17, Identity=42%"; Hit description =Integrase, catalytic region
  Subcellular localization annotation: CTP_CleavageSite=3; ConfidenceScore=5.24e-01
MAYASIPPPPPPPPGNGATSLGSSAVIIAKEFLHSISQKLNNSNYLLCNKINSFCRGFNQPSLARFFCNSLDAKQLGIFGTNFHLMVCAKKRQLRNDLHNIFLNNSSISDYLFRIQTIIDLLSWIGEHVLESNHADIILDGLPNEFESLITFVSGKFESLSIDEVATLLFAHESQEKSCLVYGFN

SEQ ID NO: 135552 - protein, 219 aa, Glycine max
  Coding DNA Sequence Number=SeqID_18774
  Gene Ontology: Mol. function=RNA-directed DNA polymerase activity; Cellular component=membrane; Biological process=RNA-dependent DNA replication
GELWAKVLDSKYGSWRSLDESRRNSRDSIWWRDLSNVCNAFEEGSWFRSGIKWKIGCGSKVKFWEDGWLDGGILLLEKYPRMYSISQQQHHFVQQLGVASLGGWDWQLQWRSLLREAEIDIAAKFMKDIEGVVVQANQQDSWGWGVDPSGIYSVGSAYKALNRHLSKENDNEVFKELWKLKVPSKVSPFAWRLIRDRLPTKANLRRRNVDLNDISLPFL

SEQ ID NO: 135553 - protein, 346 aa, Glycine max
  Coding DNA Sequence Number=SeqID_18775
  Homolog annotation: Hit_ID=Q1S8G7; Match level="QueryCoverage=96%, HitCoverage=70%, E-value=4e-28, Identity=30%"; Hit description =Cyclin-like F-box; FBD
  Pfam annotation: Domain name=FBD; Domain location=259-308; Score =52.3; E_value=1.6e-12; Accession=PF08387.1; Description=FBD
MVLLHLANSSIQNFSLCLTCYQYDSSLISAWISSIFERGVHNLHIQYADDVHFPSHTLFSCISLVQLVLQMKCTISVPIFSSLPNLQNLSISGVSLCEWLTKQNISMKAPLLEKFSIAIWGSLSNESHKSAIKIFAPNLTDFSYEGDLEQHVILLNSSIRSVYVVVVIDEDNKDRMENVGFKVHNLLAQIREVEQLKLLFYKVLMHARDSFTHPPAFGRLTCLQLNEVTGEALLNILHNSPILNTLVLQNGVSESNKDVLASAPVPQCFLSSLKVFQFKEFNVHELELLLVKFVMANAAMLEQMTICSAFWLRYSDIDMEKVKEQILSFPKCSNFVMIQCSNVNSY

SEQ ID NO: 135554 - protein, 202 aa, Glycine max
  Coding DNA Sequence Number=SeqID_18776
  Gene Ontology: Mol. function=protein serine/threonine kinase activity; Cellular component=integral to membrane; Biological process=protein amino acid phosphorylation
  Homolog annotation: Hit_ID=Q9C867; Match level="QueryCoverage=94%, HitCoverage=32%, E-value=8e-50, Identity=51%"; Hit description =Protein kinase, putative
  Pfam annotation: Domain name=Pkinase; Domain location=1-190; Score= -23.4; E_value=3.6e-07; Accession=PF00069.15; Description=Protein kinase domain
  Pfam annotation: Domain name=Pkinase_Tyr; Domain location=1-190; Score=-58.6; E_value=7.1e-09; Accession=PF07714.7; Description =Protein tyrosine kinase
  Pfam module annotation: Pfam domain module=Pkinase::Pkinase_Tyr; Domain location=1-190::1-190
MPHGSLDSFLHGRSREKKVLDWPTRYRIAAGAARGISYLHHDCIPHIIHRDIKSSNILLDRNMDARVSDFGLATLMQPTKTHVSTIVAGTFGYLAPGRATLQGDVYSFGVVLLELLTGKKPSDEAFMEEGTMLVTWVKAVVRDKKEELVLDNSLGSCSMQEVNKVFSIAMMCLEPDPLKRPTMAEVVSLLEQTEADKLITAS

SEQ ID NO: 135555 - protein, 389 aa, Glycine max
  Coding DNA Sequence Number=SeqID_18777
  Gene Ontology: Cellular component=membrane
  Homolog annotation: Hit_ID=Q6ZGZ0; Match level="QueryCoverage=94%, HitCoverage=96%, E-value=2e-83, Identity=45%"; Hit description =Putative purine permease
  Pfam annotation: Domain name=DUF6; Domain location=59-194; Score= -3.0; E_value=0.099; Accession=PF00892.11; Description=Integral membrane protein DUF6
  Pfam annotation: Domain name=TPT; Domain location=214-363; Score =184.9; E_value=1.9e-52; Accession=PF03151.7; Description=Triose -phosphate Transporter family
  Pfam module annotation: Pfam domain module=DUF6::TPT; Domain location= 59-194::214-363
MADREIEASPRYHPDNDVKESIAVGVSTTTDEDEPSSLFQLSRWRWWFLVVINIALLLMGQSGAVLLGRFYFDQGGESIWMATLVQTIAFPILFFPLFFFPHPKNLSNTTHLTMHSYTLTLIMVYFLLGILLAGDNMMYTIGLLYLPVSTYSLICASQLAFNAIFSFLINAEKLTMLILNSVILLTISASLIALHSDSSEDNTKNVTKNKHMVGIWCTLGASAGYALLLCLMQLTFERVLKRETFSVVLEMQIWTSFVASCVCIVGLFASGEGKGLEDEMRRFKAGREVYMLTLVGTALAWQICSVGVVGLIYLVSSLFSNVMSMLSLPLVPVAAVLLYREQMDGVKIVAMLLAILGFSSYIYQNYLDENKPKETAILAIDTPETSISG

SEQ ID NO: 135556 - protein, 579 aa, Glycine max
  Coding DNA Sequence Number=SeqID_18778
  Gene Ontology: Mol. function=protein binding
  Homolog annotation: Hit_ID=Q1S8G7; Match level="QueryCoverage=67%, HitCoverage=75%, E-value=2e-37, Identity=33%"; Hit description =Cyclin-like F-box; FBD
  Pfam annotation: Domain name=F-box; Domain location=21-68; Score =25.8; E_value=0.00015; Accession=PF00646.23; Description=F-box domain
  Pfam annotation: Domain name=FBD; Domain location=374-423; Score =57.8; E_value=3.6e-14; Accession=PF08387.1; Description=FBD
  Pfam module annotation: Pfam domain module=F-box::FBD; Domain location=21-68::374-423
MDSNAATMHGTTKQLKYGAKDIISQIHDSILGHILSFLPTMEAVQTSVLSTRWIDVWTSITNLKLNDGVLICSGKKMQKEQYEYFVNTMLLHLANLSIQSFSLCLTCFHYESSQVSAWISSILERGVQRLEIQYANKIFFPSHTLFSCNSLVQLVLQMRCTLSVPIFACLPNLQTLGLSGIKLVSDHESSTYSKDLVLSFPILKVFEAKGCEWSTKQNLCIQVPLLERFSIAMWNSLSNESCKSSIKIFSPHLTDFSYKGDLEQEIILLNTLLIRTASVVSVIDADKKESMRRLGFQVHKLLTQICEVEQLKLLLYKVLVHAADIFTHLPVFGKLTYLLLNEVTGEALLNLLHNSPMLNTLILQNGVFDLNEDMLTSASVPQCFLSSLKVFQFKGFNVHEHELLLAKFVMANATVLERMTLSTAFWLQYSDIDMEKSASSPCQLKYPKFLCLTSCHYDSSQNSAWVISFPVLKGLEAREDIITTNNLTDFSNEGDLEREITSIKFTLLSGKALQRDGSACTMVYSPVLAGQRLLYHNFTKYELYKRAITFMINESRKQNNRSLKQVINDQVVMKVRYLS

SEQ ID NO: 135557 - protein, 212 aa, Glycine max
  Coding DNA Sequence Number=SeqID_18779
  Gene Ontology: Mol. function=isomerase activity; Biological process =protein modification process
  Homolog annotation: Hit_ID=Q53B73; Match level="QueryCoverage=82%, HitCoverage=74%, E-value=1e-74, Identity=74%"; Hit description =Putative chalcone isomerase 3
  Pfam annotation: Domain name=Chalcone; Domain location=41-212; Score=- 19.1; E_value=0.00069; Accession=PF02431.6; Description=Chalcone -flavanone isomerase
MNHERSYSFSFSIAPIFKVVMVPILDFTWAKAYHLARAVNAEYVEEPATNVKFQTSLSFPGCSNSLTLFGTGYREKVFAIIGVKVYAAASFEKSLQIILVRDVDGKTFWDALSDAISPRIQQPTTTDETALTTFRGVFLDRPLKKGAIIILTWLNPSGLLVSVSSNGLPSTMDATIESANVASALFNVFLGDSPVSPSLKASVAESLSKVLK

SEQ ID NO: 135558 - protein, 94 aa, Glycine max
  Coding DNA Sequence Number=SeqID_18780
MEHIVQMKGRLKLNVTTTSNGVAPESIIQIFSVPEALKDRKLELLPAMVREQELDVLLKGFIKARRCSNDDDERWLTVEDGIEQRPMVYVVTGH

SEQ ID NO: 135559 - protein, 50 aa, Glycine max
  Coding DNA Sequence Number=SeqID_18781
MAPSGRRVLPKVIKRIPEEQIFRKAPETPLPDDLSSGSGSTSRKTLSSGI

SEQ ID NO: 135560 - protein, 351 aa, Glycine max
  Coding DNA Sequence Number=SeqID_18782
  Gene Ontology: Mol. function=ATP-dependent helicase activity; Cellular component=intracellular; Biological process=DNA recombination
  Homolog annotation: Hit_ID=Q7XHW1; Match level="QueryCoverage=91%, HitCoverage=36%, E-value=1e-119, Identity=62%"; Hit description =Putative ATP-dependent DNA helicase recQ
  Pfam annotation: Domain name=Helicase_C; Domain location=101-177; Score=99.7; E_value=8.8e-27; Accession=PF00271.21; Description =Helicase conserved C-terminal domain
MEFGTKKDNFFLVNPGHPLREPKTSPSKVQYDIIGSLKLNYPFVTIGSVDRTNLFYGVKLLNRGQSFIDELVREISKEVTNGGSTIIYCTTIKDVEQIFKSFAEAGIEAGMYHGQMNGKAREESHRLFVRDELQVMVATIAFGMGIDKPNIRQVIHYGCPKSLESYYQESGRCGRDGIASVCWLYYTRSDFAKGDFYCGEVKSEKQRKAIMESLLAAERYCVLTTCRRKFLLEYFGEKFPADRCGNCDNCKISRKERDMSREAFLLMACIHSCRGGWGLNMPIDVLRGSRSKKILDVQFDKLPLHGLGKNYPANWWKALGYQLISQGTFSGNNLPSYSLIRTDHNGTDLKR

SEQ ID NO: 135561 - protein, 47 aa, Glycine max
  Coding DNA Sequence Number=SeqID_18783
MLELGDYGCAIVVVAWVVAEWGKMKWLGRGKGLVAEHLMASEHHEPA

SEQ ID NO: 135562 - protein, 105 aa, Glycine max
  Coding DNA Sequence Number=SeqID_18784
  Gene Ontology: Mol. function=oxidoreductase activity; Cellular component=membrane; Biological process=electron transport
  Homolog annotation: Hit_ID=Q2MJ18; Match level="QueryCoverage=69%, HitCoverage=14%, E-value=3e-13, Identity=50%"; Hit description =Cytochrome P450 monooxygenase CYP72A59
MEAAWITILVLILILSLIGAWKLLNWLWLTPKRLERLLREQGLQGNPYTLLVGDSMEVIKIRKEALSKPITLFSHDIVPRVSSYAQHTLNKHGICLCPSFSFLHF

SEQ ID NO: 135563 - protein, 181 aa, Glycine max
  Coding DNA Sequence Number=SeqID_18785
  Gene Ontology: Mol. function=serine-type peptidase activity; Cellular component=integral to membrane; Biological process=proteolysis
  Homolog annotation: Hit_ID=Q2R135; Match level="QueryCoverage=79%, HitCoverage=76%, E-value=5e-39, Identity=54%"; Hit description =Signal peptidase I family protein, expressed
  Pfam annotation: Domain name=Peptidase_S24; Domain location=43-113; Score=25.3; E_value=0.00022; Accession=PF00717.13; Description =Peptidase family S24
MRFVGYIAQWRSAAKEALDRTAITVKFLCWLHFTGNYLCSPCHTYGVSMLPTLNVAGDVLLADHLSPRLGNIGHGDLVLVRSPLNPKIRLTKRVVAVEGDTVTYFDPLHSEAAQVAVVPKGHVWIQGDNIYASRDSRHFGPVPYGLIEGKVFFRVTVVPHTYYILVYYILSIGFLGFTPLS

SEQ ID NO: 135564 - protein, 213 aa, Glycine max
  Coding DNA Sequence Number=SeqID_18786
  Gene Ontology: Cellular component=ribonucleoprotein complex
  Homolog annotation: Hit_ID=Q5QLQ3; Match level="QueryCoverage=52%, HitCoverage=71%, E-value=5e-14, Identity=34%"; Hit description=60S ribosomal protein L18A-like
MTDEDKPKAFSGGHHNHPPPQPQPFPAAQYGTFQGVANYPPPQPHPAIGFPHPVPPPGAVDSSAPPPPYYPGYQAVPGYAVAEGRPVRERRLGCCGLGCGWCLFILGFFLAGIPWYVGAIIMLCSRVDYREKPGYIACVVAMFPRGIVWLYRLIALGFYLHITQAFCIFSCILRIKLLEVVVFTCIIDDIMHEKAVLGTIAIILGVTEGVDDW

SEQ ID NO: 135565 - protein, 595 aa, Glycine max
  Coding DNA Sequence Number=SeqID_18787
  Homolog annotation: Hit_ID=Q1SHD0; Match level="QueryCoverage=52%, HitCoverage=93%, E-value=3e-18, Identity=26%"; Hit description =Leucine Rich Repeat, putative
  Pfam annotation: Domain name=F-box; Domain location=6-53; Score=36.9; E_value=6.9e-08; Accession=PF00646.23; Description=F-box domain
  Pfam annotation: Domain name=FBD; Domain location=415-464; Score =30.0; E_value=8.6e-06; Accession=PF08387.1; Description=FBD
  Pfam module annotation: Pfam domain module=F-box::FBD; Domain location=6-53::415-464
MMVNPDMISNLPDEIKTNILSKLCIDEAVRCSVLSKTWKGLWKGMSHMELNATNMVEPFTKLLRSRKPRTFPDFSAIAPPMLKSVIGYNALVVPLLFNHLGVISSCRIQHFKKSLAFEHVENWVEILVAIHTRLKDLSLECVAHCEELTEKIMPEEYTYIPRFRHGAFECLASLELINYTLNSWIPFLECSQLKRLKMKSIYLDDVTLSGILENCVVVENFSLLECIGFERVIIMRSTLKVLQLQALCVDELQISCENLDVMMLDSIICPMQSLSIYAPCLRTFHTYCNSMYGRMLSVRNGNSIVKTHEILTHCCGLLNNRQTYPVIETTRKPCTSKDKQMKEVGSPNGNIFQNVSTLCIDLDLNNIREAEVLSYVLKLCPNLQVLEIALPAFRPKSQISNSSQRCDLSYPIPMFWERRELCNCISQKLKFVCIRGFRGEEQEVEFSKYMITRATMMKRITIISSNSLRNIMKAADNLFSLPWASGNLSMNFKASNPTDKFAEHQNKLLKCLSMELEACCRRHIGLYLDTLESKYVVTHHMNVLGIFVDHQRKKPFRDLWNHKISSSLKVSSYPSITYTSSTTRGVPSYPIQAMQ

SEQ ID NO: 135566 - protein, 856 aa, Glycine max
  Coding DNA Sequence Number=SeqID_18788
  Homolog annotation: Hit_ID=UPI00005F738B; Match level="QueryCoverage =32%, HitCoverage=75%, E-value=1e-112, Identity=69%"; Hit description= COG3964: Predicted amidohydrolase
  Pfam annotation: Domain name=MFS_1; Domain location=147-535; Score= -38.2; E_value=0.018; Accession=PF07690.6; Description=Major Facilitator Superfamily
MVTVVIGDRLGKGQKVAAGVEKAGGRAVVVPGVAADMKLGDVMKAENADFGISFCGSGGAGVTAIDESASVLGFGFMDKEQLGDSKAKAFADALSKVQQQVLRTSQKILLRIEPLDVRRGAGNYRQRHCDRHRERDLHSNSLIIGGLVGVGVGAGAARMFHAPVTQGMGAFRTLGELNSCEGDPASHFSFGLGFFFNAWASSVAAGSFTQDVDHRILPNWGAAALMVKNRNVAETLHNPKRMAIACGIIGMIVVAFLNSTASAVPTALQVTAVKVLVPAANLLVNTVMPVIFWLAAIDAGKKSGFWATIFGGLAQLIMGNAVPGLVLGILIGKGVEESGWNKVTKVMMAAIVLLFVLSGFFRGFDNENKGFWYADWSFPLFVGLLSSGVFAGTHMYYLYGIGAFNEVAFVSMLRSGMETGVYGAVAAFGASFLFARIIEGSLVGILDIGGAIQTGVGLGVPALLLGAGIVFPVANFAASLATGLVIGVAIGYVIILARKFTINQSDSTYGADVMMGAGNASGRFLGPLIILSAMAASIPIGLGSLVGALLFYLWNKPITGGAILGAMVLGAIFPLVDIAIRAGKIAAVGKVDGAAQQERDLGGRYYVSAGWIDSHVHCYPKSPIYHDEADAIGVAQGVTTVVDAGSTGADHIDDFYQLTRSAKTEVRALINISRTGIVTQNELADMAQIDGEAVVQAVQRRPDFIVGLKARMSSSVVGDNGIQPLVRAKAIQQAAGNLPLMVHIGNNPPVLEEIATLLTSGDIITHCFNGKPNRILSPQGELKAAVKQAIARGVKLDIGHGSASFSFAVAREAIAQGILPDTISSDIYCRNRINGPVHSLAHVMSKFFSIGMTLPQ

SEQ ID NO: 135567 - protein, 1084 aa, Glycine max
  Coding DNA Sequence Number=SeqID_18789
  Homolog annotation: Hit_ID=Q3V735; Match level="QueryCoverage=59%, HitCoverage=94%, E-value=1e-92, Identity=57%"; Hit description =Antigenic protein Et 76
  Pfam annotation: Domain name=BON; Domain location=1022-1078; Score =57.5; E_value=4.3e-14; Accession=PF04972.7; Description=Transport -associated domain
  Pfam annotation: Domain name=BON; Domain location=944-1008; Score =54.9; E_value=2.7e-13; Accession=PF04972.7; Description=Transport -associated domain
  Pfam annotation: Domain name=LppC; Domain location=30-660; Score =337.0; E_value=3.3e-98; Accession=PF04348.4; Description=LppC putative lipoprotein
  Pfam annotation: Domain name=UPF0102; Domain location=656-750; Score =127.2; E_value=4.7e-35; Accession=PF02021.8; Description =Uncharacterised protein family UPF0102
  Pfam module annotation: Pfam domain module=BON::BON::LppC::UPF0102; Domain location=1022-1078::944-1008::30-660::656-750
GRLVPVLLAGLILAACSGQGPQQTSSVNVQGPATGRSDYYLQQVQQSSDDSKTDWQLLAIRALLKEGKYPQAQNQLGQLPQQLSDVQQQELLLLRAQLQIAQQDFNGAQQLLGQIKAADLSQDQQVRYYALQIAAAQNRPSLALLRAYIAQETLLKGADHQSNIDATWQALTQLTQDQLNSVVINADENTLQGWLDLLNTWHANSQDAQMLKAAISDWQTRYPQNPGAKTLPTQLSQVQNFTKASTSTIALLLPLNGQAQVFASAIQKGFNDAKNGVLTAPAAPAAPASSDASASTQQPASTATPANGDANAVVSPAAAAITPSDSAQPQQPAAQPAVAQPASSAQVKVYDTSSQPIAQVMQQAQQDGATLVVGPLLKNNVEQVANSQTPLNVLALNEPEQIQNHPNICYFALSPEDEARDAAHHIWDQGKRQPLLLMPRSSYGDRVGKAFAQEWQKLGGATVLQQRFGGVGELKQGINSGAGIALSGTPLTVQPDQPQGVAVAGLTIPAPQTSAPAPESASSSGSVDAVYIIATQDELQLIKPMIAMRTSSRNNIALYASSRSAQAGAGPDFRLEMDGLQFSDIPLLSGANPGLMQQAARSFNNDYSLVRLYAMGIDAWTLANQFNQMRQEVGMEPVSSGTNRSGAVNRQRLGAEQEQQARRYLERAGLQWEASNVRCRSGEIDLIMRDADCWVFVEVRYRRDARFGGAAASVTRQKQQKLLRTAALWLLARGGSFDTVNCRFDIIAITGRELTQIAAAEALPDAISRAAMTLVQSLLNGNKILSCGNGASAANAQHFAASMINRFETERPSLPALALSADNVMLTAIGNDRLHDEIYAKQVRALGQAGDVLLAISTRGNTRDIVKAVEAAVTRDMTIVALTGHDGGMTEGAQMKALNAIAILLTAMLLQGCVAVVAGGAAVATKTATDPRTVGTQVDDGTLELRVTNALAKDEQIKNQARVVVTAYQGKVLLTGQAPSADLASRAKQIAMGVDGATEVYNEIRTGQKVSLGTSSSDTWITTKIRSQLLGSDQVKSSNVKVTTENGEVFLLGLVTQEEAKAAADIASRVSGVKHVTTAFTILK

SEQ ID NO: 135568 - protein, 1076 aa, Glycine max
  Coding DNA Sequence Number=SeqID_18790
  Gene Ontology: Mol. function=protein-N(PI)-phosphohistidine-sugar phosphotransferase activity; Cellular component=intracellular; Biological process=phosphoenolpyruvate-dependent sugar phosphotransferase system
  Homolog annotation: Hit_ID=Q5PJA4; Match level="QueryCoverage=60%, HitCoverage=99%, E-value=0.0, Identity=65%"; Hit description =Putative BglB-family transcriptional antiterminator
  Pfam annotation: Domain name=DUF1341; Domain location=245-463; Score =439.3; E_value=5.2e-129; Accession=PF07071.2; Description=Protein of unknown function (DUF1341)
  Pfam annotation: Domain name=HTH_11; Domain location=447-503; Score =54.2; E_value=4.3e-13; Accession=PF08279.2; Description=HTH domain
  Pfam annotation: Domain name=HTH_11; Domain location=532-590; Score =18.2; E_value=0.0009; Accession=PF08279.2; Description=HTH domain
  Pfam annotation: Domain name=HTH_DeoR; Domain location=447-498; Score= 0.4; E_value=0.055; Accession=PF08220.3; Description=DeoR-like helix -turn-helix domain
  Pfam annotation: Domain name=Mga; Domain location=502-606; Score =13.7; E_value=0.00091; Accession=PF05043.4; Description=M protein trans-acting positive regulator (MGA)
  Pfam annotation: Domain name=PRD; Domain location=738-828; Score =67.9; E_value=3.3e-17; Accession=PF00874.10; Description=PRD domain
  Pfam annotation: Domain name=PTS_EIIA_2; Domain location=934-1072; Score=-12.4; E_value=0.0007; Accession=PF00359.12; Description =Phosphoenolpyruvate-dependent sugar phosphotransferase system, EIIA 2
  Pfam annotation: Domain name=SelA; Domain location=1-216; Score= -246.2; E_value=0.012; Accession=PF03841.4; Description=L-seryl-tRNA selenium transferase
  Pfam module annotation: Pfam domain module=DUF1341::HTH_11::HTH _11::HTH_DeoR::Mga::PRD::PTS_EIIA_2::SelA; Domain location=245 -463::447-503::532-590::447-498::502-606::738-828::934-1072::1-216
MVALGGGRLIEAGYSNECSPEQLAAAITPTTAALLYVKSHHCVQKSHLSVEQAAVVARKHGIPLIVDAAAEEDLQCYYQMGADLVIYSGAKAIEGPTSGLVIGRSQYVEWVKRQSNGIGRAMKVGKEGILGLTQAIENYLLQSKTSGADMVAKMTPFIDNLNTLNGVSARVVWDAAGRDIARAEIKFDEAVTGWPTGELVQALKNGDIAIYFRGYKANEGIIEADPHPGAAQRRKTRMNLNANFYQGRLCLNVLAGSKQNAQAIWQAAEGHVLVGVLSKNYASNEAAIADMREYAALIDNALSVGLGAGDPNQSAMVSEISAELQPQHVNQVFTGVATSRALLGQSHTIVNGLVSPTGTPGKVKISTGPRSSQAADGIVPIATAIAMLQDMGGSSVKYFPMGGLKAVEEYRAVADACARHDFWLEPTGGIDLNNFEEIVRIALEAGRLAQLFAALQSETLPQDELARRFSVSTRTVRTDITALNALLEQHGAQFVLARGAGYQLKIDDAVRFGRLQQESAAPLRVPRTSQDRVRYLLSRFLTAAYSLKLEDLSEEWFVSRATLQSDMAEVREWLGRYHLNIETKPRYGMKLFGSEAAIRTCLTDLLWQIDQQTPDSPLLTVEALHSGMLAQLQPLLAQCFTQHAIRLSDEGERYLLIYCAVAVRRISEGFPLSDPGAEDVGEEIREAAHDLVNLMRPLVGKGISQAEENWLRVNIAARQIQALAPSTINADDADALVDYLLNYINTHYNYRLQQDEQLRADLLTHIKTMITRVRYQIHIPNPLLSNIKQHYPMAYDVTLAAVTSWGKYTPYTISENEIGFLVLHIGVGLERHYDVGYQRHPQVLLVCDSGNSTLRMIEALLLRKYPQLVVTARLSQRDYEVRAHIDEDFVISTARLSEKNKPVVMMSPFPTEFQLEQLGKLVLVDRTRPYMLEKYFDAQHFMVLDRPMSQSALFRLLCDRLEAEGYVDADFYPSVEEREAIVSTMLGEGIALPHSLGLLAKKTVVYTVLAPHGVSWGDETASVIFLLAISKSEYEEAMAIYDLFVTFLRERAVTRLRDCADFVSFKAVAMDCLSRL

SEQ ID NO: 135569 - protein, 415 aa, Glycine max
  Coding DNA Sequence Number=SeqID_18791
  Homolog annotation: Hit_ID=Q5PCA2; Match level="QueryCoverage=27%, HitCoverage=86%, E-value=3e-38, Identity=71%"; Hit description =Putative membrane protein
MVTIALGGKAGFPGWPGAAVCRDPVTPDCFCVMPDTVNQLSHKPSIKKTGRGKSPPLLFSICAVARLVCLACGCWHKALTNQAVNAVGARTYQTQHQETTGDGQVFHEHQLVNAFRKVAVEQERGQQREAGGEQRGEARQETEQNRQAAPQFQQNHQRQQEAGHAHRLHVLCGARIGGDFAPAGSNKQDGILKEENRTFSIRFKVGKLAWRHRRFDHAPGAPQAESAFGPAHDAVGAADRPDGQRAAANRQIAAQAEKRQPAAIVLRGAFQPVAAGSAEIQPLLLYLIKQFMNACFTFTLTHERCSSSKVRSVSSSLRVWRNSVDCRDLRNVHKPKISASANSTPVVMAIAISRYCASTAQIISTIRLINPKAVNSMVRPIMISIWIRLAFSSSSSATASRTRVSTMPTSVVTTR

SEQ ID NO: 135570 - protein, 336 aa, Glycine max
  Coding DNA Sequence Number=SeqID_18792
  Gene Ontology: Cellular component=integral to membrane
  Homolog annotation: Hit_ID=Q665N4; Match level="QueryCoverage=56%, HitCoverage=81%, E-value=9e-92, Identity=84%"; Hit description =Putative DedA-family membrane protein precursor
MPIASSASTPAHSQGSKRLGKLRNPVITVTSRSDPPDTDDQQHQRQQHQAEHQLIFIAAENGCFPQRKAEHGKNQHPQEAAHPVKELEAGIAQAREAGNGRQQGTDKSDKAANQQRRQAVAVEQTVGALMILRGQMGEPFLHRRRIAKPAALNVTDPAAEAGTGGQHQQGEREAHGAFRDQHADQNQQTITGQKRGGQQAIFEKQNHEQHAINRPHQRGVGEHFVILLPQGMQQCLQNIHQSFLNIIVKRAREGLRRRRVKLYILGMPPEQDFRIHPELIVKSATFYSPVAKGKKRAITVTKIAGFRQCKVAVAQEFYLLTQMVKRSFTRADTIAD

SEQ ID NO: 135571 - protein, 188 aa, Glycine max
  Coding DNA Sequence Number=SeqID_18793
  Homolog annotation: Hit_ID=Q7CPR4; Match level="QueryCoverage=48%, HitCoverage=73%, E-value=4e-17, Identity=50%"; Hit description =Putative periplasmic protein
  Pfam annotation: Domain name=DUF1090; Domain location=77-183; Score =98.8; E_value=1.7e-26; Accession=PF06476.2; Description=Protein of unknown function (DUF1090)
MQHETVVKIRVAHSGTNLPDGFYLYQQLSAQGVRIKSITSAGDALRVRRRHSRWWTLIAPPIADPRRRREQTTSWDAPPVRFATGRQQWKQKQQDIQREIEMAKQHDNQRRVTGLERALTEVRANCTDEKLKSAHAERIEAQQHKVAERERELQQDRQEGKDQEKIGKRERKLEEARQELKKLQAEPY

SEQ ID NO: 135572 - protein, 323 aa, Glycine max
  Coding DNA Sequence Number=SeqID_18794
  Gene Ontology: Mol. function=tagaturonate reductase activity; Cellular component=cytoplasm; Biological process=metabolic process
  Homolog annotation: Hit_ID=P0A6L7; Match level="QueryCoverage=100%, HitCoverage=67%, E-value=1e-112, Identity=61%"; Hit description =Altronate oxidoreductase
  Pfam annotation: Domain name=Mannitol_dh; Domain location=16-173; Score=90.7; E_value=4.5e-24; Accession=PF01232.13; Description =Mannitol dehydrogenase
  Pfam annotation: Domain name=Mannitol_dh_C; Domain location=203-323; Score=-73.3; E_value=0.0034; Accession=PF08125.3; Description =Mannitol dehydrogenase C-terminal domai
  Pfam module annotation: Pfam domain module=Mannitol_dh::Mannitol_dh _C; Domain location=16-173::203-323
MLRLNRRDFPGARYSERVIQFGEGNFLRAFIDWQLDWLNEHQGTDAGVVVVRPRNRMQTETLNQQDGLYTTLLRGLNDAGEPLSETRLIRSLNREIQPYQQFEEFLALARAPQMRFVFSNTTEAGIVYAEQDRLEDQPASSFPGKLTQLLWARYQHFAGAADKGWLIVPCELIDHNGDTLRALVLRYCQQWQLPAAFAQWVTQHCAFYNTLVDRIVSGYPPDGAQIAAQLGYDDRYLVAGERYYQLVLEGPDALMHELQLTALAPAVRRVDDITPYKAQKVAILNGAHTALVPVAFQAGLESVGEAMNDAQLAAFVDALLREE

SEQ ID NO: 135573 - protein, 809 aa, Glycine max
  Coding DNA Sequence Number=SeqID_18795
  Homolog annotation: Hit_ID=UPI00005F8B44; Match level="QueryCoverage =37%, HitCoverage=92%, E-value=1e-138, Identity=79%"; Hit description= COG0861: Membrane protein TerC, possibly involved in tellurium resistance
  Pfam annotation: Domain name=DUF81; Domain location=386-617; Score= -72.9; E_value=0.079; Accession=PF01925.9; Description=Domain of unknown function DUF81
  Pfam annotation: Domain name=GFO_IDH_MocA; Domain location=7-126; Score=140.4; E_value=5e-39; Accession=PF01408.12; Description =Oxidoreductase family, NAD-binding Rossmann fold
  Pfam annotation: Domain name=NAD_binding_3; Domain location=14-124; Score=-15.7; E_value=0.1; Accession=PF03447.6; Description =Homoserine dehydrogenase, NAD binding domain
  Pfam annotation: Domain name=Semialdhyde_dh; Domain location=8-125; Score=-9.9; E_value=0.0043; Accession=PF01118.15; Description =Semialdehyde dehydrogenase, NAD binding domain
  Pfam annotation: Domain name=TerC; Domain location=413-532; Score =211.5; E_value=1.9e-60; Accession=PF03741.6; Description=Integral membrane protein TerC family
  Pfam module annotation: Pfam domain module=DUF81::GFO_IDH_MocA::NAD _binding_3::Semialdhyde_dh::TerC; Domain location=386-617::7-126::14 -124::8-125::413-532
AGEPAVIRFAIVGTNWITRQFIDAAHESGKMKLSAVYSRSQQQADAFVADYPCPLTFTSLEALAASAEIDAVYIASPNALHCEQALLFMSHGKHVICEKPLASNLREAEAMIGCARQHQVVLFEAFKTASLPTFLRLQQALPQLGTLRKALFNYCQYSSRYQRYLDGENPNTFNPRWSNGSIMDIGYYCLAAAVTLWGAPQQAKAEASLLASGVDAHGVVVLDYGDFDVTLLHSKVSDSLIPSEIQGEAGSLVIEKISECQQLRLIPRGGESQNLTQPQHINTMLYEAETFARLVETRQVEHPALEVSRITARLLTEIRRQTGVVFPADRKEDTTMHSVGTPLLWGSFAVVVLIMLAIDLFLQGRRGAQTMSFKQAAVWSLVWISVSLLFAAAFWWYLDGSAGREVATAQTLAFLTGYVLEKALAVDNVFVWLMLFSYFAIPSNLQRRVLIYGVLGAIVLRTIMIFAGSWLVTQFSWILYIFGAFLLFTGIKMAFAKEGDDAAVGDKPVVRWLRKHLRMTDELHGEKFFTRKNGVLFATPLLLVLIMVELSDVIFAVDSIPAIFAVTTDPFIVLTSNLFAILGLRAMYFLLANVAERFSMLKYGLAIVLVFIGIKMLIVEFYHIPVAISLTVVGVILGGALIAPALFRQCQPSRFISLSHFPSSADQKTDLARTGRIISFLVSSFPYTPPGKPKPGKTNHDRPDCRRGAGVAFTRCRAGRGPAGRGTAAGTGAGDLLDCQPSAGAKNQYSPDHYAVPAQYLLRGGGRGDFQPSVPADAVDGRRRDRNYPAVRHHRSAARPADEHGRQSD

SEQ ID NO: 135574 - protein, 404 aa, Glycine max
  Coding DNA Sequence Number=SeqID_18796
  Gene Ontology: Mol. function=oxidoreductase activity; Cellular component=cytosol; Biological process=D-gluconate metabolic process
  Homolog annotation: Hit_ID=Q3EH47; Match level="QueryCoverage=65%, HitCoverage=77%, E-value=2e-96, Identity=62%"; Hit description =Threonine dehydrogenase and related Zn-dependent dehydrogenases
  Pfam annotation: Domain name=ADH_N; Domain location=163-276; Score =127.7; E_value=3.1e-35; Accession=PF08240.2; Description=Alcohol dehydrogenase GroES-like domain
  Pfam annotation: Domain name=ADH_zinc_N; Domain location=305-403; Score=33.8; E_value=5.9e-07; Accession=PF00107.16; Description=Zinc -binding dehydrogenase
  Pfam annotation: Domain name=GerE; Domain location=77-138; Score =24.8; E_value=1.5e-05; Accession=PF00196.10; Description=Bacterial regulatory proteins, luxR family
  Pfam annotation: Domain name=Sigma70_r4; Domain location=76-124; Score=5.7; E_value=0.062; Accession=PF04545.6; Description=Sigma-70, region 4
  Pfam annotation: Domain name=Sigma70_r4_2; Domain location=70-122; Score=16.7; E_value=0.014; Accession=PF08281.2; Description=Sigma-70, region 4
  Pfam module annotation: Pfam domain module=ADH_N::ADH_zinc _N::GerE::Sigma70_r4::Sigma70_r4_2; Domain location=163-276::305 -403::77-138::76-124::70-122
MESPAIVKMVLSAGVKGFIGKSHNMQEIVQAIRQVAQGRLFLSQEVAYEVENLYVMNEDAINENLDLSSKGNMYEKVKTLSPREVEVVRCFLDGLSVSQIAVKFKRSRKTVSGQKQDGRRLLFRLSASRSRTEGATMNIETQSCVITGKKQVSVAQQQVQWDGTGTLVRITRGGICGSDLHYYQEGKVGSFEVKMPMILGHEVIGYVVESDDPQLQPNQKVAVNPSKPCGSCKYCLREQQNQCTSMRFFGSAMYLPHVDGGFTQYKVVDSAQCVPFPQEADDSVMVFAEPLAVCIHATQQAGDLSGKTVFISGVGPIGCLIAAAAKARGAAEIICSDISERSLSLAQQMGATGVIHAADGDFTPYLADKGFFDVAFEASGHPSSLQRCLDVVCAKGTLVQGGIL

SEQ ID NO: 135575 - protein, 400 aa, Glycine max
  Coding DNA Sequence Number=SeqID_18797
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q2ZRC5; Match level="QueryCoverage=71%, HitCoverage=23%, E-value=5e-22, Identity=29%"; Hit description=PAS precursor
  Pfam annotation: Domain name=SBP_bac_3; Domain location=77-297; Score= -85.7; E_value=0.021; Accession=PF00497.10; Description=Bacterial extracellular solute-binding proteins, family 3
  Subcellular localization annotation: CTP_CleavageSite=24; ConfidenceScore=5.06e-01
MRSISFAADSDFAAVSPGPGHPVPARPAKNPAPAHPPWHNSKTAQVKPLQLLARYDTAQPALQLAEPISSAFRNKVIKVAVAGKSQPPIYMDTDTRRFEGLSADYLSLIQSMLETSIELYHFPSHSAAQQAVLKGEMHMLAIYVAQPSSPSQPLLASAPWMLDYSVMGLKTDSDLFLNNGMPEQIAWSGTPLQRQYLEETYENAQLVRFPGYYDAVAATVYGQTARVWGNAATLTHLNRYLFANALTILADEHTIPLNVGFGISPLYPALADAINQALPQIPLSIRMQIAKRWQLDPHHVLQRNPLALTADEEQWLQNNIHIETTLPLAQAPLSSRTPAEQFRGMAPDVLELITSQTGLNFVAHASHEHPGGRPLPKLFPLEILEPQFEAQPALITRPWL

SEQ ID NO: 135576 - protein, 338 aa, Glycine max
  Coding DNA Sequence Number=SeqID_18798
  Gene Ontology: Mol. function=transporter activity; Cellular component= integral to membrane; Biological process=transport
  Homolog annotation: Hit_ID=UPI00006DBEB5; Match level="QueryCoverage =50%, HitCoverage=26%, E-value=3e-25, Identity=44%"; Hit description =COG0659: Sulfate permease and related transporters (MFS superfamily)
  Pfam annotation: Domain name=Pro_CA; Domain location=1-157; Score =19.8; E_value=6.2e-08; Accession=PF00484.9; Description=Carbonic anhydrase
RVPAEVLTGSHPGELFVHRNIANMVLPDDDNFISVLQYAIFYLGVERIVLCGHYGCGGVQAALGLPASPLAQEDSALARRIAALRRALQQGLVAYHASPAQEEESSKLNRLVEANVIAQFSQLVRCEPVQQAWQAGQQLDVFGCVNRQRNPHHESANASSGYSCWSGGVSGGAATVSGHRAGQRSAALCRSAHRGDRRSAGYRAQSLALCRERPGGGAGDHCCGLNPDARQLFRVSHRADSGWRAAVHARPAARRSFYLAGASDAGLQSLVSGEFSFSLSAMLVAGSGLLILWLWTTPAIKAVKALSWIPGPLVAVLFGCLATVLGDRLFPSLGEGLP

SEQ ID NO: 135577 - protein, 75 aa, Glycine max
  Coding DNA Sequence Number=SeqID_18799
MFFWSWVASLGELGGNLLPLFLINRLKGAVLRIPDAPENPSRGSSVTLPRGFRKQIREGFPPLFTVLHPFFVLQR

SEQ ID NO: 135578 - protein, 183 aa, Glycine max
  Coding DNA Sequence Number=SeqID_18800
DMRKKAQANQKHNIAPHVLSREGYEYSENKLMDEKRKKKLEEAAQSGSTDTVIDPLSPIRQHMKWKMARTKKTGQMTSEAAKEIAEKIESLEEQASYGFFVAIGRPEHRSRVGVVGVGVTIKKYFGLAPRTSRMSSSMAPEDLEQLMQQIRDQLEESITEKVTQRLMLSFQATVHPEIRAIEI

SEQ ID NO: 135579 - protein, 110 aa, Glycine max
  Coding DNA Sequence Number=SeqID_18801
MYNSIITYIGLHCSAHWQMVVILPKENVVIWFCSLHTRPDNYLKGIINSIHVCIQQCFEGLDDTPQSKSKAGARLIVVKYFNDVRPLEPERLKALRIQWAKYYLKVRNET

SEQ ID NO: 135580 - protein, 124 aa, Glycine max
  Coding DNA Sequence Number=SeqID_18802
MNSCRGGFGGPCPRAGRSARRLWLRCGRSHPRNGVVILGFGGGWDRVERGGSLCGRVEEGCVTEVKREMASFGVSQYLCFRRTRVAVSVFWVVENWDRENNNKNLVGVVVFRGTTTRARFSTHM

SEQ ID NO: 135581 - protein, 557 aa, Glycine max
  Coding DNA Sequence Number=SeqID_18803
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=99%, HitCoverage=28%, E-value=0.0, Identity=72%"; Hit description=Glucan synthase-like protein
  Pfam annotation: Domain name=Glucan_synthase; Domain location=1-433; Score=-80.4; E_value=0.00051; Accession=PF02364.6; Description=1,3 -beta-glucan synthase component
MSYQETSFVTIGQRVLANPLRVRFHYGHPDVFDRVFHITRGGISKASKTINLSEDVFAGFNSTLRRGCISYHEYLQIGKGRDVALNQISKFEAKVANGNCEQTISRDMFRLGRQFDFFRMLSCYFTTVGFYFSSLISVIGIYVFLYGQLYLVLSGLERALIIEARIKNVQSLETALASQSFIQLGLLTGLPMVMEIGLERGFLTALKDFVLMQLQLAAVFFTFALGTKTHYYGRTLLHGGAKYRPTGRKVVFHASFTENYRLYSRSHFVKAFELLLLLIVYNMFRRSYQSSMAYVLITYAIWFMSLTWLCAPFLFNPAGFSWTKTVDDWKEWNKWIRQQGGIGIQQDRSWHSWWHDEQAHLRWSGFGSRLTEVLLSLRFFIYQYGLVYHLDISQHSKNFLVYVLSWIVIVAIFLLVKAVNMGRQLLSANYQLGFRLFKAFLFLAVLAIIFTLSVICELSLTDIFVCCLAFMPTAWGLIMIAQAARPKIEHTGLWDFTRALAREFDYGMGIVLFGPIAILAWLPIIKAFHARFLFNEAFKRHLQIQPILSGKKKKHRT

SEQ ID NO: 135582 - protein, 134 aa, Glycine max
  Coding DNA Sequence Number=SeqID_18804
  Homolog annotation: Hit_ID=Q9LUD6; Match level="QueryCoverage=89%, HitCoverage=32%, E-value=1e-18, Identity=43%"; Hit description =Similarity to salt-inducible protein
  Pfam annotation: Domain name=PPR; Domain location=35-69; Score=17.9; E_value=0.037; Accession=PF01535.11; Description=PPR repeat
  Pfam annotation: Domain name=PPR; Domain location=70-104; Score=20.0; E_value=0.0086; Accession=PF01535.11; Description=PPR repeat
  Pfam module annotation: Pfam domain module=PPR::PPR; Domain location =35-69::70-104
MEVGGVEADVAVYNVLIGGLRKVGRVLEGMVRRGVCPNEVLCGLVEKGRVEEGKGVVERMGKEGFVPSFGAYKGLVKGFCEKGRIGEVEWVVRDMVWKGFVPKMGMRRRIVKCVVERERSDEWVAGAIDGVFED

SEQ ID NO: 135583 - protein, 345 aa, Glycine max
  Coding DNA Sequence Number=SeqID_18805
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=100%, HitCoverage=16%, E-value=1e-103, Identity=59%"; Hit description =Glucan synthase-like protein
MEGDKDHQHKVVKALLDVCPPLTNEMMFDSRILDMFHFPEQNECGFVYFRNDDQLFDSVEMNRDFYPFAKENSIHFPLPESGPLMEKIKRFHLLLTVKDTAMDVPSNLDARRRISFFATSLFTDMPDAPKVHNMMPFCSITELCLIYDMIGSVITPHYIEDINFSLKELGSDKEEDSIIFYMQKIYPDEWTNFLERMGCDNRKSLEDEHKTEDLRLWASFRGQTLSRTVRGMMYYREALKLQAFLDMAEEEDILEGYETAERGNRALFARLEALADMKYTYVISCQSFASQKASNDPRYQDMIDLMIRYPSLRVAYVEEKEEIVQGKPHKVYSSKLVKVVNGYEQ

SEQ ID NO: 135584 - protein, 364 aa, Glycine max
  Coding DNA Sequence Number=SeqID_18806
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9LUD7; Match level="QueryCoverage=97%, HitCoverage=19%, E-value=1e-128, Identity=58%"; Hit description =Glucan synthase-like protein
MIRKVPMFFVPAILDVAFMWKARYTMESSQKVKLVVKLVLATIWTIVLPVCYANSRRKYTCYSTKYGSLVEEWCFTSYMVAAAIYLTTNAVEVLLFFVPAVAKYIEVSNYKICKVLSWWTQPRIYVGRGMQEDQIKPLIAPTRQIMKIGVKKYEWHELFPKVKSNAGAIVAVWSPVVIVYFMDTQIWYSVFCTIIGGLYGVLHHLGEIRTLGMLRSKFDSLPSAFNVCLIPPSSKRGKKKRKGLLSNIFQKLPDEKNATAKFVVVWNQIVNHLRLEDLISNREMDLMMMPVSSELFSAKVRWPVFLLANKFSTALTIAKDFEGKEEILVKKITKDKYMFYAVRECYQSLKYVLEILVVGSIEKR

SEQ ID NO: 135585 - protein, 128 aa, Glycine max
  Coding DNA Sequence Number=SeqID_18807
  Homolog annotation: Hit_ID=Q9LUD7; Match level="QueryCoverage=78%, HitCoverage=5%, E-value=1e-33, Identity=63%"; Hit description=Glucan synthase-like protein
MAYELHGILSGAISLTTWEKVMPAYGGETESFLNNVVTPIYTVIRQEVANSKGGAADYSVWRNYDDLNEYFWSPDCFKIGWPMRLDHDFFFVKPRNKPEPDVKNALVVSPGKTKEKKKREKRDEEEPE

SEQ ID NO: 135586 - protein, 92 aa, Glycine max
  Coding DNA Sequence Number=SeqID_18808
MKIPFYFPILVLVVFIASGKQVQMTVVPNCVVESLSVHCEIFKNPCELLCQQHFGSPAAHGACGIKFHRSMLAYCDKLSNPCDFRCNKIYAP

SEQ ID NO: 135587 - protein, 178 aa, Glycine max
  Coding DNA Sequence Number=SeqID_18809
MTTLDFNNLQSFKGMSWKCTVAYVFLIFQIAKNQCLQIVECIGTLDIFVAFQKQTYLLVKLKYPGLISPKLLADSNSLAHLDLHCWFHLFLLQPPIGYYNYPYDREAADHRAKVQTEQSAEVQAGHTRVQIKEKPKRRVTRLNYLRRLCLRAGRELSSNPYRVMLLLEQETSLTDLIL

SEQ ID NO: 135588 - protein, 918 aa, Glycine max
  Coding DNA Sequence Number=SeqID_18810
  Gene Ontology: Mol. function=protein binding; Biological process =defense response
  Homolog annotation: Hit_ID=Q9LUD7; Match level="QueryCoverage=22%, HitCoverage=11%, E-value=2e-67, Identity=61%"; Hit description =Glucan synthase-like protein
  Pfam annotation: Domain name=NB-ARC; Domain location=99-351; Score= -74.5; E_value=1.5e-05; Accession=PF00931.13; Description=NB-ARC domain
MDSKTVESKVEPVSSQFGLGYITSYKSNLESLKTEVQKLEATKNSVRDSVDEATKNGEVIVNVVEIWLKKVDATVAEANKLIIESDAPAQQEIPEDDTKIYQVLEEGNFDRISYSKPSTLKEIQQALKDPNIFRIGLYGTDVMAEVYNSLDVENIQGQIANALGLKLDEETKERRVQQLRQRIRKEKNILVILDDICGKLDLAEVGIPFGDDHKGCKLVLTSEYLNVLKCQMGTQKDFKLEVLSDNDSWKLFEKIAVIVAKALRKKHVKLSILECMLLFDMAKAMASRTHLNNEEQKFTQMEQWDIDQLQKCHYINLPSYNIDELPKKLDCPELKLISLRRNHGYLTIPDNFFSGTREVKVNNLHGMRFAPSPLPSLRLLTNLISLNLYGCVLEDIAIVAELRRNITESNPLSLSPALATASHDKDCYSIPFLPSSIVFEARALVKLQHLEIKGCFILVEIFVRQEEVAFPNLETLLISRMINQQVPNSLCKLNKIKITSSLGLHHVFPVVVAKELRQLQVLEIWRSSKKETIVEKSDSGDAQDEIASTKLEEQKVESEKKGDALGEFASTNSEELIPGSGNKGDAPQELKLYGLPRLNYKLMQVTPSLSKVRYGYDHRELDWVDINALILMGIQTSKRNLSLSSKSEEKKLLFAHLRYLAMSEIVPAEPIGGIYFERGETSTASASASETPHVTLAITNGSNNVEYVPEPFDSERLPTVFASEIQRFLRVANLLGKEEPRVAYLCRVHAFVIAHNLDKNSSGRGVRQFKTSLLHRLEQDEHVTKKKGTSDIRELKNVYRAYRDYYIRHEKAFDLEQRERLINARDIATVMFEVLKTVTDPASSQALIQGNAIHKKTEFSILPLEQGCIQHAIMQKSEIKAAIAVIRNVRGLPPVQDFKKDGAFVDLFDFLQHCFGFQ

SEQ ID NO: 135589 - protein, 60 aa, Glycine max
  Coding DNA Sequence Number=SeqID_18811
MKDLTIIMMFGPRELLGAPGIIVGAPSTLRAKIKIPPSIFKLIRKFVKDQVDLQVTHRST

SEQ ID NO: 135590 - protein, 328 aa, Glycine max
  Coding DNA Sequence Number=SeqID_18812
  Gene Ontology: Mol. function=nucleoside-triphosphatase activity; Biological process=defense response
  Homolog annotation: Hit_ID=Q1STU9; Match level="QueryCoverage=93%, HitCoverage=27%, E-value=2e-25, Identity=28%"; Hit description=H+ -transporting two-sector ATPase, alpha/beta subunit, central region; Disease resistance protein
MSTPYSAFPNLETLVLFNLSNMKEICYGPVPAHSFEKLQVITVVDCDEMKNLLLYSLLKNLSQLREMQITRCKNMKEIIAVENQEDEKEVSEIVFCELHSVKLRQLPMLLSFCLPLTVEKDNQPIPLQALFNKKVVMPKLETLELRYINTCKIWDDILPVDSCIQNLTSLSVYSCHRLTSLFSSSVTRALVRLERLVIVNCSMLKDIFVQEEEEVGLPNLEELVIKSMCDLKSIWPNQLAPNSFSKLKRIIFEDCEGFDYVFPISVAKKLRQLQSLDMKRCVIKNIVEESDSSDMTNIYLAQLSVDSCDNMNTIVQPSVLFQNLDELV

SEQ ID NO: 135591 - protein, 79 aa, Glycine max
  Coding DNA Sequence Number=SeqID_18813
MGSSYGRWSWHNERWEAAMGSGVDMGAGVRVARRSKMALSLLFKAHWVRQFTASSRHSMVLRHILSFDMLTVPRSGRTN

SEQ ID NO: 135592 - protein, 550 aa, Glycine max
  Coding DNA Sequence Number=SeqID_18814
  Gene Ontology: Mol. function=nucleoside-triphosphatase activity; Cellular component=membrane; Biological process=defense response
  Homolog annotation: Hit_ID=Q1STU9; Match level="QueryCoverage=99%, HitCoverage=47%, E-value=1e-96, Identity=39%"; Hit description=H+ -transporting two-sector ATPase, alpha/beta subunit, central region; Disease resistance protein
  Pfam annotation: Domain name=LRR_1; Domain location=430-451; Score =6.8; E_value=15; Accession=PF00560.23; Description=Leucine Rich Repeat
  Pfam annotation: Domain name=LRR_1; Domain location=453-473; Score =10.2; E_value=3.6; Accession=PF00560.23; Description=Leucine Rich Repeat
  Pfam annotation: Domain name=LRR_1; Domain location=475-496; Score =12.6; E_value=1.3; Accession=PF00560.23; Description=Leucine Rich Repeat
  Pfam annotation: Domain name=LRR_1; Domain location=498-521; Score =8.3; E_value=8.1; Accession=PF00560.23; Description=Leucine Rich Repeat
  Pfam annotation: Domain name=NB-ARC; Domain location=27-315; Score =126.9; E_value=5.6e-35; Accession=PF00931.13; Description=NB-ARC domain
  Pfam module annotation: Pfam domain module=LRR_1::LRR_1::LRR_1::LRR _1::NB-ARC; Domain location=430-451::453-473::475-496::498-521::27-315
MTQKISEVIGNGKFDRISYRVPAEVTRTPSDRGYEALDSRTSVLNEIKEALKDPKMYMIGVHGMGGVGKTTLVNELEWQVKKDGSFGAVVIATITSSPNVKEIQNKIADALNKKLKKETEKERAGELCQRIREKKNVLIILDDIWSELDLTEVGIPFGDEHSGYKLVMTSRDLNVLIKMGTQIEFDLRALQEEDSWNLFQKMAGDVVKEINIKPIAENVAKCCAGLPLLIVTVPKGLRKKDATAWKDALIQLESFDHKELQNKVHPSLELSYNFLENEELKSLFLFIGSFGINEIDTEELFSYCWGLGFYGHLRTLTKARNRYYKLINDLRASSLLLEDPECIRMHDVVCDVAKSIASRFLPTYVVPRYRIIKDWPKVDQLQKCHYIIIPWSYIYELPEKLECPELKLLVLENRHGKLKVPDNFFYGIREVRTLSLYGMSFNPFLPPLYHLINLRTLNLCGCELGDIRMVAKLTNLEILQLGSSSIEELPKEIGHLTHLRLLNLATCSKLRVIPANLISSLTCLEELYMGSCPIEWEVEGRKSESNNASL

SEQ ID NO: 135593 - protein, 77 aa, Glycine max
  Coding DNA Sequence Number=SeqID_18815
MGTCFSKETKLPTDQSNICFLDEKQCVYRGRRGKVYGKLGFWLKVCRTAGHGICQGLASGSGIKGMSHVISMIHMQQ

SEQ ID NO: 135594 - protein, 80 aa, Glycine max
  Coding DNA Sequence Number=SeqID_18816
  Homolog annotation: Hit_ID=Q9C5Z1; Match level="QueryCoverage=46%, HitCoverage=5%, E-value=5e-13, Identity=86%"; Hit description =Eukaryotic translation initiation factor 3 subunit 9
MTRPLHLPESQRDIGLKGLNGQLEFYNVDELETMAMAEHFMATSVEWDPTGRPPSPLSPEKEEEMSKNLKKYSKKYEAED

SEQ ID NO: 135595 - protein, 149 aa, Glycine max
  Coding DNA Sequence Number=SeqID_18817
  Pfam annotation: Domain name=zf-CCHC; Domain location=129-146; Score =10.4; E_value=0.019; Accession=PF00098.13; Description=Zinc knuckle
  Subcellular localization annotation: CTP_CleavageSite=61; ConfidenceScore=5.41e-01
MLVATLLVFSLGDERFGLSIWPSPSRRGVKRNKLNLLTWQIFGSNNTKSQSLSNMQKSSFRFMSRSSSKAIYTDTSYDDESDDDSSDEDDQLAFISRKIRNMWKKRSGLDRKRSKKPYRERKDKDISSIICYKCKKPGYFKLECPYLGK

SEQ ID NO: 135596 - protein, 154 aa, Glycine max
  Coding DNA Sequence Number=SeqID_18818
  Subcellular localization annotation: CTP_CleavageSite=57; ConfidenceScore=5.77e-01
MGHFALKLKFKKSAAPSSPTFLASFFSSSAPSSSPRLPTAISDQPSLLRFCHREDVVGKNGEKADLECLVRPEEPSFGNFPEEPLLPRVPEEVVPEVSPEEGSSRNFLEEIVPETFRKKVLMDDHLVLLKEPSGTTSSGSFSRRSGFSGSRNFF

SEQ ID NO: 135597 - protein, 69 aa, Glycine max
  Coding DNA Sequence Number=SeqID_18819
  Subcellular localization annotation: CTP_CleavageSite=52; ConfidenceScore=5.66e-01
SSRAKRTLWAQCTSTAKRNFSVLSVTRESGRAQGSRSRTKREISLPSEMFVSCQAQRTTGAKSKSTYSR

SEQ ID NO: 135598 - protein, 111 aa, Glycine max
  Coding DNA Sequence Number=SeqID_18820
MSYCLAKRDCALSEQYELCLKVTASCRNLPFGGRATRGLAGASSKKGKCAESPPTFIRGKCRKTRKGEKREVVAAQLAQASWVASTRRHCLLLEHPEGPSGPGCYLHTPFY

SEQ ID NO: 135599 - protein, 244 aa, Glycine max
  Coding DNA Sequence Number=SeqID_18821
MVDASTGKTEPTLDTSSNDEDSQPNKTVNSDGEELIFESREDLIKGHNQLLFTSPHVSKSYKSIRITRKVHQAHLVDFVLETTSPGGVQDTSICEEVKALLNEKVSNGQKILLKDFQDLEERVKSLTTTLDDSKEERKELPPKIEKLYKEIDTFRDNLGKFICGHEALKKIIKVQRNPKDKSSLGFKGKKVMHAEEVNVFYFYGKVGHEAHKCKDLSEEGNPSKGLSSAYQHTQANKKKGPKKI

SEQ ID NO: 135600 - protein, 115 aa, Glycine max
  Coding DNA Sequence Number=SeqID_18822
  Gene Ontology: Mol. function=transporter activity; Cellular component= membrane; Biological process=response to nematode
  Homolog annotation: Hit_ID=Q9LXV3; Match level="QueryCoverage=61%, HitCoverage=18%, E-value=2e-20, Identity=75%"; Hit description=2 -oxoglutarate/malate translocator-like protein
MDKSLKEEKMRVGRRREEARNFREEKMSQTQAHPTLHRLILRLWRSHPLAHCPHFLLHQGEALLALAIPSVSMRVGGIFLPLVKALCMVCGSNTSDGMEHKLGNVHGKLAEVMTG

SEQ ID NO: 135601 - protein, 93 aa, Glycine max
  Coding DNA Sequence Number=SeqID_18823
  Gene Ontology: Mol. function=nucleic acid binding; Biological process= DNA integration
  Homolog annotation: Hit_ID=Q1SYY5; Match level="QueryCoverage=99%, HitCoverage=25%, E-value=2e-13, Identity=61%"; Hit description =Integrase, catalytic region; Zinc finger, CCHC-type
MQEELDQFQNNDVWELVELPKGKSVVGAKWVFRNKFDETCKVGRNKAKLVAKGCLVTVMRILLEIEWKEKASVEDVTSLMDAWSLGRARNMGQ

SEQ ID NO: 135602 - protein, 61 aa, Glycine max
  Coding DNA Sequence Number=SeqID_18824
  Gene Ontology: Mol. function=DNA binding; Biological process=DNA integration
  Homolog annotation: Hit_ID=Q1SKC8; Match level="QueryCoverage=83%, HitCoverage=12%, E-value=1e-08, Identity=55%"; Hit description =Integrase, catalytic region
LKSKWSRLFTIKKVRPYGAVELYDPQAKDPDRTWVVNGQRLKLYHGGTIERLNIILYFQEA

SEQ ID NO: 135603 - protein, 115 aa, Glycine max
  Coding DNA Sequence Number=SeqID_18825
MMCGYQSSNGSDLWCETSDNDTRYCEEETSLNTILVMRDSKRAFEPVDEWVATDAFDVLLWEKKKNKRFWSWSGSLSASIRAKRKQHNKEGHMTSIWKKRGQLEVLEGAQCVNTC

SEQ ID NO: 135604 - protein, 750 aa, Glycine max
  Coding DNA Sequence Number=SeqID_18826
  Gene Ontology: Mol. function=binding; Cellular component=nucleus; Biological process=metabolic process
  Homolog annotation: Hit_ID=Q7EZR5; Match level="QueryCoverage=84%, HitCoverage=92%, E-value=1e-164, Identity=38%"; Hit description =Putative pentatricopeptide (PPR) repeat-containing protein
  Pfam annotation: Domain name=PPR; Domain location=169-203; Score =23.9; E_value=0.00056; Accession=PF01535.11; Description=PPR repeat
  Pfam annotation: Domain name=PPR; Domain location=231-265; Score =28.3; E_value=2.6e-05; Accession=PF01535.11; Description=PPR repeat
  Pfam annotation: Domain name=PPR; Domain location=267-301; Score =18.7; E_value=0.02; Accession=PF01535.11; Description=PPR repeat
  Pfam annotation: Domain name=PPR; Domain location=333-367; Score =30.6; E_value=5.6e-06; Accession=PF01535.11; Description=PPR repeat
  Pfam annotation: Domain name=PPR; Domain location=395-429; Score =36.1; E_value=1.2e-07; Accession=PF01535.11; Description=PPR repeat
  Pfam annotation: Domain name=PPR; Domain location=496-530; Score =49.1; E_value=1.4e-11; Accession=PF01535.11; Description=PPR repeat
  Pfam annotation: Domain name=PPR; Domain location=531-565; Score =16.1; E_value=0.093; Accession=PF01535.11; Description=PPR repeat
  Pfam annotation: Domain name=PPR; Domain location=567-601; Score =10.5; E_value=0.42; Accession=PF01535.11; Description=PPR repeat
  Pfam annotation: Domain name=PPR; Domain location=73-107; Score=28.8; E_value=2e-05; Accession=PF01535.11; Description=PPR repeat
  Pfam module annotation: Pfam domain module=PPR::PPR::PPR::PPR::PPR::PP R::PPR::PPR::PPR; Domain location=169-203::231-265::267-301::333 -367::395-429::496-530::531-565::567-601::73-107
MKQHSRTLHKRITKLNLFQSKLNQSHNNDSINSGGKGSKFLIQCNTQIAENGRNGNVKEAESIFHKMPIKNTASWTAMLTAFAQNGQIQNARRLFDEMPQRTTVSNNAMISAYIRNGCNVGKAYELFSVLAERNLVSYAAMIMGFVKAGKFHMAEKLYRETPYEFRDPACSNALINGYLKMGEVNEALRIFENMGERDVVSWSAMVDGLCRDGRVAAARDLFDRMPDRNVVSWSAMIDGYMGEGFFQEGFCLFMDMKREGLVEVNSTTMTIMFKACGNCGRMSEGMQIHGLVSRLGFEFDNVLSNSVITMYSMLGCTDMADKVFCTVSDKDIVTWNSLISGYIHNNEVEAAYRVFGRMPVKDVISWTAMIAGFSKSGRVENAIELFNMLPAKDDFVWTAIISGFVNNNEYEEALHWYARMIWEGCKPNPLTISSVLAASAALVALNEGLQIHTCILKMNLEYNLSIQNSLISFYSKSGNVVDAYRIFLDVIEPNVISYNSIISGFAQNGFGDEALGIYKKMQSEGHEPNHVTFLAVLSACTHAGLVDEGWNIFNTMKSHYGIEPEADHYACMVDILGRAGLLDEAIDLIRSMPFKPHSGVWGAILGASKTHLRLDLAKLAAQRITDLEPKNATPYVVLSNMYSAAGKKIDGDLVKMAKNLKGIKKSPGCSWITMKNKVHLFLAGDQSHGSIEEIKTTILTMDREMQCVESSFSQTSTTVLISNNRIKSDVSKKLSYSIIIYCYFLVIRYL

SEQ ID NO: 135605 - protein, 203 aa, Glycine max
  Coding DNA Sequence Number=SeqID_18827
  Gene Ontology: Mol. function=glycine hydroxymethyltransferase activity; Cellular component=nucleus; Biological process=regulation of transcription, DNA-dependent
  Homolog annotation: Hit_ID=Q0GPG8; Match level="QueryCoverage=98%, HitCoverage=83%, E-value=4e-59, Identity=66%"; Hit description=BZIP transcription factor bZIP94
  Pfam annotation: Domain name=bZIP_1; Domain location=116-176; Score =17.9; E_value=0.0017; Accession=PF00170.11; Description=bZIP transcription factor
MEFGNNADERAREAQTQVLDLERDLLFMGNELNKYKNQHQLWNREYEKMQNQPVPLWTGIVPILNGFLLFLVEPWKQLMFILPAFLNLERWINLLDFALKIPIPERCESSGSKDKSNQKVTLRRLAQNCEAARKSRLRKKAYQQQLESSRFKLTQLEQELQRARQQVLYDYKDKINQPVFPGLQGGPYNHTIIGLAVALKQGT

SEQ ID NO: 135606 - protein, 74 aa, Glycine max
  Coding DNA Sequence Number=SeqID_18828
  Gene Ontology: Mol. function=protein binding; Cellular component =membrane; Biological process=defense response
  Homolog annotation: Hit_ID=Q2HUN2; Match level="QueryCoverage=100%, HitCoverage=6%, E-value=3e-15, Identity=58%"; Hit description=TIR; Disease resistance protein
  Pfam annotation: Domain name=LRR_3; Domain location=55-74; Score =36.4; E_value=1e-07; Accession=PF07725.3; Description=Leucine Rich Repeat
MTNLRFLRIHKGWRSNNQFNVFLSNGLESLSNKLRYLHWDECCLESLPSNFCAEQLVEISMPRSKLKKLWDGVQ

SEQ ID NO: 135607 - protein, 341 aa, Glycine max
  Coding DNA Sequence Number=SeqID_18829
  Gene Ontology: Mol. function=transmembrane receptor activity; Cellular component=membrane; Biological process=defense response
  Homolog annotation: Hit_ID=Q2HUN2; Match level="QueryCoverage=97%, HitCoverage=32%, E-value=4e-80, Identity=47%"; Hit description=TIR; Disease resistance protein
  Pfam annotation: Domain name=NB-ARC; Domain location=16-275; Score =84.9; E_value=2.6e-22; Accession=PF00931.13; Description=NB-ARC domain
MCARNDVELLKDIVRAVSEKLPRRYQNQSKGLVGIEEHYKRIESFLNNGSSEVRTLGIWGMGGIGKSTLATALYNELSPEFEGHCFFINVFDKSEMSNLQGKRVFIVLDDVATSEQLEKLIGEYDFLGLGSRVIVTSRNKQMLSLVDEIYSVEELSSHHSLQLFCLTVFGEEQPKDGYEDLSRRVIFYCKGIPLALKILGKSLRQKCKDAWESELRKIQKILNVEIHNELKLSYYDLDCSQKEIFLDLACFFKGGKRDWVAGLLEAFGFFPASEIEVLLDKSLIRISKYNEIEMHDLTQEMGREIIRQQSIKDPGRRSRLCKHEEVVDVLKHNKASAIAFI

SEQ ID NO: 135608 - protein, 478 aa, Glycine max
  Coding DNA Sequence Number=SeqID_18830
  Gene Ontology: Mol. function=protein serine/threonine kinase activity; Cellular component=nucleus; Biological process=protein amino acid phosphorylation
  Homolog annotation: Hit_ID=Q9XF36; Match level="QueryCoverage=98%, HitCoverage=75%, E-value=0.0, Identity=82%"; Hit description=Mitogen- activated protein kinase homologue
  Pfam annotation: Domain name=Kdo; Domain location=39-230; Score= -83.2; E_value=0.045; Accession=PF06293.4; Description=Lipopolysacchar ide kinase (Kdo)
  Pfam annotation: Domain name=Pkinase; Domain location=43-334; Score =295.1; E_value=1.3e-85; Accession=PF00069.15; Description=Protein kinase domain
  Pfam annotation: Domain name=Pkinase_Tyr; Domain location=43-332; Score=34.5; E_value=1.4e-14; Accession=PF07714.7; Description =Protein tyrosine kinase
  Pfam module annotation: Pfam domain module=Kdo::Pkinase::Pkinase_Tyr; Domain location=39-230::43-334::43-332
MQQDQLKKVVSFSMIAPFVCKVCYGADIKEVEFFTEYGDANRYKILEVVGKGSYGVVCSAIDTHTGGKVAIKKIHDIFEHISDAIRILREVKLLRLLRHPDIVEIKRIVLPPSKREFKDIYVVFELMESDLHQVIKANDDLTREHYQFFLYQMLRALKYMHTANVYHRDLKPKNILANANCKLKVCDFGLARVAFSDAPTTTFWTDYVATRWYRAPELCGSFFSKYTPAIDVWSIGCIFAEVLTGKPLFPGKSVVHQLDLITDLLGTPSPETIAGVRNDKARKYLMEMRKKSPVPFEQKFQNADPLALRLLQRLLAFDPKDRPTAQEALADPFFKGLSKVEREPSCQPISKLEFEFERRRVTKDDVRELIYREILEYHPQLLKDYMNGTEGTHFLYPSAVDQFRKHFAYLEENHGKSGPVIPPERKHVSLPRSIVHSSTIPPSSQPSFTSYENKQMALEASKVSRSVESNSRSQLRSS

SEQ ID NO: 135609 - protein, 139 aa, Glycine max
  Coding DNA Sequence Number=SeqID_18831
  Homolog annotation: Hit_ID=Q108V0; Match level="QueryCoverage=99%, HitCoverage=7%, E-value=3e-26, Identity=45%"; Hit description =Expressed protein
MLEPFLDPGIAVPKSKIAFGDIASSFPEKQEHNCTIALNIIRTAVRKPAVLPSLESEWRHGSVAPSVLLSILEPHMLLPPDVDLCKSVLRPTDHETASISHLSSAINGGGAFSKSNGQDESDGKTNVSEMAGKSDFVED

SEQ ID NO: 135610 - protein, 81 aa, Glycine max
  Coding DNA Sequence Number=SeqID_18832
MEVVSAQRLLEVVKRRSHADKQWSPNEIRVRQSPLPTSGPQESRLGVPLSRNPLHLLKHTRTSLPLCSNALQQETLCLLAL

SEQ ID NO: 135611 - protein, 635 aa, Glycine max
  Coding DNA Sequence Number=SeqID_18833
  Gene Ontology: Mol. function=protein serine/threonine kinase activity; Cellular component=integral to membrane; Biological process=protein amino acid phosphorylation
  Homolog annotation: Hit_ID=Q6QLL5; Match level="QueryCoverage=96%, HitCoverage=92%, E-value=0.0, Identity=57%"; Hit description=WAK -like kinase
  Pfam annotation: Domain name=EGF; Domain location=139-171; Score =22.8; E_value=0.0012; Accession=PF00008.17; Description=EGF-like domain
  Pfam annotation: Domain name=Pkinase; Domain location=266-538; Score =150.3; E_value=5.1e-42; Accession=PF00069.15; Description=Protein kinase domain
  Pfam annotation: Domain name=Pkinase_Tyr; Domain location=266-538; Score=99.5; E_value=1e-26; Accession=PF07714.7; Description=Protein tyrosine kinase
  Pfam module annotation: Pfam domain module=EGF::Pkinase::Pkinase_Tyr; Domain location=139-171::266-538::266-538
  Subcellular localization annotation: CTP_CleavageSite=19; ConfidenceScore=5.75e-01
MANAGSTPFSSLLASPKVVQSSLTVPTTKSNFAANSPIFTENFAPTINNSFLVQDCREVFGGCVIPASFVSNQIDVENCSNKSANISCFSKQDEVFVTYADLNGTKCKYLFSAVSFGQSKEIPLQFQVVELGWWLPGQCDDHQCSNNATCTTVDRVGFRCQCIEGFTGDGFKNGIGCRKASASSCSASTLTSGGCGKATKIGVVVGVITTGALVVAGLFLLCYCARRRSTWLRKHTMVKRQLREAAGNSSVPFYPYKEIEKATNFFSEKHRLGTGAFGTVYAGKLHNDEWVAIKKLRQRDTNSADQVMNEIRLLSSVSHPNLVRLLGCCIEKGEHILVYEFMQNGTLSQHLQRERSKGLPWTIRLTIATETANAIAYLHSAIHPPIYHRDIKSTNILLDYGFKSKIADFGLSRLALTETSHISTAPQGTPGYVDPQYHQNFQLSDKSDVYSFGVVLVEIITAMKVVDFARPRSEINLAALAVDRIRRGAVDEIIDPFLEPHRDAWTLYSIHKVAELAFRCLAFHSDMRPTMMEVAEELEHIRRSGWASMEETLTASPIGSTSSSPRHGSEKSLGGIKKARQGQGSERLIVPQKTESFLQSMEVKDSSPVSVHDPIPWSSGHSSPSSNSLLGNVIP

SEQ ID NO: 135612 - protein, 229 aa, Glycine max
  Coding DNA Sequence Number=SeqID_18834
  Homolog annotation: Hit_ID=Q1SDX7; Match level="QueryCoverage=75%, HitCoverage=26%, E-value=1e-18, Identity=30%"; Hit description =Cyclin-like F-box
MGGKSEKGEVMEWSVANTKAFIEKIYERVKNGQLQGSTFKTTTWEEINKDLFEMIQTNYGVDKLKSKFNRLRQMHRDFSTLLARTGVTWEMESNKVNAPDEVWDELIKKGRHYKNFKKHGFEYNYDILGDIFNSSTSTGKLSHSFTQEPPNSNEEKAMEGDFLTKGIHINVFDDEKDDMKGPRHKRNMQDVPTSAYFKLMEKFTSEHWRQMFIVMDAERSKQLTESLTE

SEQ ID NO: 135613 - protein, 110 aa, Glycine max
  Coding DNA Sequence Number=SeqID_18835
  Homolog annotation: Hit_ID=Q56SE1; Match level="QueryCoverage=43%, HitCoverage=18%, E-value=4e-09, Identity=62%"; Hit description =Methyl jasmonate esterase
MGSNKTVRIKWPAGLNPSDDSYYLWVGRRIRCEERAKNNDGEGEEKEAFEEEQVILVGHSFGGLCISVAMELFPTKIAAAVFVSAWLPSPDLNYLDLLQEEIKTLKMRLV

SEQ ID NO: 135614 - protein, 78 aa, Glycine max
  Coding DNA Sequence Number=SeqID_18836
  Subcellular localization annotation: CTP_CleavageSite=46; ConfidenceScore=5.05e-01
MTIKHKLCNLKDKNYFNVNSTYITKMSVLLCVAVRLGRSREWVMVVAESGSQVATSTESGSRRDCVRRQARAAVMERE

SEQ ID NO: 135615 - protein, 144 aa, Glycine max
  Coding DNA Sequence Number=SeqID_18837
  Gene Ontology: Cellular component=chloroplast thylakoid membrane
  Homolog annotation: Hit_ID=O64835; Match level="QueryCoverage=85%, HitCoverage=86%, E-value=3e-17, Identity=42%"; Hit description =Expressed protein
  Subcellular localization annotation: CTP_CleavageSite=60; ConfidenceScore=5.72e-01
MVCAISSSPFSTLSFRRLVVRNATPSPCKPRAVKPLTALPSAGRRQLLFFLTATTALTAREAASVAQDIPLFGIRKSLKKVEEEAEEIVREGFEAADKGLVAAEKGLETAEKGLAGAVAGAEVFGILVATAVVNGILGPEAQKS

SEQ ID NO: 135616 - protein, 126 aa, Glycine max
  Coding DNA Sequence Number=SeqID_18838
MVWGHYRVLPSSCIPHFWQHRGMIKDTRQNQFGGRLDIHYRSTTVCWLNGVGDFFDKRDVLWAGLRKIKYGDFQNEPYSQPKSTKWSLWWRDIWSFDKRNAAALGREWVMDTLQASGSTNGLGKSH

SEQ ID NO: 135617 - protein, 51 aa, Glycine max
  Coding DNA Sequence Number=SeqID_18839
MVLKCTPNESPKEVSGVVGCRGTGWVGGRESGEWKGLLKREEGLNRLTVLK

SEQ ID NO: 135618 - protein, 34 aa, Glycine max
  Coding DNA Sequence Number=SeqID_18840
MANRAKKPKCNSAVDEQGKPSPQFRAASIPFLAL

SEQ ID NO: 135619 - protein, 460 aa, Glycine max
  Coding DNA Sequence Number=SeqID_18841
  Gene Ontology: Mol. function=ATP binding; Cellular component =ubiquitin ligase complex; Biological process=electron transport
  Pfam annotation: Domain name=WD40; Domain location=129-165; Score =16.7; E_value=0.084; Accession=PF00400.22; Description=WD domain, G -beta repeat
  Pfam annotation: Domain name=WD40; Domain location=201-239; Score =24.0; E_value=0.00054; Accession=PF00400.22; Description=WD domain, G-beta repeat
  Pfam annotation: Domain name=WD40; Domain location=243-280; Score =32.2; E_value=1.8e-06; Accession=PF00400.22; Description=WD domain, G-beta repeat
  Pfam annotation: Domain name=WD40; Domain location=290-328; Score =8.4; E_value=3.8; Accession=PF00400.22; Description=WD domain, G -beta repeat
  Pfam annotation: Domain name=WD40; Domain location=333-369; Score =31.0; E_value=4.2e-06; Accession=PF00400.22; Description=WD domain, G-beta repeat
  Pfam annotation: Domain name=WD40; Domain location=376-422; Score =37.4; E_value=4.8e-08; Accession=PF00400.22; Description=WD domain, G-beta repeat
  Pfam annotation: Domain name=WD40; Domain location=91-127; Score =18.0; E_value=0.035; Accession=PF00400.22; Description=WD domain, G -beta repeat
  Pfam module annotation: Pfam domain module=WD40::WD40::WD40::WD40::WD4 0::WD40::WD40; Domain location=129-165::201-239::243-280::290 -328::333-369::376-422::91-127
MTGSSRKGRGYMDEGSIHGRKYGKLKKDEFDGYNSDSHPRKNNPITLDAPHLDPQMEADNAPYDPSLSPLSKSPWSSHTNDDAFSGSNENDALVGSLVREEGHIYSLAATKDLLYTGSDSKNIRVWKNQKEFAGFKSNSGLVKAIVIAGEKILTGHQDGRIRVWKVSGKNEQQHKRVATLPTLRNYIKCSMKPSNYVEVRRHRNVIWIKHYDAISCLSLTEDHSLIYSASWDKTFKVWRTSNFKCLESVKAHDDAVNALVVGLNGMVFTGSADGTVKIWRREVQGKGTKHFFSQTLLKQECAVTSLAINEEGNVLYAGSSEGLVNYWVHETNLEHKGVLRGHKLAVLCLAAAGSLVFSGSADMAICVWKRTLSEEHTCVKILSGHTGPVKCLAAEKDPEAMCNERRWILYSGSLDKSVKVWKVSENINAGAQNNNHQPPRLSVDQFPRVSSLRKMGSRRY

SEQ ID NO: 135620 - protein, 291 aa, Glycine max
  Coding DNA Sequence Number=SeqID_18842
  Gene Ontology: Mol. function=RNA-directed DNA polymerase activity; Biological process=RNA-dependent DNA replication
MPRIVSSYQTGFIPSRSIHENIIVAQEILHSMRLIKRKPWFFVLKVELVKAYDRMRWSFIADIFHEVGIPDKLASVIMHCISLVQSNIAPFNEVTSLGRYLEVSLLGKAPRRRDFQYLVEKLAHRDIQKTQGAFIWGDQGMMRKIHAVSWKTMMFPKDHGGMAMSNLVQMDKVYLMKLGWALRSYKYGLWGEVLLGKYNRGAEGNSGQILTLAANSHIWKAIANLWPIIVENEICIIGDGGNINVWQEKWINGSIKLIDVIPHIPSNFLNLRVKDLTDLNGEWDITLLNSL

SEQ ID NO: 135621 - protein, 148 aa, Glycine max
  Coding DNA Sequence Number=SeqID_18843
MSDREDNAPEEFTTEQGIQQDEEIRRIQRENKARVVREGKERRRRWAQKITPRPSKAGKKSEDVEDSEPQQESNTAAGFLPDNIVQMLAARENLKPVILSEIGPPPCLNSALDFLKKKQMSVQRSSSVLNNSNKAFRLLSRSGVLRSK

SEQ ID NO: 135622 - protein, 168 aa, Glycine max
  Coding DNA Sequence Number=SeqID_18844
MAATEEPILSRIDRLDNMVIRGCNPSPKSSCASTPTSGSDGHVSSTDFSPKSLEKHCRPIEFVMMETEVKGTMIERLNQVEDRMLKEELVAKKKEEEKKMNSPKKGFKQLVKQSFDVYPATIAFKIPCIHCSKQSFCFPRDDEVEDEVGGLWRKRDTQGIWAEEDQPK

SEQ ID NO: 135623 - protein, 921 aa, Glycine max
  Coding DNA Sequence Number=SeqID_18845
  Gene Ontology: Mol. function=cellulose synthase (UDP-forming) activity; Cellular component=membrane; Biological process=cellulose biosynthetic process
  Homolog annotation: Hit_ID=Q2IB40; Match level="QueryCoverage=89%, HitCoverage=75%, E-value=0.0, Identity=83%"; Hit description =Cellulose synthase 4
  Pfam annotation: Domain name=Cellulose_synt; Domain location=275-921; Score=1372.1; E_value=0; Accession=PF03552.5; Description=Cellulose synthase
MRMLRWMCGKTRQDKIGNEAIRERVGVAPIVEKMVENRLRWFGHVERRPVDSVVRRVDQMERRQTIRDRGRPKKTIREVIKKDLEINGLDRRSPAILGDMEEDGAPAADGASDFNYDSENQNQNQNQKQKISERMLSWQLTYSRGEEVGAPNYDKDVSHNHIPLLTSGQEVSGELSAASPERLSMASPAVGGGKRVHNIPYSSDINQSPNIRAGDPGLGNVAWKERVDGWKMKQEKNVVPMSTGLAASERGAGDVDASTDVLVDDSLLNDEARQPLSRKVSIPSSRINPYRMVIMLRLVILCIFLHYRITNPVPNAYPLWLVSVICEIWFAISWILDQFPKWLPVNRETYLDRLALRYDQEGEPSQLAAVDIFVSTVDPLKEPPLVTANTVLSILAVDYPVDKVSCYVSDDGAAMLTFEALAETSEFARKWVPFSKKYSIEPRAPEWYFAQKIDYLKDKVHPSFVKDRRAMKREYEEFKVRVNGLVAKAQKVPEEGWVMQDGTPWPGNNIRDHPGMIQVFLGQSGGLDTEGNELPRLVYVSREKRPGFQHHKKAGAMNALVRVSAVLTNGPFLLNLDCDHYINNSKALREAMCFMMDPNLGKHVCYVQFPQRFDGIDRNDRYANRNTVFFDINLRGLDGIQGPVYVGTGCVFNRTALYGYEPPLKPKHKKPGLLSSLCGGNRKKSSKSSKKGTDKKKSNKHVDPTVPIFNLEDIEEGVEGTPLLLIHMFLGTGFDDEKSLLMSQMSLEKRFGQSAVFVASTLMENGGVPQSATPETLLKEAIHVISCGYEDKTDWGSEIGWIYGSVTEDILTGFKMHARGWRSIYCMPKRPAFKGSAPINLSDRLNQVLRWALGSVEILFSRHCPIWYGYGGRLKWLERFAYVNTTIYPVTAIPLLIYCILPAVCLLTNKFIIPQVVSLDE

SEQ ID NO: 135624 - protein, 739 aa, Glycine max
  Coding DNA Sequence Number=SeqID_18846
  Gene Ontology: Mol. function=signal transducer activity; Cellular component=cell cortex; Biological process=G-protein coupled receptor protein signaling pathway
  Homolog annotation: Hit_ID=O81225; Match level="QueryCoverage=99%, HitCoverage=82%, E-value=0.0, Identity=70%"; Hit description=Extra -large G-protein
  Pfam annotation: Domain name=G-alpha; Domain location=307-697; Score=- 1.7; E_value=2e-17; Accession=PF00503.10; Description=G-protein alpha subunit
RLGVPESVLSLEYPSTRVSSLKAEDIDAKRPPIVTFDVDTDDALDEEFDVDDTVSNKPVKRAPLTKGKKGSCYRCFKGSRFTEKEVCLVCDAKYCGNCVLRAMGSMPEGRKCVTCIGFPIDEAKRGSLGKFSRMLKRLLNDLEVRQIMKAERFCEANQLPPEYVCVNGHPLSYEELVTLQNCPNPPKKLKPGNYWYDKVSGLWGKEGQKPSQIISPHLNVGGPIQPDASNGNTQVFINGREITKVELRMLQLAGVQCAGNPHFWVNEDGSYQEEGQKNTRGYIWGKAGTKLVCAFLSLPVPSKSSNSLGEQPSSLASRTMPDYLEHGIVQKLLLVGCSGSGTSTIFKQAKILYKSVPFSEDEHENIKLIIQSNVYAYLGMLLEGRERFEEESLGDLKKRQSSVQDTTGTSPRLDEKTVYSIGPRLKAFSDWLLKTMVLGKLDAIFPAATREYAPLIEELWNDAAIKATYERRSELEMLPSVAGYFLERAVKILRTDYELSDLDILYAEGVTSSNGVACVEFSFPQSVSEETVDTTDRYDSLVRYQLIRVHARGLGENCKWLEMFEDVEMVIFCVSLTDYDQFSVDGNGCLTNKMVLSRKFFETIVTHPTFEQMDFLLILNKYDLFEEKIEQVPLTECEWFSDFHPIISCNRPNSNSNSINNNPSLGQLASHYVAVKFKRLYSSLTGRKLYVSLVKGLEPGSVDSSLKYAKEILKWSEERPNFSLSEYSMYSTEASSCSH

SEQ ID NO: 135625 - protein, 357 aa, Glycine max
  Coding DNA Sequence Number=SeqID_18847
  Gene Ontology: Mol. function=oxidoreductase activity; Cellular component=membrane; Biological process=electron transport
  Homolog annotation: Hit_ID=Q9SZ46; Match level="QueryCoverage=89%, HitCoverage=60%, E-value=1e-74, Identity=45%"; Hit description =Cytochrome P450-like protein
  Pfam annotation: Domain name=p450; Domain location=40-355; Score= -160.7; E_value=0.0012; Accession=PF00067.12; Description=Cytochrome P450
MDAFQFKILISSILALLVCALFYQFKRTLCGNTKKICSAPQAAGAWPIIGHLHLFNGHQLTHKTLGMMAEKHGPIFTIKLGSYKVLVLSSWEMAKECFTVHDKAFSTRPCVAASKLMGYNYAMFGFTPYGSYWRQVRKLTTIELLSNNRLEPLKETRTFELDAAVKELYKLWTRNGCPKGGVLVDMKQWFGDLTHNIALRMVGGKSYCGVGDDHAEGEARRYRRVMRDWVCLFGVFVWSDSFPFLGWLDINGYEKDMKRTASELDTLVEGWLEEHKRKKKRGLSVNGKEEQDDFMDVMLNVLQGTEISGYDSDTIIKATCLYHKISKLLTPIAGVQQQQQQRLIPLGGVGYMDQLPP

SEQ ID NO: 135626 - protein, 199 aa, Glycine max
  Coding DNA Sequence Number=SeqID_18848
  Gene Ontology: Mol. function=oxidoreductase activity; Cellular component=membrane; Biological process=electron transport
  Homolog annotation: Hit_ID=Q6XL72; Match level="QueryCoverage=98%, HitCoverage=75%, E-value=2e-66, Identity=63%"; Hit description =Cytochrome P-450-like protein
MVTLTWALSLLLNHQTELKRAQHELGTLMGKHRKVDESDIKKLVYLQAVVKETLRLYPPSPIITLRAAMEDCTFSCGYHIPAGTQLMVNAWKIHRDGRVWSDPNDFKPERFLTSHKDVDVKGQNYELVPFSSGRRACPGASLALRVVHLTLARLLHSFNVASPSNQVVDMTESFGLTNLKATPLEVLLTPRQDTKFYED

SEQ ID NO: 135627 - protein, 75 aa, Glycine max
  Coding DNA Sequence Number=SeqID_18849
  Gene Ontology: Mol. function=cellulose synthase (UDP-forming) activity; Cellular component=membrane; Biological process=cellulose biosynthetic process
  Homolog annotation: Hit_ID=Q8H2C6; Match level="QueryCoverage=97%, HitCoverage=6%, E-value=2e-34, Identity=86%"; Hit description =Cellulose synthase
  Pfam annotation: Domain name=PHD; Domain location=19-68; Score=8.7; E_ value=0.0076; Accession=PF00628.19; Description=PHD-finger
MESEGEAGAKPVTALGAQVCQICSDGVGKTVDGEPFVACDVCAFPVCRPCYEYERKDGNQSCPQCKTRYKRHKGK

SEQ ID NO: 135628 - protein, 157 aa, Glycine max
  Coding DNA Sequence Number=SeqID_18850
  Homolog annotation: Hit_ID=O81652; Match level="QueryCoverage=46%, HitCoverage=29%, E-value=2e-33, Identity=90%"; Hit description=Phyb1
MSQYKIGKIGLRWRTEKEVISGKGQFICGNKHCNEKDGLASYEVNFYYFEAGENKQALVKLVTCERCAFKLNYKRQKEKEQLEKRQQEQDRRKRNRSKSDDDLDDFHESKERRRKGRKKFHFYSQGREGKRALTSASDHKIDDDDDNLDEFLEGMFP

SEQ ID NO: 135629 - protein, 463 aa, Glycine max
  Coding DNA Sequence Number=SeqID_18851
  Gene Ontology: Mol. function=porin activity; Cellular component =integral to membrane
  Homolog annotation: Hit_ID=O23173; Match level="QueryCoverage=85%, HitCoverage=67%, E-value=1e-105, Identity=53%"; Hit description =Nucleoporin-like protein
  Subcellular localization annotation: CTP_CleavageSite=62; ConfidenceScore=5.55e-01
MSFSLFATPQQQQQQSPFQPQQTSLFLPQQQQQQQQQQQFQQQQQQQQPQQQLFLFTNDRTPASYSTNWADLHPDSQKILLQIEYALIFPHSSMERILEYRDESQRLDQCSRLYDSSVSNDGFELDAGHIVQELGGINTAMERQKTLLQELMSTVKDMLRNTEVAVRSFMMLRPRFLHPSGGTSSATAPSQTPGATIAPSSSSQPTTASIVPVFDFYSGLPKKPSPFLQQTVLRFEKYLGECHQWIEELEQLLLLDSERNASANGSSLLQSLPKVMTNVHDFFVHVAAKVESIHQYIESMKSAYLADQRRRGEVNDPFLEADRRETARQEAASKRVHPTLHLPANSQPSTQVAGLFSSSGTQAALTAPQTSAATSSLSSGSGFSLFSTPSSAPSSSMLSSLFTTPTPAPGPQTSLFGSTSVPGSASTPSLFGNTTPLFSTTPATNSLFSSPFVSGTVLFYSSS

SEQ ID NO: 135630 - protein, 544 aa, Glycine max
  Coding DNA Sequence Number=SeqID_18852
  Gene Ontology: Mol. function=binding; Cellular component =intracellular; Biological process=protein amino acid phosphorylation
  Homolog annotation: Hit_ID=Q2QZN2; Match level="QueryCoverage=91%, HitCoverage=81%, E-value=4e-76, Identity=26%"; Hit description =Pentatricopeptide, putative
  Pfam annotation: Domain name=PPR; Domain location=125-159; Score =18.5; E_value=0.024; Accession=PF01535.11; Description=PPR repeat
  Pfam annotation: Domain name=PPR; Domain location=196-230; Score=3.3; E_value=3.1; Accession=PF01535.11; Description=PPR repeat
  Pfam annotation: Domain name=PPR; Domain location=24-58; Score=38.5; E_value=2.3e-08; Accession=PF01535.11; Description=PPR repeat
  Pfam annotation: Domain name=PPR; Domain location=272-306; Score =11.3; E_value=0.34; Accession=PF01535.11; Description=PPR repeat
  Pfam annotation: Domain name=PPR; Domain location=328-362; Score =19.0; E_value=0.017; Accession=PF01535.11; Description=PPR repeat
  Pfam annotation: Domain name=PPR; Domain location=363-397; Score=3.0; E_value=3.3; Accession=PF01535.11; Description=PPR repeat
  Pfam annotation: Domain name=PPR; Domain location=59-93; Score=6.3; E_ value=1.3; Accession=PF01535.11; Description=PPR repeat
  Pfam module annotation: Pfam domain module=PPR::PPR::PPR::PPR::PPR::PP R::PPR; Domain location=125-159::196-230::24-58::272-306::328 -362::363-397::59-93
MYLNCVDLNSAELVFWDMVDRDDVAWNSLITGYLRNSKIKEGVWLFIKMMSVGFSPTLFTYFMVLNACSRLKDYRSGRLIHAHVIGRNVPLDLLLQNTLVGMYCNVGNMRTAYKIFSRMENPDLVSWNSIISGYSENEDGEKAMNLFVPLREMFFPKPDDYTFAGIISATRAFPSSSYGKPLHAEVIKTGFERSVFVGSTLVSMYFKNHESEAAWRVFCSISVKDVVLWTELITAHEVDDYVLSGCADLVVLRQDEIIHCYAVKLGYDAEMSVSGNLIDMYAKNGSLEAAYLVFSQVSESDLKCWNSMLGGYSHHGMILKQGLIPDQVTFLSLLSACSHSRLVEQGKFLWNYMNSIGLIPGPKHYTCMITLFSRAALLEEAEEIINKSPYIEDNLELWRTLLSSCVINKNFKVGIHAAEEVLRLKAEDGPTLVLLSNLYAVARRWDKVAEIRRNVRGLMLEKDPGLSWIEAKNDIHVLSSGDQSHPKADEVQAELHRLKRNMIRTENDDRETQNACYISCRDEAYALEVEFNSKTNEVHTGLKF

SEQ ID NO: 135631 - protein, 374 aa, Glycine max
  Coding DNA Sequence Number=SeqID_18853
  Gene Ontology: Mol. function=hydrolase activity, acting on ester bonds; Cellular component=cellular_component; Biological process =lipid metabolic process
  Homolog annotation: Hit_ID=O80470; Match level="QueryCoverage=91%, HitCoverage=88%, E-value=1e-143, Identity=70%"; Hit description =Putative GDSL-motif lipase/hydrolase
  Pfam annotation: Domain name=Lipase_GDSL; Domain location=35-355; Score=188.3; E_value=1.8e-53; Accession=PF00657.12; Description=GDSL- like LipaseAcylhydrolase
MAAKYHNTFALLLLLVNLRFHGNVAAQNAKLAASFIFGDSLVDAGNNNYLSTLSKADVPPNGIDFKASGGNPTGRFTNGRTISDIVGEELGQANYAVPYLAPNTSGKTILNGVNYASGGGGILNATGSLFVNRLGMDIQINYFNITRKQIDKLLGKSEAREYIMKKSLFSIIVGSNDFLNNYLLPFVSSGVRASQNPDAFVDDMINYFRIQLYRLYQLDARKFVISNVGPVGCIPYQRIINELNDEDCVDLANELATQYNSRLKDLVAELNDNLPGATFVLANVYDLVSELIVNYHKYGFTTASRGCCGIGSGGQVAGIIPCVPTSSLCSDRNKHVFWDQYHPSEAANIILAKQLINGDKRYISPMNLRQLIDL

SEQ ID NO: 135632 - protein, 104 aa, Glycine max
  Coding DNA Sequence Number=SeqID_18854
MEHATRGTAWRTRQQQGSDPGDYAPGSCPRQRHYQSRPRTGHYQSRPRTGHYQSRPRTGHYQSRPAAGRYQTCPRQGRYPAAASCAALCHVSRVPWKRLPGGAL

SEQ ID NO: 135633 - protein, 127 aa, Glycine max
  Coding DNA Sequence Number=SeqID_18855
  Gene Ontology: Mol. function=catalytic activity; Biological process =aromatic compound metabolic process
  Homolog annotation: Hit_ID=Q56S61; Match level="QueryCoverage=87%, HitCoverage=41%, E-value=8e-24, Identity=50%"; Hit description=MKS1
MFDEDTSNHRNGSRIFGPQFLASNLYQLCPPEDLTLAMSLLRPTRIYGDEELMRENTRLTKDKYGTVAKVYIVCEQDNELKQDFQLSMIERNPHNEVKEIVGADHVPMFSKPQELFSYLHEIANTYY

SEQ ID NO: 135634 - protein, 260 aa, Glycine max
  Coding DNA Sequence Number=SeqID_18856
  Gene Ontology: Mol. function=transcription factor activity; Cellular component=nucleus; Biological process=regulation of transcription, DNA-dependent
  Homolog annotation: Hit_ID=Q10EQ4; Match level="QueryCoverage=64%, HitCoverage=51%, E-value=3e-10, Identity=33%"; Hit description=CCAAT- binding transcription factor subunit B family protein, expressed
  Pfam annotation: Domain name=CBFB_NFYA; Domain location=215-260; Score=29.7; E_value=1.1e-05; Accession=PF02045.6; Description=CCAAT -binding transcription factor (CBF-BNF-YA) subunit B
MFLLRSHSIIEKRGYLERERDNGSHFNAIQVLKTKAFHRKSCAKMPGKADTDDWRVERGEQIQFQSSIYSHHQPWRCGVGENASKSSSADQLNGSIVNGITRSETNDKSGEGVAKEYQNIKHAVLSTPFTMDKHLAPNPQMELVGHSVVLTSPYSDAQHGQILTTYGQQVMYFFIRLIVSEEDARLALDVTQYKINPQLYGMYHARMPLPPEMEEEPVYVNAKQYHGILRRRQSRAKAELEKKEGDYTAKRKGLNILKKN

SEQ ID NO: 135635 - protein, 524 aa, Glycine max
  Coding DNA Sequence Number=SeqID_18857
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q94IR2; Match level="QueryCoverage=99%, HitCoverage=92%, E-value=0.0, Identity=79%"; Hit description =Carotenoid 9,10-9',10' cleavage dioxygenase
  Pfam annotation: Domain name=RPE65; Domain location=38-523; Score =622.5; E_value=3.5e-184; Accession=PF03055.6; Description=Retinal pigment epithelial membrane protein
MGDDGKKISGEGGLVKVEPKPSNGFTSKVVDLLEKLVVKFLYDSSLPHHYLTGNFAPVSETPPTKDLPVKGYLPDCLNGEFVRVGPNPKFAPVAGYHWFGIDMHAFKFISIKKCVLQLDFEAYQALPDCFCRFDGDGMIHGLRIKDGKATYVSRFVRTSRLKQEEYFGGSKFMKIGDLKGLFGLLMVNIHMLRTKWKVLDASYGTGTANTALVYHHGKLLALSEADKPYAIKVFEDGDLQTLGMLDYDKRLGHSFTAHPKVDPFTGEMFTFGYAHTPPYITYRVISKDGYMHDPAKGIPGVSVLIFWQKLIFQEMVKNKTLIFSFDSTKKARFGVLPRYAKDEKLIRWFELPNCFIFHNANAWEEEDEVVLITCRLQNPNLDLVGGTAKEKLENFSNELYEMRFNMKTGEASQKKLSASAVDFPRVNESYTGRKQRYVYGTTLDSIAKVTGIIKFDLHAEPDNGKTKLEVGGNVQGLYDLGPGKYGSEAVYVPRVPGTDSEEDDGYLICFVHDENTGYCFPPHT

SEQ ID NO: 135636 - protein, 325 aa, Glycine max
  Coding DNA Sequence Number=SeqID_18858
  Homolog annotation: Hit_ID=Q1RTB4; Match level="QueryCoverage=56%, HitCoverage=46%, E-value=3e-11, Identity=27%"; Hit description=IMP dehydrogenase/GMP reductase
MTTLGIISTEAIASLTQYYDQPLRCFTFGDFQLTPTVEEFEEILGCPLGGRKPYLFSGTKEMFGSKGESLGKSRQMGSIGGRPGALDLRSGPLSKRETRLPARRPLLMHREEGGKLGPTLSKQRRTVCQLVPRWKEGRIGILILCGGFPNVPLMGTRGCINYNPVLTIRQLGYPMRGAPLEEGLTPFIAQGFNSTNTGVLQGVRKAWEMVQKKDKELRGSSNGPISGYHKWLKAYAQGLDWLPNLRATKEVEGEAPKEDKELQALKIKLEKAQAVKEKFKSAAVRIRKENAELRDVNIATTKALEQKTKRARKEEHGWNKFQGAL

SEQ ID NO: 135637 - protein, 137 aa, Glycine max
  Coding DNA Sequence Number=SeqID_18859
MFLFPPKQKKVTEEDNEVVRHLRQPGPLPPLSTTVLNLGHGAGLFCVTNSHINNSSLSQDRIRMNKIKRTSGYNHRDDDTGRLIVTTGAIVAEAHIIEAHSDDADAPANSQMSFENLFPPHLISIRLIHHFLHFSCS

SEQ ID NO: 135638 - protein, 108 aa, Glycine max
  Coding DNA Sequence Number=SeqID_18860
MGAADCSARIQRKPEFEFRSAIFASDVEIGKGKVEETHLVTDDGDADNHLVLRRCADADQGLARFRCTRTHRINGLKGKARKRRKQPAAVGSVLVCMGLLELNLERIM

SEQ ID NO: 135639 - protein, 87 aa, Glycine max
  Coding DNA Sequence Number=SeqID_18861
MLGKPKRGLRILKIRVRELFTHREGISTLCDENPETGQIQAKGPSNPCGVYPDLSSFTGSGVYPDLSSFTGSGVIQILVACIKHSAP

SEQ ID NO: 135640 - protein, 115 aa, Glycine max
  Coding DNA Sequence Number=SeqID_18862
  Homolog annotation: Hit_ID=Q5ZA84; Match level="QueryCoverage=72%, HitCoverage=9%, E-value=2e-08, Identity=46%"; Hit description =Embryogenesis transmembrane protein-like
MGTLPIGIRKNWLTYFKYEEVRDTPRETRNILLIIFTLVAVVTFQAGVNPPGGVWQENKDGHLQEEQYMLQMSMLTMSSSSSILWPFLIPSLLFCYSLTSFLSILRYGLPLFPWL

SEQ ID NO: 135641 - protein, 129 aa, Glycine max
  Coding DNA Sequence Number=SeqID_18863
MSSGPPPLDDKGADDHNLSLPVNELACLWLTKGRQKVQEMMLVSVRQRARLPLVDKWCRTIRFPRMSPDFTGQDDKRDSKRMFTGYRQVSSHATGLLGHGNKGGVVDKSRAFAPTYPQFVMRNSDLRSS

SEQ ID NO: 135642 - protein, 1018 aa, Glycine max
  Coding DNA Sequence Number=SeqID_18864
  Gene Ontology: Mol. function=RNA-directed DNA polymerase activity; Cellular component=chromatin; Biological process=one-carbon compound metabolic process
  Pfam annotation: Domain name=RVP_2; Domain location=99-217; Score= -55.6; E_value=0.021; Accession=PF08284.2; Description=Retroviral aspartyl protease
  Pfam annotation: Domain name=rve; Domain location=709-862; Score =60.8; E_value=4.3e-15; Accession=PF00665.16; Description=Integrase core domain
  Pfam annotation: Domain name=zf-H2C2; Domain location=654-691; Score =19.2; E_value=0.001; Accession=PF09337.1; Description=His(2)-Cys(2) zinc finger
  Pfam module annotation: Pfam domain module=RVP_2::RVT_1::rve::zf -H2C2; Domain location=99-217::342-595::709-862::654-691
MSLNKQPRIVGTRVGIRGFDVGAYLSEFEDLVNRIIRLPPPFLLSCFIFGLSPEIRREIQALQPLMLVQATGLARLQEEKFLDTRRPFRDDDEGGLASDPNIDPLPKPPDGYHQVVILVDGGSTHNFILEHLVHQLGLPTQTTTPLNVMVGNGHHLDCRHVCATLAVHIKDIVFNIDLHVLPLCGAHIVLDVQWLKSLGSVLTDYNDLSMKFSRDGRVIEFKGDIASNLSLLTPPQLRRLVHKSGASALFHIRILSTELPSNQASPTQLLSGIQTLITKFNSPFQQPTTLPPSRPTNHHIHLFPNSNPVNVRPYRYPYFQKQEIEAQVYSMLQRGVIRPSTSLFSSPVLLVKKHDGTWRFFVDYQALNAITIKDHFPILTIDELLDELGGSQWFTKLDLLQGYHQILMHEDDIIKTAFKTYHGHYEFTVMPFGLCNAPSSFQATMNSLFRPYLRRFIIGQFFIKLSKCSFAQTQVEYLGHWCPTKGSNQSSRRSKPYSNGQYHALHEGSAQTAFDTLKIALTSAPVLLLLDFTILFIVEMDASRTGMGARIIRHYYGGQKMASLPLGSPIHNHYRSSKSKGVVNSSGPNFRAANVSNLPHGAFVQLQQAILAEPTTYPDHSVIQDLILKNGCIWLPSGFSFIPTLLLEYHSSPTDAHIGVTKTMARLSENFTWIGIRKDVEQFVAACLDCQYTKYEAQKMAGLLCPLPVPCRPWEDLSFNFIIGLSEFRGYTAILVVVGRFSKGIHLGMLPTCHTVVVLFIEIVRKIHGMPRSLVSDRDPLFISQFWRELFRLSDTRLRMSSVYQPQTDGQTEVLNHIIEQSLRAFVHNKPSTWGKFLSWVEWSYNTSCHSSSGMSPYKITFGKKPFNILQYLAGTSVVAANDDMLTNMEAVSAEVRKKLLKAQALMKQNADKKIKDANLKEGVIGLSRFLSGGCACDNTEPGAARAVHSLINACIESGQVIATSPPQNLHGAYIAFDDCNDATSLGIIAREKTSLSLLVLGLFHLLLDLVPSNFSQL

SEQ ID NO: 135643 - protein, 475 aa, Glycine max
  Coding DNA Sequence Number=SeqID_18865
  Gene Ontology: Mol. function=binding; Cellular component=membrane; Biological process=photosynthesis
  Homolog annotation: Hit_ID=Q6Z4S6; Match level="QueryCoverage=90%, HitCoverage=90%, E-value=1e-69, Identity=39%"; Hit description =Tetratricopeptide repeat-containing protein-like
  Pfam annotation: Domain name=TPR_1; Domain location=236-269; Score =17.1; E_value=0.049; Accession=PF00515.18; Description =Tetratricopeptide repeat
  Pfam annotation: Domain name=TPR_1; Domain location=67-100; Score =14.2; E_value=0.11; Accession=PF00515.18; Description=Tetratricopepti de repeat
  Pfam annotation: Domain name=TPR_2; Domain location=236-269; Score =17.9; E_value=0.037; Accession=PF07719.7; Description=Tetratricopepti de repeat
  Pfam annotation: Domain name=TPR_2; Domain location=67-100; Score =14.7; E_value=0.34; Accession=PF07719.7; Description=Tetratricopeptid e repeat
  Pfam module annotation: Pfam domain module=TPR_1::TPR_1::TPR_2::TPR _2; Domain location=236-269::67-100::236-269::67-100
MAEEAPASETSVTMPQPSEVITVDGTLNSSENDKSGISVDAAAHSGEETVSNAEASGSDPQKSLELANELMEKGNKAIKENDFGEAADNFSRALEIRVAHYGELAPECVHTYYKYGCALLYKAQEEADPLADVPKKEDGSQHGSNKDGSVKSSLNAESSTASFSSNAEQDVTSNDQGGAVDDGSTKNDQEEDDEDSDAEDLAEADEDETDLDLAWKMLDIARAIVEKQSVNTIEQVDILSTLADVALEREDFETSLSDYQKALTILEQLVEPDDRKIADLYPLYNSYLDVSSKPQEAIAYCQKATSVCKARLHRLTNEVKSCSDLTSASELAQDVPACPKSESNNSILDKQSEIETLKGLSSELEKKLEDLQQLVSNPKSILAEILGIAAAKAGNVKESSSAMVSSSQLATANGSGGFDSPTISTAHTNGSGGVTHLGVVGRGVKRASNATPAEGSTPKKPGLESTEDKDDGNSH

SEQ ID NO: 135644 - protein, 69 aa, Glycine max
  Coding DNA Sequence Number=SeqID_18866
MTVKKQGFGKKLQSHFSENYLVWTKIKSFRTAHGQLGNEQQRSQIRDSHEPATVVDTREGRPHRRPHRE

SEQ ID NO: 135645 - protein, 517 aa, Glycine max
  Coding DNA Sequence Number=SeqID_18867
  Gene Ontology: Mol. function=signal transducer activity; Cellular component=membrane; Biological process=response to light stimulus
  Homolog annotation: Hit_ID=Q9FJY3; Match level="QueryCoverage=93%, HitCoverage=96%, E-value=1e-128, Identity=47%"; Hit description =Photoreceptor-interacting protein-like
  Pfam annotation: Domain name=NPH3; Domain location=145-380; Score =241.3; E_value=2.1e-69; Accession=PF03000.5; Description=NPH3 family
MATGAQLSSRGQAWFCTIGLPSDIVIEVDDMDFHLHKTFPHGSYTFELAAKFCFGVKIALSSSNVVPLCCGEEFLEMTEQHSKENLISKTKTFLSHSVLNNIKDSIRCVDSIISETLFRWPVSDSASTLLLLHTNGRRSRRNSEDGSWFEELTLLGLPVFKQLILAMKGSELKPEIIETCFMQYTKKHIPGLSRSNRKALALSSSETEQKELLEIVILNLSLKHSTPLRFLFRLLRTATVLIASEACRNVMEKKIGSQLDEVTVDDLLIPSYSYLNETLYDIDCVARILGYFLQKERNVAAVDGLAPRSATLMLVGKLIDGYLLEIAFDANLKPSKFYDFAISVPDLARRFTTAHSWVSKSDREKISRVFDCQKRKLEACMHAAQNERLPLRAVVQVLFFEQLQLRHAIAGMLVVAKEPACHSATMAEEEEMEDDSGTGKRARGRRWVHELECECSSMKRVIEKMSPRDGGPWRASLALGRKFGCKFKTQINELFPPGSGFLPKSKHQSKCLLPQAK

SEQ ID NO: 135646 - protein, 91 aa, Glycine max
  Coding DNA Sequence Number=SeqID_18868
  Gene Ontology: Mol. function=RNA-directed DNA polymerase activity; Biological process=RNA-dependent DNA replication
  Homolog annotation: Hit_ID=Q1T2D5; Match level="QueryCoverage=52%, HitCoverage=3%, E-value=1e-10, Identity=68%"; Hit description=Chromo
MSTKVLIRITVSSQQGLKSLIRHRRPRWICYTKEFGAELFTEKAMGCPFWERTAPMPVLEASISTINRIVKSRRSNTGAEVNAIFNVSKAV

SEQ ID NO: 135647 - protein, 138 aa, Glycine max
  Coding DNA Sequence Number=SeqID_18869
MRTSDEIGRTTTNKTSNTEHLLHGDHQIFKYFTGPPMESNIKKTKESKEGRRRIKGYLPEKASSGNIPDDVLLERVSEYFRNHEFFFRKKVLSKSFRKRSLPEKGSSGNGFPGRAFSPLHYLLGAPTIMLGARSNSLK

SEQ ID NO: 135648 - protein, 667 aa, Glycine max
  Coding DNA Sequence Number=SeqID_18870
  Gene Ontology: Mol. function=binding; Cellular component=nucleus; Biological process=regulation of transcription
  Homolog annotation: Hit_ID=Q2QVE3; Match level="QueryCoverage=91%, HitCoverage=88%, E-value=1e-124, Identity=42%"; Hit description =Pentatricopeptide, putative, expressed
  Pfam annotation: Domain name=PPR; Domain location=103-137; Score =31.7; E_value=2.5e-06; Accession=PF01535.11; Description=PPR repeat
  Pfam annotation: Domain name=PPR; Domain location=204-238; Score =51.5; E_value=2.7e-12; Accession=PF01535.11; Description=PPR repeat
  Pfam annotation: Domain name=PPR; Domain location=274-308; Score =18.9; E_value=0.019; Accession=PF01535.11; Description=PPR repeat
  Pfam annotation: Domain name=PPR; Domain location=336-370; Score =44.5; E_value=3.5e-10; Accession=PF01535.11; Description=PPR repeat
  Pfam annotation: Domain name=PPR; Domain location=437-471; Score =43.7; E_value=6.2e-10; Accession=PF01535.11; Description=PPR repeat
  Pfam annotation: Domain name=PPR; Domain location=472-505; Score=4.8; E_value=2; Accession=PF01535.11; Description=PPR repeat
  Pfam annotation: Domain name=PPR; Domain location=540-573; Score =10.7; E_value=0.4; Accession=PF01535.11; Description=PPR repeat
  Pfam annotation: Domain name=PPR; Domain location=574-608; Score=1.4; E_value=5; Accession=PF01535.11; Description=PPR repeat
  Pfam module annotation: Pfam domain module=PPR::PPR::PPR::PPR::PPR::PP R::PPR::PPR; Domain location=103-137::204-238::274-308::336-370::437 -471::472-505::540-573::574-608
MFSALKLKPASVGSRLFCVGSLQTQINKTIWHQLKSPTHQTLHHLLDQCSSMKRLKLVHAQIILHGLAAQVVTLGKLLSLCVQEGDLRYAHLLFDQIPQPNKFMYNHLIRGYSNSNDPMKSLLLFRQMVSAGPMPNQFTFPFVLKACAAKPFYWEAVIVHAQAIKLGMGPHACVQNAILTAYVACRLILSARQVFDDISDRTIVSWNSMIAGYSKMGFCDEAILLFQEMLQLGVEADVFTLVSLLSASSKHCNLDLGRFVHLYIVITGVEIDSIVTNALIDMYAKCGHLQFAKHVFDQMLDKDVVSWTSMVNAYANQGLVENAVQIFNHMPVKNVVSWNSIICCLVQEGQYTEAVELFHRMCISGVMPDDATLVSILSCCSNTGDLALGKQAHCYICDNIITVSVTLCNSLIDMYAKCGALQTAIDIFFGMPEKNVVSWNVIIGALALHGFGEEAIEMFKSMQASGLYPDEITFTGLLSACSHSGLVDMGRYYFDIMISTFRISPGVEHYACMVDLLGRGGFLGEAMTLIQKMPVKPDVVVWGALLGACRIYGNLEIAKQIMKQLLELGRFNSGLYVLLSNMYSESQRWDDMKKIRKIMDDSGIKKCRAISFIEIDGCCYQFMVDDKRHCASTGIYSILDQLMDHLKSVGYPCKSSEVEEIYYSSNI

SEQ ID NO: 135649 - protein, 181 aa, Glycine max
  Coding DNA Sequence Number=SeqID_18871
  Gene Ontology: Mol. function=DNA binding; Biological process=DNA integration
  Homolog annotation: Hit_ID=Q1RSI0; Match level="QueryCoverage=53%, HitCoverage=16%, E-value=1e-10, Identity=42%"; Hit description=IMP dehydrogenase/GMP reductase
NLQDSGTLKRVAWGLDVGTRESKWNEIQACRGQTECPERIFVSISEYRDENKKLQVQGRTLRNVEGDKQDEDYPQKDPKECAFRARSKRTVVSFATGEKVSRKSKPSIWVYPFATRRKSPSLVLLKSMIPNIWQGGNSERSEIMMIVLESWAVEVGDGFIVGAIGTSKFSLLLENGAGERE

SEQ ID NO: 135650 - protein, 450 aa, Glycine max
  Coding DNA Sequence Number=SeqID_18872
  Gene Ontology: Mol. function=nucleic acid binding; Cellular component= oxygen evolving complex; Biological process=DNA integration
  Homolog annotation: Hit_ID=Q1ST43; Match level="QueryCoverage=95%, HitCoverage=87%, E-value=2e-58, Identity=33%"; Hit description =Integrase, catalytic region; Peptidase aspartic, catalytic
MATPLIDPSQDSTNPLWEELAGYKPTFSCTCEGQILLSDPLPSIGNVFSLILQEEAQREIVVTHSPTNALDNIAFSVNSASKNQYDNTKGKYIKKERPKCAHCDMLGHTKDKCYKLVGYPPNYFKNHTNNSARLVVRGFTQQYGLDFKENFSPVAKITTLRLLLSLAASQHWHLAQLDVNNAFLNGSLDEEIYMQIPQGYNHQASRSWFNKFGTTLTSQKYIQSKHDYTLFTKGTCSSFIAIMVYVDDIVIASPAKTAIHSAKDTGMLACKPSAVPMAADLKLNAESGSQLPDLEAYRRLIGKLLYLTISRLDICYTVHKLSQFVSDPRSGHMNAANILLRYLKHTTGQGVLFKTKSDTSLHAYVDADWVVYCDNKEAIYIATNPTYHERTKHLEIDLHYVREQVDKGALKLIHVRKYHQLADVFTKSLPRSAFLSIISKLGIENIFLPS

SEQ ID NO: 135651 - protein, 76 aa, Glycine max
  Coding DNA Sequence Number=SeqID_18873
MDLLEEERCLSDVEIARKVHLQEEFWRLAKLNESFLIQKSRASWANEGDCKSKLFHSIINWRRRKNSLKGLNVKGS

SEQ ID NO: 135652 - protein, 155 aa, Glycine max
  Coding DNA Sequence Number=SeqID_18874
  Homolog annotation: Hit_ID=Q9FJY2; Match level="QueryCoverage=66%, HitCoverage=66%, E-value=3e-27, Identity=61%"; Hit description =Arabidopsis thaliana genomic DNA, chromosome 5, TAC clone:K1F13
MGNCSSSDSTQVATAKLVLQDGRLQEFSYPVKVSFLLQKYPACFICNSDEMEFGDVVSAIDEDQVLQPGQLYFALPLSRLRHPLQPHEMAALAVKASSALMKTADKCGSRRKQILFSNEYDSNPKRVSPALAAGGGRGRTTAGAGELVLGNNGSD

SEQ ID NO: 135653 - protein, 266 aa, Glycine max
  Coding DNA Sequence Number=SeqID_18875
  Gene Ontology: Mol. function=nucleic acid binding; Biological process= DNA integration
  Homolog annotation: Hit_ID=Q1T2A4; Match level="QueryCoverage=95%, HitCoverage=86%, E-value=1e-19, Identity=25%"; Hit description=Zinc finger, CCHC-type
  Pfam annotation: Domain name=zf-CCHC; Domain location=142-159; Score =4.9; E_value=0.16; Accession=PF00098.13; Description=Zinc knuckle
  Pfam annotation: Domain name=zf-CCHC; Domain location=180-197; Score =6.6; E_value=0.08; Accession=PF00098.13; Description=Zinc knuckle
  Pfam module annotation: Pfam domain module=zf-CCHC::zf-CCHC; Domain location=142-159::180-197
MESYLYLHPSESSIVALVSPALDSNNYHSWSRSMITVLSAKNKVEFVNGNAPEPLKTDRMYGAWCRCNNMVVSWIVHSGDLLRISDLQQEASSMKQDPIPPVLAPLSALVQFLPPLHNLSGNNSLTSISLESKESSTNVVKTVCEFCGRVGHIESVFYKKHGVPSSYDGKNKGYNIKNGKTCTHCGRSDHTVDVCYRKLGFPTGYVFNNGNTTTISIVAVESKATDDQIQRYESQEVVNFSPEQYKALLALIRQPSSGNSVPTQSQ

SEQ ID NO: 135654 - protein, 212 aa, Glycine max
  Coding DNA Sequence Number=SeqID_18876
  Homolog annotation: Hit_ID=Q6NLY8; Match level="QueryCoverage=30%, HitCoverage=33%, E-value=4e-09, Identity=46%"; Hit description=HVA22- like protein k
  Pfam annotation: Domain name=TB2_DP1_HVA22; Domain location=127-201; Score=-26.9; E_value=0.013; Accession=PF03134.9; Description=TB2DP1, HVA22 family
  Subcellular localization annotation: CTP_CleavageSite=70; ConfidenceScore=5.39e-01
MMLFAHYNIVFGTPLLNCIIQGHGGNISVPESKLVSSTTLSFSLLRPRSLPFSLKFHASFSLKSPTSTFCAFSDAEEDEEDDEEEDQDQDNVSADEYDDVSGEADVFARHGGFKWQRVDKLCNEVGLRLLLSPVTSNLLLRTACCSIGLALPVYSTFKAIENNDPYEQQRCLLYWAGLQKLALLNLEGCQVYAEGPARPTGGAAAVAMLIGP

SEQ ID NO: 135655 - protein, 72 aa, Glycine max
  Coding DNA Sequence Number=SeqID_18877
MVLETEESFGRKQRGTSGTRYKIQPIATKPNDIYTSSKVSQGVSSCMDAVRSSAIADGENDAELEDARWCRH

SEQ ID NO: 135656 - protein, 170 aa, Glycine max
  Coding DNA Sequence Number=SeqID_18878
MSFSKQLVELQVPKQLRQLPTIGLYNGSFDLNDHLWRFESALAYIGTSASIMCHASPLSLKSTMLKRFQSLPLRFINSWLDLREKFRFAFATSKERPKIEVNLRLIQQGLGEPLNGYILRFNKEARVMEQPGVVLMLAKDSVWEGSFLHIHHKNATYHFGGILEKGGEIY

SEQ ID NO: 135657 - protein, 549 aa, Glycine max
  Coding DNA Sequence Number=SeqID_18879
  Gene Ontology: Mol. function=transcriptional elongation regulator activity; Cellular component=cytoplasm; Biological process =regulation of transcription, DNA-dependent
  Homolog annotation: Hit_ID=Q9FJY0; Match level="QueryCoverage=96%, HitCoverage=82%, E-value=1e-147, Identity=54%"; Hit description =Arabidopsis thaliana genomic DNA, chromosome 5, TAC clone:K1F13
  Pfam annotation: Domain name=DUF547; Domain location=406-549; Score =246.2; E_value=6.7e-71; Accession=PF04784.5; Description=Protein of unknown function, DUF547
MAVEGVGENRMLRLKFTPRHKRSKSFPDKKRIEEDKPDNRIQASGRIKVDMGYLAECDKARKNRSPTNEVHSTPKQEILQLERRLQDQFQVRSTLEKALGFRSSSLVNSNEMMIPKPATELIREIAVLELEVVYLEQHLLSLYRKAFDQQLSSVSPTSKEESVKFPLTTHSARFINFSMPEVLTKRECSTVQSNEHNKLETLRKEYDRYEPETFRKEQSRDLLEEKHLDSGVYRCHSSLSHCPAFTRESPPADSLAKSLRACHSQPLSMLEYAQSSSSNIISLAEHLGTRISDHVPVAPNKLSEDMVKCISAIYCKLADPPMAQPGLSSPSSSLSSASAFSIGDQGEMWSPRFRNNSSFEVRLDNPFHVEGLKEFSGPYSTMVEVSWLYRESQKSADTEKLLQNFRSLICRLEEVDPGRLKHEEKIAFWINIHNALVMHAFLAYGIPQNNVKRVFLLLKAAYNVGGHTISADTIQNTILKCRMSRPGQWLRLLFSQRSKFKAGDRRQAYALEQAEPLSHFALCSGNHSDPAVFPQFSLASNFVTHFRKA

SEQ ID NO: 135658 - protein, 241 aa, Glycine max
  Coding DNA Sequence Number=SeqID_18880
  Gene Ontology: Mol. function=electron carrier activity; Cellular component=extracellular region; Biological process=response to biotic stimulus
  Homolog annotation: Hit_ID=Q41495; Match level="QueryCoverage=82%, HitCoverage=94%, E-value=1e-48, Identity=49%"; Hit description=STS14 protein precursor
  Pfam annotation: Domain name=SCP; Domain location=107-229; Score =63.9; E_value=5.1e-16; Accession=PF00188.16; Description=SCP-like extracellular protein
  Subcellular localization annotation: CTP_CleavageSite=27; ConfidenceScore=5.19e-01
MAKPQVNGLGLLNMQTKTLNWPNLNPRERSLSTPSFTFQISRYVLFYQYYTTDRASELDKVTYMNNMFGQYPLFSLASLATFLVLTHAATAPENPPPPLTAAAREFLEAHNQARAEVGVEALSWSEKLGNVSSLMVRYQRNKKGCEFANLTASRYGGNQLWAGVTEVAPRVVVEEWVKEKKFYVRENNTCVGKHECGVYTQVVWRNSTEVGCAQAVCVKEQASLTICFYDPPGNVIGEIPY

SEQ ID NO: 135659 - protein, 282 aa, Glycine max
  Coding DNA Sequence Number=SeqID_18881
MHYWMRPSKDCWDGRFVVNEGKKKSCLKKNSASANSIVKLFNKIGGHPFALNVSKHSVVVGKLMEKSKDKPMSVASLYAASGVIIIDDDVELTNSSLVPARKFDGPFMWRGKRVSDSCYPKGTSFVVQVEGTSTWVVVTENKRGYISCGSVQVEGTSTWLFKENKGGYIPCVSFLVKENVNQQTEKLINTKATWDQWEENFKKVVNVSFKNALKQVDDGELHQTHPGAPKIMNENFVGQETADVETLDEEMVDWFINTPEANSDDKIVEASNANANLEGSKR

SEQ ID NO: 135660 - protein, 398 aa, Glycine max
  Coding DNA Sequence Number=SeqID_18882
MEVLPCSGVQYAGESDCPQQSSGTAFVYQEQPNCPENGEHVNFVAAQLNESSHKMQGPQIERHLSTNSDCQCIGTSCCDCQVDDQHEYCGFHDFEEDMINEPCLTSENFISVVDTIEIESPNNSREGDLSCSEPKWLEGDESVALWVKWRGKWQAGIRCARADWPLSTLKAKPTHDRKKYFVIFFPHTRIYSWANMLLVRSINEYPHPIAYKTHQVGLKMVKDLTVARRFIMQKLVVGLLNMVDQFHFNALTETARDVKVWKEFAMEASRCKGYSNFGRILLKLHKLLNIVVCVDFSDPWHCFAKTSILQHHINADWLQHSYLSWAERCQSSNSAESVELLKEVPCDFDYQFITAFLSLLVYSFLFVIGMLKEIYGFLILALQLVLGHHSSTHSQSRM

SEQ ID NO: 135661 - protein, 1149 aa, Glycine max
  Coding DNA Sequence Number=SeqID_18883
  Gene Ontology: Mol. function=histone-lysine N-methyltransferase activity; Cellular component=intracellular; Biological process =chromatin modification
  Homolog annotation: Hit_ID=Q6YV15; Match level="QueryCoverage=99%, HitCoverage=94%, E-value=0.0, Identity=40%"; Hit description =Putative SET domain protein SDG117
  Pfam annotation: Domain name=Pre-SET; Domain location=853-986; Score =39.0; E_value=1.6e-08; Accession=PF05033.6; Description=Pre-SET motif
  Pfam annotation: Domain name=SET; Domain location=988-1133; Score =185.7; E_value=1.1e-52; Accession=PF00856.18; Description=SET domain
  Pfam annotation: Domain name=zf-C2H2; Domain location=463-486; Score =11.7; E_value=0.57; Accession=PF00096.16; Description=Zinc finger, C2H2 type
  Pfam annotation: Domain name=zf-C2H2; Domain location=497-520; Score =20.5; E_value=0.0062; Accession=PF00096.16; Description=Zinc finger, C2H2 type
  Pfam annotation: Domain name=zf-C2H2; Domain location=531-554; Score =4.0; E_value=3.9; Accession=PF00096.16; Description=Zinc finger, C2H2 type
  Pfam annotation: Domain name=zf-C2H2; Domain location=600-623; Score =15.0; E_value=0.25; Accession=PF00096.16; Description=Zinc finger, C2H2 type
  Pfam module annotation: Pfam domain module=Pre-SET::SET::zf-C2H2::zf -C2H2::zf-C2H2::zf-C2H2; Domain location=853-986::988-1133::463 -486::497-520::531-554::600-623
MQSTLGSEWKTWKQDVMKWFSAPPSLSSSKDTQQQSSDDLYQANLQVCRKRPKLEVRRADTHASQVEIKDQTIALEADPGFFKNQDTLSTIAAQSCKQEGVREVSMTTSPSNLANKWNEIVVEATASDFLHIKEMESTPTNEMSVAKSVEPGSKNRQCIAYIEAKGRQCVRWANDGDVYCCVHLSSRFLGSSTKSEKPVPVDTPMCEGTTVLGTRCKHRALPDSLFCKKHRPHAETVQTSNLPQNTLKRKHEENYTGSKDMYALVNVESPLQVDPVSSIGGDSVHVESNFNEKPKHSENDHNAVVSMHCIGSPPYDYKNPCREGPKRYCLYCERHLPSWLKRARNGKSRIVSKEVFTELLGECSSWEQKVHLHKACELFYRLFKSILSLRNPVPKDVQFQWALTEASKDSNVGEFFTKLVHSEKARIKSIWGFNDDMDISSIMEEPPLLPSTINDNYDEENAIKCKICSAEFPDDQALGNHWMDSHKKEAQWLFRGYACAICLDSFTNKKLLETHVQERHHVQFVEQCMLLQCIPCGSHFGNTEQLWQHVLLVHPVDFKPSTAPKQQNFSTGEDSPVKHDQGNLAPLENNSENTGGLRKFVCRFCGLKFDLLPDLGRHHQAAHMGPNLASSRPAKRGVRYYAYRLKSGRLSRPKFKKTLAAASYRLRNKANANLKRGIQASNSLGMGGITIQPHVTESETTNIGRLAEHQCSAVSKILFSEIQKMKPRPNNLDILSIAQSACCKVSLAASLEEKYGILPEKLYLKAAKLCSENSILVNWHQEGFICPRACNVSKDQALLSPLASLPNSSVRPKSVNLSDPASDEWEVDEFHCIINSHTLKIGSLPKAVILYDDISFGKESVPVSCVVDQELMHSLHMNGCNRQNISPSMPWETFTYVTKPMLDQSLSLDSESLQLGCACLCSTCCPETCDHVYLFGNDYDDAKDIFGKPMRGRFPYDENGRIILEEGYLVYECNHMCRCNKSCPNRVLQNGVRVKLEVFKTEKKGWAVRAGEAILRGTFVCEYIGEVLDVQEARDRRKRYGAEHCSYLYDIDARVNDMGRLIEEQAQYVIDATKFGNVSRFINHSCSPNLVNHQVLVESMDCERAHIGFYASRDIALGEELTYDYQYELMPGEGSPCLCESLKCRGRLY

SEQ ID NO: 135662 - protein, 187 aa, Glycine max
  Coding DNA Sequence Number=SeqID_18884
MSSRKSSLKGSFGRSSPSYFENRRNTQVVDGRGEGGWTIQDNEDMTEKGIELCPQRWLNPRLMAIVPSTNTDSNAHPLATEPNNEGIPSSKVIICCEFLKSLEQLYSYEDGLELAKASLLYPQYMHGSMENCVEVVRMERQLIGLKGDKAPGLEDINWADEKIHGIRFVLTPMVLDLLTHQFPITKE

SEQ ID NO: 135663 - protein, 473 aa, Glycine max
  Coding DNA Sequence Number=SeqID_18885
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SS89; Match level="QueryCoverage=47%, HitCoverage=31%, E-value=3e-62, Identity=49%"; Hit description =Integrase, catalytic region
  Pfam annotation: Domain name=rve; Domain location=138-273; Score =33.5; E_value=7.4e-07; Accession=PF00665.16; Description=Integrase core domain
PFPTIEHAYAHVRREDTCQTVMTSGAENTTSGAGPSDGGKCTHCGNVIHTHDTCFKLHGYPEWWHELQAKKKKNTPTLEEGTSKVVAVTVESQLSLCPMTSSSTLMKPDFSHSTLPHRTYIANENGVAYPVTGPGTVALSSPVSLSDTLLVPTLSNKFMFVSQITEELNCVVLMYYTFRLLQDVLSKKIIRRGEFVNHHFKAYFQQHGLLHETSCLETPQHNGVAERKNRYIVKTTHALLLGTHVPTRHWDDAVTAAVYLLNRMPSKAMDYTKKGYKCLDPTTNKTYITMDVTFLESEPFFSPMLSNSALQGESMKKELNWYLAAPSSIVEMKQIGEHESEVEGVIYDEPIEMQHLNIIEVKSEEDPSTNEGIANEKISVNEDYIDQARIVEPLGRRRRKKWGKRTGYSGRFRKNLEGFFQNFRKKLFRKISGSNQGSSGRTLLPEIFQNTSSGNFPEEVVLPENFWKKGSSG

SEQ ID NO: 135664 - protein, 740 aa, Glycine max
  Coding DNA Sequence Number=SeqID_18886
  Gene Ontology: Mol. function=sequence-specific DNA binding; Cellular component=nucleus; Biological process=regulation of transcription, DNA-dependent
  Homolog annotation: Hit_ID=Q9M7S0; Match level="QueryCoverage=99%, HitCoverage=95%, E-value=1e-154, Identity=46%"; Hit description =Homeodomain protein
  Pfam annotation: Domain name=Homeobox; Domain location=491-546; Score= 8.0; E_value=0.00073; Accession=PF00046.19; Description=Homeobox domain
  Pfam annotation: Domain name=POX; Domain location=270-395; Score =230.9; E_value=2.8e-66; Accession=PF07526.2; Description=Associated with HOX
  Pfam module annotation: Pfam domain module=Homeobox::POX; Domain location=491-546::270-395
MSQDFQQGIFSFPNGLERGRVMSPQQQIRRDKVRFEAAPLVGIEEEEPVYETAGMLSEMFNFPPATELLEQQHATATFRAARQAGEWYGNRQQQQQQISGINADSAAAMQLFLMNPQTRSPSPPQSHTTPSSTLHMLLPNPSSNSLQGFTGSAAGGSFGQFTWVPEGAHQQGGVVEGQGLSLSLSSSLEAAKAEELRMGDSGFLYYNHQQGGGGGGGGGGPSSSSSAVQFQYKNNNSHHHQALHLQGAMGHDNNHQGHVGFGSSSLGVVNVLRNSKYVKAAQELLEEFCSVGRGQFKKSKFNRQNSNPNSNPGGGGSSPSSKDAPPPPPPLSAADRIEHQRRKVDRRYNHYCEQMQMVVNSFDLMMGFGAAVPYTALAQKAMSRHFRCLKEAITAQLKQSCEVLGDKDGAGSSGGLTKGETPRLKMLEQSLRQQRAFHQMGMMEQEAWRPQRGLPERSVNILRAWLFEHFLHPGTVSSNVAVSLDVVSAAKRWKKMHTASSIDALITMNISWYPSDADKHLLARQTGLSRNQVSNWFINARVRLWKPMVEEMYQQELKEAESAEEREKDQSNNISGNQAQIPTTPSAATTSTATATAPPPPPSTTTKTTKPTGKRSDTINAPESDPSQHLAMNNRQGFSENQAKKSTASTTTTTIASEVAPPVSQCFDDSDLPAHRLMASDDTCHLVTADFGTASASADIGSTLIRFGTTPGDVSLTLGLRHAGNMPEKSPFSVRDFGAI

SEQ ID NO: 135665 - protein, 90 aa, Glycine max
  Coding DNA Sequence Number=SeqID_18887
MKREEKQFREEMFKFTCFIRGCHDASKLLQYKKYGDEEIGAKKGYAYLSFSDLYGSSIPRLYNWMTSPLSTSIGLPSVEQVYTSHHQGLS

SEQ ID NO: 135666 - protein, 288 aa, Glycine max
  Coding DNA Sequence Number=SeqID_18888
  Gene Ontology: Mol. function=chitin binding; Cellular component =extracellular region; Biological process=chitin metabolic process
  Homolog annotation: Hit_ID=UPI000044A8F0; Match level="QueryCoverage =79%, HitCoverage=99%, E-value=7e-36, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFRGQHALAFRGLHVLVFRGLHALAFRGLHALPFRGLHALPFRGLHFLPFKWLHVLAFRGLHVLTFRGLHVLTFRGLHVLTFRGLHALAFRGLHVLAFRGLHDLAFRGLHVLTFIGLHVLAFRGQHALAFRGFHVLVFRGLHALAFSGIHVLTFKRLHVLAFRGLHVLAFRGLHVLTFRGLHALAFRGLHVLVFRGLLARAIRGLQVLKPLEKASQRSHEEASGGSLLMKLLEKATWSCLGKNAVQPSLTKPLNEASGGSLIMKLLEKTTWSCLGKNAGQPLLT

SEQ ID NO: 135667 - protein, 160 aa, Glycine max
  Coding DNA Sequence Number=SeqID_18889
  Gene Ontology: Biological process=protein folding
  Homolog annotation: Hit_ID=Q10T60; Match level="QueryCoverage=84%, HitCoverage=41%, E-value=8e-49, Identity=63%"; Hit description =Expressed protein
MCSKLSFLQLLPECAPHSVSYILELLALPHCVGCQLHRAESRGSFWDSEGNHIKKAPYGPPFALIQGTLESYGSMFKDIPKEHCPTIRRGSVAWVGSGPEFFISLADHGEWRNAYTVFGSVLSEDMEILEKIAQLPTKSEIWNILKFLSWRTQFHYGFGE

SEQ ID NO: 135668 - protein, 208 aa, Glycine max
  Coding DNA Sequence Number=SeqID_18890
  Gene Ontology: Mol. function=3-deoxy-8-phosphooctulonate synthase activity; Cellular component=cytoplasm; Biological process =biosynthetic process
  Homolog annotation: Hit_ID=O50044; Match level="QueryCoverage=93%, HitCoverage=67%, E-value=1e-103, Identity=94%"; Hit description=2 -dehydro-3-deoxyphosphooctonate aldolase
  Pfam annotation: Domain name=DAHP_synth_1; Domain location=1-199; Score=182.5; E_value=1e-51; Accession=PF00793.10; Description=DAHP synthetase I family
ILEKVKIAYDIPIVTDVHETIQCEAVGRVADIIQIPAFLCRQTDLLVAAAKTGKIINIKKGQFCAPSVMTNSAEKVRLAGNPNVMVCERGTMFGYNDLIVDPRNLEWMREANCPIVADITHSLQQPAGKMLDGGGVASGGLRELIPCIARTAVAVGVDGIFMEVHDDPLNAPVDGPTQWPLRHFKELLEELVAIAVGFRQSSVQPDPI

SEQ ID NO: 135669 - protein, 785 aa, Glycine max
  Coding DNA Sequence Number=SeqID_18891
  Gene Ontology: Mol. function=nucleic acid binding
  Homolog annotation: Hit_ID=Q6YH14; Match level="QueryCoverage=35%, HitCoverage=79%, E-value=1e-121, Identity=78%"; Hit description =Putative heterogeneous nuclear ribonucleoprotein
  Pfam annotation: Domain name=RRM_1; Domain location=200-271; Score =93.4; E_value=7e-25; Accession=PF00076.12; Description=RNA recognition motif. (a.k.a. RRM, R
  Pfam annotation: Domain name=RRM_1; Domain location=280-357; Score =23.9; E_value=0.00058; Accession=PF00076.12; Description=RNA recognition motif. (a.k.a. RRM, R
  Pfam annotation: Domain name=RRM_1; Domain location=377-450; Score =32.1; E_value=2e-06; Accession=PF00076.12; Description=RNA recognition motif. (a.k.a. RRM, R
  Pfam module annotation: Pfam domain module=RRM_1::RRM_1::RRM_1; Domain location=200-271::280-357::377-450
MPPRIVKRGAAAKRASRGSSKAAPENQPEPETTEVVVKNNQENPVVDAVVEEKLVDVEQEHEEVPNESAKVENTEEEVKESIDEYEKDEHLDFEDNYPEYEAEEYGGVDYDEKEIEQEEGQEEGDEVEEDPEEIVGEEEGDTGDEEVEYVYEEVEDDDDDDDEHAVEEFEHDEHAQKPDAEEEEHREVVKERRKRKEFEVFVGGLDKDATEHDLKKVFGKVGVVTEVRLMINPQTKRNKGFAFLRFETVEQARRAVVELKNPVINGKQCGVTPSQDSDTLYLGNICKTWKKEALKEKLKHYGVENVEDLTLIEDGTNEGMNRGFAFLEFSSRSDAKEAYRRLQKRDVAFGVDKPAKVSFADSFIDLGDEIMAQVKTVFVDSLPPSWDEVYVRDLLKKYGEIEKIELAKDMPAARRKNYGFVTFSTHAAAVECADSITSAGLGEGDKKAKVRARLSRPLSKPLQRGRGKHVNHGDFRSGRNSGRLVRSSRSRPAPRSLPARVVRGVGSRVPPVRPISVRSRRPVTSMLERSRPVAPPARSYDRRLAAPAYPKSGMKRDYRRRVNLPPPRNRVAADYGSRLASQRHTSHRDYPARGSNYPELHRSTSRGSAPKRGYVDDGHGQRFERAPPPPPPPPHLSYREGRPRDYDTLSGSKRPYTDIDDVPPRYDTSARQSRSRLNYDYGGSASQYGDAYGDRLGRSSLGYSGSRNSISSQDLHGTYGSRQGMSYGGGSFGGSDGGMYSSSYGGDYVSRGSDVGGRSYSSMYSGRGVGDSSNYMGGGGSGSYY

SEQ ID NO: 135670 - protein, 36 aa, Glycine max
  Coding DNA Sequence Number=SeqID_18892
MGLIDYGLQIRKGPNEHAGGSSCDLLIAHWLESWRP

SEQ ID NO: 135671 - protein, 85 aa, Glycine max
  Coding DNA Sequence Number=SeqID_18893
MDEESKSRSLMIEMQRYRMELDDIMLEMESSNNCCSFVNGDHDGDVTKVYDDDDDDDDDEDDDDDDADEEDVDHNRVPFLQICFC

SEQ ID NO: 135672 - protein, 57 aa, Glycine max
  Coding DNA Sequence Number=SeqID_18894
MKLQRVEIRKDASENERSEKRNNVALRCVAVYLLLLVDDGRIRIIALQIPKHSYVGG

SEQ ID NO: 135673 - protein, 104 aa, Glycine max
  Coding DNA Sequence Number=SeqID_18895
MAESTHSKSNMDCIEDTIAKLTATQLHLTATQNSMSMKLDDLLQKMASSKLVGLHQHHPWLLPTRVLFWLGTNEWRTMVKLLPGPIYFKLRRLALLRHNTTTRQ

SEQ ID NO: 135674 - protein, 458 aa, Glycine max
  Coding DNA Sequence Number=SeqID_18896
  Gene Ontology: Mol. function=protein binding; Cellular component =microtubule associated complex; Biological process=carbohydrate metabolic process
  Homolog annotation: Hit_ID=Q8S929; Match level="QueryCoverage=97%, HitCoverage=97%, E-value=1e-138, Identity=55%"; Hit description =Autophagy 4a
  Pfam annotation: Domain name=Peptidase_C54; Domain location=136-409; Score=408.8; E_value=8e-120; Accession=PF03416.9; Description =Peptidase family C54
  Subcellular localization annotation: CTP_CleavageSite=66; ConfidenceScore=5.15e-01
MVLKGLCERIVSSKCSSKSSTETVDNTQVPVYSKAGSSDCKFPKASLWSSIFTSGFSVVETYSESSASEKKAVPSRSSGWAAAVRKVVTGGSMRRFQERVLGSSRTDISSSDGDIWLLGVCHKISQQESTGGVDTSNGLASFEQDFSSKILVTYRKGFDAIGDTKYTSDVNWGCMLRSSQMLVAQALLFHKLGRSWRKPIDKPLDKEYIDVLQLFGDSEASAFSIHNLLQAGKGYGLAVGSWVGPYAMCRTWEVLARKKNDLGEPPLPMAIYVVSGDEDGERGGAPVVCIEDASKRCSEFSSGLAVWTPLLLLVPLVLGLDKVNPSLGIMGGKPGASTYIIGVQNEKAFYLDPHDVQQVVNISGDTQEPTGTSSYHCKHIPLDSIDPSLAIGFYCRDKDDFDDFCSQASKLAEESNGAPLFTVAKSRSFSKQVSNDVSGDNTGFQEDDFPGMDCGNDT

SEQ ID NO: 135675 - protein, 600 aa, Glycine max
  Coding DNA Sequence Number=SeqID_18897
  Gene Ontology: Mol. function=protein dimerization activity; Cellular component=cytoplasm; Biological process=regulation of transcription, DNA-dependent
  Homolog annotation: Hit_ID=Q9LT11; Match level="QueryCoverage=66%, HitCoverage=95%, E-value=4e-71, Identity=40%"; Hit description =Arabidopsis thaliana genomic DNA, chromosome 5, P1 clone:MQM1
  Pfam annotation: Domain name=DUF1771; Domain location=242-307; Score =19.2; E_value=0.00025; Accession=PF08590.1; Description=Domain of unknown function (DUF1771)
MAASAHSSLKKMSWAKGQSSGWTAFDLKQRKNKDFESEVDDDPFPAIGPTDPIIKKNHVPAKPFSSVLLPTKNFPPLNEDGNSKKAMLGSDSDGKYCGATTQEDVNLAIKKLREQHLWAEHSLIDDIFTAVNNNIDKATSLLETMAPAVNFEESKVSINPRSTTSDDTPCMDKTDDSLTSEKVEDDIPFDYNLVDNLQDNDKDLEDRNAPSGQKLSGVDYLRCKMKLLNSVPVEPEWEDDDIYISNRKDALRTMRLASRHSKAASSAFLRGDHFSAQHHSMKARAEWHTAEELNSDAAKKILSIRNNENDIWRLDLHGLHATEAIQALQEHLYRIECQGFSKSSATSNGVKENGLGHSTLGSFNFMDREKLDTQAPLRLRPLALHVITGIGNHSRGLAALPAAVRSFLNENSFCGAYATNFSNLWFNRRGTSIEPFSDPPNSTSNLMANFGTTQRTPNTTTTPSPPSLDPYEPKGPHEKLYTDFKIYWPFTMPLTSEAAAIRVIRNLEHLGLYYTLFVWIILFIVLIPHLFATFVQLILTEAGIQLAVTLACAVPFVLVHAVLWVSHHAFEIEDDSGTKELTPLVGHNGCACRAKALENV

SEQ ID NO: 135676 - protein, 368 aa, Glycine max
  Coding DNA Sequence Number=SeqID_18898
  Gene Ontology: Mol. function=catalytic activity; Cellular component =nucleus; Biological process=metabolic process
  Homolog annotation: Hit_ID=Q9LHZ4; Match level="QueryCoverage=94%, HitCoverage=63%, E-value=5e-43, Identity=31%"; Hit description =Pentatricopeptide (PPR) repeat-containing protein-like
  Pfam annotation: Domain name=PPR; Domain location=179-213; Score =26.6; E_value=8.9e-05; Accession=PF01535.11; Description=PPR repeat
  Pfam annotation: Domain name=PPR; Domain location=280-314; Score =34.3; E_value=4.2e-07; Accession=PF01535.11; Description=PPR repeat
  Pfam annotation: Domain name=PPR; Domain location=322-356; Score =22.3; E_value=0.0017; Accession=PF01535.11; Description=PPR repeat
  Pfam annotation: Domain name=PPR; Domain location=77-111; Score=15.8; E_value=0.1; Accession=PF01535.11; Description=PPR repeat
  Pfam module annotation: Pfam domain module=PPR::PPR::PPR::PPR; Domain location=179-213::280-314::322-356::77-111
MRALGVELNVYSFSNVIKSFAGATAFLQGLKTHGLLIKNGLVDNYILRTSFIDKYFKCGKVMLACRVFEEIPERDIVVWGAMLAGFAHNRLQREVLEYVRWMVEEGVKLSSVVMTIVIPVIWEVCLRRLGQEFHAYVVKTKSYSKLVPVQSALIDMYCKCGDMISARQVFYGSKERNVVCWTALMAGYAVNGKLKQALRSTIWMQQEGFRPDVVTLATVLPVCAQLRALEQAKQIHAYALKHWFLPSVSVTSSLMTMYSKCGVFEYSRRLFDNMEQRNVISWTAMIDSYIENGYLCEALGVIRSMQLSKHRPDSVVPVKGSMTWTALIRAYGDLELYQDAVNLFDQMRYSPNHFTFEAILSICDSWIC

SEQ ID NO: 135677 - protein, 125 aa, Glycine max
  Coding DNA Sequence Number=SeqID_18899
  Homolog annotation: Hit_ID=Q9LIP0; Match level="QueryCoverage=76%, HitCoverage=85%, E-value=2e-18, Identity=53%"; Hit description =Arabidopsis thaliana genomic DNA, chromosome 3, BAC clone:F20C19
MNSVARRLSSLVRHSGFTPEPFNNGHHQMQQLQQCRGIRVKVMGGNLEAALGLMQRKMQSSGIERMIKQEQRFHIKNSEKRVLAQKNLERKIRSEDLAKKLKAIMIKKVSIDFDTDTPVWPMSQI

SEQ ID NO: 135678 - protein, 283 aa, Glycine max
  Coding DNA Sequence Number=SeqID_18900
MPKHYFRLYMTFVSTCTLQPDKILPYNKAYIDEEDEEEWSTQSDEEKGQKELKKTINNSNDILTKKRKKKSSHIDKANKEPSISSSSSHVINIKEMRKTLERRGQGLTKNDSVSVSIRETFIQFCSTKIICPQEHRAALAVKLYGVQAALLSALGNPFENLSQSISSRNSSQILSLSKASTGFLPAILWTGMFIVSFVYTLIVVWSLAFRVPIISMLCLSLLYCLSVLVAAASGFDVMCGTFRMSGILFASLGVLGFVMLLLVVVLLVLFASWRCPKQDGGAK

SEQ ID NO: 135679 - protein, 105 aa, Glycine max
  Coding DNA Sequence Number=SeqID_18901
MSVIPTQVQHKIPVEFNTQTSEDGGEGGETDIDWEGANDMVVLGDPIREEVAFWCGTSVTVSENEPETDNNDDERRGLESDLGMTTVAMTSMTTKVTMTTMATRD

SEQ ID NO: 135680 - protein, 293 aa, Glycine max
  Coding DNA Sequence Number=SeqID_18902
  Gene Ontology: Mol. function=zinc ion binding
  Homolog annotation: Hit_ID=Q5SMM0; Match level="QueryCoverage=93%, HitCoverage=40%, E-value=9e-42, Identity=51%"; Hit description=LIM domain containing protein-like
  Pfam annotation: Domain name=LIM; Domain location=205-262; Score =30.0; E_value=1.7e-06; Accession=PF00412.12; Description=LIM domain
  Pfam annotation: Domain name=UIM; Domain location=163-180; Score =11.8; E_value=0.73; Accession=PF02809.10; Description=Ubiquitin interaction motif
  Pfam annotation: Domain name=UIM; Domain location=42-59; Score=16.8; E_value=0.077; Accession=PF02809.10; Description=Ubiquitin interaction motif
  Pfam module annotation: Pfam domain module=LIM::UIM::UIM; Domain location=205-262::163-180::42-59
MGWFTKLLKGSDYKILRGQYHGKYGEDRIWDNHHSSMDDLTDIEKEDIDRAIALSLSEEDHKGKKVVESECVKQLIISTPNIAKRSHVFLSHNTLDYDSQSEDEELCKIDDEEDEHLVKVHLEEEERLAKIQQEEEERLAKIQQDERLAKIQQEDERLAKAQLEEDEQLARAIQESLKIGSPPRYDNDSSILSFPHLFPPGYRICAGCKTEIGQGRFLSCMGGVWHPECFCCHACHLPITDYEFSMSSNRPYHKACYREKHHPRCDVCKNFQPSRVGHGKHIIRKALVLGGSF

SEQ ID NO: 135681 - protein, 188 aa, Glycine max
  Coding DNA Sequence Number=SeqID_18903
  Gene Ontology: Mol. function=oxidoreductase activity; Cellular component=integral to membrane; Biological process=electron transport
  Homolog annotation: Hit_ID=Q2LAK2; Match level="QueryCoverage=56%, HitCoverage=30%, E-value=4e-53, Identity=88%"; Hit description =Cytochrome P450 monooxygenase CYP90A15
YTIPKGWRVVASFRAVHLNPDHYKDARTFNPWRWQSNSEASSPSNVYTPFGGGPRLCPGYELARVVLSVFLHRIVTRYSWFPAEEDKLVFFPTTRTQKRYPIIVKRREESRLRGYRKECLISRPWEGIGNEDVKDRTPYHPNKSVELNPPVYMILINSYKSFHVYHNKSMAKVCIKINEIGHEALVDP

SEQ ID NO: 135682 - protein, 192 aa, Glycine max
  Coding DNA Sequence Number=SeqID_18904
  Gene Ontology: Mol. function=catalytic activity
  Homolog annotation: Hit_ID=Q5VQE5; Match level="QueryCoverage=93%, HitCoverage=29%, E-value=1e-30, Identity=42%"; Hit description =Alpha/beta hydrolase-like
MGFSKEEKSKRVWRGVKVVFFLITMVISLLLFSAPVLLVIADALVPSALLSAFSPSSLFSHFDNYDFGYSLIDIPLLSMARSLVILCVYSFCDGQRLSHGPYLGVTMLCSVMSLMFVCLKAVYVFSLNTSVDERRGSGYDRSSQIALFVWSCALAVGHVVVAYRTSCRERRKLLVYKIDIEAVRVFSSHFTS

SEQ ID NO: 135683 - protein, 406 aa, Glycine max
  Coding DNA Sequence Number=SeqID_18905
  Gene Ontology: Mol. function=phosphoinositide phospholipase C activity; Biological process=intracellular signaling cascade
  Homolog annotation: Hit_ID=Q75IL8; Match level="QueryCoverage=42%, HitCoverage=30%, E-value=2e-37, Identity=53%"; Hit description =Putative phosphatidylinositol-specific phospholipase C
  Pfam annotation: Domain name=C2; Domain location=326-406; Score=31.4; E_value=3.2e-06; Accession=PF00168.20; Description=C2 domain
  Pfam annotation: Domain name=efhand_like; Domain location=38-131; Score=15.5; E_value=0.00038; Accession=PF09279.1; Description =Phosphoinositide-specific phospholipas
  Pfam module annotation: Pfam domain module=C2::efhand_like; Domain location=326-406::38-131
MGYNIATYNKYKSLLFFIRNCKFTKLLTPVTELLPPQDLMEAYSKFTGGGSYMSAKQLHRFLVEHQGAKDHTLTDLEKVVEKVLQVRKTCQEIINVDQNREQQITHDELFHFLLHDDFNGPLIAKDNKDCSTLNESESSEEESKGKESLNSSRKKVETEDTLNDSDRDEGNDKLKTDGELRRQSWSETTHEKASESHGTDIVRYLPSLTFKSSLNTYTRPRYLFHDLSDSSSYSSQVHTEKYPQGVSKGNAGQILKFEATYWVDVWGSDGCIQYADKPIKFTCNLQGMFRANGGCGYVKKPQILMQKHQCGNEFDPTWILTVKKTLKVKVYTGHGWSLDFSLSSTHFDNCSPPDFYTEKKTKVMMNDSFPVWDEEFEFSLTVPELALLLIQVKDKDPGKDDFSGQT

SEQ ID NO: 135684 - protein, 39 aa, Glycine max
  Coding DNA Sequence Number=SeqID_18906
MAVVEFECGCIYVAIDFVKQDTSLRASLRKTHIFNKDKT

SEQ ID NO: 135685 - protein, 121 aa, Glycine max
  Coding DNA Sequence Number=SeqID_18907
  Homolog annotation: Hit_ID=Q6UEI6; Match level="QueryCoverage=40%, HitCoverage=35%, E-value=2e-11, Identity=66%"; Hit description=Early flowering 4
  Pfam annotation: Domain name=DUF1313; Domain location=13-94; Score =34.4; E_value=4e-07; Accession=PF07011.2; Description=Protein of unknown function (DUF1313)
MDGDSSRRSSTAEDDGDPAVWEAFNESLSEVPSVLDRNRLLIEQVNENQHSRLRDNMVTNVSLIRSSAATSPRLSLSTPISPPPWNNNNTPRTPPPTPHVANHDTSRDFNGSASSVSIHNI

SEQ ID NO: 135686 - protein, 515 aa, Glycine max
  Coding DNA Sequence Number=SeqID_18908
  Gene Ontology: Mol. function=oxidoreductase activity; Cellular component=membrane; Biological process=electron transport
  Homolog annotation: Hit_ID=O81974; Match level="QueryCoverage=96%, HitCoverage=99%, E-value=0.0, Identity=89%"; Hit description =Cytochrome P450 71D8
  Pfam annotation: Domain name=p450; Domain location=34-494; Score =367.6; E_value=2e-107; Accession=PF00067.12; Description=Cytochrome P450
MEYSPLSIVITFFVFLLLHWLVKIYKQKSRYKLPPSPWRLPIIGNLHQLALAASLPDQALQKLVRKYGPLMHLQLGEISALVVSSPKMAMEVMKTHDVHFVQRPQLLAPQFMVYGATDIVFAPYGDYWRQIRKICTLELLSAKRVQSFSHIRQDENRKLIQSIHSSAGSSIDLSGKLFSLLGTTVSRAAFGKENDDQDELMSLVRKAITMTGGFELDDMFPSLKPLHLLTRQKAKVEHVHQRADKILEDILRKHMEKRTIGKEGSNEAEQEDLVDVLLRLKESGSLEVPMTMENIKAVIWNIFASGTDTPASTLEWAMSEMMKNPRVREKAQAELRQTFKGKEIIRETDLEELSYLKSVIKETLRLHPPSQLIPRECIKSTNIDGYDIPIKTKVMINTWAIGRDPQYWSDAERFIPERFDDSSIDFKGNSFEYIPFGAGRRMCPGITFGLASITLPLALLLYHFNWELPNKMKPADLDMDELFGLTVAKGDSIRVPMIFRIKKLQRIKEPKAQRN

SEQ ID NO: 135687 - protein, 1733 aa, Glycine max
  Coding DNA Sequence Number=SeqID_18909
  Gene Ontology: Mol. function=binding; Cellular component=clathrin vesicle coat; Biological process=intracellular protein transport
  Homolog annotation: Hit_ID=Q2RBN7; Match level="QueryCoverage=92%, HitCoverage=93%, E-value=0.0, Identity=87%"; Hit description =Clathrin heavy chain, putative, expressed
  Pfam annotation: Domain name=Clathrin; Domain location=1097-1238; Score=134.9; E_value=2.3e-37; Accession=PF00637.10; Description =Region in Clathrin and VPS
  Pfam annotation: Domain name=Clathrin; Domain location=1243-1389; Score=118.0; E_value=2.8e-32; Accession=PF00637.10; Description =Region in Clathrin and VPS
  Pfam annotation: Domain name=Clathrin; Domain location=1392-1551; Score=86.7; E_value=6.9e-23; Accession=PF00637.10; Description =Region in Clathrin and VPS
  Pfam annotation: Domain name=Clathrin; Domain location=506-648; Score= 70.2; E_value=6.6e-18; Accession=PF00637.10; Description=Region in Clathrin and VPS
  Pfam annotation: Domain name=Clathrin; Domain location=655-797; Score= 106.9; E_value=5.9e-29; Accession=PF00637.10; Description=Region in Clathrin and VPS
  Pfam annotation: Domain name=Clathrin; Domain location=802-941; Score= 127.7; E_value=3.3e-35; Accession=PF00637.10; Description=Region in Clathrin and VPS
  Pfam annotation: Domain name=Clathrin; Domain location=948-1093; Score=127.5; E_value=3.8e-35; Accession=PF00637.10; Description =Region in Clathrin and VPS
  Pfam annotation: Domain name=Clathrin-link; Domain location=288-311; Score=36.8; E_value=7.3e-08; Accession=PF09268.1; Description =Clathrin, heavy-chain linker
  Pfam annotation: Domain name=Clathrin_propel; Domain location=152 -192; Score=14.7; E_value=0.34; Accession=PF01394.10; Description =Clathrin propeller repeat
  Pfam annotation: Domain name=Clathrin_propel; Domain location=210 -245; Score=15.2; E_value=0.24; Accession=PF01394.10; Description =Clathrin propeller repeat
  Pfam annotation: Domain name=Clathrin_propel; Domain location=253 -287; Score=21.5; E_value=0.0031; Accession=PF01394.10; Description =Clathrin propeller repeat
  Pfam annotation: Domain name=Clathrin_propel; Domain location=4-44; Score=13.6; E_value=0.71; Accession=PF01394.10; Description=Clathrin propeller repeat
  Pfam annotation: Domain name=Clathrin_propel; Domain location=52-83; Score=16.3; E_value=0.11; Accession=PF01394.10; Description=Clathrin propeller repeat
  Pfam annotation: Domain name=Clathrin_propel; Domain location=98-141; Score=22.1; E_value=0.002; Accession=PF01394.10; Description=Clathrin propeller repeat
  Pfam module annotation: Pfam domain module=Clathrin::Clathrin::Clathri n::Clathrin::Clathrin::Clathrin::Clathrin::Clathrin-link::Clathrin _propel::Clathrin_propel::Clathrin_propel::Clathrin_propel::Clathrin _propel::...
  Pfam module annotation: Pfam domain module=Clathrin_propel; Domain location=1097-1238::1243-1389::1392-1551::506-648::655-797::802 -941::948-1093::288-311::152-192::210-245::253-287::4-44::52-83::98 -141
MPMQPLRRPITADSALMNPNTRILALKAHVPGSTQDHLQVFNIESKAKMKSYQMGQQVVFWKWITPKTLGIVTQSSVYHWSIEGDGEPVKVFDRTANLANNQIINYRCDPTEKWLVLIGIAPGSSDRPQLVKGNMQLFSVDQQRSQALEAHAASFATFRVAGNDKDSTLICFASKSINAGQVTSKMHAIELGAQPGKPSFSKKQADLFFPPDFADDFPVSMQISNKYGLIYVITKLGLLFVYDLETATAVYRNRISPDPIFLTTEASSEGGFYAINRRGQVLLATVNEATIVPFVSGQLNNLELAVSLAKRGNLPGAEELVVKRFQELFAQTKYKEAAELAAQSPQGVLRTPDTVAKFQSVPVQAGQTPPLLQYFGTLLTMGKLNAFESLELSRLVVNQNKKNLLENWLAEDKLECSEELGDLVKTVDNDLALKIYIKARATPKVVAAFAERREFDKILIYSKQSDAFFSFPLMKVGYTPDYMFLLQTILRTDPQGAVNFALMMSQMEGGCPIDYNTITDLFLQRNLIREATAFLLDVLKPNLPEHGYLQTKVLEINLVTFPNVADAILANGMFSHYDRPRIGQLCEKAGLFIRALQHYTELPDIKRVIVNTHAIEPQGLVEFFGTLSREWALECMKDLLLVNLRGNLQIIVQTAKEYSEQLGVDACIKLFEQFKSYEGLYFFLGAYLSSSEDPDIHFKYIEAAAKTGQIKEVERVTRESNFYDAEKTKNFLMEAKLPDARPLINVCDRFGFVPDLTHYLYTSNMLRYIEGYVQKVNPGNAPLVVGQLLDDECPEDFIKGLILSVRSLLPVEPLVEECEKRNRLRLLTQFLEHLVSEGSQDVHVHNALGKIIIDSNNNPEHFLTTNPYYDSRVVGKYCEKRDPTLAVVAYRRGQCDDELVNVTNKNSLFKLQARYVVERMDSDLWEKVLNPENEFRRLLIDQVVSTALPESKSPDQVSAAVKAFMTADLPHELIELLEKIVLQNSAFSGNFNLQNLLILTAVKADPSRVMDYINRLDNFDGPAVGEVAVEAQLYEEAFSIFKKFNLNVQAVNVLLDNLQTIDRAVEFAFRVEEDAVWSQVAKAQLREGLVSDAIESFIRADDSTHFLEVIKAAEDADVYHDLVKYLLMVRQNTKEPKVDSELIYAYAKIEHLGEIEEFILMPNVANLPNVGDRLYDEALYEAAKIIFAFISNWAKLAVTLVKLKQFQGAVDAARKANSSKTWKEVCFACVDAEEFRLAQICGLNVIIQVDDLEEVSEYYQNRGCFNELISLMESGLGLERAHMGIFTELGVLYARYRPEKLMEHIKLFSTRLNIPKLIRACDEQQHWKELTYLYIQYDEFDNAATTVMNHSPEAWDHMQFKDVIVKVASVELYYKAVHFYFKEHPDVINDMLNVIALRVDHTRVVDIMRKAGHLRLVKPYMVAVQSNNVSAVNEALNEIYVEEEDYDRLRESIDLHDNFDQIGLAQKIEKHELLEMRRVAAYIYKKAGRWKQSIALSKKDNLYKDCMETCSQSGDRELSEDLLIYFIEQGKKECFASCLFVCYDIIRPDVALELSWMNNMIDFAFPYLLQFIREYTGKVDELIKDKIEAQNEEKAKEKEEKEVLAQQNMYAQLLPLALPAPPMQGMGGGYAPSPPLPMGGMGMPPMPPFGDYLRVKEFDVVAPSISLLVCYYFPMIAVFFNESFPSHVDPFLVDYMTIQTGVTTIATSLAFGDVWMKKNWEGKNKRSRSRREI

SEQ ID NO: 135688 - protein, 373 aa, Glycine max
  Coding DNA Sequence Number=SeqID_18910
  Gene Ontology: Mol. function=oxidoreductase activity; Cellular component=integral to membrane; Biological process=electron transport
  Homolog annotation: Hit_ID=O81974; Match level="QueryCoverage=98%, HitCoverage=73%, E-value=1e-119, Identity=57%"; Hit description =Cytochrome P450 71D8
  Pfam annotation: Domain name=p450; Domain location=1-366; Score =154.4; E_value=3e-43; Accession=PF00067.12; Description=Cytochrome P450
MKKICVSELLSAKRVQSFSDIREDETAKFIESVRTSEGSPVNLTNKIYSLVSSAISRVAFGNKCKDQEEFVSLVKELVVVGAGFELDDLFPSMKLHLINGRKAKLEKMQEQVDKIVDNILKEHQEKRERARREGRVDLEEEDLVDVLLRIQQSDNLEIKITTTNIKAIILDVFTAGTDTSASTLEWAMAEMMRNPRVREKAQAEVRQAFRELKIINETDVEELIYLKLVIKETLRLHTPSPLLLPRECSKRTIIDGYEIPVKTKVMINAWAIARDPQYWTDAERFVPERFDGSSIDFKGNNFEYLPFGAGRRMCPGMTLGLANIMLPLALLLYHFNWELPNEMKPEYMDMVENFGLTVGRKNELCLIPVVNDL

SEQ ID NO: 135689 - protein, 631 aa, Glycine max
  Coding DNA Sequence Number=SeqID_18911
  Gene Ontology: Mol. function=transferase activity, transferring hexosyl groups; Cellular component=mitochondrion; Biological process= metabolic process
  Homolog annotation: Hit_ID=Q2R1F4; Match level="QueryCoverage=16%, HitCoverage=15%, E-value=2e-11, Identity=37%"; Hit description =Pentatricopeptide, putative, expressed
  Pfam annotation: Domain name=PPR; Domain location=221-255; Score =31.0; E_value=4.1e-06; Accession=PF01535.11; Description=PPR repeat
  Pfam annotation: Domain name=PPR; Domain location=256-290; Score =18.7; E_value=0.021; Accession=PF01535.11; Description=PPR repeat
  Pfam annotation: Domain name=PPR; Domain location=462-496; Score =28.6; E_value=2.1e-05; Accession=PF01535.11; Description=PPR repeat
  Pfam annotation: Domain name=PPR; Domain location=497-531; Score =16.5; E_value=0.083; Accession=PF01535.11; Description=PPR repeat
  Pfam annotation: Domain name=PPR; Domain location=532-566; Score =37.3; E_value=5.5e-08; Accession=PF01535.11; Description=PPR repeat
  Pfam module annotation: Pfam domain module=PPR::PPR::PPR::PPR::PPR; Domain location=221-255::256-290::462-496::497-531::532-566
MNCGLIPTLANCKNEERIGESENDERMGNAARHCGENDERVAKCGPQFFREANLLNGLTLQVQARSYARRREQFPTKVSHCLHRAKLIDYIRLTLRSNTPNSSLPSLINHRLLDSFVVSHALRSAPSADSALSLVHALEKSSHFSHTHHTLHALATVLVLAKSGRSSELKSLVDDIRANRFGSVQISFMNLMQWHAAARDLDTVLQVWEQYALENDHLCTESYSIVMTLYAQMGKDFEAVRVFHRMIDEGSLPNCRSYTVIIEHLVKSRKLSEALEAFNLLPSMRIKRTLKQYSVLLEGFVGSKQFDEQMKEEGVLEGKERLLRGILPDARVRSVSYSIDNGDEDEDENEKEGKDENISDACQCDHVDGIHLKPWMDPRALASALRNWSPDEKLHGVSSVGLAIKEDLLMTYTRMEGMRLPFSTIRLIIDFYGISKNADAALKVFNDDRILCGPISNVNLMLLYSSLLRTLTKCGRNSDALDMLDDMILNGICPDIQTFSGLMQYFSQLGDIKTVQKLFAMVRQSGLEPDAYLFKVLIQGYCKSERAALACRLFEDMKNSGLVPDSATKELLVKSLWKEGRRREAAAVEESYEEINTVLPLALQGHDHNSGRVSLHFSALSRIVMTAITVT

SEQ ID NO: 135690 - protein, 270 aa, Glycine max
  Coding DNA Sequence Number=SeqID_18912
  Homolog annotation: Hit_ID=O80618; Match level="QueryCoverage=85%, HitCoverage=83%, E-value=2e-34, Identity=38%"; Hit description =Predicted by genefinder and genscan
  Pfam annotation: Domain name=mTERF; Domain location=9-267; Score =43.9; E_value=5.5e-11; Accession=PF02536.5; Description=mTERF
  Subcellular localization annotation: CTP_CleavageSite=43; ConfidenceScore=5.23e-01
MLLSYSLHLPITSSYSHTSNRSPNSSGYIKFRTRYRENLRYLRALTIIDPKTKPEDLPLPNDVDHIIDTLTFLKSHSFSDADIPRLKFLTPELFTTAVVPSDVSAVFRFLADDLAATKSESRDLILRCPKLLFSHVDLCLRPTLQFLRQGLNRPTTRNAHLLNTRVDKLHAKVEFLQELGFSYEEAVRACARLPAIFGYDVENNLWPKFVYLVKEMERDLEDLKRFPQYFGFSLKERIVPRHLHLKKRGVRIPLNRMLMWADQKFYAKWK

SEQ ID NO: 135691 - protein, 131 aa, Glycine max
  Coding DNA Sequence Number=SeqID_18913
MEAERGGAPNYELQVSFTNTPQALHEMGFVQYEENQVLGFLSPSSQSQSSHLSQSLNSDTGVVAVTATTPTATIGFMSHSGLVTKTWNNDQVGTLDPKPVEDENCTGNGSDQGNNNTWYIPLPTSISFHYL

SEQ ID NO: 135692 - protein, 52 aa, Glycine max
  Coding DNA Sequence Number=SeqID_18914
MSIWPRITPAILSGHEFHGGTINDYVHMTAQHNDALHGVYAFFLIDRTGSLR

SEQ ID NO: 135693 - protein, 41 aa, Glycine max
  Coding DNA Sequence Number=SeqID_18915
MKVLISSHSSNAWKSYQSKSEKTLEESQEIARDAAIVVRIH

SEQ ID NO: 135694 - protein, 87 aa, Glycine max
  Coding DNA Sequence Number=SeqID_18916
  Gene Ontology: Mol. function=sequence-specific DNA binding; Cellular component=nucleus; Biological process=regulation of transcription, DNA-dependent
  Homolog annotation: Hit_ID=Q93WY4; Match level="QueryCoverage=61%, HitCoverage=26%, E-value=2e-21, Identity=85%"; Hit description =Probable WRKY transcription factor 12
  Pfam annotation: Domain name=WRKY; Domain location=33-76; Score=13.5; E_value=1.6e-05; Accession=PF03106.6; Description=WRKY DNA -binding domain
WRSAATEKNKVKIRRKLREPRFCFQTRSDVDVLDDGYKWRKYGQKVVKNSLHPRKCVVEYTGNITGIIPGGNEGKMSFLGKSYVGSE

SEQ ID NO: 135695 - protein, 253 aa, Glycine max
  Coding DNA Sequence Number=SeqID_18917
  Gene Ontology: Cellular component=intrinsic to vacuolar membrane; Biological process=vacuole fusion, non-autophagic
  Homolog annotation: Hit_ID=Q1RYZ1; Match level="QueryCoverage=95%, HitCoverage=91%, E-value=2e-77, Identity=62%"; Hit description=SPX, N-terminal
  Pfam annotation: Domain name=SPX; Domain location=1-152; Score=78.6; E_value=1.9e-20; Accession=PF03105.10; Description=SPX domain
MKFEKILKRLIEQTLPDWRDKFLCYKILKKQLNVMCPEDGQAPPQLDANELNHFLTLLQLEIDKFNNFFIDKEEEYVIKWRELQDRVVEAVNSNVDLMSLGTETVDFHGEMVLLENYSALNYTGMLCLVKIIKKHDKKTGALLRSPFIQAVVKQPFYEIDALNKLVKECEVILSILFNNGPSSSISQDFMQNGFGSMSDKENKETVMQVPEELSEIKNMKNMYIELTLTALHTLEQIRGRSSTLSMFPSSPHN

SEQ ID NO: 135696 - protein, 95 aa, Glycine max
  Coding DNA Sequence Number=SeqID_18918
  Subcellular localization annotation: CTP_CleavageSite=4; ConfidenceScore=5.28e-01
MLPTASKGRSSSSSSSSRPNNPMLLPYLRRIIKIYFSHHSKIQFVLLSLPFILYLFSLMNFFGVLDMELYNGCSYQHTKYHKLIGSAMFTELLSY

SEQ ID NO: 135697 - protein, 152 aa, Glycine max
  Coding DNA Sequence Number=SeqID_18919
MAHPVSLWAHPEVRREHPGLAEEYPELHKPRCRLCSIGSVTSELRHYAGTDDGGAEGDGVEVEVEGVGAEVEAGGVGAEEDGPSDPRARALRVPGNTIVGSSRFQQFFFMYAKLMTGLKDSKVRESEITHRATQSAGMRVGKPSLEELDWAI

SEQ ID NO: 135698 - protein, 113 aa, Glycine max
  Coding DNA Sequence Number=SeqID_18920
MINCEGCRKALWFKENLPQLWGRLWGDNKCGEKMKNKKVVMAGVSLSEACALSENHPLSEALSLLSESGEYVKHLRAQRVINSLSESFVFSRAKRAQLTQRKITNSLLVQKCR

SEQ ID NO: 135699 - protein, 121 aa, Glycine max
  Coding DNA Sequence Number=SeqID_18921
  Homolog annotation: Hit_ID=Q9FF46; Match level="QueryCoverage=84%, HitCoverage=9%, E-value=3e-27, Identity=60%"; Hit description =Putative white-brown complex homolog protein 29
MPPNSSSLYEQSSSALKSQNKEPTNLTKILNSLEDDPHSNEGFNLQIGDKNIKKQMPKGKNLHTQSQSLRYTYGQIEKEKVQQEKNKNLTFSGVISMATKGDVRTRPMIEVAFKDLTPTFK

SEQ ID NO: 135700 - protein, 36 aa, Glycine max
  Coding DNA Sequence Number=SeqID_18922
MEYYRIKFAKSVSYYPTESSKADMLIPNSPSNVILE

SEQ ID NO: 135701 - protein, 132 aa, Glycine max
  Coding DNA Sequence Number=SeqID_18923
  Homolog annotation: Hit_ID=O81004; Match level="QueryCoverage=48%, HitCoverage=23%, E-value=2e-09, Identity=46%"; Hit description=GTP -binding protein At2g22870
MGAHTFFLNTRIHEIKPSFKIKCFLPVFGAIPGAGATLDELDVLDSGITDVGSDGDVGAGKGRGVIELVGRCLNGKEGGERRRERRDTAGFGEEISGGRRRERWGFWRHCLNKLRATLQVYLFQEFLPIAYA

SEQ ID NO: 135702 - protein, 59 aa, Glycine max
  Coding DNA Sequence Number=SeqID_18924
MSYIIWRWKGPQRIGVFFWKAVKRGSDEKFSAVWFWFRNNYTPSTGLCHFYSSLDALDW

SEQ ID NO: 135703 - protein, 167 aa, Glycine max
  Coding DNA Sequence Number=SeqID_18925
  Gene Ontology: Mol. function=heat shock protein binding; Cellular component=nucleus; Biological process=protein folding
  Homolog annotation: Hit_ID=Q8L8S5; Match level="QueryCoverage=86%, HitCoverage=45%, E-value=6e-69, Identity=84%"; Hit description =Putative heat shock protein
  Pfam annotation: Domain name=DnaJ_C; Domain location=43-165; Score =46.8; E_value=7.6e-11; Accession=PF01556.9; Description=DnaJ C terminal region
MVLISWKFSFMSLTSMCQKIEGRPTTVEEILTIEIKPGWKKGTKITFPEKGNEQRGVIPSDLVFIIDEKPHGVFKRDGNDLVITQKISLVEALTGYTAQLTTLDGRNLTVSTNSIISPTYEEVIKGEGMPIPKEPSKKGNLRIKFNIKFPSRLTSEQKTGIKRLLTS

SEQ ID NO: 135704 - protein, 143 aa, Glycine max
  Coding DNA Sequence Number=SeqID_18926
MAVAADVAEIAECEEDEKREAAGNRSTAITGDNNLWHLPFSNNLDFTISPGFFTQSLFSLFSHDLALVSFYLNLALNSLKMAEHGKRPKFCHIKQPLHLMVPPWQASLHKLPMTVGNKSTTPFRHGGYSTTLLKTIISPQILH

SEQ ID NO: 135705 - protein, 511 aa, Glycine max
  Coding DNA Sequence Number=SeqID_18927
  Gene Ontology: Mol. function=citrate transporter activity; Cellular component=integral to membrane; Biological process=citrate transport
  Homolog annotation: Hit_ID=Q9LT68; Match level="QueryCoverage=99%, HitCoverage=86%, E-value=0.0, Identity=67%"; Hit description =Similarity to Na+/H+ antiporter
  Pfam annotation: Domain name=CitMHS; Domain location=67-446; Score= -84.3; E_value=0.00036; Accession=PF03600.6; Description=Citrate transporter
NLTPESGSCDPLCSLDETSSQEFEDSYQPKTDFLKAVAILATAATGAVAINHSWVATNQDLAMALLFVIGYAGIIFEESLAFNKSGVGLLMAVSLWVIRSIGAPSTDIAVSELTHASAEVSEIVFFLLGAMTIVEIVDAHQGFKLVTDNITTRNPRLLLWVFSSRQPDIHHSYGFSVAEIGASIRVPKYSPTILRFGYTLSNPQVVDLDSVDRILGAVVVIAANAGGAWTPIGDVTTTMLWIHGQISTVQTVKDLFVPSAVSLAVPLALMSLTSEVNGKGQNSPNVLASEQIAPRGQLVFSVGLGALIFVPVFKALTGLPPYMGMLLGLGVLWILTDAIHYGESERQKLKVPQALSRIDTQGVLFFLGILLSVSSLEAAGILREIANYLDAHVPSSELIASTIGLISAVIDNVPLVAATMGMYDVTSFPQDSEFWQLIAFCAGTGGSMLIIGSAAGVAFMGMEKVDFFWYLRKISGFAFAGYAAGIVAYLALHKLNISLPTLAEVPFLSGS

SEQ ID NO: 135706 - protein, 305 aa, Glycine max
  Coding DNA Sequence Number=SeqID_18928
  Gene Ontology: Mol. function=carboxylic ester hydrolase activity; Cellular component=lysosome; Biological process=lipid catabolic process
  Homolog annotation: Hit_ID=Q71DJ5; Match level="QueryCoverage=80%, HitCoverage=60%, E-value=3e-75, Identity=55%"; Hit description =Triacylglycerol lipase 1 precursor
  Pfam annotation: Domain name=Abhydro_lipase; Domain location=50-120; Score=11.1; E_value=0.00019; Accession=PF04083.6; Description=ab -hydrolase associated lipase region
  Subcellular localization annotation: CTP_CleavageSite=19; ConfidenceScore=5.03e-01
MGEDGEAGLTGLILPSLPSSARFQKNSSLGMMMMMMIAITVSILLGNVQSFDGGSLCEELIIPSGYPCSEYTIQTKDGFLLGLQRVSSSSSLRLRNHGDGGPPGSESSLIPAGDAWFLNTPEQSLGFILADHGFDVWVGNVRGTRWSHGHISLLEKKKQFWDWSWQELALYDVAEMINYINSVTNSKIFVVGHSQGTIISLAAFTQPEIVEKVEAAALLSPISYLDHVSAPLVLRMVKMHIDEMILTMGIHQLNFKSEWGASLLVSLCDTRLSCNDMLSSITATTKLPVMCANARNLGFKTCLSL

SEQ ID NO: 135707 - protein, 71 aa, Glycine max
  Coding DNA Sequence Number=SeqID_18929
MEEERMTKERSGYGGDDALSTEASGFSEYGGAHTLSAGLTLSAPLGFFVGLFTLSLSWSLSEAMRCACLVR

SEQ ID NO: 135708 - protein, 633 aa, Glycine max
  Coding DNA Sequence Number=SeqID_18930
  Gene Ontology: Mol. function=protein kinase activity; Cellular component=extracellular region; Biological process=protein amino acid phosphorylation
  Homolog annotation: Hit_ID=Q2R2M3; Match level="QueryCoverage=93%, HitCoverage=91%, E-value=1e-111, Identity=37%"; Hit description =Protein kinase domain containing protein, expressed
  Pfam annotation: Domain name=LysM; Domain location=123-167; Score =9.5; E_value=0.057; Accession=PF01476.10; Description=LysM domain
  Pfam annotation: Domain name=LysM; Domain location=188-232; Score =26.3; E_value=0.00011; Accession=PF01476.10; Description=LysM domain
  Pfam annotation: Domain name=Pkinase; Domain location=355-614; Score =84.9; E_value=2.5e-22; Accession=PF00069.15; Description=Protein kinase domain
  Pfam annotation: Domain name=Pkinase_Tyr; Domain location=356-614; Score=43.7; E_value=3.8e-15; Accession=PF07714.7; Description =Protein tyrosine kinase
  Pfam module annotation: Pfam domain module=LysM::LysM::Pkinase::Pkinas e_Tyr; Domain location=123-167::188-232::355-614::356-614
MDLFPFIPIIIFTLLIHNFSLILGQQPYIGLGTVACPRRGNKNSIRGYTCNGANHSCQSYLTFRSQPIYNSVKTISTLLGSDPSQLAKINSVSMNDTFETNKLVIVPVNCSCAGEYYQTNTSYEFHNSETYFLIANNTFEGLTTCQALENQNHNPANIYPGRRLLVPLRCACPTKNQTEKGIRYLLSYLVNWGDSVSFISEKFGVNFMTTLEANTLTLTQATIYPFTTILVPLHDKPSSSQTVSPTRRTPPPSPPSSDHSSNKTWVYVVVGVVVGAIALISVLCAVIFFTRYRKNRKKDDSVVVGSKSFEAIEEKPEVKVNEKLSEIISGIAQSFKVYNFEELQRATDNFSPSSWIKGSVYRGVINGDLAAIKRIEGDVSKEIEILNKINHSNVIRLSGVSFHEGGWYLVYEYAANGDLSEWIYFHNVNGKFLSWTQRMQIALDVATGLDYLHSFTSPPHIHKDINSSNILLDGDFRGKVTNLSLARCLEGGDDQLPATRHIVGTRGYMAPEYLENGLVSTKLDVYAFGVLMLEMVTGKEVAAILTEDETKLSHVLSGILGEESGKEMLKEFVDPSLGENCPLELAMFVIEMIDNCIKTDPASRPSVHEIVQSMSRTLKSSLSWERSMNVPRN

SEQ ID NO: 135709 - protein, 409 aa, Glycine max
  Coding DNA Sequence Number=SeqID_18931
  Homolog annotation: Hit_ID=Q1S569; Match level="QueryCoverage=96%, HitCoverage=99%, E-value=1e-113, Identity=56%"; Hit description =Cystinosin/ERS1p repeat
  Pfam annotation: Domain name=PQ-loop; Domain location=259-347; Score =25.9; E_value=3.6e-05; Accession=PF04193.5; Description=PQ loop repeat
  Pfam annotation: Domain name=PQ-loop; Domain location=29-95; Score =90.7; E_value=4.5e-24; Accession=PF04193.5; Description=PQ loop repeat
  Pfam module annotation: Pfam domain module=PQ-loop::PQ-loop; Domain location=259-347::29-95
MPESYCVKESKPCVGWVEKYLDDCLCNLKDKISFGFGFISLVCWGVAEIPQIITNFRAKSSHGVSLAFLLTWVAGDIFNLLGCHLEPATLYTITTIVLVLQSFYYDYIYKWGKPLRKINIDEAHEEEEKKPLRQKPGRDSGIPIQNDGPKETPRRDYYYRSARSLAANDTPPFGTYLRAAKSVPSAMEMNNDSSSDDEAPPLSSTKPVTQPRPIPRSVPASYGTFLAASMNLPRQGNALMEGYKRFNGRKLLSQEHNMHSALGQWLGWLMAVIYMGGRLPQIWLNLCILFFCALITDKVVDYVIIGQIKRGSVEGLNPLMFIFALIANATYVGSILVRTIEWESIRANMPWLLDAIVCVALDLFDYKVGKPQQWQIILQYANYRYVRKKTGSDDADYGDYKEASKTFVS

SEQ ID NO: 135710 - protein, 273 aa, Glycine max
  Coding DNA Sequence Number=SeqID_18932
  Homolog annotation: Hit_ID=Q9FJV7; Match level="QueryCoverage=52%, HitCoverage=48%, E-value=5e-33, Identity=48%"; Hit description =Arabidopsis thaliana genomic DNA, chromosome 5, P1 clone:MFO20
  Pfam annotation: Domain name=DUF607; Domain location=84-260; Score =192.2; E_value=1.3e-54; Accession=PF04678.4; Description=Protein of unknown function, DUF607
MRKRHASRREKGGQVSGKRQGRNRRAHEGASRGKRLGGGAYGKTPATRPFYGSWPFAGLLLTCSFLRYPLILWITVLPPLSELIPLAAAERPSAASHWHDRFPDWKAGSERNAINVAKAIQGLLPVPGAKAHESVRREFEVMEKKKSAIDKKADTMVRRELWGGLGFMMVQTMAFMRLTFWELSWDVMEPICFYLTSMYCMAGYTFFLRTSKEPSFEGFYQVRFSSKQKHLMKLHNFDIEKYNQLRAACSPTTMPPKFDPSIALPFDNSSIHQ

SEQ ID NO: 135711 - protein, 333 aa, Glycine max
  Coding DNA Sequence Number=SeqID_18933
  Gene Ontology: Mol. function=lyase activity; Cellular component =anchored to membrane; Biological process=cell wall modification
  Homolog annotation: Hit_ID=Q1SGJ9; Match level="QueryCoverage=89%, HitCoverage=86%, E-value=1e-140, Identity=75%"; Hit description =Pectolytic enzyme, Pectin lyase fold
  Pfam annotation: Domain name=Pec_lyase_C; Domain location=84-250; Score=194.3; E_value=2.8e-55; Accession=PF00544.9; Description =Pectate lyase
MNVIDRCWRLNPEWRRHRPQLATCSVGYTGKMTNNIGDDLIHYKVIDPSDDPINPKFGTLRYGASVIQGKVWITFQRDMHIKLERPLLISSFTTIDGRGVNVHIADNACIMIFKATNIIIHGIRVHHCKPQAPGIVMGPEGKIWIDHNTLYNCQDGLLDVTRGSTDVTISNNWFRDQDKVMLLGHDDGYVRDQNMKITVVYNHFGPNCNQRMPRIRHGYAHVANNLYLGWVQYAIGGSMGPSLKSEANLFIAPTTGSKEVTWRKNSHKNGDIWEFHSVRDAFENGASFAVTKGGRVPKPNYSKEQCFKVVNVNSVRSLTSSSGVLQCTKTSIC

SEQ ID NO: 135712 - protein, 270 aa, Glycine max
  Coding DNA Sequence Number=SeqID_18934
  Gene Ontology: Mol. function=transferase activity, transferring hexosyl groups; Biological process=carbohydrate biosynthetic process
  Homolog annotation: Hit_ID=Q1S568; Match level="QueryCoverage=91%, HitCoverage=86%, E-value=6e-93, Identity=70%"; Hit description =Glycosyl transferase, family 8
MQEADRARMQVSAKPAEVIPAEAVLVPPVIHGDYVSRENEQKRRQRSEFVDPHSLLELHPLLDLGGIVPGTPALQVNDHDAGVEVAGGAAGEGEGEGGVGPEGWGEVGAEVGVAVFGGGEDGVVVVSEGGGGEFCDVVDENEVGVQVDDFEDAGGEEVGEVVAGVVEGAVQGGADGGGDEAGDGGGVVEGVDLEFEVGEGGGEGAVEEGGGGGGDEVEDDVFGAGGMLEDGEDGGHGAAEVGYVQGHGHVDCLVGTRVALVAMAKGASKF

SEQ ID NO: 135713 - protein, 173 aa, Glycine max
  Coding DNA Sequence Number=SeqID_18935
MNDYDLVLIDLFLHIDLSLSYKIQEGANILRAVWKIPAPSKSLGFSWSVIRPKKQFLTCSSLVPSLIQFEQGYIGGRVSSDILVYMATQECSHTFKEVELCQASFKASFYDWLNQPVLCLNAGRDEEVSNGYVGLGGGGALWLLGLEVGCSDVGFMARVVKVREGVLSADYHA

SEQ ID NO: 135714 - protein, 53 aa, Glycine max
  Coding DNA Sequence Number=SeqID_18936
  Homolog annotation: Hit_ID=Q9FJE9; Match level="QueryCoverage=98%, HitCoverage=50%, E-value=2e-07, Identity=50%"; Hit description =Similarity to RNA binding protein
  Pfam annotation: Domain name=RRM_1; Domain location=1-52; Score=7.4; E_value=0.029; Accession=PF00076.12; Description=RNA recognition motif. (a.k.a. RRM, R
LSFNTTQQQLKKLFSPFRLVTQALDPITKRPKGFSFVSFKSEIEAEKAFKAIN

SEQ ID NO: 135715 - protein, 381 aa, Glycine max
  Coding DNA Sequence Number=SeqID_18937
  Homolog annotation: Hit_ID=Q10QE9; Match level="QueryCoverage=91%, HitCoverage=92%, E-value=7e-84, Identity=45%"; Hit description =Expressed protein
  Pfam annotation: Domain name=DUF677; Domain location=43-374; Score =507.8; E_value=1.3e-149; Accession=PF05055.3; Description=Protein of unknown function (DUF677)
MGGQSSKIPSNSGVPTPIKMGTHSLYAADLNSYEAACVEDPNLQSLDATIQERTNRVITSLANGIEVRSISIESLGEMTGSLLEMNQDVAKVILECQQDIWNKKDRELFSLVEDFFENSLQTLNFCNALDKCLNRARGRHVIVKSAITCFEEEVQNGVEGSTYLKTLQELKGFKEAGDPFTEEFYSLFQSVYQQQASMLKKLKIRKQKLDKKLKSFKTLKRVSNAIFVAAFVSVLIFSVVAAAIAAPPVVTALAGALAVPIGSVGKWCNSLFKRYETALKGQRELISSMQVGSYITLVDLKNIRLRIDQLEIKIESMLQSSDFALRNEDAVKFAIDEIKKNIDIFAETIEALSKQADECSRQIRMARTVVVKKIINYTNTS

SEQ ID NO: 135716 - protein, 54 aa, Glycine max
  Coding DNA Sequence Number=SeqID_18938
MKRSKRAREGVELDNPKQNCSRDRAFVFSERTREGGDMQWPKSLLWAELHKLKA

SEQ ID NO: 135717 - protein, 126 aa, Glycine max
  Coding DNA Sequence Number=SeqID_18939
MGSSENTIVQYGQRNLHKSSEGEAINQTLDALMNMKLELSAYKYMKCIIQIDHKEISTNTPVNYGGVERKEIDSEKVMTKMKCIFIKKTTEECCFAFSFTELIWHCMSENSLNMEAKEDFFSSKGL

SEQ ID NO: 135718 - protein, 174 aa, Glycine max
  Coding DNA Sequence Number=SeqID_18940
  Homolog annotation: Hit_ID=Q6ZA97; Match level="QueryCoverage=36%, HitCoverage=42%, E-value=1e-14, Identity=52%"; Hit description =Putative transmembrane protein
  Pfam annotation: Domain name=UPF0016; Domain location=31-114; Score= -9.0; E_value=0.01; Accession=PF01169.9; Description=Uncharacterized protein family UPF0016
MDRDVEELAEVEAKLDKDWKASNGATKNSNKAFSITCFGEWGDKSQLATIGLAADKNPFGVVLGNFETSNAQFKHILVLSINYQRLDVVDDLMANLEIMPHIAQHLHRLLFEVAVDNDFPNYQSTCLVHMDAEEVLGEDELLLDLDLLTMLDLNLELVEEDDNIVVITKSGFLS

SEQ ID NO: 135719 - protein, 71 aa, Glycine max
  Coding DNA Sequence Number=SeqID_18941
  Gene Ontology: Mol. function=protein disulfide oxidoreductase activity; Biological process=cell redox homeostasis
  Homolog annotation: Hit_ID=Q1RSD5; Match level="QueryCoverage=97%, HitCoverage=53%, E-value=3e-12, Identity=62%"; Hit description =Glutaredoxin active site
MLLAIYQQYWHLLILRPFDFFLTERINLHNFVRNSKPQIGRERHRSEEPLAVGAPWGGLPDRPEPQRCQGT

SEQ ID NO: 135720 - protein, 163 aa, Glycine max
  Coding DNA Sequence Number=SeqID_18942
MQNSGVTLRAESQHFASVHEDNPRVASIPYFGFIEEIWELNYDLHWWILRNSLTRMILSLGQNKQSRWSVVLHGKTIGVNVEDADSYIDTYVSPLSTQISPNVVGEEEVDDQMATPPNSPPPPPLPPTSATSHSPSTLKWTRKATCLRSLANRPVGAERPLHH

SEQ ID NO: 135721 - protein, 249 aa, Glycine max
  Coding DNA Sequence Number=SeqID_18943
  Gene Ontology: Mol. function=small conjugating protein ligase activity; Cellular component=cellular_component; Biological process =protein modification process
  Homolog annotation: Hit_ID=Q9SDY5; Match level="QueryCoverage=69%, HitCoverage=95%, E-value=5e-86, Identity=86%"; Hit description=NEDD8- conjugating enzyme Ubc12
  Pfam annotation: Domain name=UQ_con; Domain location=33-169; Score =191.5; E_value=2e-54; Accession=PF00179.16; Description=Ubiquitin -conjugating enzyme
MIKLFKVKEKQRELAENASGGPPVKKQSAGELRLHKDISELNLPKSCTMQFPNGKDDLMNFEVSIRPDDGYYLGGTFLFSFQVSPIYPHEAPKVKCKTKVYHPNIDLEGNVCLNILREDWKPVLNINTVIYGLYHLFTEPNYEDPLNHDAAAVLRENPKMFESNVRRAMAGGYVIFLGGETGQVLKTTKLQKAKQVEYDLATKQYEPGLNILIFLIHSATDAISRNGSEARVSSILGNKQPSHDGTMNV

SEQ ID NO: 135722 - protein, 81 aa, Glycine max
  Coding DNA Sequence Number=SeqID_18944
  Subcellular localization annotation: CTP_CleavageSite=36; ConfidenceScore=5.07e-01
MGHAQFRYSNAQVKKRLSHEVLKRTFTAKCSFSTLSATEESGRASISRLHAKCKISALSAAVIFSQAQHTIGAKLESTYSR

SEQ ID NO: 135723 - protein, 347 aa, Glycine max
  Coding DNA Sequence Number=SeqID_18945
  Gene Ontology: Mol. function=transcription regulator activity; Cellular component=transcription factor complex; Biological process =regulation of transcription, DNA-dependent
  Homolog annotation: Hit_ID=Q8W0W3; Match level="QueryCoverage=97%, HitCoverage=98%, E-value=2e-42, Identity=33%"; Hit description =Transcription initiation factor IIB
  Pfam annotation: Domain name=TFIIB; Domain location=143-215; Score =49.4; E_value=1.2e-11; Accession=PF00382.10; Description =Transcription factor TFIIB repeat
  Pfam annotation: Domain name=TFIIB; Domain location=245-316; Score =8.9; E_value=0.0018; Accession=PF00382.10; Description=Transcription factor TFIIB repeat
  Pfam annotation: Domain name=TFIIB_Zn_Ribbon; Domain location=6-49; Score=38.8; E_value=1.8e-08; Accession=PF08271.2; Description=TFIIB zinc-binding
  Pfam module annotation: Pfam domain module=TFIIB::TFIIB::TFIIB_Zn _Ribbon; Domain location=143-215::245-316::6-49
MTADEEYCSDCKSYTPLVYDHKAGDSICSECGLVLESRSIEEEIPKLRLYGDKLEDDDDGGGDHEDEDEHQEQVFSVSDPFNPLLLTSGADLTTLVTHPSLYDNNNSDMVKTCKNQRGIKNSNRAAKRKLKRDCDLVAALLTMEQMANNLGLARSIQNHAKELYKKAEDRRVFRGRRRHSRASMVACLYLVCQEEGFPMTLKEIQSVSGEAKEKNKHINKAIGVFKKHFQVGRNYDKTQALDLGERLCTDLGLGNHVIKAVREVLQKALELIERSRPSSVMAATIYMVDQLSSDNMMHFRDIKEVAKACRLKEYTIKKAYRDLHALAFVLIPSWYANAEDIKRLCNI

SEQ ID NO: 135724 - protein, 150 aa, Glycine max
  Coding DNA Sequence Number=SeqID_18946
  Gene Ontology: Mol. function=DNA binding; Biological process=DNA integration
  Homolog annotation: Hit_ID=Q1SKN1; Match level="QueryCoverage=98%, HitCoverage=24%, E-value=4e-19, Identity=56%"; Hit description =Integrase, catalytic region
MDMADICIVLPLASINNWHLHQFDVSNVYLHGELSKEVYMVIPPDTHDYKPYQCCKLLKSLYDLKQASLSIKIEVLTLLLSSSEYRALASTTYELQWLIYLLADLQVSWHCLVVLYCGNQSALHIAVNPFFRESTKHLDISYHIVREKAQ

SEQ ID NO: 135725 - protein, 875 aa, Glycine max
  Coding DNA Sequence Number=SeqID_18947
  Gene Ontology: Mol. function=X-Pro aminopeptidase activity; Cellular component=exocyst; Biological process=creatine metabolic process
  Homolog annotation: Hit_ID=Q93X45; Match level="QueryCoverage=76%, HitCoverage=99%, E-value=0.0, Identity=69%"; Hit description=Xaa-Pro aminopeptidase 2
  Pfam annotation: Domain name=Peptidase_M24; Domain location=406-629; Score=-21.3; E_value=1.6e-06; Accession=PF00557.14; Description =metallopeptidase family M24
DRCDSKLSEETEKTEENKMEDTVSALRSLMVSHSPPLDALVVPSEDYHLSEYVSARDKRREFVSGFTGSAAFISLGFKLPPVSAFSCNCFNISRAEKELSAGWKLMRIGEDPAVDIWMADVSNLLNLPKEASVGVDPWCISIDTAQRWERAFAEKQQKLVPTSKNLVDEVWINRPPAEINAVIVHPVKFAGRSVADKLKDLRKKLVHEQTRGIIFTALDEVAWLYNIRGSDVAYCPVVHAFAIVTSNSAFIYVDKQKVSVEVQTHLVENGIEIQEYTAVSSDATLLATDELDAVSTAKAALAETEARKIPSEIDKSVNGEHQAEENSNDLIWADPVSCCYALYAKLNPDTVLLQQSPLALAKALKNSVELDGLKKAHIRDGAAVVQYLVWLDKKDIYGASGYFLEKDSVKKEKHLQSLKLTEVTVSDQLEGFRASKEHFKGLSFPTISSVGSNAAIIHYFPKAETCAELDPDKIYLFDSGAQYLDGTTDITRTVHFGKPSTHEKACYTAGFILSLLDLLNFVQVLKGHIALGNARFPNGTNGHSLDILARIPLWKDGLDYRHGTGHGIGSYLNVHEGPHLISFRPQARNVPLQSSMTVTDEPGYYEDGEFGIRLENVLIVKEADTTFNFGDRGYLSFEHITWAPYQTKLIDLNLLSPEEINWLNSYHATCRNILAPYLDEVENAWLKKATEPVAWFSTNSVPYTSTPLKQKYHATGVCNGLIYLNPIKTREDSTTCSVRFYNPATSDTYKVVAIRNLKSKRELRVRCLGDNCWKNVASWSGFPRILGNKGRFVSNTLNWIAELSTTNQYAVFSFDLRKETYRYLSLPVDVDVDVAFDVPNIGDYMGCLCLSHNFKGAHLAVWQMKEFGFKNLGLC

SEQ ID NO: 135726 - protein, 492 aa, Glycine max
  Coding DNA Sequence Number=SeqID_18948
  Gene Ontology: Mol. function=transferase activity, transferring glycosyl groups; Cellular component=integral to membrane; Biological process=lignin metabolic process
  Homolog annotation: Hit_ID=Q9LVR1; Match level="QueryCoverage=95%, HitCoverage=98%, E-value=1e-113, Identity=45%"; Hit description=UTP -glucose glucosyltransferase
  Pfam annotation: Domain name=UDPGT; Domain location=7-469; Score= -57.4; E_value=9.9e-08; Accession=PF00201.9; Description=UDP -glucoronosyl and UDP-glucosyl transferase
MVTSKPHAALIASPGMGHLIPMVELGKRLLTHHSFHVTIFVVTTDSAITTSHILQQTSNLNIVLVPPIDVSHKLPPNPPLAARILLTMLDSIPFVHSSILSTKLPPPSALIVDMFGFAAFPMARDLGMLIYVYFATSAWFSAVTVYVPAMDKKMIESHAENHEPLVILGCEAVRFDDTLEPFLSPIGEMYQGYLTAAKEIVTADGILMNTWQDLEPAATKAVREDGILGRFTKAEVYSVGPLVRTVEKKPEAAVLSWLDGQPAESVVYVSFGSGGTMSEVQMREVALGLELSQQRFVWVVRPPCEGDASGSFFEVSNGGDVALNYLPEGFVKRTEAVGVVVPMWAPQAEILGHPATGGFVTHCGWNSVLESVLNGVPMVAWPLYAEQKMNAFMLSEELGVAVRVAEEGGVVRREQVAELVRRVMVDEEGFGMRKKVKELKVSGEKALSKVGSSHHWLCQMSKDCEAHVQGSEAKVSSAYTTTTAVLSDVVRS

SEQ ID NO: 135727 - protein, 64 aa, Glycine max
  Coding DNA Sequence Number=SeqID_18949
  Subcellular localization annotation: CTP_CleavageSite=40; ConfidenceScore=5.60e-01
MALVQPFASLSISFRDARVFTAPKCSPTTHFPHRNLVPTRASFIAGSPLCKTSSSCAVVTPYHI

SEQ ID NO: 135728 - protein, 310 aa, Glycine max
  Coding DNA Sequence Number=SeqID_18950
  Gene Ontology: Mol. function=protein phosphatase type 2C activity; Cellular component=protein serine/threonine phosphatase complex; Biological process=protein amino acid dephosphorylation
  Homolog annotation: Hit_ID=Q2QN36; Match level="QueryCoverage=93%, HitCoverage=73%, E-value=1e-108, Identity=70%"; Hit description =Protein phosphatase 2C family protein, putative, expressed
  Pfam annotation: Domain name=PP2C; Domain location=1-240; Score=56.1; E_value=1.1e-13; Accession=PF00481.12; Description=Protein phosphatase 2C
MPTVVVFSVILPQIEAHEFATEQGGLSVDVIKKAFSATEEEFLHLVKLSLPISPQIASVGSCCLFGAISNNVLYVANLGDSRAVLGRRDTVRKNSPVVAQRLSTDHNVADEEVRKEVEALHPDDSHIVVYNRGVWRIKGIIQVSRSIGDVYLKKPDFYRDPVFQQFGNPIPLKRPVMTAEPSIIIRELESQDLFLIFASDGLWEQLSDEAAVQIVFKHPRAGIAKRLVRAALHEAAKKREMRYDDIKKIDKGIRRHFHDDITVVVIYLDHHAGSSNGRFKQTGVDYTTAPVDIFSLNADEAEKRMLGTVA

SEQ ID NO: 135729 - protein, 60 aa, Glycine max
  Coding DNA Sequence Number=SeqID_18951
MAVRNGLTCLYRSEDSFLLFNKCRMFFERKKMAVRNGPNAKEVFQDGGEENVNPQGKGFP

SEQ ID NO: 135730 - protein, 98 aa, Glycine max
  Coding DNA Sequence Number=SeqID_18952
  Gene Ontology: Mol. function=protein binding
  Homolog annotation: Hit_ID=Q8LDD9; Match level="QueryCoverage=92%, HitCoverage=32%, E-value=2e-17, Identity=41%"; Hit description =Putative leucine-rich repeat disease resistance protein
MEEGIVPEKELDRRVKVWRLESEEIEEGIGPNKLFSARSSVVRPQMKEVRRGSEHGSVVKFHEARHDHCVMEEGLIEALKALSAAMSEGEVRAWTRML

SEQ ID NO: 135731 - protein, 170 aa, Glycine max
  Coding DNA Sequence Number=SeqID_18953
EIHAGKSYSMENYQWEQELQPYNQYEEERSSNLDNLLMQFKETIESTQRAFKSLEIQVGKLAKEVTKFVATREENFVEVEAYEESLVEEHDSREKDEEKSEEKAQQWDECSQEERHGEYEKALSVILSLIAITSLAMIWKVFLEYMSFMESLAKRQKCKEDVFYVTFMPP

SEQ ID NO: 135732 - protein, 83 aa, Glycine max
  Coding DNA Sequence Number=SeqID_18954
  Gene Ontology: Mol. function=hydrolase activity
  Homolog annotation: Hit_ID=Q6YX89; Match level="QueryCoverage=65%, HitCoverage=20%, E-value=1e-17, Identity=72%"; Hit description =Cyclase-like protein
MFKKEFDTSYVGFKEDGAKWLAENTDIKLVGVDYLSVAAYDHSIPSHLVFLESKDEPAIRSNVAPNTISGVHKKQFDANCKLS

SEQ ID NO: 135733 - protein, 160 aa, Glycine max
  Coding DNA Sequence Number=SeqID_18955
MGQKLDPRELDNTAAQVHVHLHHQAIYQPCPINIKIKSVRGRRKVKVVKYTPCLSECSEVCVHVLKACQIFLSFSKDDWGVEEVIDRLCIKPDDLPPHPISIVNLLLLEFGEYPAALPPLELSVKFTEHPCGELYVPLRSEARGIPGGFPSLCRNCSAFS

SEQ ID NO: 135734 - protein, 50 aa, Glycine max
  Coding DNA Sequence Number=SeqID_18956
MWVELHDLQAIVLGVTLACHKIPKSLSDEPDMLAAWQPSFTDLGHKPCWG

SEQ ID NO: 135735 - protein, 275 aa, Glycine max
  Coding DNA Sequence Number=SeqID_18957
  Pfam annotation: Domain name=Transposase_23; Domain location=106-174; Score=-14.8; E_value=0.047; Accession=PF03017.5; Description =TNP1ENSPM transposase
MTSEPAKEIANKIASQDSFVAHGRQDVLTVVIGRQNTLVVDQLEESITEKVTRQLMLSFNQMQYQFQSRMQSQELALPSEPKVGPSAARVNTKESCVDPLGNDPDTGDSKKCRLYVKENPPHLVALGRLYKGSTIVHNMPLRQDQVKVGVEEVRDEDVFIPIPTKQVMWDATMFGVFNDNFPLYIKYEDLSEIAQMGNVVIWFCSLHNRPDNYLKGIINSALKELNHTPQSKSKAAARWIIVKCNRQKGSTEYGYYVMHWMSAIILGSFKNNWET

SEQ ID NO: 135736 - protein, 79 aa, Glycine max
  Coding DNA Sequence Number=SeqID_18958
MAPDTADEFLTHFLLAFRTCKIYQIHTSPGTEMDAKKCKFGIMLSVAVVKCGGYSLCRGNNESEDETVIVSGRRGVDRD

SEQ ID NO: 135737 - protein, 87 aa, Glycine max
  Coding DNA Sequence Number=SeqID_18959
  Homolog annotation: Hit_ID=Q6NLY8; Match level="QueryCoverage=71%, HitCoverage=31%, E-value=2e-18, Identity=63%"; Hit description=HVA22- like protein k
  Pfam annotation: Domain name=TB2_DP1_HVA22; Domain location=14-81; Score=-25.2; E_value=0.0091; Accession=PF03134.9; Description=TB2DP1, HVA22 family
MALLGSNITSEVGLRLLLCPLGSNVVIRTACCTVGVAMPVYTTFKAIESKDQDAQHRCLLYWAVVYPALFFGEKLPGVTTLPMSGEV

SEQ ID NO: 135738 - protein, 98 aa, Glycine max
  Coding DNA Sequence Number=SeqID_18960
  Gene Ontology: Mol. function=catalytic activity; Biological process =metabolic process
MKVSEISFLNSQLSPHADDSLLQEISSKLAKCRSVADVGGHVELHPPVRGIAVAAYHTAEGSLFTINDVVIKIKIDLCIFSNNFIVILTHCEIFPNNN

SEQ ID NO: 135739 - protein, 120 aa, Glycine max
  Coding DNA Sequence Number=SeqID_18961
  Gene Ontology: Mol. function=sequence-specific DNA binding; Cellular component=nucleus; Biological process=regulation of transcription, DNA-dependent
  Homolog annotation: Hit_ID=Q9ZPM1; Match level="QueryCoverage=59%, HitCoverage=35%, E-value=1e-14, Identity=58%"; Hit description =Putative MADS box transcription factor ETL
  Pfam annotation: Domain name=K-box; Domain location=2-85; Score=16.7; E_value=1.7e-05; Accession=PF01486.8; Description=K-box region
MQHLKEGDMSMAKKIEHLEDSRRKLLGDELDKCSIDELQQLENQLERSLDKIRARKEKCLLEVNKRLREQYRIDRQRCLTDNVTEKEAEEVETELFIGRPERRMPLKLKSATHSAHKYIA

SEQ ID NO: 135740 - protein, 49 aa, Glycine max
  Coding DNA Sequence Number=SeqID_18962
MCATKGFEVVPDFDRQNVCDLEVQRARPLGKESSGCASFRERGGCLQPP

SEQ ID NO: 135741 - protein, 100 aa, Glycine max
  Coding DNA Sequence Number=SeqID_18963
  Homolog annotation: Hit_ID=Q4JFW8; Match level="QueryCoverage=99%, HitCoverage=36%, E-value=1e-28, Identity=69%"; Hit description =Senescence-inducible chloroplast stay-green protein 1
  Subcellular localization annotation: CTP_CleavageSite=52; ConfidenceScore=5.54e-01
MATLATVFLPSKLKPSHSGNQVSPFTHKTPLWKKVNQPLVPVARLFGPAIFEASKLKVLFLGVDQKKHPSYLPRTYTLTHCDITSKITLSISQTINNSQI

SEQ ID NO: 135742 - protein, 398 aa, Glycine max
  Coding DNA Sequence Number=SeqID_18964
  Gene Ontology: Mol. function=aminoacyl-tRNA ligase activity; Cellular component=extracellular space; Biological process=tRNA aminoacylation for protein translation
  Homolog annotation: Hit_ID=P93363; Match level="QueryCoverage=99%, HitCoverage=92%, E-value=1e-170, Identity=73%"; Hit description =Tyrosyl-tRNA synthetase
  Pfam annotation: Domain name=tRNA-synt_1b; Domain location=54-351; Score=247.4; E_value=2.9e-71; Accession=PF00579.15; Description=tRNA synthetases class I (W and Y)
MEQPPTEAVESLSVSDPQIPQSSNPSPTHLEISHSVRSVGEECIQEDELLNLLTKKPEPVCYDGFEPSGRMHIAQGVMKTINVNKLTSAGCIVKIWIADWFAKLNNKMGGDLKKIETVGRYLIEIWKAVGMDLESGKVEFLWSSKEINARADEYWPLVLDIAQKNNLKRIIRCSQIMGRSEQDELTAAQIFYPCMQCADIFFLKADICQLGMDQRKVNVLAREYCDDIKRKNKPIILSHHMLPGLQQGQEKMSKSDPSSSIFMEDEEAEVNVKIKKAYCPPKTVEGNPCLEYIKYLVLPWFNEFTVERSADNGGNKTFTSFAELTAAYESGELHPGDLKPALAKSLNKILEVTISDYVLCGTSSTIVSWTLQPVREHFRKDSNAKELLKRVKAYRVTK

SEQ ID NO: 135743 - protein, 517 aa, Glycine max
  Coding DNA Sequence Number=SeqID_18965
  Gene Ontology: Mol. function=nucleic acid binding; Cellular component= intracellular; Biological process=regulation of transcription
  Homolog annotation: Hit_ID=Q9LVQ7; Match level="QueryCoverage=99%, HitCoverage=100%, E-value=1e-84, Identity=60%"; Hit description=Zinc finger protein
  Pfam annotation: Domain name=RS4NT; Domain location=122-159; Score =15.6; E_value=0.028; Accession=PF08071.2; Description=RS4NT (NUC023) domain
  Pfam annotation: Domain name=zf-C2H2; Domain location=137-159; Score =19.5; E_value=0.012; Accession=PF00096.16; Description=Zinc finger, C2H2 type
  Pfam annotation: Domain name=zf-C2H2; Domain location=164-185; Score =16.0; E_value=0.14; Accession=PF00096.16; Description=Zinc finger, C2H2 type
  Pfam annotation: Domain name=zf-C2H2; Domain location=61-83; Score =26.4; E_value=0.0001; Accession=PF00096.16; Description=Zinc finger, C2H2 type
  Pfam module annotation: Pfam domain module=RS4NT::zf-C2H2::zf -C2H2::zf-C2H2; Domain location=122-159::137-159::164-185::61-83
  Subcellular localization annotation: CTP_CleavageSite=56; ConfidenceScore=5.25e-01
MPVDLDNVSTASGEASVSSSGNLTVPPKPTTKKKRNLPGMPDPDAEVIALSPKTLMATNRFVCEICNKGFQRDQNLQLHRRGHNLPWKLRQRSSKEVRKRVYVCPEPTCVHHDPSRALGDLTGIKKHFCRKHGEKKWKCDKCSKKYAVQSDWKAHSKICGTREYKCDCGTLFSRRDSFITHRAFCDALAEESARSQPQTVAKASSESDSKAVTGDSSPPVAVEAPPPLVPPVSSQSNSVVVPSSSLQTQKPELPENSPQIIEEPKVNTAMNGSCSSTSTSTTSSTSNSNSGASSSVFASLFASSSASATASLHSQTPAFTDLIRAMGHPDHPADLSRPSSSEPISLCLATNHGSSIFGTGRQERRQYAPPPQPAMSATALLQKAAQMGAAATNASFLRGLGIVSSSASTSSVQQDNLQWGHQPVEPESASVPAGLGLGLPCDSSSGLKELMMGTPSMFGPKQTTLDFLGLGMAAGGTPGGGLSALITSIGGGLDVTTAAASFASGEFPGKDIGRRST

SEQ ID NO: 135744 - protein, 614 aa, Glycine max
  Coding DNA Sequence Number=SeqID_18966
  Gene Ontology: Mol. function=nutrient reservoir activity; Cellular component=extraorganismal space; Biological process=defense response to bacterium
  Homolog annotation: Hit_ID=Q8W3X8; Match level="QueryCoverage=60%, HitCoverage=57%, E-value=1e-106, Identity=50%"; Hit description =PreproMP73
  Pfam annotation: Domain name=Cupin_1; Domain location=239-394; Score =114.2; E_value=3.8e-31; Accession=PF00190.13; Description=Cupin
  Pfam annotation: Domain name=DUF1682; Domain location=172-483; Score=- 159.9; E_value=0.068; Accession=PF07946.4; Description=Protein of unknown function (DUF1682)
  Pfam module annotation: Pfam domain module=Cupin_1::DUF1682; Domain location=239-394::172-483
MEPRKASPLSWVLIFFLSISLSGVKVLSEEQHHAKSQEGPVVERDQRRTLLVTEFGEITAIDIKEGQKELPYHLRFITLEPNSLFLPVLLHADMVFYVHTGSGKLTWANDDGTSTIRLREGDVCSLKEGSVFYIQSNLEAERRKLRIYAMFTNTDDNTYDPSIGAYSRINELVKGFDTKIMQAALKVPEDLIEAIINKTETPAIVHAVPEKRNILQELEASFLKNFLGIGSNSKKLKTYNIFDHDPDFKNPNGWSTAVTKKQLKSLKRTNIGFLMVNLAMGSILGPHWNPKATELVVGVDGGGMVRVVCGSSNEDETECQNMRFKVKEGDAFLVPRFHPMAQMSFNDGPFVFLGFSTSAKKNHPQFLAGKGSVLHILDKRILATSFGVSNRTIDQLLRSPEDSIIFGCSSCAEEEEKIMKDEEENRKREEEEKEKKKEEEEEKRKREEEEERKREEEEDEKKRRREEEEEEKKKEEEEEKRKREEEEAKRQQEEREKKREEEEARREKEREREEEAEREQEQAKREAEAAAQREQEQAKREQERRERRRQEEEDEEEPTRWERRGRREKGKSPEGVEWEQEEARRQQAESDRQVEEQSHRNSFEGRRALKIRNV

SEQ ID NO: 135745 - protein, 473 aa, Glycine max
  Coding DNA Sequence Number=SeqID_18967
  Gene Ontology: Mol. function=RNA binding
  Homolog annotation: Hit_ID=Q8RYR6; Match level="QueryCoverage=48%, HitCoverage=67%, E-value=3e-72, Identity=58%"; Hit description =Fertility restorer-like protein
  Pfam annotation: Domain name=PPR; Domain location=303-337; Score =21.6; E_value=0.0029; Accession=PF01535.11; Description=PPR repeat
  Pfam annotation: Domain name=PPR; Domain location=338-372; Score =37.9; E_value=3.5e-08; Accession=PF01535.11; Description=PPR repeat
  Pfam annotation: Domain name=PPR; Domain location=373-407; Score =36.1; E_value=1.2e-07; Accession=PF01535.11; Description=PPR repeat
  Pfam annotation: Domain name=PPR; Domain location=408-442; Score =14.3; E_value=0.15; Accession=PF01535.11; Description=PPR repeat
  Pfam module annotation: Pfam domain module=PPR::PPR::PPR::PPR; Domain location=303-337::338-372::373-407::408-442
MLGPGPVVHRQGLPSPSRCVRVLCRVAFSTLDFVTLTHHSPLTTHQYTSSEVVDFESGFDLILALVAESCMVNTKQMVHMAASRGGVHKLVSSSRIEKLVSLLYSKQYLPPWLETVRHFSFTDDRSGRSKQPVGESDDFFREQSDSSFKDNGSNRTQESYNVEQSLSEPIPSRPLRGKKPINQPPPRFREYDRGSHSFPPRFDDNHGGPDELDKINKSSQIDLAFQGTTNVAETNRDVGKSGGSFLDKFKLGFDDKTVNLSEVAASKQSEEAKRSNPNQPAQESMPQDANEIFKKMKETGLIPNAVAMLDGLCKDGLVQEALKLFGLIREKGTIPEIVIYTAVVEGYTKAHKADDAKRIFRKMQSSGISPNAFSYTVLIQGLYKCNRLHDAFEFCVEMLEAGHSPNVTAFVGLVDGFCNEKGVEEAKSAIKTLTEKGFVVNEKAVGQFLDKKAPFSPSVWEAIFGKKAPQRPF

SEQ ID NO: 135746 - protein, 694 aa, Glycine max
  Coding DNA Sequence Number=SeqID_18968
  Gene Ontology: Mol. function=binding; Cellular component =intracellular; Biological process=metabolic process
  Homolog annotation: Hit_ID=Q9FLZ9; Match level="QueryCoverage=91%, HitCoverage=94%, E-value=0.0, Identity=53%"; Hit description =Selenium-binding protein-like
  Pfam annotation: Domain name=PPR; Domain location=180-214; Score =45.4; E_value=1.9e-10; Accession=PF01535.11; Description=PPR repeat
  Pfam annotation: Domain name=PPR; Domain location=281-315; Score =42.0; E_value=2e-09; Accession=PF01535.11; Description=PPR repeat
  Pfam annotation: Domain name=PPR; Domain location=382-416; Score =37.5; E_value=4.6e-08; Accession=PF01535.11; Description=PPR repeat
  Pfam annotation: Domain name=PPR; Domain location=417-451; Score=8.2; E_value=0.79; Accession=PF01535.11; Description=PPR repeat
  Pfam annotation: Domain name=PPR; Domain location=485-519; Score =45.5; E_value=1.8e-10; Accession=PF01535.11; Description=PPR repeat
  Pfam annotation: Domain name=PPR; Domain location=520-554; Score =23.4; E_value=0.00081; Accession=PF01535.11; Description=PPR repeat
  Pfam annotation: Domain name=PPR; Domain location=556-590; Score=8.9; E_value=0.66; Accession=PF01535.11; Description=PPR repeat
  Pfam annotation: Domain name=PPR; Domain location=78-112; Score=30.9; E_value=4.5e-06; Accession=PF01535.11; Description=PPR repeat
  Pfam module annotation: Pfam domain module=PPR::PPR::PPR::PPR::PPR::PP R::PPR::PPR; Domain location=180-214::281-315::382-416::417-451::485 -519::520-554::556-590::78-112
MKKGMMFATTAAQCESLLGKFSASQSHSETKRLHALILTLGIFSSSNLCSKLATTYAQCHHASYASHLFDKLSQPCLFSWNAMMRMYVQIGRPFDALNLFVEMLGSGRTLPDKFTYPVVIKACGDLSLIDVGVGIHGQTFKFGYDSDTFVQNTLLAMYMNAGEKEAAQLVFDPMQERTVISWNTMINGYFRNNCAEDAVNVYGRMMDVGVEPDCATVVSVLPACGLLKNVELGREVHTLVQEKGFWGNIVVRNALVDMYVKCGQMKEAWLLAKGMDDKDVVTWTTLINGYILNGDARSALMLCGMMQCEGVKPNSVSIASLLSACGSLVYLNHGKCLHAWAIRQKIESEVIVETALINMYAKCNCGNLSYKVFMGTSKKRTAPWNALLSGFIQNRLAREAIELFKQMLVKDVQPDHATFNSLLPAYAILADLQQAMNIHCYLIRSGFLYRLEVASILVDIYSKCGSLGYAHQIFNIISLKDKDIIIWSAIIAAYGKHGHGKMAVKLFNQMVQSGVKPNHVTFTSVLHACSHAGLVNEGFSLFNFMLKQHQIISHVDHYTCMIDLLGRAGRLNDAYNLIRTMPITPNHAVWGALLGACVIHENVELGEVAARWTFKLEPENTGNYVLLAKLYAAVGRWGDAERVRDMVNEQDDNDDILTMRERQSRTRSVPPILIDLYFMQSLVSYVEHNDFTYW

SEQ ID NO: 135747 - protein, 367 aa, Glycine max
  Coding DNA Sequence Number=SeqID_18969
  Gene Ontology: Mol. function=phosphoric monoester hydrolase activity; Cellular component=cytoplasm; Biological process=dephosphorylation
  Homolog annotation: Hit_ID=Q8GZT8; Match level="QueryCoverage=92%, HitCoverage=56%, E-value=1e-142, Identity=71%"; Hit description=PTEN- like protein
  Subcellular localization annotation: CTP_CleavageSite=76; ConfidenceScore=5.06e-01
MDSVPADVSNSHTINDPSKSPPAKETDRQASASVASGQDNSPHEASPRLSPTGISSWAKNLKISQPFSGSQDDSSSGNVGKSTFARITSNFGLRLSPKSPVEDDSSSETAGQSNLFGTITKGLVDSSKNAVKAVQEGGFDLDMTYITENIIAMGFPAGDMSSGFFGYVEGFYRNHMEEVIKFFETHHKKATRSASEDKYKVYNLCSERLYDASLFEGKVASFPFDDHNCPPIQLIISFCQSAYSWLKEDIENVVVVHCKAGMARTGLMISSLLVFLKFFPTAEESMDYYNQKRCVDGKGLVLPSQIRYVKYFERVLTYFNGENPPARRCMLRGFRLHRCPYWIRPSITVSDHSGMFAIKISLTAYTT

SEQ ID NO: 135748 - protein, 272 aa, Glycine max
  Coding DNA Sequence Number=SeqID_18970
  Gene Ontology: Mol. function=actin binding; Cellular component =cytoskeleton; Biological process=sensory perception of sound
  Homolog annotation: Hit_ID=Q9ZU34; Match level="QueryCoverage=89%, HitCoverage=42%, E-value=2e-95, Identity=65%"; Hit description =Putative stress protein
  Pfam annotation: Domain name=WD40; Domain location=10-49; Score=20.6; E_value=0.0055; Accession=PF00400.22; Description=WD domain, G-beta repeat
  Pfam annotation: Domain name=WD40; Domain location=190-229; Score =4.5; E_value=11; Accession=PF00400.22; Description=WD domain, G-beta repeat
  Pfam annotation: Domain name=WD40; Domain location=53-91; Score=25.9; E_value=0.00014; Accession=PF00400.22; Description=WD domain, G-beta repeat
  Pfam annotation: Domain name=WD40; Domain location=98-136; Score =39.1; E_value=1.6e-08; Accession=PF00400.22; Description=WD domain, G-beta repeat
  Pfam module annotation: Pfam domain module=WD40::WD40::WD40::WD40; Domain location=10-49::190-229::53-91::98-136
MAQFIMWDSGSTVGDFDGHSHRVLSCAFKTTRPFRIVTCGEDFLANFYDGPPFKFNMSIRDHTNFVNCVRFSPDGSKFITVSSGRKGTIYDGKTGNKLGELSMEDGHKGSIYAVSWSPDSKQVLTVSADKSAKVWDIVEDGSSGTVNKTLTCTESGGVEDMLVGRLWQNDYLLTICLGGTTYLYSAKDLDKSPLSLSGHMKNITVLTMLNRSEKMLLSSSYDGVGKQFGLIKLLVAGQDEVIAAGFDNKIHLMFIHSFIANTEAPRLLRNYS

SEQ ID NO: 135749 - protein, 575 aa, Glycine max
  Coding DNA Sequence Number=SeqID_18971
  Gene Ontology: Mol. function=oxidoreductase activity; Cellular component=viral capsid; Biological process=lignin catabolic process
  Homolog annotation: Hit_ID=Q9C9A4; Match level="QueryCoverage=95%, HitCoverage=94%, E-value=0.0, Identity=66%"; Hit description=Spore coat protein-like protein; 24980-21957
  Pfam annotation: Domain name=Cu-oxidase; Domain location=240-370; Score=-11.0; E_value=0.0015; Accession=PF00394.12; Description =Multicopper oxidase
  Pfam annotation: Domain name=Cu-oxidase_2; Domain location=419-574; Score=14.5; E_value=2.3e-05; Accession=PF07731.4; Description =Multicopper oxidase
  Pfam annotation: Domain name=Cu-oxidase_3; Domain location=74-215; Score=-6.8; E_value=4.7e-05; Accession=PF07732.5; Description =Multicopper oxidase
  Pfam module annotation: Pfam domain module=Cu-oxidase::Cu-oxidase _2::Cu-oxidase_3; Domain location=240-370::419-574::74-215
MGKRTLLLKLLTLVSLLGCSSASDHLVNVSKLEMFVDELPHMPRILGYHLSDGVPRSKSFKIGMFKKKWKFHKDLPPTTVYAFGTSKHTATVPGPTIEALYGVDTHVRWQNHLPPKHILPWDPTIPTAMTNSTRGIPTVVHLHGGIHAPESDGNANAWFTSKFNQRGPTWTKKTYHYPNNQQPGNLWYHDHAMGLTRVNLLAGLLGAYIIRHPEIEDPLGLPSGDEFDRTLIVFDRSFRTDGSIFMSSIGNNPKIHPQWQPEYFGDAIIVNGKAWPRLTVRRRKYRFRIINASNARFFRFFFSNGLRFTHVASDSAYIEKPVTANETLVGPSEITDIVVDFSRSKSDVAILANDAKYPYPSGDPVNEANGKVIKFIIIPDHDQQLHTSRLPKRFLEYPLLDLSSVTHTRYVAMYEYASDIDEPTHLYLNAKPYEAPATENPKVGSTELWYVINLTEDNHPLHIHLGLFKVLDQTELVKPHDEFTECMTKINDAVKCHVDKYARGKKIEVPAHEKGWKNVFKMMPGHVTKVAVRFSYIHTNASYAFDATTEPGYVYHCHVLDHEDNAMMRPLKIIK

SEQ ID NO: 135750 - protein, 100 aa, Glycine max
  Coding DNA Sequence Number=SeqID_18972
  Homolog annotation: Hit_ID=Q9SEL1; Match level="QueryCoverage=78%, HitCoverage=19%, E-value=4e-13, Identity=56%"; Hit description=Seed maturation protein PM23
MGRGSENEEGGTGFSARERERKGGAKERRVRVRVAMEKRKRGGEDGGKGCHTNEEDNHQHHFSFPSLSVTLSRSHNKAVISLWVIKIRGNETCQNNTRLR

SEQ ID NO: 135751 - protein, 468 aa, Glycine max
  Coding DNA Sequence Number=SeqID_18973
  Gene Ontology: Mol. function=RNA binding; Cellular component =intracellular
  Homolog annotation: Hit_ID=Q1T629; Match level="QueryCoverage=46%, HitCoverage=65%, E-value=5e-29, Identity=37%"; Hit description =Pumilio/Puf RNA-binding
  Pfam annotation: Domain name=PUF; Domain location=258-292; Score =16.1; E_value=0.051; Accession=PF00806.9; Description=Pumilio-family RNA binding repeat
  Pfam annotation: Domain name=PUF; Domain location=294-329; Score =19.1; E_value=0.016; Accession=PF00806.9; Description=Pumilio-family RNA binding repeat
  Pfam annotation: Domain name=PUF; Domain location=336-370; Score=1.0; E_value=5.5; Accession=PF00806.9; Description=Pumilio-family RNA binding repeat
  Pfam annotation: Domain name=PUF; Domain location=372-407; Score=3.8; E_value=2.3; Accession=PF00806.9; Description=Pumilio-family RNA binding repeat
  Pfam annotation: Domain name=PUF; Domain location=427-462; Score =17.3; E_value=0.035; Accession=PF00806.9; Description=Pumilio-family RNA binding repeat
  Pfam module annotation: Pfam domain module=PUF::PUF::PUF::PUF::PUF; Domain location=258-292::294-329::336-370::372-407::427-462
MDHKPNPWAPICFWKSPLGVLCSALMALDEDFNPFPFMQQKKPQNPTQETTSSFPLPSRNPQFSGFDLLNIHDMNMSHPYGFNDHGLHGMRLIGAQNPTVNETFLPLPSRNMQHSGLGWFNHIGETGTSSGVQGFDMNLSNPYDFYDYGTNNKHEASLHNMGIIGATGQDLQNPTFVGTSVPSYSRNLQGSGFGCLNYGQRSAYGVQSLLPRMEALNLSNPYGFNDYDTDLMYEAALHHIRVNGAADYATLPHHNLETHSGHSVSVAKDPRGSRLLQKKINEGTPQEICKILKELKYHLHELINHPFGHFVIQKLFQSSNISVAQKNALVYLIIVDLQKLKNVCMDDQGNRVIQQILANVKEPSMIHKIAVIMRSISLALMKNFNGGYVIQQCLKLFPPNKYASNVVEELLRYSGADNVAVIARELMKSPEFLNLVQHPYGNYVVQRAVKYTEDAINDHKRLNEADIT

SEQ ID NO: 135752 - protein, 674 aa, Glycine max
  Coding DNA Sequence Number=SeqID_18974
  Gene Ontology: Mol. function=protein binding
  Homolog annotation: Hit_ID=Q5CTC1; Match level="QueryCoverage=25%, HitCoverage=39%, E-value=2e-23, Identity=38%"; Hit description=2x WD domain containing protein
  Pfam annotation: Domain name=WD40; Domain location=359-397; Score =15.5; E_value=0.19; Accession=PF00400.22; Description=WD domain, G -beta repeat
  Pfam annotation: Domain name=WD40; Domain location=400-448; Score =1.0; E_value=28; Accession=PF00400.22; Description=WD domain, G-beta repeat
  Pfam annotation: Domain name=WD40; Domain location=452-492; Score =30.5; E_value=6e-06; Accession=PF00400.22; Description=WD domain, G -beta repeat
  Pfam annotation: Domain name=WD40; Domain location=535-593; Score =0.5; E_value=32; Accession=PF00400.22; Description=WD domain, G-beta repeat
  Pfam module annotation: Pfam domain module=WD40::WD40::WD40::WD40; Domain location=359-397::400-448::452-492::535-593
MGEFMHIHTLNLDFSSSLTSFQEDCFNCMPNLMRLSMCDTRITNLWTTVAALSKLPSLIELRFQYWQYCNDAVTSFISSSGKSDDTADFSLLDSVPFIGEPYTYTTELTDPNFNAEDPLRNFYSFDEEVINHDVQSMVEDSSDDSEVDFTSRHHKYWLSDVFPGWSSEVPLQNENEDGEESLQAAFTDSNADVSMKYMSRHASPICYEKHYREFMIASLPNLKNLDNMPIRKIDKERATGIFSQYFEYLPYKWKHKESVVSILQKREIKSVHNKVQSSKHRLSYPSGKSQYFYSRSLSAAKLGSSTWPILHPLSFVGCELDKGFHPRQFEYHPSDSSLMVFGTLDGEVVVINHETEHILSYIPSLGAMNSVLGLCWLKKYPSKLIAGSDNGSLKLYDIYHIPRKVTGLHGNFGCVTFDEFDQLTSVHVNSMDELFLASGYSRNVALYDINSGKRLQVFTDMHRGHINVVKFANHSPSIFATSSFDHDVKMWDLRQKPIHPCFTVSSSRGNVMVCFSPDDQYILASAVDNEVACLSLCKILSQDHIVVVQTDMLHLVFDIAPTDSSQNYTRSYYMNGRDYIISGSCDEHIRICCAQTGRRLRDISLEGRNLGSSVFVQSLRGDPFRDFNMSVLAAYMRPGSKSKIVKINLLASSDHANKDDSDDLRPCPFHSMGG

SEQ ID NO: 135753 - protein, 634 aa, Glycine max
  Coding DNA Sequence Number=SeqID_18975
  Gene Ontology: Mol. function=binding; Cellular component =intracellular; Biological process=metabolic process
  Homolog annotation: Hit_ID=Q1SNX8; Match level="QueryCoverage=90%, HitCoverage=83%, E-value=9e-96, Identity=36%"; Hit description =Pentatricopeptide repeat
  Pfam annotation: Domain name=PPR; Domain location=199-233; Score =29.7; E_value=1e-05; Accession=PF01535.11; Description=PPR repeat
  Pfam annotation: Domain name=PPR; Domain location=309-343; Score =31.6; E_value=2.8e-06; Accession=PF01535.11; Description=PPR repeat
  Pfam annotation: Domain name=PPR; Domain location=345-379; Score=1.9; E_value=4.5; Accession=PF01535.11; Description=PPR repeat
  Pfam annotation: Domain name=PPR; Domain location=415-449; Score =34.6; E_value=3.4e-07; Accession=PF01535.11; Description=PPR repeat
  Pfam annotation: Domain name=PPR; Domain location=550-584; Score=7.7; E_value=0.91; Accession=PF01535.11; Description=PPR repeat
  Pfam annotation: Domain name=PPR; Domain location=96-130; Score=26.2; E_value=0.00011; Accession=PF01535.11; Description=PPR repeat
  Pfam module annotation: Pfam domain module=PPR::PPR::PPR::PPR::PPR::PP R; Domain location=199-233::309-343::345-379::415-449::550-584::96-130
MLSLSHQIVFPTTQRLKFKPIVALLHSPSSCSIADPTNLATLLQGNIPRSHLLQIHARIFYLGAHQDNLIATRLIGHYPSRAALRVFHHLQNPNIFPFNAIIRVLAQDGHFFHALSVFNYLKRRSLSPNDLTFSFLFKPCFRTKDVRYVEQIHAHIQKIGFLSDPFVCNGLVSVYAKGFNSLVSARKVFDEIPDKMLVSCWTNLITGFAQSGHSEEVLQLFQVMVRQNLLPQSDTMVSVLSACSSLEMPKIEKWVNVFLELVGDGVSTRETCHDSVNTVLVYLFGKWGRIEKSRENFDRISTSGKSSVVPWNAMINAYVQNGCPVEGLNLFRMMVEEETTRPNHITMVSVLSACAQIGDLSFGSWVHGYLISLGHRHTIGSNQILATSLIDMYSKCGNLDKAKKVFEHTVSKDVVLFNAMIMGLAVYGKGEDALRLFYKIPEFGLQPNAGTFLGALSACSHSGLLVRGRQIFRELTLSTTLTLEHCACYIDLLARVGCIEEAIEVVTSMPFKPNNFVWGALLGGCLLHSRVELAQEVSRRLVEVDPDNSAGYVMLANALASDNQWSDVSGLRLEMKEKGVKKQPGSSWIIVDGAVHEFLVGCLSHPEIEGIYHTLAGLVKNMKVASHFNLVCCC

SEQ ID NO: 135754 - protein, 407 aa, Glycine max
  Coding DNA Sequence Number=SeqID_18976
  Homolog annotation: Hit_ID=Q2QXS5; Match level="QueryCoverage=18%, HitCoverage=10%, E-value=3e-24, Identity=75%"; Hit description=Heavy metal-associated domain containing protein, expressed
  Pfam annotation: Domain name=HMA; Domain location=16-76; Score=45.8; E_value=1.5e-10; Accession=PF00403.16; Description=Heavy-metal -associated domain
MTKEEDFKLLKIQTCVLKVNIHCDGCKQKVKKLLQRIEGVYQVQIDAEQQKVTVSGCVDSATLIKKLVRAGKHAELWSQKTNQNQKQKNNNAKDDKNKGQKQALVRGLEAFKNQQKFPAFSSEEDEYYSEYDDDDDEDEDEEMRFLREKANQLQMLKQQAANANNARKGMGAIAAGSNNGKMNNGCNANSGKKGGPNHQNMGMKDSPNGRLDQKTMSALKLNNGHLGGEGLNLGEAKRANDIGAMMNLAGFNGNNGANVGSATVLGGNNNSNGLGGFPVQSNNNMIPGSSASFSNGGGLSGGQYPSSLLMNMNGFNNHPSPSPLMMNMQQQARQAMMQQQPQMMYHRSPFVPPNTGYYYNHSSSYSPAHYSYSSYGLPGYPAAGGDDHHSAAHMFSDDNTSSSCSIM

SEQ ID NO: 135755 - protein, 123 aa, Glycine max
  Coding DNA Sequence Number=SeqID_18977
  Homolog annotation: Hit_ID=Q1SCZ2; Match level="QueryCoverage=68%, HitCoverage=20%, E-value=3e-08, Identity=34%"; Hit description =Transcriptional factor B3
  Pfam annotation: Domain name=B3; Domain location=41-123; Score=8.3; E_ value=0.0087; Accession=PF02362.12; Description=B3 DNA binding domain
MTWGVYDKNQRCHNSNDTFEVLDEVAPTMRKAAKFTPENPYFKITIKGNRQGDTRPRLPLNFMRKYLHNKQTVELRVGQKPWRVNVIGDVRTKLSSGWAQFEKETKLRIGDALFDVHIFRARP

SEQ ID NO: 135756 - protein, 1002 aa, Glycine max
  Coding DNA Sequence Number=SeqID_18978
  Gene Ontology: Mol. function=sequence-specific DNA binding; Cellular component=nucleus; Biological process=regulation of transcription, DNA-dependent
  Homolog annotation: Hit_ID=Q04996; Match level="QueryCoverage=56%, HitCoverage=81%, E-value=4e-77, Identity=61%"; Hit description =Homeobox protein HAT3.1
  Pfam annotation: Domain name=PHD; Domain location=343-398; Score =59.7; E_value=9.2e-15; Accession=PF00628.19; Description=PHD-finger
  Pfam annotation: Domain name=TIP41; Domain location=877-1002; Score =72.0; E_value=1.9e-18; Accession=PF04176.4; Description=TIP41-like family
  Pfam module annotation: Pfam domain module=PHD::TIP41; Domain location=343-398::877-1002
MASPTGELTSHNDGTTDRMGTEQCELSEKTPQIGSEGLENEQKELGTELTSSVIEEKSNQVSAIVTENAVIQLPEPLQHDLQKNCQTVEGSCLEQSTVEQVTVDLSNDKPENKCKPLSENVQSEPVESIPAVVVEGQMQSNPSQANMSSVNELLDQPSGDAVNNISSNCSEKMSNSPTHSQSRRKGKKNSKLLKKYMLRSLGSSDRALRSRTKEKPKEPEPTSNLVDGNNNGVKRKSGRKKKKRKEEGITNQFSRIRSHLRYLLNRISYENSLIDAYSGEGWKGYSIEKLKPEKELQRAKSEILRRKLKIRDLFQNLDSLCAEGKFPESLFDSAGEIDSEDIFCAKCQSKELSTNNDIILCDGVCDRGFHQLCLDPPMLTEDIPPGDEGWLCPGCDCKDDCMDLVNDSFGTSLSISDTWERVFPEAASFAGNNMDNNSGVPSDDSDDDDYNPNGPDDVKVEGDESSSDESEYASASEKLEGGSHEDQYLGLPSEDSDDGDYDPDAPDVECKVNEESSSSDFTSDSEDLAAAIEDNTSPGQDGGISSSKKKGKVGKKLSLPDELSSLLEPDSGQEAPTPVSGKRHVERLDYKKLYEETYHSDTSDDEDWNDTAAPSGKKKLTGNVTPVSPNGNASNNSIHTPKRNAHQNNVENTNNSPTKSLEGCSKSGSRDKKSGSSAHKRLGEAVVQNIYCNKKKGQNNLKERAGNSESELNRMSEIVPENRAGLETLGRDFTNLLKKISIQIEPQKKAWHKNLDLLISRLPNGLAIHVGASGIHHKWKPIQKGKGPGPNFVNFEKSARPVYPGVATVSVKVKVMMELEVDENDLKAAGAELFVDGGRRGIRINGWVIETRRHSILNSSTLQEWEQNLDTSHLPEMVFGENTLILKHLSSGTNIHFNAFDALRGWKQEALPPVEVPAAAKWKFRSKPSQQVILDYDYTFTTPYCGSGTMEIDKDPNEGERETSKETSDIHWEDCKDQIDVVALASKEPILFYDEVGSEYLE

SEQ ID NO: 135757 - protein, 313 aa, Glycine max
  Coding DNA Sequence Number=SeqID_18979
  Gene Ontology: Biological process=polysaccharide catabolic process
  Homolog annotation: Hit_ID=Q109U3; Match level="QueryCoverage=70%, HitCoverage=85%, E-value=3e-39, Identity=54%"; Hit description=Large secreted protein, putative, expressed
MQRCQQLTSTVMSFSYSTDFFFTLSSHAHYRLSWAVQDCERVMVRHTPQKNWWKPSLTNAEDDDPPPRPLKVTFAEPATHWTDAIPIGNGRLGAMVWGAVPSEALQLNEDTLWTGIPGDYSNKSAPQALAEVRKLVDDGKFSEATAAAAKLSVDPSDVYQLLGDIKLEFPDSPILIIQESYYRELDLDTATAKIKYSVGDDTQLVSRKLQTSKAVEVSLIKRGDDGPGGQQLEKLHCGHKFTIVSTHRMIKHLTVLMEPDRGFGFEGGLYNNLFTAHSPFQFCFCRNKLSYHENLGRISISIYVMLRLQLLFP

SEQ ID NO: 135758 - protein, 725 aa, Glycine max
  Coding DNA Sequence Number=SeqID_18980
  Gene Ontology: Mol. function=hydrolase activity, hydrolyzing O -glycosyl compounds; Biological process=tRNA aminoacylation for protein translation
  Homolog annotation: Hit_ID=Q339Q0; Match level="QueryCoverage=99%, HitCoverage=85%, E-value=0.0, Identity=60%"; Hit description=Large secreted protein, putative, expressed
MKVFQLLGDIKLEFHDSHLNYSKESYYRELDLDTATAKIKYSVGDVEFTREHFASNPDQVIVTRLSASKPGSLSFTVYFDSKMHHDSRVSGQNQIKIEGRCPGSRIRPRVNSIDNPQGIQFSAVLDMQISKDKGVIHVLDDKKLRVEGSDSAILLLTASSSFDGPFTKPEDSKKDPASESLSRMVSVKKFSYDDLYARHLADYQNLFHRVSLQLSKSSKTGSGKSVLEGRKLVSSQTNISQKRGDDTIPTSARVKSFQTDEDPSFVELLFQYGRYLLISCSRPGTQVANLQGIWNKDVEPAWDGAPHLNINLQMNYWPSLACNLHECQEPLFDFISSLSVIGKKTAKVNYEANGWVAHQVSDIWGKTSPDRGEAVWALWPMGGAWLCTHLWEHYIYTMDKDFLKNKAYPLLEGCTTFLLDWLIEGRGGLLETNPSTSPEHMFTAPDGKTASVSYSSTMDISIIKEVFSMIISAAEVLGRHNDTIIKRVTKYQSKLPPTKVARDGSIMEWAEDFVDPDVHHRHVSHLFGLFPGHTISVEKTPDLCKAVEVSLIKRGDDGPGWSTTWKASLWAHLHNSEHAYRMIKHLIVLVEPDHERDFEGGLYSNLFTAHPPFQIDANFGFSGAIAEMLVQSTTKDLYLLPALPRDKWANGCVKGLKARGGVTVNICWKEGDLLEFGLWTENQNSQLRLHYRGNVVLTSLSPGRVYSYNNLLKCVKAYSLNEVNP

SEQ ID NO: 135759 - protein, 301 aa, Glycine max
  Coding DNA Sequence Number=SeqID_18981
  Gene Ontology: Mol. function=transcription regulator activity; Cellular component=nucleus; Biological process=regulation of transcription
  Homolog annotation: Hit_ID=Q9LT67; Match level="QueryCoverage=91%, HitCoverage=92%, E-value=4e-34, Identity=38%"; Hit description =Similarity to ER33 protein
  Pfam annotation: Domain name=HLH; Domain location=140-196; Score=4.8; E_value=0.044; Accession=PF00010.16; Description=Helix-loop-helix DNA- binding domain
MEAKKEYEVDHLSTPTGTSFSQLLFGDDDDDVDESALGLAVDQSYSYNYNNLTRSPLFSIHKAPQMLCFGNHQNEEGGVLLPETNVTPQKSVITSSDSSSASASSCNHTNTAFNSLPKSNNSLQKKRQEGVAKVGVGSQRQTKKNKAENPTSTGHAKRKEKLGERIATLQQLVSPFGKTDTASVLHEAMGYIRFLHDQVQVLCSPYLQSLPSSYHQNQHLMWAQLQFCCKDPDVDAEITGGGGNNEEEVNKDLRSKGLCLIPVGCTVHVAGSNGADFWSSAAIGNNVSFTISQAVKRNQDQ

SEQ ID NO: 135760 - protein, 86 aa, Glycine max
  Coding DNA Sequence Number=SeqID_18982
MAVESSRNSCRMQVITAYVDSGFVMVSFWGLAPYTCDPVKLATRHACWETYDPQKKTTNGVRQSIAIWHASKMKTVESVSDAVSPA

SEQ ID NO: 135761 - protein, 76 aa, Glycine max
  Coding DNA Sequence Number=SeqID_18983
MGLRDTNCEKESRGLTRWLEAVVERLAAMMGWLATVIRVMTTVVGWLASSDNDGVTRDRNGVAVVVVGWPATELSC

SEQ ID NO: 135762 - protein, 188 aa, Glycine max
  Coding DNA Sequence Number=SeqID_18984
  Homolog annotation: Hit_ID=Q109U3; Match level="QueryCoverage=69%, HitCoverage=11%, E-value=5e-24, Identity=48%"; Hit description=Large secreted protein, putative, expressed
MATANRHSYELLLLHRLLLYFVVSCSLSLSWAVQDGERVMVRNTPQKNWWKPSLTNAEDDDPPPRPLKVTFAEPATHWTDAIPIGNGRLGAMVWGAVPSEALQLNGSNMVWDLSPNLKYGILVEVYEALDSASRMASFCEDTLWTGIPGDYTNKSAPQALAEVRKLVNDRKFAEATAAAVKLSGEPSD

SEQ ID NO: 135763 - protein, 52 aa, Glycine max
  Coding DNA Sequence Number=SeqID_18985
  Gene Ontology: Mol. function=protein binding; Cellular component =mitochondrion; Biological process=cell division
  Homolog annotation: Hit_ID=Q6V5L1; Match level="QueryCoverage=88%, HitCoverage=10%, E-value=3e-20, Identity=100%"; Hit description=Cell cycle switch protein CCS52a
  Pfam annotation: Domain name=WD40; Domain location=1-39; Score=38.1; E_value=3.1e-08; Accession=PF00400.22; Description=WD domain, G-beta repeat
MSKLATLTGHTYRVLYLAISPDGQTIVTGAGDETLRFWNVFPSPKSQCHERG

SEQ ID NO: 135764 - protein, 49 aa, Glycine max
  Coding DNA Sequence Number=SeqID_18986
MSLEDKNAGGQQFMENGDNHKGLNKYACASVLAANIVSAIFGYVQKITI

SEQ ID NO: 135765 - protein, 105 aa, Glycine max
  Coding DNA Sequence Number=SeqID_18987
MSFTSGDATPSSPKTARSEGHEKDGGEKRNERYKERINHRRYGGRQRKEGIEGVKVKIPTFKETYDPDLYHEWEMKVEQVFNCYNYNEENIKLTSLEFEGYALVW

SEQ ID NO: 135766 - protein, 56 aa, Glycine max
  Coding DNA Sequence Number=SeqID_18988
MDNNTTITMVVTGDANDNINDSDRGMTKKTHDVIIGLQDAIAATYRLPMQSEVLKQ

SEQ ID NO: 135767 - protein, 449 aa, Glycine max
  Coding DNA Sequence Number=SeqID_18989
  Gene Ontology: Mol. function=enzyme activator activity; Cellular component=centrosome; Biological process=cell division
  Homolog annotation: Hit_ID=Q4TU48; Match level="QueryCoverage=93%, HitCoverage=80%, E-value=0.0, Identity=74%"; Hit description=Cell cycle switch protein CCS52A
  Pfam annotation: Domain name=WD40; Domain location=219-257; Score =0.7; E_value=30; Accession=PF00400.22; Description=WD domain, G-beta repeat
  Pfam annotation: Domain name=WD40; Domain location=310-346; Score =24.0; E_value=0.00052; Accession=PF00400.22; Description=WD domain, G-beta repeat
  Pfam annotation: Domain name=WD40; Domain location=351-389; Score =35.5; E_value=1.8e-07; Accession=PF00400.22; Description=WD domain, G-beta repeat
  Pfam annotation: Domain name=WD40; Domain location=393-434; Score =19.5; E_value=0.012; Accession=PF00400.22; Description=WD domain, G -beta repeat
  Pfam module annotation: Pfam domain module=WD40::WD40::WD40::WD40; Domain location=219-257::310-346::351-389::393-434
SKKRVIRSGGGATVRGKKQSTIHDRATGTAMEDLSGHLNIPPAASAATLRHVDRMINSNHYTSPSRTIYSDRFIPSRSASKFALFNIASPPEGRDDSSSAYTTLLRTALFGPDFAPPPTPEKTASPAMTLPSRNIFRYKTETRQSMHSLSPFMCEDSVPGVVHGPVKAPRKVPRSPFKVLDAPALQDDFYLNLVDWSSHNVLAVGLGNCVYLWNACSSKVTKLCDLGIDDLVCSVGWAQRGTHLAVGTSNGKVQIQIHHCADKLADYACSLGCDYLFFEQQPSFLKDLLFSDAMGVSFPCVIPIWDASRCKKIRSLEGHRLRVGALAWSSSLLSSGGRDKNIYQRDIRAQEDFVSKLSGHKSEVCGLKWSYDNRELASGGNDNRLFVWNQHSTQPVLKYCEHTAAVKAIAWSPHLHGLLASGGGTADRCIRFWNTTTNSHLSCMDTGSQ

SEQ ID NO: 135768 - protein, 72 aa, Glycine max
  Coding DNA Sequence Number=SeqID_18990
MVYQGGGGMVVALGGGGTTRVGAKREPGAFHLGNALVDAKLTIKSIQEPCLISVLNYLCRAFVRGANTRVMI

SEQ ID NO: 135769 - protein, 265 aa, Glycine max
  Coding DNA Sequence Number=SeqID_18991
  Gene Ontology: Cellular component=extracellular region; Biological process=cellulose and pectin-containing cell wall organization and biogenesis
  Homolog annotation: Hit_ID=Q8W2X8; Match level="QueryCoverage=92%, HitCoverage=93%, E-value=1e-101, Identity=67%"; Hit description =Putative expansin-A30 precursor
  Pfam annotation: Domain name=DPBB_1; Domain location=74-160; Score =162.7; E_value=9.3e-46; Accession=PF03330.8; Description=Rare lipoprotein A (RlpA)-like double
  Pfam annotation: Domain name=Pollen_allerg_1; Domain location=171 -249; Score=132.0; E_value=1.7e-36; Accession=PF01357.11; Description= Pollen allergen
  Pfam module annotation: Pfam domain module=DPBB_1::Pollen_allerg_1; Domain location=74-160::171-249
MAATLQHCSFLLITTFTWMFILIIGKPPIVAGTFQPSQWTLAHATFYGDESASATMGGACGYGNLLINGYGKDTAALSSTLFNNGYACGTCYQIRCVQSSACYSNVPYTTVTATNLCPPNWAQASDNGGWCNPPRTHFDMSKPAFMKIAQWQAGIIPVMYRRVPCVRSGGIRFSFQGNGYWLLVYVMNVGGGGDIANMWVKGSGTGWISMSHNWGASYQAFATLGGQALSFKVTSYTTKETIIAWNVAPTNWGVGLTYSSNVNFI

SEQ ID NO: 135770 - protein, 221 aa, Glycine max
  Coding DNA Sequence Number=SeqID_18992
  Gene Ontology: Mol. function=sequence-specific DNA binding; Cellular component=nucleus; Biological process=regulation of transcription, DNA-dependent
  Homolog annotation: Hit_ID=Q8LC79; Match level="QueryCoverage=98%, HitCoverage=86%, E-value=1e-20, Identity=41%"; Hit description=GATA transcription factor 19
  Pfam annotation: Domain name=GATA; Domain location=103-137; Score =9.8; E_value=0.022; Accession=PF00320.17; Description=GATA zinc finger
  Subcellular localization annotation: CTP_CleavageSite=23; ConfidenceScore=5.61e-01
KPAPSPCSSPCPTTNHPTTIPTTSMTILPSLPLPLPLTAPSPSVPLPPASPKTKKSEAATNPAPSRTSAGTYYNLNTTTLNPIPNPPEPPTPPTLSSLAAAPIVTPLLLPSGEMAPVAPRGSLCNACGIRYKKEERRASAAAATPPAAAASGGMMDSAQVYNNSWYAHQQSQKMQCFSPGMGSEFRFVDDGDRDAADNGIQFLSWRLDVTDRTSLVHDFTR

SEQ ID NO: 135771 - protein, 157 aa, Glycine max
  Coding DNA Sequence Number=SeqID_18993
MTHDLTLFVFSQFSPRGRVQEGKIGGGGEKGESSGGRRVGRGGLKAREKKGGCNEKRKGRMTVEIVWIFQKTIIVTTTNTFMTTVVVTNMTDVVATTGRDDDDHDVGGCGDGGNSNNDNIHVGGSVVDDHGGCCSDSHYRYGGNNHDNDVDDRFEIF

SEQ ID NO: 135772 - protein, 390 aa, Glycine max
  Coding DNA Sequence Number=SeqID_18994
  Gene Ontology: Mol. function=RNA binding; Cellular component=nucleus; Biological process=35S primary transcript processing
  Homolog annotation: Hit_ID=Q2QX78; Match level="QueryCoverage=91%, HitCoverage=36%, E-value=3e-65, Identity=36%"; Hit description=Nrap protein, expressed
  Pfam annotation: Domain name=WCOR413; Domain location=130-294; Score=- 101.9; E_value=0.063; Accession=PF05562.2; Description=Cold acclimation protein WCOR413
MEADAIAVDSTELKLTELLKEVNVDHSHQFSKLVDDTVSAIKTSIDKIPNDFKVTADLASRFVTDIGADKVEFKFKKPASVKIGGSYSIQSIAKPEVNVDLIIRLPKECFHEKDYLNYRYYAKRCLYLCLMKNYLEKSPSIDRVEWSTLQNEARKPLLVVYPAAKLVEVPGFFVRIIPSAKAIFSIAKLNLKRSNIHNLSDGTALLATPKYNSSILEDMFIEDVEFINNYFLGWKELREALILLKVWARQRSSIHVHDCLNGFLISVILAYLASKQHITNSMKSTEIIRITLNFIATSELWSRGLYFPKEGHSNITKEQRMQLKESFPVVISHPFGGFNLAFRMSRIGFTQLQNEATLTLRCMEKCRDGGFEEVFMTKIDYAGKYDYCMR

SEQ ID NO: 135773 - protein, 156 aa, Glycine max
  Coding DNA Sequence Number=SeqID_18995
  Homolog annotation: Hit_ID=Q75GV2; Match level="QueryCoverage=47%, HitCoverage=80%, E-value=5e-11, Identity=43%"; Hit description =Expressed protein
MGYCKLRRAVLSLNAVCGLPVVKSEAAEIWYRTLLVSLPQMISIVAVALQPKPSDPSLIFPFLKVLARMDSNNKQTDEKRPASRDSFCQRKKSENGSFVSNLRNHFHEFIHASADEHKTCLRNTIQKILNASKIFGKDRDSTNEGDSVPLQSSTKN

SEQ ID NO: 135774 - protein, 70 aa, Glycine max
  Coding DNA Sequence Number=SeqID_18996
MDKTLSLPTVIFQKSMHRVQEEYMDVHVSDAERATLRCHHHLVAPYRAPRPQNLVASFCCPFYIVSDVLL

SEQ ID NO: 135775 - protein, 292 aa, Glycine max
  Coding DNA Sequence Number=SeqID_18997
  Homolog annotation: Hit_ID=Q10DM3; Match level="QueryCoverage=99%, HitCoverage=98%, E-value=7e-24, Identity=33%"; Hit description =Expressed protein
MTLGLINANPVVHAKKERIARSDDPHADDAVDPLDIYDILFFFSFSLLPLPTQLTVEILDLALTNFVRDIRDPEHPYSLEQLSVLSEESISVDDKLGRILLSKFPPLTDSWVSILVLICSVQWIMDLDSSQAGIWRIHAVSQSELLDEDWTTHILFCGLTAAIANKIRENYGWSGLQKTYFNQRSEAVPSHNRGRCRRVAVADQTTVIGDKIVLVRSHPTIRNSIFLVGHPAPLFGIDNYGWWCVDIKVSPGSHANEESVNKQLNDKERVAAALENPNLRQLVDECLYSNEL

SEQ ID NO: 135776 - protein, 101 aa, Glycine max
  Coding DNA Sequence Number=SeqID_18998
  Gene Ontology: Mol. function=DNA binding; Cellular component=nucleus; Biological process=regulation of transcription, DNA-dependent
  Homolog annotation: Hit_ID=Q0NZY1; Match level="QueryCoverage=92%, HitCoverage=95%, E-value=4e-22, Identity=50%"; Hit description=AtRL1
  Pfam annotation: Domain name=Myb_DNA-binding; Domain location=12-61; Score=23.3; E_value=0.00086; Accession=PF00249.21; Description=Myb -like DNA-binding domain
MTSYTLSSPNTSLRWTTEKNKLFENALAIYDKDTPERWNNIAMFVGGTTEVEVKRQYEILLEDIKNIESGKVPLPDYTRNAGCGKLNISSAEQRLRDLKLR

SEQ ID NO: 135777 - protein, 872 aa, Glycine max
  Coding DNA Sequence Number=SeqID_18999
  Gene Ontology: Mol. function=RNA binding; Cellular component=nucleus; Biological process=35S primary transcript processing
  Homolog annotation: Hit_ID=Q2QX78; Match level="QueryCoverage=76%, HitCoverage=58%, E-value=0.0, Identity=50%"; Hit description=Nrap protein, expressed
  Pfam annotation: Domain name=Arf; Domain location=714-864; Score =137.8; E_value=3e-38; Accession=PF00025.11; Description=ADP -ribosylation factor family
  Pfam annotation: Domain name=Nrap; Domain location=1-675; Score =278.1; E_value=1.7e-80; Accession=PF03813.5; Description=Nrap protein
  Pfam module annotation: Pfam domain module=Arf::Nrap; Domain location= 714-864::1-675
GKKEVFASGFCLDDECWRSYEDKIHGILSKGLNDRAKFIQVTWRNTHCQWSVDDGLSVLDKVPLFIGISVSTLEKAFRMVDIGPNAESKEEALEFRKFWGEKAELRRFKDGRIAESTVWEIEQWAKHLILKRIVEHVLSRHLSLSKENIVVVVDQLDFSLLHGSGDPISYSGNLLGAFDVLSKRLRLIEDLPLKVSSVQPLDSAFRFTSVFPPEPHHLANEKHESLRLNKLVPSCIQPLEVMIQLEGSGNWPMDEIAIEKTKSSFLVQIGVSLQKMWGMTCTATEDNVDVLVSGYAFRLKILHERGLSLLNKEIGNDQAKRIPSADKKLFIRSQHANMINGLQSRYAIFGPVVRLAKRWAASHLFSSCLVEEAVELLVAYLFLNPLPYDVPCSRITGFLRTRKQPLCICKGKAAYNIPPPYLRIAKSLWAMGFLRLLSHYDWTFSPLIVDINHDLSQSDGKEINDNFLLRRKGQGENGQSVGSAMFLATVYDKESEAWTGLSPSGMELKRLVAYARSSANLLAKLTFLEEIGPFRWECLFRTPLNNYDAVIFLHKDKLPYPQRLLFPSEVNHGTHVAEGQASKCFQPFLLPKDLKGRPEELRNKLLQEFSTTFQVWHDYLGGDVIGLTWGESYPSKKRKHEEVVVEEEYNPCKVLKAVGEVGKGFVKIQLSNHLPLDIINDLSLWNYVRSRVEEFWEPNGSSEYHKENQAEREGNANSNGRIGQFWENHNRFKDKRRGHQRHQSHARLQHQNHNLPKKTIRSYWRNYFEQTDGLVWVVDSSDLRRLDDCKFELDNLLKEERLSGASLLILANKQDIKGALTPEEIAKVLNLEAMDKSRHWQIVGCSAYTGEGLLEGFDWLVQDIASRIYMLD

SEQ ID NO: 135778 - protein, 40 aa, Glycine max
  Coding DNA Sequence Number=SeqID_19000
MKAGTAVLVILIELINKNSNSMLQQNHQKQKDHGSAKPIS

SEQ ID NO: 135779 - protein, 187 aa, Glycine max
  Coding DNA Sequence Number=SeqID_19001
  Gene Ontology: Mol. function=nucleic acid binding
  Homolog annotation: Hit_ID=Q1S3K9; Match level="QueryCoverage=93%, HitCoverage=26%, E-value=8e-80, Identity=83%"; Hit description=IQ calmodulin-binding region
MPISRTSKKSKEMDDLPFKSECQVETIQSALLNPNSPKHIAALKLQKVYKSFRTRRKLADCAILVEQSWWKLLDFAELKRSSISFFEIEKHETAVSRWSRARTRAAKVGKGLLKDDKAQKLALQHWLEAIDPRHRYGHNLHFYYDRWLQCQSREPFFYWLDIGEGKEVNLEKCPRSKLQQQYGKAGL

SEQ ID NO: 135780 - protein, 338 aa, Glycine max
  Coding DNA Sequence Number=SeqID_19002
  Gene Ontology: Mol. function=nucleic acid binding
  Homolog annotation: Hit_ID=Q1S3K9; Match level="QueryCoverage=99%, HitCoverage=49%, E-value=2e-99, Identity=59%"; Hit description=IQ calmodulin-binding region
  Subcellular localization annotation: CTP_CleavageSite=5; ConfidenceScore=5.09e-01
HSSFLAGGATSSAGRLVVQNGVLKKNDFVVSFQQAVWPHSGHYRPTEENFKEFISFLQENNVSLLDVKMDPVDEVDDLLSLRSSGHLRSHSSEEDFTENMNGLEIEETTTEDSVAVEKANLIETERPSALMAPSPRQFQILGRELGNLEIPKRGNVFEGLENEIEGVEQSCVSFPMESHTGSQETTLAFVPELDHTISEKKNLSDDNDVETIPQESILKRINSHKEMKSYQLGKQLSCKWTTGAGPRIGCVRDYPCELQFRALEQVNLSPKSGSRSKSSFALRSTILLSSSLSNVASLCGDLTIEPLHMPQRGESYSSRSECSPLIRGTSVIPVIHSS

SEQ ID NO: 135781 - protein, 60 aa, Glycine max
  Coding DNA Sequence Number=SeqID_19003
MVVLAGSFIDLVRRGSDLRKSFGLAYGMALELWSGKYVDVGDFGMNGLKTLCRLWLLSPE

SEQ ID NO: 135782 - protein, 211 aa, Glycine max
  Coding DNA Sequence Number=SeqID_19004
  Gene Ontology: Mol. function=oxidoreductase activity, acting on the CH-CH group of donors; Cellular component=mitochondrion; Biological process=tricarboxylic acid cycle
  Homolog annotation: Hit_ID=O82663; Match level="QueryCoverage=99%, HitCoverage=35%, E-value=3e-94, Identity=76%"; Hit description =Succinate dehydrogenase [ubiquinone] flavoprotein subunit 1, mitochondrial precursor
  Pfam annotation: Domain name=Succ_DH_flav_C; Domain location=79-211; Score=272.4; E_value=8.6e-79; Accession=PF02910.10; Description =Fumarate reductasesuccinate dehydroge
VVTIKGDNPDAVVSGLMAAGETACASVHGANRLGANSLLDIVVFGEKQKPLEKDAGQRTIAWLDKLRNSNGSLPTSQIRLNMQRVMQNNAAVFRTQETLEEGCQLIDKTWESFHDVQVKDRSLIWNSDLIETIELENLLINACITMYSAEARKESRGAHAREDFKVRDDGNWMKHTVGFWENEKVRLDYRPVHLNVLDDEVESFPPKARVY

SEQ ID NO: 135783 - protein, 172 aa, Glycine max
  Coding DNA Sequence Number=SeqID_19005
SKSLAFVDHTAFCRHDSRAGSPRRYLTVIRTLLSSRGGGPDDKQRPSFGHSAPLYHPEAAGPMIRGDTLRLFAPFCHPEAAGPMTSRDQVWSFCTLVSSRGGGPDDTRRYLTVIRTLLSSRGGGPDDKQRPKTKFGHSAPLYHPEAAGPMIRGDTRVVIRINILLLSVRQNA

SEQ ID NO: 135784 - protein, 78 aa, Glycine max
  Coding DNA Sequence Number=SeqID_19006
MSSSTLLLILTRESGDVQRYPSGYPYKRFLLTLTREVRWQAGGQRVRWQAEIPYGRPHLSSTKANEFDGIQMMLVVRF

SEQ ID NO: 135785 - protein, 101 aa, Glycine max
  Coding DNA Sequence Number=SeqID_19007
MEAPAFVEDIPADAGIEAAEDQHQGFPGSPSGPSVLIAYADHVACSERYELKLSSHGRKVHSLGRPVPAIEGLIAGTGLSPLIACSVDTSDRGLLSTFVER

SEQ ID NO: 135786 - protein, 71 aa, Glycine max
  Coding DNA Sequence Number=SeqID_19008
MLIAMMLRMLNVLCFMQQSLSVTVDHDPVAGLPLTPKKRMSSDEADEELGSSQISPAQLSSNKLTRHSHKS

SEQ ID NO: 135787 - protein, 429 aa, Glycine max
  Coding DNA Sequence Number=SeqID_19009
  Gene Ontology: Mol. function=oxidoreductase activity, acting on the CH-CH group of donors; Cellular component=mitochondrion; Biological process=tricarboxylic acid cycle
  Homolog annotation: Hit_ID=Q6ZDY8; Match level="QueryCoverage=88%, HitCoverage=59%, E-value=0.0, Identity=88%"; Hit description =Succinate dehydrogenase [ubiquinone] flavoprotein subunit, mitochondrial precursor
  Pfam annotation: Domain name=DAO; Domain location=66-407; Score= -17.9; E_value=7.8e-05; Accession=PF01266.14; Description=FAD dependent oxidoreductase
  Pfam annotation: Domain name=FAD_binding_2; Domain location=66-429; Score=480.3; E_value=2.4e-141; Accession=PF00890.14; Description=FAD binding domain
  Pfam module annotation: Pfam domain module=DAO::FAD_binding_2; Domain location=66-407::66-429
HDLNFEMNVASVPKEETGIIVHLTTWEVFIAPRGVDYYTKKEAESFFCVVQSGANSSYTVVDHTYDAVVVGAGGAGLRAAIGLSEHGFNTACITKLFPTRSHTVAAQGGINAALGNMTEDDWRWHMYDTVKGSDWLALWPTGDQDAIQYMCREAPKAVIELENYGLPFSRTEDGKIYQRAFGGQSLNYGKGGQAYRCACAADRTGHALLHTLYGQAMRHNTQFFVEYFALDLLINSDGTCQGVIALNMEDGTLHRFQAASTILATGGYGRAYFSATSAHTCTGDGNAMVARAGIPLEDLEFVQFHPTGIYGAGCLITEGSRGEGGILRNSEGERFMERYAPTAKDLASRDVVSRAMTMEIREGRGVGPLKDHIYLHLNHLPPDVLKERLPGISETAAIFAGVDVTKEPIPVLPTVHYNMGGIPTNHYGE

SEQ ID NO: 135788 - protein, 67 aa, Glycine max
  Coding DNA Sequence Number=SeqID_19010
  Gene Ontology: Mol. function=oxidoreductase activity; Biological process=electron transport
  Homolog annotation: Hit_ID=Q1S3J9; Match level="QueryCoverage=80%, HitCoverage=10%, E-value=2e-23, Identity=85%"; Hit description =Rieske [2Fe-2S] region
MASNNALQLKRYKNNWHKACFVPIQSDALVIGYRTWLKKYAGGQVDWRGKYSGALPPTPPREQLMDR

SEQ ID NO: 135789 - protein, 389 aa, Glycine max
  Coding DNA Sequence Number=SeqID_19011
  Gene Ontology: Mol. function=oxidoreductase activity; Cellular component=chloroplast; Biological process=electron transport
  Homolog annotation: Hit_ID=Q1S3K4; Match level="QueryCoverage=91%, HitCoverage=67%, E-value=1e-177, Identity=79%"; Hit description =Rieske [2Fe-2S] region
  Pfam annotation: Domain name=PaO; Domain location=157-256; Score =122.7; E_value=1e-33; Accession=PF08417.2; Description=Pheophorbide a oxygenase
  Subcellular localization annotation: CTP_CleavageSite=41; ConfidenceScore=5.07e-01
MYMVQFCALKGPIGLSQYMTPTPNFFTLLKTQVHTSKKACVAAYPSTVQNDILWFWPNTDPQYKDIITRKRPPYIPELDDPSYTKLMGNRDISYGYEVLIENLMDPAHVPYAHYGLMRTPKPKVKVDREGGRPLELSIETLDINGFTANQGWSKSKFMPPCIFYVYTDSDQPASSAETQKSSAQKKFALIFVCVPVSPGKSRLIWCFPRNFGVWIDKIVPRWIFHVGQNRILDSDLYLLHVEEQKIVDIGPKNWHKACFVPTKSDALVIGYRNWLKKYAGGQVDWRGKYSGALPPTPPREQLMDRYWSHVVNCKSCNSAYKSLNVIEVMLQIISVASIGIVAIMKHGTMSVAKRNSMVALAVLSLALSRWLAHFIYKNFRYHDYEHAFR

SEQ ID NO: 135790 - protein, 293 aa, Glycine max
  Coding DNA Sequence Number=SeqID_19012
  Homolog annotation: Hit_ID=Q5XWK4; Match level="QueryCoverage=46%, HitCoverage=34%, E-value=2e-26, Identity=42%"; Hit description =Expressed protein-like
  Pfam annotation: Domain name=DUF616; Domain location=138-293; Score =57.8; E_value=8.2e-17; Accession=PF04765.4; Description=Protein of unknown function (DUF616)
MEGDLQRALSLRLNRRGDRSNQSPAKDDMTVKDIVTLALANKLSLFVGDADFERASSGAMEKLRLGDRLVMDSNPEIASLHMEGGTLVTMCNKDSKVFNMLDNMGLVSKPHRCPIPLSNDPDKIVIPTGRTPNETVKNLSYVMEDEVPHSEAQSSPLFGGHPSGGAEMNRVDIKYVKKCKFVVASGIFDGYDLPHQPSNISLRSKELFCFLMVVDEVSLKFMRENGTVKEDRAGGKWVGIWRLVLLKHPPYDEPRRNGKVPKILTHRLFPQAQYSIWIDGKMELIVDPLLILE

SEQ ID NO: 135791 - protein, 451 aa, Glycine max
  Coding DNA Sequence Number=SeqID_19013
  Gene Ontology: Mol. function=monooxygenase activity; Cellular component=integral to membrane; Biological process=electron transport
  Homolog annotation: Hit_ID=Q1S4F4; Match level="QueryCoverage=84%, HitCoverage=93%, E-value=0.0, Identity=86%"; Hit description=E-class P450, group I
  Pfam annotation: Domain name=p450; Domain location=38-451; Score =47.3; E_value=4e-13; Accession=PF00067.12; Description=Cytochrome P450
MSDSLLTFYSLSAILALLPIFIFILIKRKQSKPRLNLPPGNMGWPFLGETIGYLKPYSATTIGEFMEQHIARYGTIYKSKLFGEPAIVSADAGLNRFILQNEGKLFECSYPRSIGGILGKWSMLVLVGDMHRDMRVISLNFLSHARLRTHLLKEVEKQSLLVLNSWSQNSIFSAQDEAKKFTFNLMAKHIMSMDPGDIETEQLKKEYVTFMKGVVSAPLNLPGTAYRKALKSRSIILKFIEGKMEERVRRIQEGNESLEEDDLLNWVLKHSNLSTEQILDLILSLLFAGHETSSVAIALAIYFLPGSPQAIQQLREEHREIARAKKQTGEVELTWDDYKRMEFTHCVVNETLRLGNVVRFLHRKAVKDVSYKGYDIPCGWKVLPVIAAVHLDPSLFDQPQHFNPWRWQEKGKRIISREVPKHLNWSLRWIPTCNHCLIGFLSLKVCGVNKI

SEQ ID NO: 135792 - protein, 162 aa, Glycine max
  Coding DNA Sequence Number=SeqID_19014
  Pfam annotation: Domain name=zf-CCHC; Domain location=79-96; Score =10.9; E_value=0.016; Accession=PF00098.13; Description=Zinc knuckle
MVLILRSLHSDFDHVRDQVLAGDQVPSMDSLITRLLRVPHALKEENPADVVETSAMAAPRGRGGGRNSRGGRGGRGGRPQCTYCKRMGHTQETCYSLHGFPDKVAQLKSEKSSSQTSSSSVPCYSTACISQSIDGPSPWILDSGASDHISGTWHGSIDWRRT

SEQ ID NO: 135793 - protein, 70 aa, Glycine max
  Coding DNA Sequence Number=SeqID_19015
MVERPGGSFGPADQHLFRSPTVFIHVSSTFEFGAMRSDCLVQLSILNPFSEPHELCFRSCVLYLRVWSYA

SEQ ID NO: 135794 - protein, 185 aa, Glycine max
  Coding DNA Sequence Number=SeqID_19016
  Gene Ontology: Mol. function=peptidyl-dipeptidase Dcp activity; Cellular component=outer membrane; Biological process=proteolysis
  Homolog annotation: Hit_ID=P27236; Match level="QueryCoverage=87%, HitCoverage=23%, E-value=2e-39, Identity=51%"; Hit description =Peptidyl-dipeptidase dcp
MTLGDDRNIAQTWVNGAIMTSRANPFFNVSPLPYQTPPFDLIDEAHFLPALEAGIAEKRQEVAAIASNPEPATFANTYEALERSGSLLNRVYPVFAAMTSANTSERLQQVDELITPQLTALNDEIYLNPALFARLDSVYQQRGSQCPDAEAMRLVEVTWQRFQLAGASLSERDKAQLRACNQELA

SEQ ID NO: 135795 - protein, 80 aa, Glycine max
  Coding DNA Sequence Number=SeqID_19017
MLIERVRVRIDIIIQGLTILAPVDSPNTDGIDPDAICELNLCSNIRRLMFKKEFDTSYVGFNSGSELLSRQNLCNAYLDF

SEQ ID NO: 135796 - protein, 66 aa, Glycine max
  Coding DNA Sequence Number=SeqID_19018
MSTLQTNNAELNQKQSLVELERIDQKTTDSAVSLLSGLHRKDVNAFKKATQAAQPLTEAKVAEPRA

SEQ ID NO: 135797 - protein, 91 aa, Glycine max
  Coding DNA Sequence Number=SeqID_19019
MLAMIRKYQEELNLATAHEHKVEDEYARVYAEKEARGRVIDSLHQEATMWMDRFGLTLNGSQELPRLLAKAKAMADAYSAPEEIHGLLSYC

SEQ ID NO: 135798 - protein, 105 aa, Glycine max
  Coding DNA Sequence Number=SeqID_19020
LLETSFILSLFSLLASPENLCTQLPTVVSGDCIGKFVLVTGQFLPLLPLSLLTASKTSFILDCNGKFDGIGNLLHSCKVSHSCLSLLQQFFPLHYSEKGADHKQG

SEQ ID NO: 135799 - protein, 119 aa, Glycine max
  Coding DNA Sequence Number=SeqID_19021
  Gene Ontology: Mol. function=protein serine/threonine kinase activity; Cellular component=protein complex; Biological process =protein amino acid phosphorylation
  Homolog annotation: Hit_ID=Q75PK5; Match level="QueryCoverage=65%, HitCoverage=12%, E-value=3e-33, Identity=85%"; Hit description =Mitogen-activated kinase kinase kinase alpha
MFQNINSSSSMLSFKGSPYWMAPEVVMNTNGNSLPVDIWSLGCTILEMATSKPPWNQYEGVAAIFKIGNSRDMPEIPEICLGSWVLELSSERPQNLLPQIATHTPHCFSLPHTPPYRCQ

SEQ ID NO: 135800 - protein, 155 aa, Glycine max
  Coding DNA Sequence Number=SeqID_19022
  Gene Ontology: Mol. function=cysteine-type peptidase activity; Biological process=proteolysis
MKILKWYTKNLHHLEASIVERYIAEEAIEFCSKYIEKAKPARLPESRHDERVGGKGSRGLHVITLILEDLQQAHLYVLNNSDEVLPYILRHKGLVKESNPKISKNKLSKFILMMPKTQVKNQESNKFQESKNRSIENQDSREDSRYARTSRKASR

SEQ ID NO: 135801 - protein, 100 aa, Glycine max
  Coding DNA Sequence Number=SeqID_19023
MELNQPHLIREQKVLTSQNQSDSTIALTAPNYVKKRLSHEVLKVTVELSSSCVKQRNCLQPDSAHDWRKAQIHLLALSARVALSATSRIQSLFKVCLVQN

SEQ ID NO: 135802 - protein, 166 aa, Glycine max
  Coding DNA Sequence Number=SeqID_19024
  Homolog annotation: Hit_ID=Q1SSE9; Match level="QueryCoverage=70%, HitCoverage=7%, E-value=4e-39, Identity=70%"; Hit description=N-6 Adenine-specific DNA methylase
GGGAYGKTPATRPFYGSWPFAGLLLTCSFLRYPLILWITVLPPLSELIPLAAAERPSAASQYCQALLKSLKTGRAPEVESWKQLALSLEERIRIHQQGGYAANLAPAKLVGKLLNFFDSTAHRVVGGLPPPAPLPSQGTIHGSEQQYQNMAPRVSSSQSTMSLGIL

SEQ ID NO: 135803 - protein, 147 aa, Glycine max
  Coding DNA Sequence Number=SeqID_19025
  Gene Ontology: Mol. function=nucleic acid binding
TNRLRILCLNTLEDTSFVVQVEGTSTWVVVLRTREGTSLVDPFKWRYIHLVVQREQGRGTSLVDLWLVQDFTRLKEISRTVGCLRTGCRHGTRLVSKLSLAITPHPKPYKLQWLNEQGEMIVNQQVKVPFSIGTYKDEVICDVVPME

SEQ ID NO: 135804 - protein, 97 aa, Glycine max
  Coding DNA Sequence Number=SeqID_19026
MKTKIPEYPVNHEDFDDIKKNLLEKEGDVNHASFDGVEKKSHVCHHQKGGECESLFQDSLKTKPCLKTMCFQDMQGSGNRLPGSVIDYQKTGLRNSC

SEQ ID NO: 135805 - protein, 96 aa, Glycine max
  Coding DNA Sequence Number=SeqID_19027
MAFVGETSSQTIVNSRLAFIYPNGSIIHNDTGVYFQTSTPVPIRVPNRCDFASLKTRIHNTLQLSDKQFLDEIHYRKPFTDTVDGTGEQDYFFWVF

SEQ ID NO: 135806 - protein, 195 aa, Glycine max
  Coding DNA Sequence Number=SeqID_19028
MCLPHGLRDTCMISLGLLALNGYRSGVIDILIGSVRHIGGRIVERQAIWWEGVLVLNLHIMGAFVLPKSLPTISEVGWFISLRSDGGIGFTLATALVAETATALASIIFFMLIMASMIVAICSFMAFMSAFIYSCTSSALPITLALARVRTCDASSMGACRPRIFFINGFLCFLEDKWQRNGEGRERGDATSRRR

SEQ ID NO: 135807 - protein, 38 aa, Glycine max
  Coding DNA Sequence Number=SeqID_19029
MGNAMGSKKAKIMKIDGETFKLKTPARANDVVKDYPGH

SEQ ID NO: 135808 - protein, 129 aa, Glycine max
  Coding DNA Sequence Number=SeqID_19030
VVVSLPKPPLKPDPEVDDPLYQVRWDATMFGVINPNFPLHLTETCMRVGNSDIYGFLEPQSIQRSGQSQFESESYIKSWMQSSQRDVYLGAYLNGPDNYLKGIINSAIKGRDDAPQPKSKAYARWIVVK

SEQ ID NO: 135809 - protein, 57 aa, Glycine max
  Coding DNA Sequence Number=SeqID_19031
MNILMAHNQEWEQELSPYNQYEEERTPNLESVFEEFMAYHTSSKANQNSMKNHEIHF

SEQ ID NO: 135810 - protein, 55 aa, Glycine max
  Coding DNA Sequence Number=SeqID_19032
MAQPPILRTDPMNTRLVGSKTMIVILTPLPDLMEVTCLHPTKQYSNGIVCYVHVQ

SEQ ID NO: 135811 - protein, 125 aa, Glycine max
  Coding DNA Sequence Number=SeqID_19033
  Gene Ontology: Mol. function=hydrolase activity
  Homolog annotation: Hit_ID=Q8L9J9; Match level="QueryCoverage=83%, HitCoverage=36%, E-value=5e-20, Identity=51%"; Hit description =Probable carbohydrate esterase At4g34215
  Pfam annotation: Domain name=DUF303; Domain location=5-59; Score= -38.4; E_value=0.013; Accession=PF03629.8; Description=Domain of unknown function (DUF303)
MAGRGGAIRDANNRSKRSDGVVPAVLWFQGESHAIHEEDAAAYKFNMETLIHNLRQDLNSPSSFTEASSFALLVWYKVALASGSDHTEKVREAQKVIDLPNVICVDAKGLQLKEDNLHLIGSQAG

SEQ ID NO: 135812 - protein, 87 aa, Glycine max
  Coding DNA Sequence Number=SeqID_19034
MDGHFIVSAVIFFINEVIPNDPKGSLTTSSWYKFEYENKKSKIDFVWWASLAFTAGFAVGFHGNFTKERILKNKRANIIHRIGSANP

SEQ ID NO: 135813 - protein, 220 aa, Glycine max
  Coding DNA Sequence Number=SeqID_19035
  Gene Ontology: Mol. function=citrate transporter activity; Cellular component=integral to membrane; Biological process=citrate transport
  Homolog annotation: Hit_ID=Q70MT2; Match level="QueryCoverage=78%, HitCoverage=40%, E-value=2e-66, Identity=73%"; Hit description =Na+/H+ antiporter precursor
GSGLTGLPPYIGMLLGLGMLWILTDAIHYDESERQKLKVPHALSRIDTQGALFFLGIVLSVSSPEAAGILREIANYFDAHVPSSELIASAIGLISALIDNIPLVAATIGMYDVSSFPQDSEFWQLIALCASTGGSILVIGSAAGVAFMGMEKVDFIWYLRKVSGFALAGYTAGIASYLVLHNLNILQPSLAEAPFLSCFINQEFGLHSNPLSWYQKQHSL

SEQ ID NO: 135814 - protein, 84 aa, Glycine max
  Coding DNA Sequence Number=SeqID_19036
MGQSRDKEREQGRGSGSDGVVSGGFRSWRHRDAKLQQSGRGVYTRESGRAVVARQWLGPGVYGVVASSKFRHSLGKKSRKQNSE

SEQ ID NO: 135815 - protein, 63 aa, Glycine max
  Coding DNA Sequence Number=SeqID_19037
MAGRKIGGEGFRERSLLQVQGRIVIDDTNMVIDYQRAMLPEITACNRLHYYGNRLPEVILARK

SEQ ID NO: 135816 - protein, 126 aa, Glycine max
  Coding DNA Sequence Number=SeqID_19038
TLFLQHFNIPLDFEPYVPIKRSFLIGAVVIASFGYRKEHDGSWVKKGAQPIDEEGHLPVGEDSSLLQRILDRFDGLQTFVGERFDALELQVDMLFDEMDTRITKVEGDVSHIRTCFDLPPPPRPSS

SEQ ID NO: 135817 - protein, 105 aa, Glycine max
  Coding DNA Sequence Number=SeqID_19039
  Subcellular localization annotation: CTP_CleavageSite=56; ConfidenceScore=5.43e-01
MVFSLVFLDPSLPKLASGSPGPPNNFMVKKPTRLGELQLPQSNPFPINRCSRGGFKGEKVQKVRELRENRKKKKKEEKTRLKRYRITIMIIPYIVPCTVFFMQPS

SEQ ID NO: 135818 - protein, 51 aa, Glycine max
  Coding DNA Sequence Number=SeqID_19040
  Subcellular localization annotation: CTP_CleavageSite=29; ConfidenceScore=5.16e-01
MALYGSAFAYSNPLKDTRLPCSGVFCLSRAGKGRRSVGRDPSFYLRPSLST

SEQ ID NO: 135819 - protein, 112 aa, Glycine max
  Coding DNA Sequence Number=SeqID_19041
MAFLENSWDFTFFISFFSFMHLKNTNRQKCPHTSTPYYKMVILEEYSILLAYLTEHHVERRSERVRTMVMLHNRFKILLYPRYHGFIVAAQGTVRLQEVEMGVRSNCPTLNY

SEQ ID NO: 135820 - protein, 111 aa, Glycine max
  Coding DNA Sequence Number=SeqID_19042
  Gene Ontology: Cellular component=extracellular region; Biological process=cellulose and pectin-containing cell wall organization and biogenesis
  Homolog annotation: Hit_ID=Q6T5H5; Match level="QueryCoverage=91%, HitCoverage=41%, E-value=5e-52, Identity=89%"; Hit description=Alpha- expansin 3
  Pfam annotation: Domain name=Pollen_allerg_1; Domain location=19-96; Score=184.1; E_value=3.4e-52; Accession=PF01357.11; Description =Pollen allergen
MGKKKNLSQKVPCRRRGGIRFTINGHSYFNLVLITNVGGAGDVHGVAIKGSRTGWMPMSRNWGQNWQSNNYLNGQSLSFKVTTSDGRTAVSYNVAPAGWSFGQTYTGAQFR

SEQ ID NO: 135821 - protein, 335 aa, Glycine max
  Coding DNA Sequence Number=SeqID_19043
  Homolog annotation: Hit_ID=Q5NRP5; Match level="QueryCoverage=76%, HitCoverage=80%, E-value=2e-80, Identity=57%"; Hit description =Putative mTERF domain containing protein, identical
  Pfam annotation: Domain name=mTERF; Domain location=6-275; Score =133.9; E_value=4.3e-37; Accession=PF02536.5; Description=mTERF
  Subcellular localization annotation: CTP_CleavageSite=46; ConfidenceScore=5.16e-01
MPTLKLSLFVSLPKPLNLRPQFSRHPINPNPTTSDRGLVFHEKVLYLKALKVNPDKAFRLNPTLRSSPLSTLKSVTRSLSSLGIPRASMGRILDMLPVLLTCDPYFQFYPLLDFLLHEVPIPYHDIHLSILRCPRLLVSSVNNRLRPTLHFLRKLGFNGPHSLTCQTTLLLVSSVEDTLLPKIEFLKGLGFTHEEVANMVVRSPGLLTLSVEKNLRPKVEFFLREMNGDVAELKRFPQYFSFSLERRIKPRYGMLRRVGVSMDLEDMLKQLQFWRQPRDLLRMQATAIAAAFVRNFLQCQGLRHDYDCNVQRDSCDSKEMRFWFMENKELDLGAL

SEQ ID NO: 135822 - protein, 174 aa, Glycine max
  Coding DNA Sequence Number=SeqID_19044
  Gene Ontology: Mol. function=RNA-directed DNA polymerase activity; Biological process=RNA-dependent DNA replication
MEYAASEVEGSWCFPSFCKKDKLTTLLVTERYRSSSTLGLGRLKTGGVTMVLLKFLDFLDVGRSVHLKYGCALIGVGFNCDHEPQELASTDPKNAFFRVEVHAVFTDFSEYFFQAKGHDPVAKVDISSDECRFLFIWGMYPNLMMPKNQELSKFQRIRSQKASRIKFQRIKIQE

SEQ ID NO: 135823 - protein, 141 aa, Glycine max
  Coding DNA Sequence Number=SeqID_19045
MGETHEIPHQNLADFEPCLEYATEGQAVSGIPLQNTLEGPQFCPQPQPLYEKMVGYTPSSFADFVFTGERIKVDLERGKSNHPALMNAKTGANEEGENDGETHAATAIPTWKIPHQLNNIITQPISALLITHHLVIHKGHP

SEQ ID NO: 135824 - protein, 229 aa, Glycine max
  Coding DNA Sequence Number=SeqID_19046
  Gene Ontology: Mol. function=DNA binding; Cellular component =membrane; Biological process=regulation of transcription, DNA -dependent
  Homolog annotation: Hit_ID=Q08859; Match level="QueryCoverage=94%, HitCoverage=52%, E-value=2e-75, Identity=62%"; Hit description =Fimbrial adhesin
  Pfam annotation: Domain name=EAL; Domain location=1-205; Score=104.9; E_value=2.4e-28; Accession=PF00563.11; Description=EAL domain
GIDILPRWGKDGVVLPPGEFLPHIHSEYAWLLLTAFVLQEAVQNINRYQGEFYFSVNIPPCIAYHDNLARMMETAWQQLQNPQWANRLVLEFAETVDLQQQGKAVENMSNIQQQGFRIFLDDCFSHSSVMFPVRTARFSGYKLDMSIVNDFQRDPHALVLIKSLVYYCQLTQNRCIAEGVDSLEKFNQLKALGVDRFQGYLFSPPVTREHLGEIISRFLPDHATCRLAG

SEQ ID NO: 135825 - protein, 78 aa, Glycine max
  Coding DNA Sequence Number=SeqID_19047
  Gene Ontology: Mol. function=N-acetyltransferase activity; Biological process=metabolic process
  Homolog annotation: Hit_ID=P39274; Match level="QueryCoverage=91%, HitCoverage=80%, E-value=1e-30, Identity=87%"; Hit description =Hypothetical protein yjdJ
MTPRENQVAEIVFVPTGEHLSIIEHTDVDPSLKGQGVGKQLVAKVVEKMRQEQRKIIPLCPFAKHEFDNTREYDDIRA

SEQ ID NO: 135826 - protein, 79 aa, Glycine max
  Coding DNA Sequence Number=SeqID_19048
MRKIEKAIYFGIDHPELLLQSTSSERTSRFHDGDLKGIETPAKPRDDVKQERGREGEILRVLANLKKNSGGKSLLTCIY

SEQ ID NO: 135827 - protein, 81 aa, Glycine max
  Coding DNA Sequence Number=SeqID_19049
NKYLVLVATCPFAGERGRGSRVRFPKEERCTESPPTFICGKRRKNRRKPVKMKILSLEVVFTFEEGIGTSHVCLKGQHPIF

SEQ ID NO: 135828 - protein, 239 aa, Glycine max
  Coding DNA Sequence Number=SeqID_19050
  Homolog annotation: Hit_ID=Q1S0F5; Match level="QueryCoverage=67%, HitCoverage=42%, E-value=2e-14, Identity=30%"; Hit description=IMP dehydrogenase/GMP reductase
MARVAKVVKILVQELDHVKQNRNGLVKIPRKRLEEKAKTLADQGEWASFIDILALLIFGVILFPNVEGLVDLAAINAFLAYHHSKESSVIAILADFYDTTFFAKKVGPPIHCKEGRAGVLSSCEGFPNVPLMGTRDCINYNPVLAIRQLGYPMRGAPSKESIKPFIARGFSDPNTRVLQGAAREEEVETPEESEEVQTLKAELERAQAIKEKFKSTAIKFRKEYDELRDVNMATTEALE

SEQ ID NO: 135829 - protein, 77 aa, Glycine max
  Coding DNA Sequence Number=SeqID_19051
MGAHLGLPGGSNKRWCLLVEATQLAWDSLEISEKNCFREENPRRSTFITFPRRFRERFREDSSPFFIVLRRSSVFNR

SEQ ID NO: 135830 - protein, 63 aa, Glycine max
  Coding DNA Sequence Number=SeqID_19052
  Subcellular localization annotation: CTP_CleavageSite=50; ConfidenceScore=5.05e-01
MCTYAIFDSQSALSMHVCKFSKGNACDVAFLGKTNFPNVCLRRNGPEEACLKEVQEGQGDRRN

SEQ ID NO: 135831 - protein, 152 aa, Glycine max
  Coding DNA Sequence Number=SeqID_19053
MERREKGVWGGDKRGGGLMVEKLREGTLVGKKGGPSTPPPTWRLEQNGGDKVQEFLNFSTSTLSARKLCANLWEVLPHQQQQQQQTPLVKMNKLGTTHRRRNRRRRSQHPRDTGSEVNNNNNQLADPPDNPSDSDQNYAVDLPFVPYIKDFY

SEQ ID NO: 135832 - protein, 335 aa, Glycine max
  Coding DNA Sequence Number=SeqID_19054
  Homolog annotation: Hit_ID=Q5SMS6; Match level="QueryCoverage=84%, HitCoverage=69%, E-value=4e-61, Identity=39%"; Hit description =Fimbriata-like
  Pfam annotation: Domain name=Kelch_2; Domain location=247-295; Score =25.8; E_value=0.00016; Accession=PF07646.5; Description=Kelch motif
METTCFNPRMRFRSIVVGLPFSYLGIPIFVGKLLFFLQWGDMIKELDGWIKKFVWVGNPDQRKIFTVKLHSVCSPLSEGGLDESTGYAYYPTLRKWYGIELPLIETSNWFIASSYGLVCFMNNDNKSKLRMCNPITKSYRNLDEPPALESSDYNALAMPVNRKSHSYNVAIVKSKQIPEDFVQWGISIHIYDSKNETWMTTSTEVLMGWRGVGGVSLESHHALLAYNISYCSSQTTLRTSFIDVPYSLTCGRLMNMNEKLVMVGGIDKHDRPCIIKGVGIWVLNDRNWEKIVRMPHKYFQGFNLGSLKFLHRLFSIQAVAAIDTYVSEFLLLCSS

SEQ ID NO: 135833 - protein, 1474 aa, Glycine max
  Coding DNA Sequence Number=SeqID_19055
  Gene Ontology: Mol. function=protein binding; Biological process =apoptosis
  Homolog annotation: Hit_ID=P29060; Match level="QueryCoverage=21%, HitCoverage=92%, E-value=3e-99, Identity=56%"; Hit description =Acidic endochitinase precursor
  Pfam annotation: Domain name=BAG; Domain location=593-670; Score =59.8; E_value=8.7e-15; Accession=PF02179.6; Description=BAG domain
  Pfam annotation: Domain name=Glyco_hydro_18; Domain location=1155 -1463; Score=127.0; E_value=5.1e-35; Accession=PF00704.18; Description=Glycosyl hydrolases family 18
  Pfam annotation: Domain name=IQ; Domain location=567-587; Score=21.5; E_value=0.0029; Accession=PF00612.17; Description=IQ calmodulin -binding motif
  Pfam module annotation: Pfam domain module=BAG::Glyco_hydro_18::IQ; Domain location=593-670::1155-1463::567-587
MMPAYRSMDSYPCQRNQIPFPHYYHPGIEAIPPQMKLDPSKPPFSYDQHWPYAGNFGHPTSPHFCCGHNNFPCHYSYMPSYPHAPSPMYYSGTCPSYSEPYFVPYSPQPHYTMELPRYENDKCMPRELHCSGSANHPCNQKEGRSVKIEEHELDGGKKENDALVPIQLKNYPYPLVWIPQEYTSNKQLKNPSTMEVREQNKPSSLENSNVDAQPTQEPIVWNGWLPFNIKGARNMIHDGYGTRNQKQESGNNRGESENGKIDQKHQSEQKRSEFPFPIFWLPYYNKQEESGETKNQEKNISSPKIVEEVPHTFKFVPVKSHVDEGGRNRTGSNQADQSTNTNASSDAVEKVNNARSIPVKQIESHEGKNVSLDQMEENVTQKDSCTGDKKRQSTSSPKGSKLPPVCLRVDPLPRKKNGHGSSSSRSPSPPSSKGNSQATTGETFKTPVSGTHDKAQPNLNHQNAPNTSEKVKPKENTIPVSECMTNENKGVDCRDGCQSQMKVNIPSKGLKGARETCPDDDDYKTEDKKAEKGAENMMEETTESREEKDSSTRTDAGRKDGRVLSDADAAVLIQAAYRSYLVRKWEPLKKLKQIDEVRKEVTRVQGRVQAFERSPELQNDDKQKIAIEETIMKLLLKLDTILGLHPSFREIRKSLARELIILQERLDSIMAKKPQQQMPDVQEHVEITPMNMQSEEHVQKQQEEKVAVPEDSAEGTRDDVKGPCANDGGSESQSPVDPPSNEGAESVALPNGSDNEDTSQVVTSDALNSSSDLSESDKMAVESEAKSEVKDNPIAEDIPIEVDKLDKTVWEELPVGVIDEDINDVSIEKEEHDDIRSGSLPAMVNDSAQEGLNSESYAMMELPLGLHEEHERDNEMNISNGETRSENEIFIEELPVGLHDEDTTISKDKRDGQAKPKTYKEVRLAQEGECNADEETSSSTDDTANETQLEQQQKLKEQEEVHYSRESDGWVKIEYPEEGELNGDAPMDIRVECKSGEEAGTDTKLLPLTTQVSDNEPENEDVFSEANYVNNKLTEPMEFVPSNDTQKEETPEMVAEEAIIPDDKDTENLAKEKTEVSAEPPPALQDRGLNGDSKLLEENEKLREMMKKLLEAGNEQLSVISDLTVRVKDLEKKLARRRTFVFLVFTTLFDASVAGVISIYWGQNGAEDTLANTCNGGNYAIVNIAFLSSFGNGNTPELNLAGHCDATNNGCSFLSGQIKTCQNKGIKVMLSIGGNYGNHNLSSVDEASLNLLIMWECLDLINEAKILKIGVLCLEKLYNDSRMQLITNESMRLDGLRKKGKFAEHLWNNFLGGQSSTRPLGNAVLDGIDFAIVTGSTQHWDELAKAISEYGKQKKIYLSAAPQCPFPDKWLSSAIETGHFDYIWVQFYNNPPCQYNGNTENLKTYWNKWIGTKAGQVFLGLPAAPEAAGSGYISPNVLISEVLPFINGSSKYGGVMIWSKFYDKGYSTAIKAHV

SEQ ID NO: 135834 - protein, 134 aa, Glycine max
  Coding DNA Sequence Number=SeqID_19056
MLEDVLVMGNIRVLGKTYELEKIHFVRWRSPWFAWKNEMVVLHFMSIVQSLKPRPGVEDEWVWKRNPREGYISTKAPSKVVSFVWRLLLLDAIQTKMKFEEEEPPNPAGQLSLRPLWRSGANFDPSIPAMQVCI

SEQ ID NO: 135835 - protein, 1395 aa, Glycine max
  Coding DNA Sequence Number=SeqID_19057
  Gene Ontology: Mol. function=RNA-directed DNA polymerase activity; Cellular component=chromatin; Biological process=chromatin assembly or disassembly
  Pfam annotation: Domain name=Chromo; Domain location=1286-1334; Score= 28.3; E_value=2.7e-05; Accession=PF00385.14; Description='chromo' (CHRromatin Organisation MOdifier
  Pfam annotation: Domain name=RVP_2; Domain location=211-333; Score= -38.8; E_value=0.0011; Accession=PF08284.2; Description=Retroviral aspartyl protease
  Pfam annotation: Domain name=RnaseH; Domain location=726-843; Score= -22.1; E_value=0.0066; Accession=PF00075.14; Description=RNase H
  Pfam annotation: Domain name=rve; Domain location=979-1135; Score =98.1; E_value=2.7e-26; Accession=PF00665.16; Description=Integrase core domain
  Pfam annotation: Domain name=zf-H2C2; Domain location=920-961; Score =19.0; E_value=0.0011; Accession=PF09337.1; Description=His(2)-Cys(2) zinc finger
  Pfam module annotation: Pfam domain module=Chromo::RVP_2::RVT _1::Retrotrans_gag::RnaseH::rve::zf-H2C2; Domain location=1286 -1334::211-333::465-634::5-74::726-843::979-1135::920-961
  Subcellular localization annotation: CTP_CleavageSite=35; ConfidenceScore=5.11e-01
MTTNGQLTSWPAFIQALQTRFAPSHYDDPTGSLFKLTQRGSVTRYLSEFEELANRIVSLPPQFLLSCFISGLTPEIRREVQSLQPLTLVQAAGLARLQEEKLLDTRSSFRNRAPPVLSVPPPRQNSTPALLQAPSSPATSARPPPVKRLSPAEIASRRERGLCFTCEEKYHRGHRCASRVFLLVAAEDDHPDPLIEDLDPGPDPPDSPNPTAAQISFNSLSGNLAPETLRLLGLASGHHVVVLVDGGSTHNFIQEELVQSIGLPTQTTTPLRVLVGNGQHLACSSWCPRVTLTIQDLTCDVDLYVLPIAGANIVLGVQWLKTLGPVLTDYSLMTMKFFYDQRLIELRDDTDLTINMLTPPQLCRFLKHNEHASCFHIAVLTEAVPDEPSQLLDPQIHALIDHFGPLFQTPTSLPPARITDHHIHLFPQATPVNVRPYRYPHYQKQEIELQVESMLQKGLIRPSTSPFSSPVLLVRKHDQSWRFCVDYRALNAITIRDRFPIPTIDELLDELGHACWFSKLDLLQGYHQIRMHSSDIAKTAFRTHHGHYEFKVMPFGLCNAPSTFQATMNMLFRPFLRRFLIVFFDDILIYSITFTDHVLHLQQAFQVLLENQFVLKLSKCTFAQTEVEYLGHVVSQRGVEPVSSKVDVVRQWPLPQSAKALRSFLGLAGFYRRFIKGYATIAAPLVAATITEPFQWTPSAQEAFDQLKQALSEAPVLTLPDFQMPFTVETDASGIGMGAVLSQKGHLIAYFSKQFPPKLRHSSTYVRELFAVTSAVKQWRQYLLGHKFTIITDHRSLKELLTQVVQTPEQHTYLARLMGYDFQIQFRSGATNQAADALSRLSEEDSSLSLILSVPCLTFMEELRKQLAQNESYQSKLQDIQATPANFPDFSISNNLILRKGRIWLPPHLPLLPTLLTEYHATPTGGHLGVAKTIARLTDNFYWDGLRDDVARFVSTCLDCQHSKYETKRAAGLLCPLPIPHRPWEDLSLDFITGLPAFQGNTTILVVVDRFSKGIHLGMLPTSHTAYTVAALFMNIVGKIHGLPRSMISDRDPLFLSRFWQDLFRLSGTHLRMSSSYHPQSDGQTEALNRAIEQYLRAFVHRRPSSWGKLLLWVEWSHNTSWNAATGSTPYEITFGKKPFNYPAYLAGDSKIDVVDDMITNREDTFRLIRKKLLKAQELMKKYADAKRRHVEYQVGDWVMVKLRPHRQNSAKPSSSSSSGKLQKRFYGPFEITERIGPVAYCLKLPEGARIHPVFHCSILKPFKGSPPSADSVCLPDQFSHGQLIVSPLAILDYRYNSDNPDSPWEVLVQWEGLDPDETSWESWTQLSRDYHLEGKVNFQGPWDDRQRGVQQIMNEILSFEFLSFPFSGGTGPRNQPNSYLTCDHKQEEKALTAF

SEQ ID NO: 135836 - protein, 238 aa, Glycine max
  Coding DNA Sequence Number=SeqID_19058
  Gene Ontology: Mol. function=hydrolase activity, hydrolyzing O -glycosyl compounds; Cellular component=vacuole; Biological process =polysaccharide catabolic process
  Homolog annotation: Hit_ID=P29060; Match level="QueryCoverage=61%, HitCoverage=50%, E-value=8e-56, Identity=65%"; Hit description =Acidic endochitinase precursor
  Pfam annotation: Domain name=Glyco_hydro_18; Domain location=1-146; Score=-55.5; E_value=0.064; Accession=PF00704.18; Description =Glycosyl hydrolases family 18
MESIVGNERHIDHRHKPSSTQQWDELAKAISEYGKQKKIYLSAAPQCPFPDKWLSSAIETGHFDYIWVQFYNNPPCQYNGNTENLKTYWNKWIGTKAGQVFLGLPAAPEAAGSGYISPNVLISEVLPFINGSSKYGGVMIWSKFYDKGYSTAIKAHGVKVITNTYSNSKLEPSQEGEAISKKASNGKPNGLGMKLKWGGHLCPFVSESTISHGIESPEGSKKIRREILKIATHERIYG

SEQ ID NO: 135837 - protein, 100 aa, Glycine max
  Coding DNA Sequence Number=SeqID_19059
MNPYYGNGILPPPAPEGQAIHKKAKNGNIDDLWMNMKWGGTIILISDLEKSKKYNIDESIKGMQRIGFYCHVKFLDIENIEVLSLLAVMTLIFNGGAILY

SEQ ID NO: 135838 - protein, 428 aa, Glycine max
  Coding DNA Sequence Number=SeqID_19060
  Gene Ontology: Biological process=biosynthetic process
VDDRVNGYLFPKDNIRVLRQILLEVISKGKISPLACNIASIGRSTAKNLMASEAIDGYASLLQNILRLPSEVSPPKAVSEIAPNFKEQWQWHLFEAFPNMTYQNRALRSNTFLDKYEHQLNHSQKNRSTTAVSANDVFVYSLWEEEKYTQLAITKKRREDEELKDRMEQSHGTWEDVYKSAKRADRSKNDLHERDEGELERTGQPLCIYEPYFGEGSWPFLHKKSLYRGIGLSGKGRRPGRDDVDAPSRLPLLNNGYYRDLLSDYGAFFAIANKIDRLHRNAWIGFQSWRATARKASLSIIAENALLDAIQSKRFAFSEAMRGMYGVKGDADSLPPMPVDGDTWSVMQSWAMPTRSFMEFVMFSRMFVDALDAQMYDEHHLTGHCSLSLSKSIPVVGRLLAKRRYGEGHYTQPCPFAYAKRLFLDSNP

SEQ ID NO: 135839 - protein, 95 aa, Glycine max
  Coding DNA Sequence Number=SeqID_19061
MSGFTRNSPQISASPHQLDLAPYASEPYNAQWNAPGLLRDKHTLRSSRILREMEDTGIGVNSTGFLAAKFTSWLMFLVCAKGGVCHGKCGRQTLW

SEQ ID NO: 135840 - protein, 117 aa, Glycine max
  Coding DNA Sequence Number=SeqID_19062
  Subcellular localization annotation: CTP_CleavageSite=62; ConfidenceScore=5.01e-01
MPLVIPSPKGSLGKLPPRNALSPEPERCPTIKTISHKWESSISLVLTVLAFFNSKRRTYTIRGREASEPSVPLCSTKPLRPFLTADSIAADSFAYYSTQKENCGFSMVEQKRDRASN

SEQ ID NO: 135841 - protein, 173 aa, Glycine max
  Coding DNA Sequence Number=SeqID_19063
  Gene Ontology: Mol. function=amino acid transporter activity; Cellular component=membrane; Biological process=amino acid transport
  Homolog annotation: Hit_ID=Q2P3W3; Match level="QueryCoverage=78%, HitCoverage=28%, E-value=4e-44, Identity=67%"; Hit description =Cationic amino acid transporter
MDVELAEQAEEIASPADRHRRGGDAVFEHQHPADEPGRELAEGGVGVGVGAAGDRHHRGELGIGQRAESAADGGQHEGQHDGRAGVVGGGLAGDDEDAAADHRADTQGGQAPGAEVAAQAQAVGVFMGGMRVLGGPHPGRSAGRAASSPRTGASAPRTPARTGTGRWPRPAGR

SEQ ID NO: 135842 - protein, 287 aa, Glycine max
  Coding DNA Sequence Number=SeqID_19064
  Gene Ontology: Mol. function=amino acid transporter activity; Cellular component=membrane; Biological process=amino acid transport
  Homolog annotation: Hit_ID=Q2P3W3; Match level="QueryCoverage=99%, HitCoverage=60%, E-value=1e-133, Identity=80%"; Hit description =Cationic amino acid transporter
  Pfam annotation: Domain name=AA_permease; Domain location=1-287; Score=-135.2; E_value=0.038; Accession=PF00324.11; Description=Amino acid permease
MAMVVLKTGLILLVIVVGWKYVDTSNWTPFIPANEGPGKYGMEGVLRGAAMVFFAYIGFEAVSVAAQESKNPQRDMPFGMMLSLVICTVLYIAMASVMTGLVPYQLLGTDEPVVTAVAAHPQLGWLRWVVEVGALVGLSSVVLVMIIGQPRIFMIMGRDGLLPPVFTKIHPKYRTPHINTVITGIGIALLAALFPLDILGELTSMGTLIAFAAVCAGVLILRRTQPDLPRPFRMPMAWLICSLGVLSCLALLSAMTMHNWMLMGVWTFVGFVIYFCYGFRHSRLRGK

SEQ ID NO: 135843 - protein, 80 aa, Glycine max
  Coding DNA Sequence Number=SeqID_19065
MAKGCGMTIVCLCTSSDSIVSGWRKGSPPLDDKRRRMTIICLCVPSDSIVSGWRKADKSEALAPMYPQFVMRNSDLRSSG

SEQ ID NO: 135844 - protein, 241 aa, Glycine max
  Coding DNA Sequence Number=SeqID_19066
  Gene Ontology: Cellular component=cytoskeleton
  Homolog annotation: Hit_ID=Q8S8M5; Match level="QueryCoverage=82%, HitCoverage=62%, E-value=5e-53, Identity=56%"; Hit description =Protein ABIL1
MALAEVDGFSYDGQIDKAISKKVLDNLKDYAVRALVNAVDHLGTVAYKLTDLLEQQTLDVSTMDLKVATINQKLLTCQIYTDKEGLRQQQLLAFIPRHHKHYILPSRPHCFYVHLELDSVNKKVHFSPHIQIDARQNPFQTRTRFQSSGTPAAKTLSWHLASETKSTLKGSSHASPSPNIENPKFSGKASGVFHLLDNEENTWMKSSPAQIHFPNGVSTSSTPMHTLGGTRKVKLFCLALE

SEQ ID NO: 135845 - protein, 379 aa, Glycine max
  Coding DNA Sequence Number=SeqID_19067
  Gene Ontology: Cellular component=chloroplast
  Homolog annotation: Hit_ID=Q84W65; Match level="QueryCoverage=98%, HitCoverage=98%, E-value=1e-95, Identity=54%"; Hit description=SufE -like protein, chloroplast precursor
  Pfam annotation: Domain name=BolA; Domain location=297-377; Score =146.9; E_value=5.5e-41; Accession=PF01722.8; Description=BolA-like protein
  Pfam annotation: Domain name=SufE; Domain location=83-207; Score =135.5; E_value=1.5e-37; Accession=PF02657.6; Description=Fe-S metabolism associated domain
  Pfam module annotation: Pfam domain module=BolA::SufE; Domain location=297-377::83-207
  Subcellular localization annotation: CTP_CleavageSite=54; ConfidenceScore=5.89e-01
MATNSITSSSFRLVTTRIPLSLFRKTPPLLSFPTKPFFSKPITFQRLQPTPPPQSSSSSSSSSSSTSASLQPIEDLPPKLQEIVHLFQSVPEPKAKYEQLLFYGKNLKPLEPQFKTNDNKVQGCVSQVWVRAYLDPNRNVVYEADSDSGLTKGLAALLVQGLSGRPVNEIIRVTPDFATLLGLQQSLTPSRNNGFLNMLKLMQRKALLLYVEAEKGGGEFNSETDVIVENSASGGESSDLGGDSEIASVPEFQGDENVELGGRGKRGIVENSSGGESSEIVDENIELWGRGKRIREKLEKELEPVELEVEDVSYQHAGHAGVRGSDGETHFNVRVVSKEFEGKSLVKRHRLIYGLLQEELDAGLHALSIVAKTPAEVEG

SEQ ID NO: 135846 - protein, 305 aa, Glycine max
  Coding DNA Sequence Number=SeqID_19068
  Gene Ontology: Mol. function=transition metal ion binding; Cellular component=chromosome; Biological process=DNA topological change
  Homolog annotation: Hit_ID=Q234R7; Match level="QueryCoverage=72%, HitCoverage=5%, E-value=2e-09, Identity=23%"; Hit description=Viral A-type inclusion protein repeat containing protein
MAFQDHIFKLNKENSSLKQNLEATNAALRVSRIEGSGASTNGTYTVKGSSDQSPNRQHKLNTQRKNRYAINNGTMSALESDAIQSEMEIKHSNLQRNHQELADLVDGYTTVAVQHAPEMQKLRLELEQERNQLANIQLKFQEEQRLNKSFQEELNILKLERDKASKEMNKIHTELNEKVSEIKHLQLELTRQENEGGEAVDSLKRLIKTLEKENTTLKMERNEIEAELENSRKSLTDKMMSDASHIQKKDSSILGDMPDHSKRFPGKEEMERSLQKLSKDLKETQQDRDKVVQELKRLKQHLLEK

SEQ ID NO: 135847 - protein, 98 aa, Glycine max
  Coding DNA Sequence Number=SeqID_19069
MWGTIANFKENLNKIALDVHDDDDDEIFRAYGAGSPANGDNSVVSDRRSSRGSTRSKLGIRSPLANGIDHASLHELGTRVNFLSASELNKHVSGSAMN

SEQ ID NO: 135848 - protein, 67 aa, Glycine max
  Coding DNA Sequence Number=SeqID_19070
MKKEAAKKMKRRMNWKIQRREYDALEESVVAPHIMEEEDGGTLVEDEGRKREEEREFCDLQKVYVTK

SEQ ID NO: 135849 - protein, 232 aa, Glycine max
  Coding DNA Sequence Number=SeqID_19071
  Gene Ontology: Mol. function=methyltransferase activity; Biological process=metabolic process
  Homolog annotation: Hit_ID=Q1SW51; Match level="QueryCoverage=82%, HitCoverage=41%, E-value=1e-23, Identity=31%"; Hit description =Generic methyltransferase
MVCQSLNPEVPNGNQNEVLMKTVEMDFLSRRQRLINKMKAIISKMVVSTKKKQSDEPADYFLREEIRKYVRIKPNRLGKQNFMGENASFTSIGHTCFAMKEELEEYMDYDVGEICNDDWKLAQKLMVHGCDPLPRRRCFSRSPKLYKQPFPVNESLWKLPDDRNVRWSQYQCKNFACLAGNATRKGFFKGVDCFNLTNHEMPRWVSLEADSDRTADFPYRIGLKCWNWDFCC

SEQ ID NO: 135850 - protein, 50 aa, Glycine max
  Coding DNA Sequence Number=SeqID_19072
MYPTPNLQATFGFDPQTATPSDEFAGKMSRGTENATRNGELPRPKGELQL

SEQ ID NO: 135851 - protein, 70 aa, Glycine max
  Coding DNA Sequence Number=SeqID_19073
MLICAAATGYTEYYFDAQSGKVCRWLKAVQLKLDGFEILDAILQEARQSKSQYQYLMIEFITQSLFFMAV

SEQ ID NO: 135852 - protein, 94 aa, Glycine max
  Coding DNA Sequence Number=SeqID_19074
MTKYSPILQHSEWRSWPDPLSYKVLLLQQRAVAKSGVHVSQREELLSSLSLYFKTDFEFERGGRDDKGIGQRHLSSHRRSGPNLIKGCLAYQKE

SEQ ID NO: 135853 - protein, 88 aa, Glycine max
  Coding DNA Sequence Number=SeqID_19075
  Gene Ontology: Mol. function=ribonuclease H activity; Biological process=DNA integration
MSHERLYQRWVKNAFDKKVRPHKLNKWDLVLKKVSQAKKDNRGKWDPNYEGPFIVKKAFSGGALVLASMDDEELPSPVNTDIVKRYYA

SEQ ID NO: 135854 - protein, 117 aa, Glycine max
  Coding DNA Sequence Number=SeqID_19076
  Gene Ontology: Mol. function=nucleotide binding; Cellular component =membrane; Biological process=small GTPase mediated signal transduction
  Homolog annotation: Hit_ID=Q40523; Match level="QueryCoverage=71%, HitCoverage=38%, E-value=2e-19, Identity=65%"; Hit description=Ras -related protein Rab11A
MFEQPEQDMPHAINVTPAEQEAIGRLEAMGFDRASVIEDAQNLAEREALSFLETSALEAFNVEKAFQTILFDIYQIMSKKALAAQGAASTTSLPHGTTINVSNMSGSVEKKSACCSN

SEQ ID NO: 135855 - protein, 73 aa, Glycine max
  Coding DNA Sequence Number=SeqID_19077
MLLSNNIIHICVRVVMLVCMIRTCLFAAAWVKSCPGMHSSCVIASLSGCACTVGHPVISEGGPGTDKRKLLAP

SEQ ID NO: 135856 - protein, 82 aa, Glycine max
  Coding DNA Sequence Number=SeqID_19078
MELSNGKGPSRVNLGFVEPWTKDVFALGFVTSMELCRGLPRTGLGFCKPLWISKREGTGDTVVSISGTHQRRTLGFASPLED

SEQ ID NO: 135857 - protein, 90 aa, Glycine max
  Coding DNA Sequence Number=SeqID_19079
MEVTILQKLGQKMDRVTSLLRLLPNTFRIVDVLLTSSFTLTKMSWTIKEHALRCPYRTRARARVMGEVEEVQEQMKANMETDVPSFSSIF

SEQ ID NO: 135858 - protein, 95 aa, Glycine max
  Coding DNA Sequence Number=SeqID_19080
MESPQGRANRMLKSDFPKKGMGKEKEVKMEKSGGKQNNFGSMKEREWKIFRPDKFSARLPFSTGDIPPHMNKEEKTETPSFLSKKHYPRENPIGP

SEQ ID NO: 135859 - protein, 222 aa, Glycine max
  Coding DNA Sequence Number=SeqID_19081
MEAWGSVKDFPTQSEYEGHVKMLKLIESAHWNLKRLIQNSMGDLCKYWDAMTNLITLQHTKIKASFDKSIHFVGYNHNVQSYKRLHIFISSLADIGSNEPYVDMPMQQEFDVILKCFAKVDIVGKVTIKSKLHEIAYPDMTSMCLPFNKVKTKGSQKGHADDHYGYHPIAVLLDMGEDAWPIVRNNLLKKLGLWRDEYAIIFGSYECYNDIKRSLRVDKLSM

SEQ ID NO: 135860 - protein, 255 aa, Glycine max
  Coding DNA Sequence Number=SeqID_19082
  Subcellular localization annotation: CTP_CleavageSite=70; ConfidenceScore=5.26e-01
HPRKILRKDLTTLSQVLSVLSYSNLAPTSHTSDLTMDMNVGALISGQITSMAQCNSSRLGFPALITSLCKSNGVASDSLVFECLSPVSNLAYIRKNCWNPDDLTVTIRRARRARTRPTEAPSTSTAPHPTRTLAAPSASTPMVAPPDSISVEQFNEWVAWPGTQSSLHREDEGPTAQAAQEAVATSEKSFEATSEPLEPVADTNSIQQAADPSTPEDQTTPVLSLNTSPTATPVLHLTDEEDVQTQDTQDRSQDF

SEQ ID NO: 135861 - protein, 248 aa, Glycine max
  Coding DNA Sequence Number=SeqID_19083
  Gene Ontology: Mol. function=protein binding; Cellular component =integral to membrane; Biological process=protein amino acid phosphorylation
  Homolog annotation: Hit_ID=Q1T2W0; Match level="QueryCoverage=99%, HitCoverage=52%, E-value=1e-48, Identity=43%"; Hit description =Leucine-rich repeat; Leucine-rich repeat, cysteine-containing type
  Pfam annotation: Domain name=LRR_1; Domain location=109-130; Score =12.6; E_value=1.3; Accession=PF00560.23; Description=Leucine Rich Repeat
  Pfam annotation: Domain name=LRR_1; Domain location=12-34; Score =11.7; E_value=1.9; Accession=PF00560.23; Description=Leucine Rich Repeat
  Pfam annotation: Domain name=LRR_1; Domain location=135-155; Score =6.0; E_value=21; Accession=PF00560.23; Description=Leucine Rich Repeat
  Pfam annotation: Domain name=LRR_1; Domain location=159-178; Score =16.6; E_value=0.09; Accession=PF00560.23; Description=Leucine Rich Repeat
  Pfam annotation: Domain name=LRR_1; Domain location=180-200; Score =1.2; E_value=1.7e+02; Accession=PF00560.23; Description=Leucine Rich Repeat
  Pfam annotation: Domain name=LRR_1; Domain location=202-224; Score =6.7; E_value=16; Accession=PF00560.23; Description=Leucine Rich Repeat
  Pfam annotation: Domain name=LRR_1; Domain location=226-246; Score =2.1; E_value=1.2e+02; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=109-130::12-34::135-155::159- 178::180-200::202-224::226-246
DEWCSVLMPLRDLQELSMSWCGLSRPLDPSLTRLENLSVIVLDGNKYYHPQCQKTFLHFKNIIILSLTNCGSNGTFPHKIFNIGTLSVIDTSWNNNLHGFLPEFPSSRSLYSLSVSNTNLSGEIPSFIALSTLPSLQAIQLSENEFSQLDEMVNLTSSRLESLDISNNNLSGRIPSFLFTSQSIELFHNQFSQLDKIRNVSRLYSLDLSSNDQFGPFSTSILQLSTLFVLHFSSNQFNGSVQLNKLLE

SEQ ID NO: 135862 - protein, 361 aa, Glycine max
  Coding DNA Sequence Number=SeqID_19084
  Homolog annotation: Hit_ID=Q8D1N4; Match level="QueryCoverage=44%, HitCoverage=29%, E-value=2e-67, Identity=77%"; Hit description =Putative sugar kinase
  Pfam annotation: Domain name=DUF548; Domain location=1-62; Score= -111.9; E_value=0.035; Accession=PF04445.4; Description=Protein of unknown function (DUF548)
MRVFQSLVGSDDDADGLLEPARRLATKRVVVKRPDYAPPLADVPAHAATLTKSHRFDIYMPLQAQAASKIASTSTIEVVASMFSGSISFCTPVAIVNCAACAMAECGFSVTAIIVTPLACSVGSRRVSSSELPPREIRISRSSARRKPRSPCAAPVASSRPAASAAAARCARRGARPAAPAPDCRFANLAPPAAIPAASRLLLHQPAVFHVVVVQLVEYPVFAVVVAFYLVGLRRDRLADAAHGAHRLRQGVEHARRHGAHHRAAEQHRFALLRQQHGAAGGVGVLLHEDRVLGAAAAGHNGVDAVAAVVHGFDDVAGAERDGLNGGQVVQRHVLRRARQLQPGQDAGQRRVGARRAVAVE

SEQ ID NO: 135863 - protein, 153 aa, Glycine max
  Coding DNA Sequence Number=SeqID_19085
  Gene Ontology: Mol. function=nucleoside-triphosphatase activity; Cellular component=integral to membrane; Biological process=transport
  Homolog annotation: Hit_ID=Q1SCH7; Match level="QueryCoverage=89%, HitCoverage=15%, E-value=2e-66, Identity=89%"; Hit description=ABC transporter, putative
  Pfam annotation: Domain name=ABC_tran; Domain location=11-138; Score =39.4; E_value=5.6e-11; Accession=PF00005.17; Description=ABC transporter
MFSNLPFSLYCSLLWESLTGREHLLFYGRLKNLKGSLLTQAVEESLMSLNLFHGGVADKQVGKYSGGMKRRLSVAISLIGDPRVIYMDEPSSGLDPASRKSLWNVVKRAKQNRAIILTTHSMEEAEALCDRLGIFVNGSLQCVGNAKEVTLLN

SEQ ID NO: 135864 - protein, 348 aa, Glycine max
  Coding DNA Sequence Number=SeqID_19086
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=P30855; Match level="QueryCoverage=57%, HitCoverage=16%, E-value=3e-33, Identity=41%"; Hit description =Sensor protein evgS precursor
  Pfam annotation: Domain name=HATPase_c; Domain location=2-91; Score =59.4; E_value=1.2e-14; Accession=PF02518.16; Description=Histidine kinase-, DNA gyrase B-, and HSP90-like ATPase
  Pfam annotation: Domain name=Hpt; Domain location=251-335; Score =48.9; E_value=1.7e-11; Accession=PF01627.13; Description=Hpt domain
  Pfam annotation: Domain name=Response_reg; Domain location=112-224; Score=100.9; E_value=3.7e-27; Accession=PF00072.14; Description =Response regulator receiver domain
  Pfam module annotation: Pfam domain module=HATPase_c::Hpt::Response _reg; Domain location=2-91::251-335::112-224
GNVAVYLSGEQNAAGELVLKIEVQDSGIGISEKEQQQLFQPFAQAAAGRQQTGCGLGLVISAQLLQQMQGSMRLHSEPGEGTLVHVTLPLPSRAPPPVTLCATGAPPAVPALHILVVDDHPANCLLLTRQLEALQHRVTAIGQPDLAPEIIATQQIDAVITDCHMPQMDGFTLTSMLRRRGYRHKIIGLTGSALAETRERGLAAGMDACLFKPLHPDQLNAALAQPATLPALLSLPQLRAMVHHDDDMVAKLLLRVCEENQRDLQQAQQELAQQQWPALARTLHRLAGAAQIIYAADINQLCQQLEQACVDARDGDLLSVGLAGLASRIDQLQLAIDCWLPFNHVVKQ

SEQ ID NO: 135865 - protein, 127 aa, Glycine max
  Coding DNA Sequence Number=SeqID_19087
  Gene Ontology: Mol. function=acetylesterase activity; Biological process=xylan catabolic process
  Homolog annotation: Hit_ID=Q83V97; Match level="QueryCoverage=96%, HitCoverage=38%, E-value=1e-17, Identity=38%"; Hit description =Pectin acetylesterase precursor
DKVSARPDFSALIYPVLSLKQGVTHPGTRAALYGKDLTAQQMAQLSQEDRVSAHTPPTFLVQALNDGTASPQNALDMFSALRQNKVNVELHLFQQGGHGFGTGQKQHLPVQNWLTLFHAWQSSLMKQ

SEQ ID NO: 135866 - protein, 133 aa, Glycine max
  Coding DNA Sequence Number=SeqID_19088
MEEKLNISSDARVMWLQTDKRTTQSFQHRKGCELISTLSEGYASDEKQVSSSQKAYEKPLSPQHIATDNFSSSLLSFSSFGVGTCICGNLSCKEFIPAYSSDKVHLVKFKKVAYVFAQFSKVPNKYLSEKMIK

SEQ ID NO: 135867 - protein, 89 aa, Glycine max
  Coding DNA Sequence Number=SeqID_19089
MNKDQKNWNEPYGEVSRSFDVRWKDELKHTLHLLDSNDNIHSIAYNQDMVNPTILTGWIELRDFYGLTRNHQVTMIHFGQSFLPDHLQR

SEQ ID NO: 135868 - protein, 220 aa, Glycine max
  Coding DNA Sequence Number=SeqID_19090
  Gene Ontology: Mol. function=nucleic acid binding; Cellular component= chromatin; Biological process=DNA integration
MLSFVAHKNIKLFKIDVKSEFLNGLIEAEVYVKQPPGFEDHTFPYHVFKLQKALYDLKQTPYAWYDKLSYFLLENDFMRGKKYTKELLKKFKMENAKPMKTPMHASNPLSKYESSYVGDIVERNSTNGGCRYLGPCLISWANKKQNSIALFTFEAEYVFAASCCSQLLWLKYQLKHYSSFENNILIYCDDTSAINLSKNPIQHSKVKYIEIRYHSIRDYV

SEQ ID NO: 135869 - protein, 82 aa, Glycine max
  Coding DNA Sequence Number=SeqID_19091
  Subcellular localization annotation: CTP_CleavageSite=14; ConfidenceScore=5.07e-01
MTDKNKSSPTRSTVVSPTSPQSSCGSNDINQDGNNNNHEVISVVVGCSHCLMYMMINKGEIKCPKCNNTNLIHFTNDNKKRG

SEQ ID NO: 135870 - protein, 129 aa, Glycine max
  Coding DNA Sequence Number=SeqID_19092
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q8PCZ9; Match level="QueryCoverage=64%, HitCoverage=53%, E-value=3e-24, Identity=69%"; Hit description=ATP synthase B chain
  Pfam annotation: Domain name=ATP-synt_B; Domain location=18-128; Score=18.6; E_value=0.00015; Accession=PF00430.9; Description=ATP synthase BB' CF(0)
  Pfam annotation: Domain name=ATP-synt_C; Domain location=15-64; Score= 4.3; E_value=0.0051; Accession=PF00137.12; Description=ATP synthase subunit C
  Pfam module annotation: Pfam domain module=ATP-synt_B::ATP-synt_C; Domain location=18-128::15-64
MYFAVLTNFAQIQSSTALAVGIMIGLAALGAGLGLAIMAGKFLESAARQPELIPVLQEARTKANEIIDQAHTRANQIVDAARNEAITEATRQNELAQAEIDAAANRAREDLRKQVSALAVTGAEELLKR

SEQ ID NO: 135871 - protein, 285 aa, Glycine max
  Coding DNA Sequence Number=SeqID_19093
  Homolog annotation: Hit_ID=Q9PE79; Match level="QueryCoverage=45%, HitCoverage=49%, E-value=1e-43, Identity=74%"; Hit description=ATP synthase, A chain
  Subcellular localization annotation: CTP_CleavageSite=38; ConfidenceScore=5.04e-01
MIQIRPAKASACARRVKLIFMRRIRPSSETGCISTRLSQTAVSAGQSLGDGASEGSRQRVGEGQQQADGDRDDERGVDQAGGDEHTDLQDRDQFRLAGGRLQELTSHDGQTQTGAQRGQADHDADGKGGGALNLREVGQDGEVHGYLQELKLLRVMKRMKAQVHDRQHHEDEGLQRDHQQVEQHPAEAEHTTGNGTEETGTTQHPDQQEHDFAAEHVAEQSHRQRDRLAQPLDDVEDQVERHHPLPNGAVRNSLMKPPTPFDFSAKNSIRKNTLMTMPRVALTSA

SEQ ID NO: 135872 - protein, 223 aa, Glycine max
  Coding DNA Sequence Number=SeqID_19094
  Gene Ontology: Mol. function=helicase activity; Biological process =viral genome replication
  Homolog annotation: Hit_ID=Q2R0W4; Match level="QueryCoverage=96%, HitCoverage=12%, E-value=1e-64, Identity=53%"; Hit description=AT hook motif-containing protein, putative
MMHGPCGLANKRAPCMANGKCFRFFPKKFQPATIVDQDGFPVYRRRDTRQTVQKQGVHLDNRFVVPYNPHLLLKYRTHLNVEWCNQSSSIKYLFKYINKGSDRITAVIVNDQNQDGPQNQVHDEIKHYLDCQYVSAPEACWKIFAFPMHGRAPAVERLYFHLENQQPVYWKDSQEIGTVLAKTTIKESMFTAWMDSNKIYHHGRDLTYAKYVSKFVYDARKRC

SEQ ID NO: 135873 - protein, 211 aa, Glycine max
  Coding DNA Sequence Number=SeqID_19095
  Homolog annotation: Hit_ID=Q9FFY5; Match level="QueryCoverage=95%, HitCoverage=73%, E-value=8e-24, Identity=37%"; Hit description =Arabidopsis thaliana genomic DNA, chromosome 5, P1 clone:MAC12
  Subcellular localization annotation: CTP_CleavageSite=42; ConfidenceScore=5.33e-01
MKNRTSGFLKEIIANLSSMAKSKTMALKSKTNAIRARLIVFSLMKNKKFLMSSLSEKFHSVWGQSSSSQQQKEDHCLLEDGISNDDHHQKSKAIVLYNSNAHSYEALPNPSETLVVEEEQDQDDGFDGYYNYDCDDDDEKYPDLTHTLFESEDLDLGGSVIDLVKNSKEEAGKEFKLEDEIDLAADLFILKFRRQMVLQKQESLKRKRENA

SEQ ID NO: 135874 - protein, 65 aa, Glycine max
  Coding DNA Sequence Number=SeqID_19096
MVRRKERRKKVVAWRREEGAWVCTVKDEVTAVTEGNRKQVTKIYNNLYKYVAQPIKLDLGLHFKF

SEQ ID NO: 135875 - protein, 200 aa, Glycine max
  Coding DNA Sequence Number=SeqID_19097
  Homolog annotation: Hit_ID=Q1SN45; Match level="QueryCoverage=49%, HitCoverage=5%, E-value=8e-20, Identity=45%"; Hit description=AAA ATPase
MSTLNSSPCIEPHTTTSCRPTQIGLTSQHINSGRYTIFNSKLIEHISHDTDDELDITQGDIVIDYLFDDIATEDFAHTDYDGNLEAPYDNENTGASYKDIGDPIWQCKQCKAKMWYDERINKDKQTKNPKFSLCCGDGKIQLPILHDAPQPLRQLLFDSRDSQAKKFQQNIRLYNLMFAFTSPGIKVGTSYNTGRGPPTL

SEQ ID NO: 135876 - protein, 86 aa, Glycine max
  Coding DNA Sequence Number=SeqID_19098
  Gene Ontology: Mol. function=structural constituent of ribosome; Cellular component=ribonucleoprotein complex; Biological process =translation
  Homolog annotation: Hit_ID=Q2QW49; Match level="QueryCoverage=54%, HitCoverage=9%, E-value=1e-09, Identity=66%"; Hit description =Ribulose bisphosphate carboxylase large chain, putative
MGSLPQRGWSERSYENSREGYSGEQISSGDDGVGPVAQRIRARGYEPRCRGFESLLAHNRPKKGRIFPSGGRKIMIGLADPKLWNL

SEQ ID NO: 135877 - protein, 58 aa, Glycine max
  Coding DNA Sequence Number=SeqID_19099
MKGLFVTKLESNEVLLSPIALKMVGPLLLDSNSSRDGTNPPSNSLYGNPQTRKQRDKQ

SEQ ID NO: 135878 - protein, 191 aa, Glycine max
  Coding DNA Sequence Number=SeqID_19100
MEKRAQTKEEKTIVDIMHVQAATIQAKVVDDNIMCKVIIDLINMGVMEKTPKASNIALANEVVHHDKEPTSKQSTTSNEATSKENNEPNVVNIYSNNLDQVQEMIVQAMDSFVEQQWQENEQFRLFMQNTITTQFSNLGVVLLQNLQQAQMTMLGAITAPTPIVAPEPPTLIHQPPPLEPIPPPPPLQVQD

SEQ ID NO: 135879 - protein, 229 aa, Glycine max
  Coding DNA Sequence Number=SeqID_19101
AKGHFGGLAARPGELRLKPEVTGSPWRAGSFTLKSFGGPGKPEASLGELGSHQLLHGGTFKDKKSTQNNIPKDLFEKHKRDPLQEVEPPNRIHANMYILNQAASYQLGLHISKAVEIKIVADKVCPRLPIWDVVKKGNKLYYNEKIPSRRMKVEVLNYSRNWTSSSGYDGSGNTDHHDFIQVLHLVRMYHFDDVYSCLTKDADSYSIIKRLLSLPTIQHETIYNLRKID

SEQ ID NO: 135880 - protein, 81 aa, Glycine max
  Coding DNA Sequence Number=SeqID_19102
MQRRANRNGRAFKTQKPKATTGMENGKACSNEKRGTSKIVHNLKRRIDNRRVMYKTTKAINGNGKEFWAGMRSAGIATRRP

SEQ ID NO: 135881 - protein, 131 aa, Glycine max
  Coding DNA Sequence Number=SeqID_19103
MWDILAGMYKGMPWVKKVKTPHFKYELFSMEESKGIQTFNKMKVAACITLSALSELRLAKRTLPILMTSRKRKSTASRPTAQYDTRRFQSLEAWNRYTDNILGWNILLERNVKLYHTEFDEFKVELERRNF

SEQ ID NO: 135882 - protein, 152 aa, Glycine max
  Coding DNA Sequence Number=SeqID_19104
  Homolog annotation: Hit_ID=Q1S6N2; Match level="QueryCoverage=36%, HitCoverage=24%, E-value=5e-07, Identity=52%"; Hit description=RNA -directed DNA polymerase
MLSEVPRCEVPKSVKLPSSLGEGFRGYACMRLCTTEDELKELIGTTYTNKIYLLFGSPSLKNFIVKHAWLGVVVRWVTFRDVSQKAYNLVVVIDVSHNNLWAIKAIFRGYELIFGLRVNFHKNNILRCVSPSSSSGYLLAQTHAIPKRGIPW

SEQ ID NO: 135883 - protein, 279 aa, Glycine max
  Coding DNA Sequence Number=SeqID_19105
MRDRLEDMIHDLVQDSFQQAHAPLYDTLESDSKKTLHLGCKKSLTLLSAMLSLVNVKARYGWSDKSFTLLSKDSLEEQSAQEHPDCVRAVGAEVMIKQYFGPASVGSCTSTSISPEELVHPVEPEVALSYAHVSTKGSYVDPLGKDPDTDALDRRGLYVDDNPPCLIALGTVYEGLATMHHVPLGNDMVNMGLQDQVFMLLNAHVAPPISNNVEEVRDVDACVSIPTKENEFKIESRTLKGSRGNLISRIKNQVSRFKFQESRSRFKTQDSRFKNQEKT

SEQ ID NO: 135884 - protein, 76 aa, Glycine max
  Coding DNA Sequence Number=SeqID_19106
MVGAFSQNIVTLAGLPMILLSESDLTNPLCGVSCYVLLSVPGWFFTDMECDNSLPVCCLCLDPVMILNFVFGGADD

SEQ ID NO: 135885 - protein, 423 aa, Glycine max
  Coding DNA Sequence Number=SeqID_19107
  Homolog annotation: Hit_ID=Q3BV56; Match level="QueryCoverage=42%, HitCoverage=77%, E-value=1e-76, Identity=82%"; Hit description =Peptidyl-prolyl cis-trans isomerase precursor
  Pfam annotation: Domain name=DUF1289; Domain location=215-269; Score =82.5; E_value=1.3e-21; Accession=PF06945.3; Description=Protein of unknown function (DUF1289)
  Pfam annotation: Domain name=FKBP_C; Domain location=87-178; Score =24.0; E_value=2.3e-05; Accession=PF00254.18; Description=FKBP-type peptidyl-prolyl cis-trans i
  Pfam annotation: Domain name=FKBP_N; Domain location=1-83; Score=6.5; E_value=0.0005; Accession=PF01346.9; Description=Domain amino terminal to FKBP-type peptidyl-prolyl isomerase
  Pfam annotation: Domain name=NUDIX; Domain location=312-420; Score =16.8; E_value=0.0035; Accession=PF00293.18; Description=NUDIX domain
  Pfam module annotation: Pfam domain module=DUF1289::FKBP_C::FKBP _N::NUDIX; Domain location=215-269::87-178::1-83::312-420
LDINSVVKGLQDAYAKKQPAITADQLKPAVEAFQKREQGRAQAAKAEYEKAAAEYKTKSDQFIAANKAKAGVQSLPSGVQYRVIEAGKGAKPTQASTVQLEVAGPFPYGQRPTEARPAQQIPSIKVSDVEMKAMRETLLQMPAGSKWEVTLPPDQAYGADPRTPFPPNVAVQFEIKLVSVNATVPRTASAPRANSARSRYCCRVQTMEETARVVASPCIGVCTLDPDRQCTGCGRHIDEIARWSSMSNEERSRIVHRVQPLREQLQQSLRGSLADHERLMRALHPLAEPPAGDGWNRSELSDLLPPGPPVEAAVLAGIVPRANGAQVILTRRTETLRQHGGQVGFPGGRTEPDDRDALAAALRESQEEIALAPGQVQALGYLDLFVTITGYRVTPVVAVVDPDFVPVPQPSEVAEVFECRWPT

SEQ ID NO: 135886 - protein, 221 aa, Glycine max
  Coding DNA Sequence Number=SeqID_19108
  Gene Ontology: Mol. function=aspartic-type endopeptidase activity; Cellular component=intracellular; Biological process=transposition, DNA-mediated
MSSFRVFLGIAASLDLEIKQLDIKTTFLRGNLKEEIYMEQPEGFEVPGKENLVCQLKKSLYGLKQAPRQWYKKFDSHRPLCIYKEEKYIEKVLERFNVHKAKPVSIPLARQFKLRKKQSPTREAMSWLTKIQKCVALSTTEVEYIAATEACKKMLWMKNFLHELCHEQQNYVVHCDNQKEKLLQLEKVHTNENWSYMMTKVIPTKKFADCCHGDSVVVPPN

SEQ ID NO: 135887 - protein, 166 aa, Glycine max
  Coding DNA Sequence Number=SeqID_19109
MEEVQVEAVINLEDDLNLVLLGVPITSMASQVRRNMNVNISSEMKKSTLLSQIKLIQRKRRIKALQPWQQIKMTIPHGGFSQPIKVVTLVRLINHFGDCKWKLTKGSMIVARGKKEGTLYVMQGRICKGEANIAHGVSSMELWHRQLGHMSEKGLHILEGKTIFLM

SEQ ID NO: 135888 - protein, 308 aa, Glycine max
  Coding DNA Sequence Number=SeqID_19110
MNWDFEDVLQKAEGIDNDDHKIIPLEKKKPSVPKWFWMAASVVLLVSAGLIFNYYQNVPVADQSKLVENQIKQQKQDFIEENHEPERQVAVNSADSIAAIKSDSVFQRNTVAEKDVLDEILPKRGRLKKEVRPKFTDNSSYRKLNVASKDSTGYNNNYVIVNGKRIDNVEEAINVTKYSFQIFANNVSEKLVQPKDDKFDKLFEKYQQVEGVTSIKIAKPMFGMLSSLNIDDSQLDQIKPLLTKINGLKILITESPENVNSPGGAKEGILDDVLLSIDSGDGGNVLVMLDGKLSMDDLSKIIKSSETK

SEQ ID NO: 135889 - protein, 174 aa, Glycine max
  Coding DNA Sequence Number=SeqID_19111
MGLRKKGREWRIAISNHYAWLQTRGWKMHERKRNSWGTEKRGREWRIALSNHYAWLQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135890 - protein, 173 aa, Glycine max
  Coding DNA Sequence Number=SeqID_19112
MRGYYMVIHIFCQPGANELVDAQRLTSSPAPFVNQGQTSTLTCRHLRHLLHLLSSRGNEPDDKQGYRMVIGTFCHPEATSLMTCGGANEPVDAQRLASSPAPFIAKGQTSSLTRRDLRRLLHLLSSQGYELDDMRGYHMVIRTFRHPEAARPMTCGGTIWLSAPFVISRWQDR

SEQ ID NO: 135891 - protein, 50 aa, Glycine max
  Coding DNA Sequence Number=SeqID_19113
MYFQFAIKLNNVVDMQIAYSLIDGKEQGQKALVMTRTRLGKYGGGGGQSE

SEQ ID NO: 135892 - protein, 74 aa, Glycine max
  Coding DNA Sequence Number=SeqID_19114
MELRDTEAIDEPLQDENPVIDMINDAFGNNKHHDVEPDMYEEAYEFVDTVPNEVNEEIVDLLKDGIEELYEGCR

SEQ ID NO: 135893 - protein, 99 aa, Glycine max
  Coding DNA Sequence Number=SeqID_19115
  Subcellular localization annotation: CTP_CleavageSite=31; ConfidenceScore=5.16e-01
MASLLMIPCQHLLLKKLQRHCHRKAASNSIRSEKTSSFSFRSNANVPFHELPGASFDQYMDDKHRVLRAVFSDDKGTTKQLNEVLTCTCFPHNLECERN

SEQ ID NO: 135894 - protein, 92 aa, Glycine max
  Coding DNA Sequence Number=SeqID_19116
  Subcellular localization annotation: CTP_CleavageSite=70; ConfidenceScore=5.22e-01
MEAAPSGGRKRQWQWRFPAPMASPALLLLLLPDPAAVKALTGMATCNVKSPTMSALSSRACHLSHMHEVASSTGASHVGLNYRNQLLLEKGF

SEQ ID NO: 135895 - protein, 65 aa, Glycine max
  Coding DNA Sequence Number=SeqID_19117
  Gene Ontology: Mol. function=sugar porter activity; Cellular component=integral to membrane; Biological process=carbohydrate transport
  Homolog annotation: Hit_ID=Q1SRU5; Match level="QueryCoverage=90%, HitCoverage=11%, E-value=2e-17, Identity=68%"; Hit description=Sugar transporter superfamily
MAGGGVEIGGPGKRAHLYEHKFSWYFVYTCFVGALGGSLFGYDLGVSAHRSNADCYFDLFHHFFL

SEQ ID NO: 135896 - protein, 155 aa, Glycine max
  Coding DNA Sequence Number=SeqID_19118
MVSSQGRNTWTVDDLVSYVEKIIILSEEQERITELVSHGPATEHQFAAQEFHMLLSSVETQGIARRREAVEAEPYLYLQMVERCHGMYYTPPTFSQYPTQMYQYPFEGHQSDTSTSEHSLGGVAETYPNFSWPTMTHSQQHDAPIPTPNALLGTQ

SEQ ID NO: 135897 - protein, 530 aa, Glycine max
  Coding DNA Sequence Number=SeqID_19119
  Gene Ontology: Mol. function=transcription factor activity; Cellular component=nucleus; Biological process=regulation of transcription, DNA-dependent
  Homolog annotation: Hit_ID=Q9FR97; Match level="QueryCoverage=93%, HitCoverage=89%, E-value=7e-83, Identity=39%"; Hit description=MYB65
  Pfam annotation: Domain name=Myb_DNA-binding; Domain location=34-81; Score=48.9; E_value=1.7e-11; Accession=PF00249.21; Description=Myb -like DNA-binding domain
  Pfam annotation: Domain name=Myb_DNA-binding; Domain location=87-132; Score=45.1; E_value=2.4e-10; Accession=PF00249.21; Description=Myb -like DNA-binding domain
  Pfam module annotation: Pfam domain module=Myb_DNA-binding::Myb_DNA -binding; Domain location=34-81::87-132
MKIDIEDEVLPNDMSGTQLNDESYEGGAGIVLKKGPWTSTEDDILVDYVKKHGEGNWNAVQKHTGLLRCGKSCRLRWANHLRPNLKKGAFTAEEERVIAELHAKMGNKWARMAAHLPGRTDNEIKNYWNTRIKRCQRAGLPLYPPEVSLQALQESQHSQSSGGLNGGEKMHPDFLQKNSFEIHDGIFDSLKDNQGILPYVHELSDISVYGNMLKGLDSSQYCSFVPPTLPKCKRLKESTIPFIDSCDMKKYDLYSFDQIRDNNSNKIAQSFGMQAPLDPGPSSHSSMCYSHSLSNGNSSTSKPYEAVKLELPSLQYPELDLGSWGSSPPPSLLESVDDFLQSPTPISTLESDCSSPQNSGLLDALLYQAKTMSSSKNHCSDKSSNSSTATPGDRADSSALNVYETEWEDYADPVSPFGATSILNECTGLRANMNSLNEQLPVQTITGDLPNLESVDQVWTPDSENQTLSLLNNTCPDFLLTSDWYDLGSGHGKNQAISTDAATAFLGDDLATDHKYMTAGTSITMFGNPF

SEQ ID NO: 135898 - protein, 721 aa, Glycine max
  Coding DNA Sequence Number=SeqID_19120
  Gene Ontology: Mol. function=RNA-directed DNA polymerase activity; Cellular component=chromatin; Biological process=chromatin assembly or disassembly
  Pfam annotation: Domain name=rve; Domain location=587-717; Score= -9.8; E_value=0.04; Accession=PF00665.16; Description=Integrase core domain
  Pfam annotation: Domain name=zf-H2C2; Domain location=528-569; Score =8.2; E_value=0.029; Accession=PF09337.1; Description=His(2)-Cys(2) zinc finger
  Pfam module annotation: Pfam domain module=RVT_1::rve::zf-H2C2; Domain location=182-401::587-717::528-569
MVFASAATRNTIEATIVPLGREPPPHIVPTNPPPDPLDPVEPLDPGPTQISLNSLAGHLAPRDFAFIGPARWPPCRGTGGQWQYPQLHPTGSRQSIAPSMPDHLYSLAGHVSLDLQYTQFTINLHVLPIVGANVAVGVQWLKSLGLIIIDYNTLCIQFFYDGCLVQLQGDKDFTLTPVTSSQFRRLSRTKTVGLYCHISLLAEDFTVFQDLLPAIQSLLTKFAVLFQQPNTLPPERDTDHHIHLLPQSAQVNVHPNSGINAPEGPYSTKHKSLFFSDVVGEETRWAIAGYHQICMHSEDVPKTAFHTHHGHYEFRVKPFRLCNGPSSFQATMNMIFHPYLHQFIIVFFDDILIYSPCFEDHLLHLEIAFHVEYLGHLVSHRGVEPLASKVEAIHQWPTSRIIRAVCSFLGLAGFYRRFIWGYASIVAPLVKITTLDQFNWSPTALTAFDQLKEAFSQAPILALLDFDLPFTIETDALGVIQMSEQHMYLAWLMGYDYQIQYRSSTHNQAVDALSRDLDMIPTLFVEYHTTPIGGHMGVVKIIARLTENFEWIGLRADVTKFVAQCLDCLHVKYEMKRTAGLLCPLSVPHQPWEDLSLDFITGLPPYRGNSVILVIVDQFSKGIHLGMLPVSHTAHAVASLFMDIMGKIHGLPRSLVSDRDPLFVSNFWQELFRRSVQVEGTSTWFFKENKGGYIPCGSLACKGFYKVERSLKNCWLLGDWM

SEQ ID NO: 135899 - protein, 92 aa, Glycine max
  Coding DNA Sequence Number=SeqID_19121
MSSWERRHRGGGAERVGAGSRGGRVTGRGEGDRARGGIGAGTGVTSPGDALDRRPGPTSLVGTLELHDISLGHHTVKEQIVFAGPEGTPTMM

SEQ ID NO: 135900 - protein, 137 aa, Glycine max
  Coding DNA Sequence Number=SeqID_19122
MTIRMPYAPGISIKKHGELWVIHYASRDFNTSVIKWVMEGYSLRRGDKLTLLVILRHANGPSRIPFIASARLQGYSLGREDKLTLLVILRHAYSPSRIPFIASTRLRECPMLCSLLLFLLHRSYNLTFSYTHKPLDR

SEQ ID NO: 135901 - protein, 148 aa, Glycine max
  Coding DNA Sequence Number=SeqID_19123
MEKKESTEKTSCSKQKMENLNKGKTQRQVKLEETDHKNEEKKKTGEGEEMTKRSLEKTMGEGWRRRHVKQPKLEAGCGWLCSNRKRREENRRRKKGRGTGEIEREMELGTKEERKEEAWEKWIAVGGTRVTTWSMGTIDISIDISFMT

SEQ ID NO: 135902 - protein, 46 aa, Glycine max
  Coding DNA Sequence Number=SeqID_19124
MQRGKYKEEKKWEKRVLAEEQELSSFLVRLTTKVKGGMALWLWWPM

SEQ ID NO: 135903 - protein, 75 aa, Glycine max
  Coding DNA Sequence Number=SeqID_19125
MTMIVAASVTHDSGGSKTLSQRGIHDLGKKIWTSKGEEKEAAKKEFIEALKLLEEQQGDKTYFGGDNIGTHYLFS

SEQ ID NO: 135904 - protein, 123 aa, Glycine max
  Coding DNA Sequence Number=SeqID_19126
  Gene Ontology: Mol. function=transition metal ion binding; Biological process=cytoskeleton organization and biogenesis
MWMYPVERYMKILKGYTKNLHRPEASIVERLPKGQHDERVGGKGSRLHVITQSVEDLQQAHLYVLNNSNEVLSYILYHEGLVKESNPKMTKNRVMKEHNKTFLDWFKDTIFADEPKRNVVTWK

SEQ ID NO: 135905 - protein, 86 aa, Glycine max
  Coding DNA Sequence Number=SeqID_19127
MLSGFWRVSGVKEGKRNVYTTVMYVGVNRYYYMCLNDLLALGGGEFELKNVEALVAALSVFNCLVNVAQAQSANATTDPSEVGLKD

SEQ ID NO: 135906 - protein, 166 aa, Glycine max
  Coding DNA Sequence Number=SeqID_19128
  Gene Ontology: Mol. function=DNA binding; Cellular component=nucleus; Biological process=regulation of transcription, DNA-dependent
  Homolog annotation: Hit_ID=Q948S5; Match level="QueryCoverage=72%, HitCoverage=11%, E-value=2e-59, Identity=85%"; Hit description=Myb
  Pfam annotation: Domain name=Myb_DNA-binding; Domain location=37-83; Score=56.2; E_value=1.1e-13; Accession=PF00249.21; Description=Myb -like DNA-binding domain
  Pfam annotation: Domain name=Myb_DNA-binding; Domain location=89-135; Score=50.3; E_value=6.4e-12; Accession=PF00249.21; Description=Myb -like DNA-binding domain
  Pfam module annotation: Pfam domain module=Myb_DNA-binding::Myb_DNA -binding; Domain location=37-83::89-135
MDGEQSMPAPSHGQVDGAQKVRALHGRTTGPTRRSTKGQWTSEEDDILQNAVERFKGKNWKKIAECFKDRTDVQCLHRWQKVLNPELVKGPWSKEEDEIIIELVKKHGPKKWSTIAQHLPGRIGKQCRERQDDLLLISCRFKPLAVPFKQALQADDHSNHPAELPF

SEQ ID NO: 135907 - protein, 957 aa, Glycine max
  Coding DNA Sequence Number=SeqID_19129
  Gene Ontology: Mol. function=DNA binding; Cellular component=nucleus; Biological process=regulation of transcription, DNA-dependent
  Homolog annotation: Hit_ID=Q948S5; Match level="QueryCoverage=91%, HitCoverage=87%, E-value=1e-159, Identity=40%"; Hit description=Myb
  Pfam annotation: Domain name=Myb_DNA-binding; Domain location=94-139; Score=41.9; E_value=2.1e-09; Accession=PF00249.21; Description=Myb -like DNA-binding domain
MDEERKVLVTNQDIKRRCKAFFYKHFDDGQGSSCNREGLETQEDKKNLAYHLRIQIGVVKQVLKRMDNGEMIGLDGIPIEVCKWVNHLDPTIKKEAWTREEELALIHYHQIFGNKWAELSKVIPGRTDNAIKNHWNSSVKKKLDSYLASGLLTQFESIPPHAGNLNQPIRLQCSGDDNGSKWTEGEEISDYSQGSANAVYFPSATGTSSADLQTGEAYRKNEECSLGKDHCPNQVSCSEPYYVSNDDVSICIPEIAHQEACTSQFVEQQSHEPGNSICGDCQFNFQSSPNVSSMVLGQESSELQRDFIAPSEICDMVNVPFPTSVELGVSTSMGTASMDSLKPEHMLISDDECCRVLFSDAMNDGCFPPVDYNKSEDIAEFSGYCSFCRSCNIQISETGGTSTAKLTCPQCSNNYKGISSSQSVPPVLSIRDDRLGPSANSNQLFVTEDHHFVSRASANFTYLNDISCSPCVDGIGSAVMEKTNVHTEKEDSGSLCYEPPRFPSLDIPFFSCDLVQSGSDMQQEFSPLGIRQFMMSSMNCLTPFRLWDSPSRDDNPDALLKSAAKTFTGTPSILKKRSRDLLSPLSDKRMDKKLETDITSSMFTRNFSSLDVTFGDNETRKADMPSSSLQTQNSRASVDDDNKENCGQTYKGEQVLEPIKSAILDEKNSQKGTVDGNSQHNVKQQPLDSKMKINAAAGIEQQQSGVLVEHDVNDLSLSSPDQVGLNSDRGLDSSAKTPKSLNKSLEAASNQSGHLKLSSKSPCPRVNSCSPCVRAKEHEGLSVAVTRVQAPGDNSGEQTRRDGGFETSSIFGGTPSAWKSPWFFNTFLSSPRLDTEILIEDFGYFMSPGDRSYDALGWLKQVSDQTAATYANAQEILANGTPKALPKDASENDKDRDHENNYPANQPGNHSQLASNALIERRTLDFSECETPGRGDNSKSSAMSFSSPSSYLMKGCR

SEQ ID NO: 135908 - protein, 78 aa, Glycine max
  Coding DNA Sequence Number=SeqID_19130
MEMTRKGEVVLWVLQMVRGVDGQQWRWKSMSPFAFSMIHPFDEVFADFNRLNQRRIENDEVWALRDVIWLRIEGVMKI

SEQ ID NO: 135909 - protein, 61 aa, Glycine max
  Coding DNA Sequence Number=SeqID_19131
MVPPADGRVETEHSGCSTSRQSQTPTAVANGDDGKEEMVITSHKWRSQVLWVKGRRGRLCL

SEQ ID NO: 135910 - protein, 283 aa, Glycine max
  Coding DNA Sequence Number=SeqID_19132
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-33, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GQHVLTFTGLDAFTFRGLHAFTFTGLHVLPIRGLHALNLRGLHVLPIRGLHVLVFGGPHVLTFRGFHVLTFRGLHVHAFKGLYDLAIRGQQALTFRGLHVLTIRGLLVLAFRGLHVLAIRGLHAFTIRGLHVLAITRLHVITNRGQHALSFRGLHVFAFRGLHALAIRGIHAFTIRGLHVLAITRLHVLTIRGQHALTSSGLHVLAFRGLHVLTFRGLPAFTFRGLHVLAIRGLHALTFRGLHVLAIRGQYALTFRGLNVLAMRGLHAITLRGLHVLAIRGLH

SEQ ID NO: 135911 - protein, 148 aa, Glycine max
  Coding DNA Sequence Number=SeqID_19133
MAPLIALRIFIKVLVDSLFSTVFPVFAQKHLDVVLDGHLDGYKYSVTSVNEFILAQLMRLSLCSSLEVQLKRNKLATTLDQMSINVTQKQVGSSGNGNRHGGNKGGHSGAPSLCWWVALTWTIWQQRNRIVFSNETFNGSKLMDDAVF

SEQ ID NO: 135912 - protein, 149 aa, Glycine max
  Coding DNA Sequence Number=SeqID_19134
  Gene Ontology: Mol. function=metal ion binding; Cellular component =nucleus; Biological process=superoxide metabolic process
  Homolog annotation: Hit_ID=Q5VRD4; Match level="QueryCoverage=48%, HitCoverage=18%, E-value=4e-21, Identity=58%"; Hit description=ATP synthetase alpha chain-like
  Pfam annotation: Domain name=zf-C3HC4; Domain location=74-114; Score =40.4; E_value=6e-09; Accession=PF00097.15; Description=Zinc finger, C3HC4 type (RING finger)
MTKERTVRPERMGEKGSPKMLISSHKLIQSLPGIQLAVGDAELQDKISPQRLIRIKIDYISLAHINFFVEGIVCCICLAKYENNDELRELPCSHLFHKDCVDKWLKINALCPLCKSDVGENLTGSVSGEDASQQRGESRVENGLTNTSV

SEQ ID NO: 135913 - protein, 466 aa, Glycine max
  Coding DNA Sequence Number=SeqID_19135
  Homolog annotation: Hit_ID=Q1SFS3; Match level="QueryCoverage=28%, HitCoverage=24%, E-value=6e-14, Identity=36%"; Hit description =Lambda repressor-like, DNA-binding
MLHFWGLSVSTNHRGVRRDLRMPDRRKEAIPLFWVLSFYGENSRSGQDLGTRIISSEAKWEWSSENIEEVLGGEGGNSGKPRRVCIIYQCISTASVWDSSISKCRRAGGSSSDRCFSCLSPQQGKPHHCRFSICLLSHVFNHGSRSFCPLQVHRMCSGKDKEKWEELLAGMTGASINWFPRWKEGGRIHKTWNKVGRKDKELRGTNNGVICGYHKWLKSRTQGITWLQKLNGLNGEEAEVPEESEEVQALKVELEKTKVAKEKLKVAVTRVRKECDELKDINMTEAEALEWETKKVRKEEWCRNKFRGALLGNRNELKLRKAEREKSRMESMMLEDKLKSFQRSKRSLKEQLSKTEENMLIIIDQYKEKVNLAASHGQMLVDKQAKVSTLRVEREVREEVIELLHKEGIKWMDRFALTLNESQELPRLLARAKVMADTYSASDEVHSLFNYCQHMVELMTHIIRNR

SEQ ID NO: 135914 - protein, 226 aa, Glycine max
  Coding DNA Sequence Number=SeqID_19136
  Gene Ontology: Mol. function=metal ion binding
  Homolog annotation: Hit_ID=Q84PB2; Match level="QueryCoverage=87%, HitCoverage=91%, E-value=2e-25, Identity=38%"; Hit description =Putative ATP synthetase alpha chain
MDVIVVSLELCLEGSSYTLPLLMARPGSLNGSQHVIEIAGSAYASTSSASHHDRHFNGTDVTQHEERISGARMPPLSQPSVSATSVSNGSNSRNSSFIRRGDTRRNRSPVHSGLWISIELVLLVSQIVASIIVLSLSRHEHPRTPLFHWIIGYASGCAATLPLLYWRYYHHNHMREQDSSQSRQSSPRINDPSGTLLFSSRTNSGEDGQAAVASSRSNQASLLMNR

SEQ ID NO: 135915 - protein, 42 aa, Glycine max
  Coding DNA Sequence Number=SeqID_19137
MQRDAPTLWNVLLLGSSGILLFHSSTVNIGIGRKIHHILKWQ

SEQ ID NO: 135916 - protein, 112 aa, Glycine max
  Coding DNA Sequence Number=SeqID_19138
MDQVQGQAFSKVHGKIWDLAMIEVSIEAIASFTQYYDQSLRCFIKEFEGILGCPLGGRKPYLFSGFYLSKARIAKVVKISEQELDRVKQIRNGVAWIPRKHLEEKAEALANC

SEQ ID NO: 135917 - protein, 1028 aa, Glycine max
  Coding DNA Sequence Number=SeqID_19139
  Gene Ontology: Mol. function=phosphotransferase activity, alcohol group as acceptor; Cellular component=cytoplasm; Biological process =metabolic process
  Homolog annotation: Hit_ID=O23461; Match level="QueryCoverage=93%, HitCoverage=94%, E-value=0.0, Identity=75%"; Hit description =Galactokinase like protein
  Pfam annotation: Domain name=GHMP_kinases_C; Domain location=868-971; Score=25.1; E_value=0.00025; Accession=PF08544.3; Description=GHMP kinases C terminal
  Pfam annotation: Domain name=GHMP_kinases_N; Domain location=642-710; Score=66.2; E_value=1e-16; Accession=PF00288.16; Description=GHMP kinases N terminal domain
  Pfam module annotation: Pfam domain module=GHMP_kinases_C::GHMP _kinases_N; Domain location=868-971::642-710
AWTTDKYVYYPKQKHYNTIILVLDLETLIEFDPFNCKMRIEQESDGVSASTKHLVFAYYVTGHGFGHATRVTEVVRHLILAGHDVHVVTGAPDFVFTSEIQSPRLFIRKVLLDCGAVQADALTVDRLASLEKYSETAVKPRAQILAQETEWLNSVKADLVVSDVVPVACRAAADAGIRSVCVTNFSWDFIYAEYVMAAGLHHRSIVWQIAEDYSHCEFLIRLPGYCPMPAFRDVIDVPLVVRRLHKSAKEVKKELGVTDDVKLVILNFGGQPSELKLKEEFLPPGWLCLVCGASETAELPPNFVKLAKDAYTPDIIAASDCMLGKIGYGTVSEALAYKCPFVFVRRDYFNEEPFLRNMLEFYQGGVEMIRRDLLTGHWRPYLERAISLKPCYEAGINGGELSGARRLRDAIVLGYQLQRAPGRDITIPEWYATAENQLGRTTPGSPVDDGRSAFSLDIENFDILHGDIQGLPDTVAFLQNLSELQDKHTRRERKAAANLFNWEEEIFVTRAPGRLDVIGGIADYSGSLVLQMPIKEACHVALQRNHPSKHRLWKHAEARQNDKGRNPTAVLQIVSFGSELSNRGPTFDMDLSDFMDEDKPISYEKAKKYFAQDPSQKWAAYVAGAILVLMTELGVQFEDSISMLVSSAVPEGKGVSSSASVEVASMYAIAAAHGLNISPRHLAILCQKVENHIVGAPCGVMDQMASACGEANKLLAMICQPAEIVGLVDIPSHIRFWGIDSGIRHSVGGADYGSVRIGAFMGMKMIKAKASEELSETCAANGLSYDEVEQDDIELLKQETSLDYLCNLPPHRFVTLYAKTIPESIVGETFLEQYQNHNDPVTTIDPKRTYGVRAPTMHPIFENFRVVNLKALLTSAASTYQLTALGELLYQCHYSYSTCGLGSDGTDRLVNLVQELQHSAASKAEGGTLYGAKITGGGSGGTVCVVGRNCLKSSEHIFEVQQRYKNATGYLPFIFEGSSPGAGKFGYLKIRRRATPEKANSSEDDGALTPEKPNASEDDGAVVVENKS

SEQ ID NO: 135918 - protein, 95 aa, Glycine max
  Coding DNA Sequence Number=SeqID_19140
  Homolog annotation: Hit_ID=P23849; Match level="QueryCoverage=43%, HitCoverage=8%, E-value=2e-10, Identity=73%"; Hit description=Trk system potassium uptake protein trkG
MGYDLVTAFATVAACINNMGLGYGETAAGFGTLNDAAKWLIPSGVQGAVPLCQRQHIHNMNDMNMRFNNKMLALAALLFAAQASADTLESIDTCA

SEQ ID NO: 135919 - protein, 67 aa, Glycine max
  Coding DNA Sequence Number=SeqID_19141
  Homolog annotation: Hit_ID=P23849; Match level="QueryCoverage=65%, HitCoverage=9%, E-value=4e-12, Identity=72%"; Hit description=Trk system potassium uptake protein trkG
MIRKRSAFNAAAGGADAAAEETRRQQQHDGVGRDPGVIGDGQTVVGHHRTGEEKPCTKASLTPYMPE

SEQ ID NO: 135920 - protein, 135 aa, Glycine max
  Coding DNA Sequence Number=SeqID_19142
MSEIEEVQEQMKADIEAMLSMRRMMESNAATVVATSAAAEVDLTHPSDINQTSRPVLYMVGQGGQVLGSTGGLHMVQNKNSFPPYGLPPNYTPPNPVHVPNENTNHSIPIPLEGQQPQLGHAPFAKPVGEAREEP

SEQ ID NO: 135921 - protein, 225 aa, Glycine max
  Coding DNA Sequence Number=SeqID_19143
  Gene Ontology: Mol. function=manganese ion binding; Cellular component=cytosol; Biological process=carbohydrate biosynthetic process
  Homolog annotation: Hit_ID=Q8L7W2; Match level="QueryCoverage=91%, HitCoverage=51%, E-value=1e-44, Identity=49%"; Hit description=Nudix hydrolase 8
  Subcellular localization annotation: CTP_CleavageSite=53; ConfidenceScore=5.28e-01
MELKSFSSCSVSTSEVAHVGRSYSTLISSFRHKVGVRFSTHFQCRRGLFLTTYCASDNTYLTDKAVISSVGQDNFAAETSSHRINGTNGSISRFYSTNLKLLDAFDDEYGGVVVHPDRLPSNPYTFASVLRLSLSQWKKMASYSTKLYIKLPDHLQGKKGIWLKLPLDQSDLVPIAVKEGFQYHHAEPGYVMLTYWIPEGPSMLPANASHQVGVGGFVINDNNEV

SEQ ID NO: 135922 - protein, 98 aa, Glycine max
  Coding DNA Sequence Number=SeqID_19144
MEGKHVYTRIFTEIKATLAGKGKVQRVVKEQEVVRIGALDERRGLGDLDVVIVEATEHNDLVIGTNRDAKDARVVKGGGVEEEVVVEEEAEREDIGGQ

SEQ ID NO: 135923 - protein, 102 aa, Glycine max
  Coding DNA Sequence Number=SeqID_19145
MSSSLITNMYFFFFFFFAAPLTSPVTKIDIAFIEEEAERLLEERLSTDLCNTDALYTLMEVKIKARVGVAERSNPGNDPINELCSMAEESRHENSSTERSGR

SEQ ID NO: 135924 - protein, 83 aa, Glycine max
  Coding DNA Sequence Number=SeqID_19146
  Gene Ontology: Mol. function=oxidoreductase activity
  Homolog annotation: Hit_ID=Q5D0G3; Match level="QueryCoverage=96%, HitCoverage=21%, E-value=5e-20, Identity=56%"; Hit description =Gibberellin 2-oxidase 3
MADKKKAFSNGVYKSIQHRVVAAEKAERFSIAFFYCPSEEAIIESQINPATYRKFTLREYRQQTEKDVKQTGDKVGLSRFLHS

SEQ ID NO: 135925 - protein, 42 aa, Glycine max
  Coding DNA Sequence Number=SeqID_19147
MNFLLQGMEDFLDEMLTMMSQTKSNGKSNEKRDLNWLCLCVS

SEQ ID NO: 135926 - protein, 255 aa, Glycine max
  Coding DNA Sequence Number=SeqID_19148
  Gene Ontology: Mol. function=oxidoreductase activity; Cellular component=proton-transporting two-sector ATPase complex; Biological process=ethylene biosynthetic process
  Homolog annotation: Hit_ID=Q84RC3; Match level="QueryCoverage=98%, HitCoverage=71%, E-value=1e-67, Identity=52%"; Hit description =Gibberellin 2-oxidase 1
  Pfam annotation: Domain name=2OG-FeII_Oxy; Domain location=186-255; Score=49.9; E_value=8.4e-12; Accession=PF03171.10; Description=2OG -Fe(II) oxygenase superfamily
  Pfam annotation: Domain name=Phage_fiber_C; Domain location=190-242; Score=2.1; E_value=0.034; Accession=PF06820.3; Description=Putative prophage tail fibre C-terminus
  Pfam module annotation: Pfam domain module=2OG-FeII_Oxy::Phage_fiber _C; Domain location=186-255::190-242
MDCEPPFLETYKTLVQKHVEDSKNIDSSSLLERSGELPLIDLGRLNGERDECVKEIAEAASKWGFFQVVNHGISQELLERLQFEQKKLFYQPFINKSAQVNLSSLSAKSYRWGNPFATNLRQLSWSEAFHFSPTDISRMDQHQCLRLSLEAFTTRMFPLAESLAEILTCKLMNTKSNYFQENCLPKSSFIRLNRYPSCPISSKVHGLLPHSDTSFLTIVHQGHVRGLQLMKDGKWVDVKPNPQALVVNIGDFFQD

SEQ ID NO: 135927 - protein, 36 aa, Glycine max
  Coding DNA Sequence Number=SeqID_19149
MARGTMMLACYYCILGLGSRWVSLVQWMLAEMQQHL

SEQ ID NO: 135928 - protein, 320 aa, Glycine max
  Coding DNA Sequence Number=SeqID_19150
  Gene Ontology: Mol. function=transcription factor activity; Cellular component=nucleus; Biological process=regulation of transcription, DNA-dependent
  Homolog annotation: Hit_ID=Q2A9W8; Match level="QueryCoverage=54%, HitCoverage=67%, E-value=3e-40, Identity=49%"; Hit description =Ethylene responsive element binding factor, putative
  Pfam annotation: Domain name=AP2; Domain location=163-228; Score =146.9; E_value=5.4e-41; Accession=PF00847.10; Description=AP2 domain
GARVLGCSLAQKIEGIERIKNNNSEARGCFVAPIIAAAVEMMANAAEVSALNRIKLHLLGELSPLATPLNYFDESNPSPSESSNSQSSSVSLNHYFTDLFEFDSKPQIIDLQTPKTLTSAQKKPQLNRKPSLLIAVPKKTEWIQFGSPDPNPVMAAPENLPQKNHYRGVRQRPWGKFAAEIRDPNKRGSRVWLGTFDTAVEAAKAYDRAAFRLRGSKAILNFPLEVSAVAETVSVAAAEGNVERKRRREEEEVVVEEVKPVVKKEKITEQDVSCFREMPLTPSMWTGFWDSDVKDIFNVPPLSPLSPFGFSPLVARPVWG

SEQ ID NO: 135929 - protein, 90 aa, Glycine max
  Coding DNA Sequence Number=SeqID_19151
  Subcellular localization annotation: CTP_CleavageSite=32; ConfidenceScore=5.03e-01
MRIGGMGESTMGGLLLKLPRASKFVQTEIIKVGSMMQSLSPRSRQICVNFKSLHSSTMLRLQCRILEKKKNIYLVLTKHFDIKPNMAVTM

SEQ ID NO: 135930 - protein, 56 aa, Glycine max
  Coding DNA Sequence Number=SeqID_19152
MAGLSRLISPSRDNEMDPNPMGTRKISTSGEDNYLLIEAENGNRSLRILSSHDIQV

SEQ ID NO: 135931 - protein, 269 aa, Glycine max
  Coding DNA Sequence Number=SeqID_19153
  Gene Ontology: Mol. function=ubiquitin thiolesterase activity; Cellular component=intracellular; Biological process=ubiquitin -dependent protein catabolic process
  Homolog annotation: Hit_ID=Q8GWE1; Match level="QueryCoverage=76%, HitCoverage=81%, E-value=1e-75, Identity=68%"; Hit description =Putative carboxyl-terminal proteinase
  Pfam annotation: Domain name=Peptidase_C12; Domain location=12-235; Score=267.3; E_value=3.1e-77; Accession=PF01088.11; Description =Ubiquitin carboxyl-terminal hydrolase, family 1
MATLDERPSAKRWLPLEANPDVMNQFLWGLGLPVDEAECGDVFGLDEELLEMVPKPVLAVLFLYPITAKSEEERLQQENVKKDYSSKVYFMKQTVGNACGTIGLLHALGNITSEVKLVEGSFFDKFFKSTASMDPLQRAVFLENDREMEVAHSVAATAGDTVITDVVMKGLVWLSYLENLASDNVDTHFICFACVDGELYELDGRKSGPISHGPSSPSTLLRLLALSATSYNDQDPLQHSPSTRLLAQKNWAGLLCLNIVGLWMWEQYD

SEQ ID NO: 135932 - protein, 105 aa, Glycine max
  Coding DNA Sequence Number=SeqID_19154
MVATTPQPRINLESLFDSNGNNNHRFRFIIVECYVSNGKFHRTPCRQNLPLHFSPLHVLERSTVTPILPQAPVVTSEGGGGSVVSVARRVPLGREGAPGKDDRQQ

SEQ ID NO: 135933 - protein, 339 aa, Glycine max
  Coding DNA Sequence Number=SeqID_19155
  Gene Ontology: Mol. function=catalytic activity; Cellular component =mitochondrion; Biological process=metabolic process
  Homolog annotation: Hit_ID=Q6H7I3; Match level="QueryCoverage=84%, HitCoverage=87%, E-value=7e-93, Identity=60%"; Hit description =Putative enoyl-CoA hydratase
  Pfam annotation: Domain name=ECH; Domain location=69-263; Score =155.2; E_value=1.8e-43; Accession=PF00378.10; Description=Enoyl-CoA hydrataseisomerase family
MCALRVLTRSVCSSSSSYVKTSKPYLTLILITHHQYHYQHQTHRTLILDSSASEFVKLHKLNGPDSGIVEISLDRPESKNAIGKEMLRGLNQAFELINQKSYANVAMISSSVPGVFCAGADLKERRAMSQSEAKIFVKSLRSTFSFLEVDVRVPTIAVIEGVALGGGLEMALACDIRICGLFERFCAMKVLDFFSTCFFFHGIGENALMGLPETGLAIIPGAGGTQRLPRLVGKAIAKDIIFTGRKIDGKEALSLGLVNYCVPAGEAYSKALAIAHDINQKGPVALRMAKRAINEGVETDLTSALELEEDCYDQVLNTKDRLEGLAAFAEKRKPSYTGE

SEQ ID NO: 135934 - protein, 143 aa, Glycine max
  Coding DNA Sequence Number=SeqID_19156
  Gene Ontology: Cellular component=nucleus
MSGGRLCTLLGELGYEGWEALDPDSFEWPFQYEQFKQEGKLLEGEDLDFAYDSISAFSDRRDNQEAVFGTEEGLKDIKEATLAYREEALALQRQLRHLQSQFDMLSGQASTLTQGRRARLAATSIVNGHLANIDDSLSVRNLQ

SEQ ID NO: 135935 - protein, 371 aa, Glycine max
  Coding DNA Sequence Number=SeqID_19157
  Gene Ontology: Mol. function=siderophore-iron transporter activity; Cellular component=outer membrane; Biological process=siderophore transport
  Homolog annotation: Hit_ID=P75780; Match level="QueryCoverage=82%, HitCoverage=48%, E-value=4e-94, Identity=54%"; Hit description =Catecholate siderophore receptor fiu precursor
MAIQCLKHCSLQPIIEWRAGVNLLVIFYGRALAADRRPSVNPVSLLQLCGKVRQLFSVKHGRNEGTRLARMIAVATLVDRCHIVGIKQVIHVELQVEVIVDLIPKLRVSHPVAFGVIRRAHGPIAAATQAANASADEPSCATLAPSRTDACCMVVHSLPRASAGLRVSAVIIGIDLIFDVGAEQCGVQQQPLVQHLPLGAHFAGFGILRFKISTVGAVAAATRRQREAAATRWLLGDGIAGISPCPPWSPAYYAPRPPDKPARRVPVPPQGRRAVVLGVIVVETNAAVQLKVRGNRQRIKCIDAKRVSLPVSVRTVAVQTANRNAADGMVDIHRRRGQRVDAIGGLVFTREIYPGTHIMPDGTGGKFRGIL

SEQ ID NO: 135936 - protein, 140 aa, Glycine max
  Coding DNA Sequence Number=SeqID_19158
  Gene Ontology: Cellular component=nucleus
MAVVVDLTISGLDALFRFIFLIHYQGPFRLVAEEGKSKCSWVNLDDISNTYVRGNDFLKILAFCSNPMQCKTVVKNLEKSHHQRVSELRRLRSIFGVSEKQWVEAQVENAKQQAILMTLKSQVSSDEAHIHLDLHSLRYL

SEQ ID NO: 135937 - protein, 61 aa, Glycine max
  Coding DNA Sequence Number=SeqID_19159
MVVQCHIIFFPFQTISDLCWELAQLQDTYILQGDYDLKVMRQEYYINRQKAVFDSRGVLVA

SEQ ID NO: 135938 - protein, 40 aa, Glycine max
  Coding DNA Sequence Number=SeqID_19160
METERRGWGGGQGRNTSLRSASGDLIAKTVRHGRCAWWKA

SEQ ID NO: 135939 - protein, 265 aa, Glycine max
  Coding DNA Sequence Number=SeqID_19161
  Gene Ontology: Mol. function=carboxypeptidase activity; Cellular component=membrane; Biological process=auxin mediated signaling pathway
  Homolog annotation: Hit_ID=Q9LI65; Match level="QueryCoverage=93%, HitCoverage=78%, E-value=5e-42, Identity=34%"; Hit description =Nodulin-like protein
MTSDNHMHITLSFKVSCRVTLTQSLYLIGLEYTSATFACAFLNMVPVFTFIMALPLGIEKVDMKKLSAKAKVLGTFVCIGGALMLILYKGVPLINQQPEHIADKGTIRSSASKLKKWIIGSLLLTAGCFLWSSRFLIQASISKKYPCQYSSTAILSFFASIQSAILTLVIDRSNAKWILKGKLEIMTVVYAGRACAMWQCHGSVLVISGTYILLWVKSKEEDQCAMKGTQESQEDECKNNLEASPNVPSKLRPNEEQGFSELQVK

SEQ ID NO: 135940 - protein, 180 aa, Glycine max
  Coding DNA Sequence Number=SeqID_19162
  Gene Ontology: Cellular component=nucleus
MSYDFLNLIPKAMLGRCLALIQAASDVQEQGGVHDSDHFLHAIRDMLKIYSNTQAQATLSTYVSAPGIVQQISALHSDLLSLQSDLENSLPEDRNRCINELRNLIKNLQKLLFASSTTAQPILTPRLCKFNRLTSTKAFVTRYGTVSRESANVAKWTDYATVVNRREEGIQFEGAWSKLG

SEQ ID NO: 135941 - protein, 134 aa, Glycine max
  Coding DNA Sequence Number=SeqID_19163
MFPHTKKLRNILEPEIFPHSGERENNDRIQKAKKKDKKKVNDDDENYVPEYEGGLGSNSSSKNYENDRHDEFSATNDLESQKRKMIKSSILNSKRVYNDSSIHHSLDKEVKEYLPNNASHASELTNVEQVESNT

SEQ ID NO: 135942 - protein, 460 aa, Glycine max
  Coding DNA Sequence Number=SeqID_19164
  Gene Ontology: Mol. function=transferase activity; Biological process= paclitaxel biosynthetic process
  Homolog annotation: Hit_ID=Q1PFY9; Match level="QueryCoverage=98%, HitCoverage=98%, E-value=1e-154, Identity=60%"; Hit description =Transferase family protein
  Pfam annotation: Domain name=Transferase; Domain location=16-457; Score=241.6; E_value=1.7e-69; Accession=PF02458.6; Description =Transferase family
MAPPWVQELNLIHLSIPITIDKMFSVMPSRPIPVKPGDSLYLSNLDDMIGARVFTPTVYFYQSDDTCFSEKPVTKTLQCALADVLVPYYPLSGRLRKTKNGKLEVFFGPDQGALIVEARSDIALAELGDLTAPNPDWEPLIFKFPDEEQYKVLEMPLVIAQVTLFRCGGFSLGLRLCHCICDGMGAMQFLGAWAATARTGTLVTDPEPCWDREIFRPRDPPEVKFPHMEFMTIEEGSNLTMTLWETKPVQKCYRIKREFQNHVKSLAQPYDAAGCTTFDAMAAHIWRSWVKALDVRPLDYQLRLTFSVNARQKLRNPPLREGFYGNVVCVACTTSTVSELVHGKLPETTLLVREARQSVSEEYLRSTVDLVEVDRPRQLEFGGKLTITQWTRFSIYKCADFGWGRPLYAGPIDLTPTPQVCVFLPEGEADCSGGSMIVCICLPESAAEKFTQDLLLNSVF

SEQ ID NO: 135943 - protein, 191 aa, Glycine max
  Coding DNA Sequence Number=SeqID_19165
MAFARGQGYHVTIIRFGRRKFYFIWEEQQTITETNTPDVHDKVKDLLKAIDEQFMTFDKSLASTLIMQFSSMKLIGIRHIMHIKDIVAQLKPLEEEDMLLMEEASDKEGVKVFLLQEEGDENHEIDQIQAKGPNGEGQSPRVKKDEGNPCGVYPDLSSFTESGVYPDLSSFTGSGVIQISVACIKRSAPSQ

SEQ ID NO: 135944 - protein, 113 aa, Glycine max
  Coding DNA Sequence Number=SeqID_19166
  Subcellular localization annotation: CTP_CleavageSite=61; ConfidenceScore=5.01e-01
MAFNLLIPIQYRTSHHTYTPTISPSSVSLFHMVVSPSSESHYHPQILVPPLHPQDTLPGPTARMTFNTRNPQAYDPLSSSYSFELVVGHQVEPSILVAIVEKLRDTYQGDLHQ

SEQ ID NO: 135945 - protein, 189 aa, Glycine max
  Coding DNA Sequence Number=SeqID_19167
  Gene Ontology: Mol. function=nucleic acid binding; Cellular component= endoplasmic reticulum membrane; Biological process=DNA integration
ANDKGMLYEVKQFLSKNFDILLEANDKVIASLMYAQVCIKLDIAFAVGVLGRYRSNLSIDHWKDAKKVMRYTQGTRDYMLMYRKTNDLEVIGYSDSKFVGCIDTRSSTYGYVFMLVGGAISWKSAKQSLTVTSTLEAEFISYFEATSHDVWLKSFISRLRVVDFIFRPLKLYCDNDVVVFMAKNNKSES

SEQ ID NO: 135946 - protein, 611 aa, Glycine max
  Coding DNA Sequence Number=SeqID_19168
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=99%, HitCoverage=99%, E-value=0.0, Identity=78%"; Hit description=Indole -3-acetic acid-amido synthetase GH3.5
  Pfam annotation: Domain name=GH3; Domain location=20-583; Score =1225.9; E_value=0; Accession=PF03321.4; Description=GH3 auxin -responsive promoter
MPEAPGDSTKDYVLEEKNKKILDFIEDVTNNADEVQKKVLSEILSRNANVEYLRRHGVNGQTVDPDTFKRLLPVITYEDIQPDINRIANGDKSPILTSKPVTEFLTSSGTSGGERKLMPTIEEELGRRCMLYSLLMPIMNQFVPDLEKGKGMYLMFIKCESKTPGGIVARPVLTSYYKSPYFRDRSYDPYTNYTSPNETVLCLDSYQSMYSQLLCGLCQHKEVLRVGAIFASGFIRAIRFLEKHWALLCNDIKTGTINNSITDSSVREAVMRILKADPKLADFIHNECSKGSWQGIITRLWPNTKYVDVIVTGTMAQYIPTLDYYSNGLPLVCTMYASSECYFGVNLNPLCKPSHVSYTLIPTMCYYEFLPVNRSNELAASRPSPTSLNQAQQQELVELVDVKLGQEYELVVTTHAGLYRYRVGDILKVSGFKNKAPQFSFVCRKNVALSIDSDKTDEVELQNAMKNAVTHLEPFDAHVSEYTSYADTTTIPGHYVLYWELNLKGSTPIPPCVYEDCCLTIEESLNSVYRQGRVSDKSIGPLEIKIVEQGTFDKLMDYAISLGASINQYKAPRCVKFAPIVELLNSRVTSNYFSPKCPKWVPGHKQWIHQN

SEQ ID NO: 135947 - protein, 574 aa, Glycine max
  Coding DNA Sequence Number=SeqID_19169
  Gene Ontology: Mol. function=oxidoreductase activity, acting on the CH-CH group of donors; Cellular component=peroxisome; Biological process=fatty acid metabolic process
  Homolog annotation: Hit_ID=Q945U3; Match level="QueryCoverage=94%, HitCoverage=80%, E-value=0.0, Identity=76%"; Hit description=Acyl -CoA oxidase
  Pfam annotation: Domain name=Acyl-CoA_dh_M; Domain location=133-185; Score=22.4; E_value=0.00019; Accession=PF02770.9; Description=Acyl -CoA dehydrogenase, middle domain
MEDIVDHLAFERNKTQFDVDEMKIAGSLHAFEVSDKMARLVASDPAFRKDDRVVLDRKALFMNTLRKTAYAWKRIIELRLSEEEAAMLRSFVDQPAFTDLHWGMFVPTIKGQGTEEQQQKWLPLAHKMQIIGCYAQTELGHGSNVQGLEKTATFDPKTDEFVIHSPTLTSSKGIWLTGYLLAITEYDFNSFDADLNSGGLVDWVSLSSCERSLDDHLPLPGITVGDIGMKFGNGAYNSMDNGVLRVSQVTREGKYVQSSVPRQLVYGTMFALLQDIVLFEDSLGQKREVLRHRFKAALHSTNIVKLCLGLSGNSISLLLVHGVLKNPNISEIVIDYKTQQARLIPLLASAYAFRFVGEWLKWLYMDVMKRLQTSDFSTLPEAHACTAGLKSFTTSATADGIEECRKLCGGHGYLCSSGLPELFAVYIPSCTYEGDNTVLLLQVARHLIKTISQLGSRKKPVGTTSYIGRVEQLMQYHSDFQKAEDGLKPNAVLGAFEARAAKKVIGCAQNLSKFTNPEEGFQEFSVDLVEAAVAHCQLIVVSKGARSRNNFVMHSKITYNCTVDPGESYELLSI

SEQ ID NO: 135948 - protein, 203 aa, Glycine max
  Coding DNA Sequence Number=SeqID_19170
  Gene Ontology: Mol. function=receptor activity
  Homolog annotation: Hit_ID=Q9FQ21; Match level="QueryCoverage=50%, HitCoverage=34%, E-value=2e-34, Identity=53%"; Hit description =Putative Hs1pro-1-like receptor
  Pfam annotation: Domain name=Hs1pro-1_C; Domain location=1-147; Score= 25.0; E_value=8.4e-16; Accession=PF07014.3; Description=Hs1pro-1 protein C-terminus
MCKLNKIHELKTTSYDERMKNHKSHALHTTHQIVKSWIHASRKVLERITDVVLSEPSRKSKELVEPTKMCKDLRHKVPEILEVEVDPKGGPRIQEAAMKLYVSKNGFEKLLTLLFLFVLNLSDLNLFVCSISLLQQHSISLFVAPTLLLPKSVVRRKGLVSRLMKRPLRQWTVTLPFRAASPLCSHMAPGISTRLLRRFKMSL

SEQ ID NO: 135949 - protein, 75 aa, Glycine max
  Coding DNA Sequence Number=SeqID_19171
MAFRRWSPMTPMYCEGVRLRGARREGVDYGLDCEGGGGEEGGSGGEAIDGDGSGNHGGKWRRLKKVDKRGEKKVK

SEQ ID NO: 135950 - protein, 239 aa, Glycine max
  Coding DNA Sequence Number=SeqID_19172
  Gene Ontology: Mol. function=oxidoreductase activity; Cellular component=integral to membrane; Biological process=protein amino acid phosphorylation
  Homolog annotation: Hit_ID=Q1S1K8; Match level="QueryCoverage=91%, HitCoverage=63%, E-value=1e-65, Identity=59%"; Hit description =Oxidoreductase, 2OG-Fe(II) oxygenase family, putative
MAATLSLPIIDLSSPHRLSTPNSIRQACVEYGFFYLVNRGVDTEIVSKVFDQSGKFFSLPVQRKLDLARKEYRSYTPLYSETLDPTSLSNGDPKETYYIGPIEDTSIAHLNQWPSEGHFRITAKLETYNGILILETNGCWKKSAALIAMPLNLEEDYFEKIGALNKAAAFLRLLHYPARFESKTAILVAIKGSDEQICGASPHSDYGMITLLMTEGVPGLQAGDSISLCQDSYCISEFE

SEQ ID NO: 135951 - protein, 103 aa, Glycine max
  Coding DNA Sequence Number=SeqID_19173
MDSSTVTRRCPLQICVRETTTTPPHQEHHLRTNYLGQPLLREPPPTRPKSTRVISGHQIRIKAIKIGGAKEVWHWFRDERHNILFEVLKNLKSFTSTKMRESE

SEQ ID NO: 135952 - protein, 47 aa, Glycine max
  Coding DNA Sequence Number=SeqID_19174
MIYFLADGIGHVVEKDNIKETHKNDKLSKAIDIMLQEDFPEQILEVR

SEQ ID NO: 135953 - protein, 133 aa, Glycine max
  Coding DNA Sequence Number=SeqID_19175
  Gene Ontology: Mol. function=chromatin binding; Cellular component =chromatin; Biological process=chromatin assembly or disassembly
  Homolog annotation: Hit_ID=Q1SAV4; Match level="QueryCoverage=92%, HitCoverage=38%, E-value=2e-21, Identity=40%"; Hit description =Integrase, catalytic region
  Pfam annotation: Domain name=Chromo; Domain location=72-122; Score =13.8; E_value=0.023; Accession=PF00385.14; Description='chromo' (CHRromatin Organisation MOdifier
MKKFADSNRREVHFQEGDWVLRIGPVAYRLQLPPNSKIHPVFHCSLLKPFHQYTTLDMHAIVLPPQSKDNKPIIARLVILNTKWITSDTRPELMVLVQWQGLLPEDTSWEPWAKLKEAYHLEGRCFQMRRGIL

SEQ ID NO: 135954 - protein, 281 aa, Glycine max
  Coding DNA Sequence Number=SeqID_19176
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=36%, HitCoverage=26%, E-value=2e-32, Identity=65%"; Hit description =Integrase, catalytic region
  Pfam annotation: Domain name=rve; Domain location=167-281; Score=4.7; E_value=0.0024; Accession=PF00665.16; Description=Integrase core domain
  Subcellular localization annotation: CTP_CleavageSite=40; ConfidenceScore=5.48e-01
MGFPWTFSVLSPLHQGLCIHHSSFDSPPSQRSISMVVEGSASLRNSQRRHLQSSGFGAVGFLPTICCQDRCFRDHGGHEKVALVFVGAPLHHLDRPQELKRTHVPSHTNARTTNLNGPNDNIDCSSFYIFARSENGAPSSLQLSGTQAKHQEQSLSLPNLCDHSGLYPIAKSNLITTRGLPAFRGHTVILVVVDRFSKGVHLGMLRPNYTASTVANLFMKIMGKIHGMPRSLVSDRDPLFVSGFWQELFKLLGTKLRMSSVYHPQSDGQIEVLNRVIEQYL

SEQ ID NO: 135955 - protein, 60 aa, Glycine max
  Coding DNA Sequence Number=SeqID_19177
  Subcellular localization annotation: CTP_CleavageSite=25; ConfidenceScore=5.33e-01
MSHTSIAVVMNPNSFVVVAALVAVVASAAQFATVTGSRGRKKDKGQRGFERAGAKNEFRF

SEQ ID NO: 135956 - protein, 106 aa, Glycine max
  Coding DNA Sequence Number=SeqID_19178
MEEKSHFSIKSDEKNGLDSSPKQLNEGHNKTETRLVGDSVKPRNRRSTNHHRVHKATENASGSSLQKSLVSVSWRVPHNNNKKPRQKHSGFDLDYSPPKTHPPHHN

SEQ ID NO: 135957 - protein, 121 aa, Glycine max
  Coding DNA Sequence Number=SeqID_19179
MVEATRSKTNMEHMEEAIAKLASNQLHATTKLDELIQHITMLETSQQHSPTPSSSSANPHPPSYYPNLPRMKLEVPYFDGSDPSGWTFKINQFFNYHATPEPKRLVMLPLPWKGPALAWFQ

SEQ ID NO: 135958 - protein, 38 aa, Glycine max
  Coding DNA Sequence Number=SeqID_19180
MALIKFGAVAGEQCPKCFAMDLATTFANLESGVVVQIP

SEQ ID NO: 135959 - protein, 141 aa, Glycine max
  Coding DNA Sequence Number=SeqID_19181
MIAAILDRVQVEKDEGLEALPRILIAKEVVIPSKSHSPPVDDTMSSIIFDSSSKDTDVISSTPMSQRSMLPESWIPPETNLVNLMSEDKGEDVDEDTSIEEDFSMDKEDPVTELELLKEDSSQDSSDESYYLTILLLFGYS

SEQ ID NO: 135960 - protein, 48 aa, Glycine max
  Coding DNA Sequence Number=SeqID_19182
MYLWLFARTPVIGYVETILVVRSFMRIDIYYEEGMEERGSEIVLELKT

SEQ ID NO: 135961 - protein, 416 aa, Glycine max
  Coding DNA Sequence Number=SeqID_19183
  Gene Ontology: Mol. function=carboxylic ester hydrolase activity; Cellular component=cellular_component; Biological process=lipid metabolic process
  Homolog annotation: Hit_ID=Q6TGC0; Match level="QueryCoverage=94%, HitCoverage=97%, E-value=1e-105, Identity=46%"; Hit description =Triacylglycerol/steryl ester lipase-like protein
  Pfam annotation: Domain name=Abhydro_lipase; Domain location=51-118; Score=83.3; E_value=7.5e-22; Accession=PF04083.6; Description=ab -hydrolase associated lipase region
  Pfam annotation: Domain name=Abhydrolase_1; Domain location=132-407; Score=-4.7; E_value=0.018; Accession=PF00561.10; Description =alphabeta hydrolase fold
  Pfam module annotation: Pfam domain module=Abhydro_lipase::Abhydrolase _1; Domain location=51-118::132-407
MSADNAGNIYTLPMANTVVSLFSIVLLCITAAQGRKRLHLNNERLTSYPVINDIDGICKTMVETQGYTCEEHQVTTEDGYILSLQRMPEGRSGEKADKPPVLLQHGIFSDASTWLVNSPDESLGFILADNGYDVWLANVRGTQYSSGHTSLIPNDTAYWDWSWDELASYDLPAFAQYVYNYTGQRIHYAGHSLGTLMALAALSQGQVVNMLRSTALLCPIAHMNQIPSLLTKLAADTFIANDMYWLGIHEFNPNGGGAASKFVEDICNKLNLNCSNLMSLVTGPNCCLNSSRTDISSEPTATKNLIHLSQMIRTGKIVKYDYGDQGQNMQHYGQPVPPLYDMTAIPNEFPLFLSYGGQDFLSDVKDVQVLLNDLKDHNGNKLVVLFKEDYAHLDFVRAVNAKQMIYDPMISFFNVN

SEQ ID NO: 135962 - protein, 168 aa, Glycine max
  Coding DNA Sequence Number=SeqID_19184
MSSRLITNILVSRHYLLPLLSLLSFPNGNHHHMPPPSTALRHHRRRPPPLHRPTPSPLLPLIFFFLLFTSNPTEPHRFHYRITPSKRGIKSVRQRLNVVLVADFDGSEKGEDDTETSSGACWWSGVGCFLLEKGKKKERGWTARWWQSMTMVVWWWWLPLEKERKVMT

SEQ ID NO: 135963 - protein, 54 aa, Glycine max
  Coding DNA Sequence Number=SeqID_19185
MGVFPLIIGEIPYSKEVDAGLASVCPQVLEYNNGSLGNHPPTIGCPFGDLRLPD

SEQ ID NO: 135964 - protein, 182 aa, Glycine max
  Coding DNA Sequence Number=SeqID_19186
  Gene Ontology: Mol. function=protein dimerization activity
  Homolog annotation: Hit_ID=Q1S5N2; Match level="QueryCoverage=57%, HitCoverage=31%, E-value=2e-07, Identity=27%"; Hit description=Viral capsid/hemagglutinin protein
MENAKEKIKCNFNNIKKEVRSSASRPLHATEYYLNPHLHYEPTFRHDELMTLRGIFSMEEAKDTRKVMQPGEWWEMFGDGTPELKRFAIHIESDDEWIIEEGYNDEDEQPQGESDGGNVELVGDVGGSSNDLVVDIFDLDNLILVEPNDDAQSEEDLDDDGDGDESDDIHGDDPIRELSKVL

SEQ ID NO: 135965 - protein, 175 aa, Glycine max
  Coding DNA Sequence Number=SeqID_19187
  Homolog annotation: Hit_ID=Q93WZ8; Match level="QueryCoverage=26%, HitCoverage=2%, E-value=1e-12, Identity=80%"; Hit description=NADH glutamate synthase precursor
WPSWLSKVAGETINGLTPRRADTFEKIDKAVSELCHNIEGNINVGSFSRLIYDMMLAWERPSYYDEEDTTENVAKEKEERKITLNTTQEQDDIPLFYSHVSVSMSTVTDALEMMVSMTHRGACGCGCEANTGDGARIMVPLPHQFYKEDVYPRWAANSHYTLVPIPEGQQLDGSR

SEQ ID NO: 135966 - protein, 356 aa, Glycine max
  Coding DNA Sequence Number=SeqID_19188
  Gene Ontology: Mol. function=nucleic acid binding
MLSQRGGPINEIGPEIEVDALPLNYSVEKVVEVVPEDSTENGIEDMDVDGANGVGKGRSDAEAEVVGVETIPNNLVYKMQKLEVVEVETQVNNGANDDEVKEHDEDANFSDHSESDPDYAYVSPEDDGQSSDTSNDSYHSKEFQSLPNSDAEGDTNSKIVYPQYYPRSCFGQVHLEVGMEFDTIKMFIEVVRDYTIFLGRDLKWHMCGRVFKNKQATMKWVTKRVADKLRVHPNLNHVAAHEHVREYYGVHIDEIKMFRAIKEAQSLVEGKSGLDGCFLKRYYGGHLLAAVGQYENNAFFVIAYAIVNVEDKDNWKWFLTLLHEDIGDYEQYGWNFMSDIQKVQFNCLALSNFDAK

SEQ ID NO: 135967 - protein, 112 aa, Glycine max
  Coding DNA Sequence Number=SeqID_19189
  Gene Ontology: Cellular component=mitochondrion
  Subcellular localization annotation: CTP_CleavageSite=40; ConfidenceScore=5.22e-01
MTLLSLGFLNSPSRRWKSSLVAPTLAVIPFTSKMRHCAISFHAKRSLDWFLEKDSRRIAHLSLRSLMVVLILGVGRSTSSTQLGIGFGADSRAAQIKRKHSQRGNEVKSKEG

SEQ ID NO: 135968 - protein, 235 aa, Glycine max
  Coding DNA Sequence Number=SeqID_19190
MKLIDASLRQQKKLQNMSLHVPYQMADKVTVSHLETSRCLFPEFSGQDSGSFEALKLEEEPAAVPKEKKGRGPPPTWYVTRSELDSLSSYMRGRLTLEKVNAAINDMVSYAEANAQLIVAPKKKLAENLWEKALEIRDIATMEGIKGKHFFLEADIKGPSLKLDNTGKAILTILTISELHLLEFFLALSKITVMVSDQPNSVAKVVTFDKVLRHLGRINETRVGHNRVIILQKPH

SEQ ID NO: 135969 - protein, 106 aa, Glycine max
  Coding DNA Sequence Number=SeqID_19191
MAEIGSFASESYSSENKLKVAPLYSNANFSQLEVVDHYDVHPYSASDDDIPTIDYSLLFCDDPNKQFHALECLRDACQEYGFFYVNLLALVSYYLHRVMNGFFFLF

SEQ ID NO: 135970 - protein, 169 aa, Glycine max
  Coding DNA Sequence Number=SeqID_19192
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=7e-19, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MHAVAVRRLHVLVFRGLLALPFKGLHILAIRGLHALTLRGLHVVAIRGSRTLTFRGLHVLAFRGLHVLAFRGLHVLAFKGPHRATRPRHQRATRPHLERTTRPHLQKTTRPHHQRTIHTRLQRTSRPHLQRTTRPPLQRATRPLLQRTTCPHLQRTTCTRLQRATRRRL

SEQ ID NO: 135971 - protein, 429 aa, Glycine max
  Coding DNA Sequence Number=SeqID_19193
  Gene Ontology: Mol. function=unspecific monooxygenase activity; Cellular component=membrane; Biological process=electron transport
  Homolog annotation: Hit_ID=Q9XFX1; Match level="QueryCoverage=90%, HitCoverage=85%, E-value=1e-142, Identity=62%"; Hit description =Cytochrome P450
  Pfam annotation: Domain name=p450; Domain location=32-421; Score =173.6; E_value=4.9e-49; Accession=PF00067.12; Description=Cytochrome P450
MMEDNIFNILYLLLFLIILKLLFFRKRDKNPPPSPPSLPVIGNLHQLKQPLHRILHAPSHKYGPIFSLRFGSQPVLVVSSASAAEECFTTNDIVFANRFPSIKTKYLGYNNTILLVASYRDQWRNLRRISSPEILSTHRLNSFLEIRNDETLNLLRNLARASNKVEFRSIFQDLTFNIIMRMVCGKRYYGEENDVTIAEEANKFRDIMNEVAQFGLIDEHRNKNEENSNTNMIDHLLSLQDSQPEYYTDEIIKGLIMVLIVAGMETSAIALEWAMSNLLNNPEVLEKARIELDTQIGQERLIEEADVTKLQYLHNIISETLRLHPPAPLLLPHFSFEDCTVGGYEVSHNTMLFVNAWTIHRDPELWIEPTSFKHERFENGPVDTHKLIPFGLGIEEGVSGWRHGSKNFGVHFRFIDSMLRVEKDWRGTS

SEQ ID NO: 135972 - protein, 105 aa, Glycine max
  Coding DNA Sequence Number=SeqID_19194
MGCLLTKGVAVTRPGRLFIKNIGLCKVIHDLGKKIWTSKGEEKEAAKKEFIEALKLLEEQLGDRTYFGGDNIGTHYLFSKHQLIFANPPSVNTQYEFNKLIVILL

SEQ ID NO: 135973 - protein, 86 aa, Glycine max
  Coding DNA Sequence Number=SeqID_19195
  Gene Ontology: Mol. function=DNA binding; Cellular component =chromatin; Biological process=DNA integration
MGFAKTFSHITDNFYWAGMRQDVKCFIYECPTYQVTKGHHDFGGGGPLLQRDTFHHVFDKLHSSSSYSGVPRLCLQAPRHSLKPYF

SEQ ID NO: 135974 - protein, 98 aa, Glycine max
  Coding DNA Sequence Number=SeqID_19196
  Subcellular localization annotation: CTP_CleavageSite=85; ConfidenceScore=5.04e-01
MTHHQVKCLLHTNRAYAFFHLQLIPSKPHPPNPLVETLTQTSAIQQLLTQSSLLFTEPKTLPPPRTRTTLFIFSSTPNPPMFVLTATPTFKSKRLNGK

SEQ ID NO: 135975 - protein, 191 aa, Glycine max
  Coding DNA Sequence Number=SeqID_19197
MEQHVHHVPEPPSSRQHRSQTIARLKDVVLQLTNTQSSLHSKIDDPIQRISSLGGHTFDHESTLTPTPHRNLRHMKLDVPYFDNFNVVSWIFKISYFFIIMTPVMRRAFKSPPSTWIVWYSTGFDGCFAMAKFPLDPNLFLRWRCVSPSYYNDPKGALFKLIQYKFVNQYLSSLESSMNWIVGLPPHFFLS

SEQ ID NO: 135976 - protein, 269 aa, Glycine max
  Coding DNA Sequence Number=SeqID_19198
  Gene Ontology: Mol. function=oxidoreductase activity; Cellular component=proton-transporting two-sector ATPase complex; Biological process=flavonoid biosynthetic process
  Homolog annotation: Hit_ID=Q1SGA8; Match level="QueryCoverage=98%, HitCoverage=73%, E-value=5e-41, Identity=33%"; Hit description=2OG -Fe(II) oxygenase
  Pfam annotation: Domain name=2OG-FeII_Oxy; Domain location=118-219; Score=79.5; E_value=1e-20; Accession=PF03171.10; Description=2OG -Fe(II) oxygenase superfamily
MQLVNHTIPDGVFDNILKGVSDFFNQTTLDERRNYSKKFPLDKIRWELNSSAGENREYLKVVAHPQYHFPSNPSGFSKILEEYGKEMRKIVIGLARAVSKTLGFEEHFVEKALNLKSGFDVLAMNLYPPNAKSKGAVGLSEHTDPGFVITLLQDINGGLQILSHKGKWINAYIPHHAILIQLGDQLEILTNGMYKSHIHRVIVGNNKVRRISVVGIHGPSLDKLISPSIEFVDEKHPQGYRGMTYKESLEVNGDDEIDVQSSLEQARLV

SEQ ID NO: 135977 - protein, 60 aa, Glycine max
  Coding DNA Sequence Number=SeqID_19199
MHAYAFCHPVSRRISEDLADTTPNSRQRSVVVWFHILLRAAISFIQKLRGKYEQVMFKYA

SEQ ID NO: 135978 - protein, 131 aa, Glycine max
  Coding DNA Sequence Number=SeqID_19200
MDFSQTVVGRWVRIMRTSTTTLTQIWMTLLLSNILPNDHNSDLPLPKCHLVYAILTQVSVHIAQLISDAIYLFVGISPMRHPVDPKKSNRALGFPALITGLCQFYGVSVTPDKLIRPPINRAFIKKYCTPK

SEQ ID NO: 135979 - protein, 148 aa, Glycine max
  Coding DNA Sequence Number=SeqID_19201
MARRDKYGHLLPLSKTQCLSNEATEVSFAIPRQSSLVACEDRHGHPFFSFIASKAPRLLLKGFVDWASEGNGQETQDRGKMVHFGTFLSRLVHLGPLDDLGGKQPTRLGEQVAFGAWEAKEKGFSTLGKHISLKISEKKEKEQENQGR

SEQ ID NO: 135980 - protein, 196 aa, Glycine max
  Coding DNA Sequence Number=SeqID_19202
MGSLKWTSSIRSKGTYRGLESEPLEGKVSSSVDESSSPRVQESSGDVSVPTRQPGILTNTWCAGTLVDAKSDPDFLSNTWGAVFSCEARQADVVSWPPPMPPDKPVPSKVCRLASARNRQKIQGLKKNGRSIEEESLPRCRLQQDRPGQIKNDENNSWSTIVAGDKDYENNQCHVKLGLALQRWQGHWEMPKEGER

SEQ ID NO: 135981 - protein, 129 aa, Glycine max
  Coding DNA Sequence Number=SeqID_19203
  Gene Ontology: Mol. function=metal ion binding; Cellular component =integral to membrane; Biological process=ubiquitin cycle
  Homolog annotation: Hit_ID=Q84TF5; Match level="QueryCoverage=39%, HitCoverage=29%, E-value=1e-17, Identity=73%"; Hit description=RING -H2 zinc finger protein RHA4a
  Pfam annotation: Domain name=PHD; Domain location=22-67; Score=1.8; E_ value=0.037; Accession=PF00628.19; Description=PHD-finger
  Pfam annotation: Domain name=zf-C3HC4; Domain location=23-64; Score =33.4; E_value=8.1e-07; Accession=PF00097.15; Description=Zinc finger, C3HC4 type (RING finger)
  Pfam module annotation: Pfam domain module=PHD::zf-C3HC4; Domain location=22-67::23-64
MVFLFPFLLVPAEKIITRHIRRCCVCLGEFELKEELVQIPYCKHVFHLECIHHWLQSNSTCPLCRCSIIPTTKFLNPAPPINIISTDPPQQHGAIISDFPLQILSLPPQSQDHQEVVGASSNAANLSRE

SEQ ID NO: 135982 - protein, 325 aa, Glycine max
  Coding DNA Sequence Number=SeqID_19204
  Gene Ontology: Mol. function=RNA-directed DNA polymerase activity; Cellular component=nucleus; Biological process=RNA-dependent DNA replication
MDNTFLVQELLRKYARKRISPRCLLKIDLHKAYDSISWKFLDWMLKSMGFPAQFCSWIMECITITSFSVVVNGSIYGHFKGQHGLRQGDPLSPYLFVLYLEYFSRDLQSLKDNINFQFHPTCVVVQLSHLAFADDITLLFRGDLPSVSAIFAKLQHFCNVSGLSISTNKSAIYSAGVVQDVLSDIQQLTRFSLGCFPFRYLGGNVWDFISSTSDLVLIKKIIHTGDIITIKEGNVEVAKQTLNSWSSNEQLLVGKAYDYIRGAKPTVNWNSNVWNPAIPPKMSFILWLAIKNCLLTLDRAAFLNKGLLCPLCRTEAESHAHLFFS

SEQ ID NO: 135983 - protein, 46 aa, Glycine max
  Coding DNA Sequence Number=SeqID_19205
MSSKDGVNFHDNPTVSKSGKEKTQCKGHFFKHRHYLKNPNGGCVRI

SEQ ID NO: 135984 - protein, 143 aa, Glycine max
  Coding DNA Sequence Number=SeqID_19206
MAMGTSKAQISLAVLQSLTLISKFDFVTMSLDPLSLNFAGGEWLFDAIGSGTTEKLKSHKENLIANLVRETWWRGGGDQQESGNIGEAKVRENERVSNEARLKGASSKGGKCTESPPTKVDKSGALAPTYPPSKRKSDLRSSF

SEQ ID NO: 135985 - protein, 83 aa, Glycine max
  Coding DNA Sequence Number=SeqID_19207
  Gene Ontology: Cellular component=integral to membrane
  Homolog annotation: Hit_ID=Q6K4V2; Match level="QueryCoverage=96%, HitCoverage=31%, E-value=7e-14, Identity=53%"; Hit description =Putative NEC1
  Pfam annotation: Domain name=MtN3_slv; Domain location=2-46; Score= -7.7; E_value=0.017; Accession=PF03083.6; Description=MtN3saliva family
SFGNGVSWTTYALIPFDPFIAIPNGIGTTFSVAQLILYATYYKSTKKQIAAARNAKEVNLSEVVVGNSTVQDPNNNKISAAPY

SEQ ID NO: 135986 - protein, 498 aa, Glycine max
  Coding DNA Sequence Number=SeqID_19208
  Homolog annotation: Hit_ID=Q8LPG9; Match level="QueryCoverage=86%, HitCoverage=54%, E-value=4e-84, Identity=45%"; Hit description =Putative SF16 protein (SF16 protein (Helianthus annuus) like protein)
  Pfam annotation: Domain name=IQ; Domain location=85-105; Score=32.1; E_value=2e-06; Accession=PF00612.17; Description=IQ calmodulin -binding motif
  Subcellular localization annotation: CTP_CleavageSite=50; ConfidenceScore=5.64e-01
EQQLLGLRPATPPERPKTPPYAPPRAPSPRPPSPRVPSPRPPSPRAASPRAASPRVTSPKATSSRIAHHHKEVGHRPEPTLRQQQASATKIQSVYRGYMARRSFRALKGLVRLQGVVKGQNVKRQTVNAMKHMQLLVRVQCQIQSRRIQMLENQARYQADFKNDKDAASILGKLTECTITNHIFSAIDGHAFLVASILLDVKLVTYYDFSHGNEEWDDSLLTKEEVEARLQRKVEAIIKRERAMAFAYSHQLWKATPKSTHTPVTDTRSGGFPWWWNWLERQTPAATPQERQSLKNFQITPPRPYSEQKTSPRPGSSTQRQPQQQQPHFAFDNMDTPTPKSTKSTIVTSSKPARTPPFRTPQANGSGSGSRYPRPRGVGSNSPFDVPLKDDDSLTSCPPFSVPNYMAPTLSARAKVRASSNPRERLGGTPTSTDSKRRLSFPLSQGIGSFKWSKGFSNKDQRIPDKFQSLESIGNVSVDSTVSLPARVVGRKPFTRFV

SEQ ID NO: 135987 - protein, 66 aa, Glycine max
  Coding DNA Sequence Number=SeqID_19209
MAKFGTSLSIGMLATVGDGDGVDVGTRGGSCASIRDGDGVDVVEGGDVVVATLEDLTGIDTIDRVG

SEQ ID NO: 135988 - protein, 101 aa, Glycine max
  Coding DNA Sequence Number=SeqID_19210
  Pfam annotation: Domain name=zf-C2HC_plant; Domain location=47-100; Score=-1.3; E_value=0.058; Accession=PF07567.3; Description=Protein of unknown function, DUF1544
  Subcellular localization annotation: CTP_CleavageSite=68; ConfidenceScore=5.55e-01
MTAPWRYGFTGFWKNTTNNDGVAGMSSASKNNNTQTPARPTAPRERDAAPHTSTMTATTANSSATTICDGNVGGITRPKEHLIGKSSSVASCMKTPPNVVE

SEQ ID NO: 135989 - protein, 64 aa, Glycine max
  Coding DNA Sequence Number=SeqID_19211
MEHFTTYLYIPRTTRSFLSFWGDSEAQMLLVCEDMLLGAPSIEQEVEGRKAYDEDLFESIISKI

SEQ ID NO: 135990 - protein, 142 aa, Glycine max
  Coding DNA Sequence Number=SeqID_19212
  Gene Ontology: Mol. function=DNA binding; Biological process=DNA integration
  Homolog annotation: Hit_ID=Q2HRM8; Match level="QueryCoverage=53%, HitCoverage=6%, E-value=2e-20, Identity=56%"; Hit description =Polynucleotidyl transferase, Ribonuclease H fold
MSLSSEVEPGSYQEALQHQWWRDEMKAKIEALELNQTWDIVDTPPSARPIGCKWVYKIKQHSDGSVERYKAQLVAKKRSTWFFLLAFILGHPNVVNSSSPFMVYLLTYSRLLGSKPVSTPMDNTVHLREESGDLLADPLPYR

SEQ ID NO: 135991 - protein, 202 aa, Glycine max
  Coding DNA Sequence Number=SeqID_19213
  Gene Ontology: Mol. function=helicase activity
  Homolog annotation: Hit_ID=Q1SRJ5; Match level="QueryCoverage=98%, HitCoverage=24%, E-value=2e-55, Identity=49%"; Hit description =Probable helicase [imported]-Arabidopsis thaliana-related
YIYLPDRYICPCESTWRIFGFPIHGRKPVVERLHFHLPGQHSVLYEDHDDIDDVLSKPSISDSKFISWMNTNQNSVEGKNLTYAEFVSKFVYNQKKRCWHLRKKGYTIGRLLWVPPITGELFYLRMMLTVYKGPTLFEDLRTIDNVQYPTYKEACFAMGFLQDDKEFIEAIKEAKYWGSAYYIRKLFVLLLLIATMSKPEQV

SEQ ID NO: 135992 - protein, 745 aa, Glycine max
  Coding DNA Sequence Number=SeqID_19214
  Gene Ontology: Mol. function=RNA-directed DNA polymerase activity; Biological process=RNA-dependent DNA replication
  Homolog annotation: Hit_ID=Q1RY72; Match level="QueryCoverage=46%, HitCoverage=94%, E-value=7e-50, Identity=33%"; Hit description =Endonuclease/exonuclease/phosphatase
  Pfam annotation: Domain name=Exo_endo_phos; Domain location=352-597; Score=12.9; E_value=0.0018; Accession=PF03372.13; Description =EndonucleaseExonucleasephosphatase family
MAKRGRGQPPNTVPPPPVNHPQPATNLVVETENHELQKHEETIEEFEATTKSPETLIEEPKEVTDRKLWVDVLNNNRNPSNGVTMEFVAPKLINGEVEVEIEAEDIASELQFWENAMILYVLGGILSMTMLKNYMVKMWNFVILPDMLYHDDGYFLLRFMNREDRETVMMRGPYTIRNMPIILKEWTPDFNLSKDLEKTMPIWVKLPQLPLCLWGLKSLNKIGSAIGNPLITDECTAQKLRVSYVRILVEVDITQKLVEEITISDRTGGKIKQIVEYEWKPEFCEKCQKAGHQCGKKKVVKKWIPRNKQADEVKADPLPKTPVQNTETEGEDKPEGWITVGKAARHTCKAIEVIGTSNVDCSNGFKALEVLNDSLGGLGMLKEISSRLLKLRPTIAILIETRVKNKNAKKIRDKLKLPHNYLDNYKWHDNGRLWIEWDNSKIDVRHVKCSSQYVHVGVYNLQGEFKFWLTAVYALNQLDRRKVLWKDLEAIHKHQQGPWCVIGDFNNVTKAQDRIGGKAVTESEYIDLLNMMETTCLAEMDTTGEFYTWTNKQVIGTIYSRIDRVLGNLNWFQDNLDTVLTVLPTSVSDHALLCVSRKDPIIKNNKNFRFSNCLIEMEGYNDMVKASWSRPTRGSPMVRLWNKLKRLQQDMRRFSKPLSNLKQNLIKAREDLQFAQENLRNNNMNGDRIDRVRQLTEEVINLNELEEKMLMQRAKVDWIRKGDGNNSFFHDIIKSRNNRRSIYML

SEQ ID NO: 135993 - protein, 450 aa, Glycine max
  Coding DNA Sequence Number=SeqID_19215
  Homolog annotation: Hit_ID=Q6Z6L4; Match level="QueryCoverage=8%, HitCoverage=4%, E-value=3e-10, Identity=70%"; Hit description =Putative aminopeptidase M
MGHFEKPIIKVEPLDEPINSTKVVEDTEVDIMSWTNKGDFGPNKVEDPDATDYSSSFADTTSDAENGYRLSDAEVESEFLGDNGLANTSDGSAFPMRKRKLTNRWRNFIRPLMWRCKWTELRIREIDSQALKYSKELAEYDKGKHTAPDEFTLEEFGSKSLPFLGEQLRSKAKKRRRRKKVEDTTDIGSYTSQNKKSDPDGYLADDFGNPVITEPHVDSTDRFDIGEDQPLLDFNEIDASFQKMLWTIDNIHARVHKLKTDVDGILSKNASKFSSSENLSFLLNHGDVQQTSSAQSPTISAGNGDTVSVGVIYNSTQDGADFDIGDFVMHDSAISSYGEGPMIPDIIESTVGLLSAVDVTLHSALVVDPCEDVSWSLGAPPGSAIGIITHCWKINLVLKVVDDWDFSRFMKKLRPYFPLWKTAINGKIANPCCKPLIQPQTCPLYAASSN

SEQ ID NO: 135994 - protein, 520 aa, Glycine max
  Coding DNA Sequence Number=SeqID_19216
  Gene Ontology: Mol. function=nucleoside-triphosphatase activity; Cellular component=membrane; Biological process=transport
  Homolog annotation: Hit_ID=Q8W1S2; Match level="QueryCoverage=93%, HitCoverage=70%, E-value=0.0, Identity=68%"; Hit description=ABC transporter-like protein
  Pfam annotation: Domain name=ABC_tran; Domain location=213-449; Score= 101.2; E_value=3e-27; Accession=PF00005.17; Description=ABC transporter
MTEVARSVVHDVLGQRVVDVDQPIVDYIVNVLADDDFDFGLDGQGAFEALGELLVAAGCVDDFSHCRSVSPNPNPSFISFKVCSTLCDKFGKHGLVKEKPAVRSLAAPFRMNEGMDDVQAPKKKPEPVDGPLLSERDRLKLERRKRKDERQREAQYQMHLAEMEAARAGMPVVCVRHDNSGGPNVKDIHMENFNISVGGRDLIVDGCVTLSFGRHYGLVGRNGTGKTTFLRHMAMHAIDGVPRNCQILHVEQEVTGDATTALQCVLNSDIERTQLLDEEAQLVAQQREFEDKIEKGDSNGVVGRDDISKRLEEIYKRLEHIDADSAEARAASILALILMLMCLSLCLICWVIDFPKGEPVMGLSFTPEMQKKATKTFSGGWRMRIALARALFIEPDILLLDEPTNHLDLHAVLWLESYLVKWPKTFIVVSHAREFLNTVVTDIIHLQNQKLTTYKGNYDAFEKTREEQVKNQQKALEANERARSHMQKPRICCSVILVYWVVNFKPQVLDLYNKSYTLCH

SEQ ID NO: 135995 - protein, 125 aa, Glycine max
  Coding DNA Sequence Number=SeqID_19217
MELQKLRKITGIVKNKREIMVDNVLIHEVAETDEHTFKSASQYPVERLQDVERGEGEEESLNPVPIPMSDIHMATTNPAVSQEQSTLKSCMYRDGNILKNKRKRGERKACSGSWNKKCSGESENQ

SEQ ID NO: 135996 - protein, 162 aa, Glycine max
  Coding DNA Sequence Number=SeqID_19218
  Homolog annotation: Hit_ID=Q6RZU5; Match level="QueryCoverage=63%, HitCoverage=67%, E-value=9e-27, Identity=62%"; Hit description =Hypothetical protein H9-9
MYVVKGMNQAAAAAPSQELVHDIHFISSCRKPWYQRAIEVTNLWKSVSKSTEIPTPNSTLWKRSSMPKSPQVPTTPSPNNKNRLRKCASLKVASSFTRVCLCAPIYSYNEILRAEVPPRRSNSYPRSKPLQNEHERTNSARLSTEGRRVFRGKSLTDDVLMR

SEQ ID NO: 135997 - protein, 83 aa, Glycine max
  Coding DNA Sequence Number=SeqID_19219
MKQKGLFCLPRNQRGMVFTSLENHHALISPTATEVVNNVVFKIATLKREKAMKMDEILKLRKETDSLLCKAVLESEMSAVEKA

SEQ ID NO: 135998 - protein, 87 aa, Glycine max
  Coding DNA Sequence Number=SeqID_19220
MAKTDDKMSNFDVGDLTCGNSTGFGTVDFFIGERHKKVDMLECKMGYSNNGRAAGYSYNGGGAEGENATCTVECPSLLEPSHTVSIM

SEQ ID NO: 135999 - protein, 84 aa, Glycine max
  Coding DNA Sequence Number=SeqID_19221
MDFQPPLEQQACGRPLLASRMHVWTLELTQALLGDPEPLRLPPLAAIHFPSCDFHMTILRRFGPPLQWPILLVGPCWIKWPRNN

SEQ ID NO: 136000 - protein, 96 aa, Glycine max
  Coding DNA Sequence Number=SeqID_19222
MVFECDQGTTVAGQEREERQGLFQDFYSNSATGLRRLLGWLKGSMIIFNNIKNLFSRCCHHFRYQRQDDGPCLYIVRIAHKHAMLLLQIAQDGSKV

SEQ ID NO: 136001 - protein, 181 aa, Glycine max
  Coding DNA Sequence Number=SeqID_19223
  Gene Ontology: Mol. function=nucleoside-triphosphatase activity; Cellular component=membrane; Biological process=regulation of translational elongation
  Homolog annotation: Hit_ID=Q8H0V6; Match level="QueryCoverage=87%, HitCoverage=20%, E-value=7e-73, Identity=85%"; Hit description=ABC transporter protein, putative
  Pfam annotation: Domain name=ABC_tran; Domain location=6-162; Score =12.1; E_value=1.5e-08; Accession=PF00005.17; Description=ABC transporter
MVMYFTSYYMTLGNWKGSEWPQVRIAVFSQHHVDGLDLSSNPLLYMMRCYPGVPEQKLRAHLGSFGVTGNLALQPMYTLSEIMYVGTLGGCCGQKSRVAFAKITFKKPHIILLDEPSNHLDLDAVEALIQGLVLFQGGILMVSHDEHLISGSVEELWVVSEGRVAPFHGTFQDYKKILQSS

SEQ ID NO: 136002 - protein, 358 aa, Glycine max
  Coding DNA Sequence Number=SeqID_19224
  Homolog annotation: Hit_ID=Q017M3; Match level="QueryCoverage=86%, HitCoverage=39%, E-value=1e-14, Identity=25%"; Hit description=[S] KOG1032 Uncharacterized conserved protein
  Pfam annotation: Domain name=GRAM; Domain location=78-144; Score =70.6; E_value=5e-18; Accession=PF02893.10; Description=GRAM domain
SMVPGSRNPMWGEEFNFSVDELPVQINVTIYDWDIIWKSAVLGSVTVPVESEGQTGAVWHTLDSPSGQGPTVVHQKPGPLQTIFGLHPDEVVDHSYSCALERSFLYHGRMYVSAWHICFHSNVFSKQMKVVIPFEDIDEIRRSQHAFINPAITIILRMGAGGHGVPPLGSPDGRVRYMFASFWNRNHALRNLQRAAKNFHEMLEAEKKENAESELRAHSSSVRGNKILDKAPEESMPKTGRLQPFVKEEALVGIYNEVFPCTAEQFFNLLLNDGSNFTSKYRSVRKDTNLVMGQWHTADEYDGQVREITFRSLCNSPMCPPDTAMTEWQHHVLSLDKKNLVFETVQQAHDVPFGSYFE

SEQ ID NO: 136003 - protein, 196 aa, Glycine max
  Coding DNA Sequence Number=SeqID_19225
MAQTKKSGQMTSEATKEIGDKIDTLEDQASQGCFVARGRQDVLTAAIRQPEHPGRVYVAGIGVTIKQYFGLAPRTSLTSSSMASEDLEQLTQKIRDQLEKLITKKCSTIYVVLQPDAVPLKVGPSAARASTKESYVDPSGNDPDTGDCGTSETCRMMRIMKQAKYSLKAQVEKDEGPSGEGQSPRVEKDEGPSGEG

SEQ ID NO: 136004 - protein, 84 aa, Glycine max
  Coding DNA Sequence Number=SeqID_19226
  Subcellular localization annotation: CTP_CleavageSite=32; ConfidenceScore=5.08e-01
MKKNTYTVENSGGSGDGGIKAWSFGNHQLLVRRVMQVTMSIAGLAVLWMFLSNSASSIEFHTFSHYFSAQSIKVILFKRQLNGY

SEQ ID NO: 136005 - protein, 88 aa, Glycine max
  Coding DNA Sequence Number=SeqID_19227
  Subcellular localization annotation: CTP_CleavageSite=50; ConfidenceScore=5.08e-01
MNKKKQQCGRLKQISLRTKKQAGTREAAWRAISRRRKKLTSISIATMAVRLAARTTSEPEAETQELDVVNREWRSCDREDDTGDTSLR

SEQ ID NO: 136006 - protein, 173 aa, Glycine max
  Coding DNA Sequence Number=SeqID_19228
  Gene Ontology: Mol. function=DNA binding; Biological process =regulation of transcription
  Homolog annotation: Hit_ID=Q8LFS2; Match level="QueryCoverage=89%, HitCoverage=41%, E-value=4e-48, Identity=53%"; Hit description =Regulatory protein
MWLRDPFKQFYEDADFQIACDAFNGNSSDINNYPNGGFKYIKSNNRTIWLNKFWFNSSKEYPGFGEQAVFNKIKLNPLISQMKLKIRFLSTSYFGGFCEPSKDLNKVSTMHANCCVGIDNKVNDLKILLEDWKKYMALPEIEKKQSNLTWSVPQSCRILKYSYNKSQYLEFTN

SEQ ID NO: 136007 - protein, 50 aa, Glycine max
  Coding DNA Sequence Number=SeqID_19229
MEWKNARTDVTVQQGRERASMVLQRRRKRGVSEWCRGGMKKLVWMQKKSP

SEQ ID NO: 136008 - protein, 151 aa, Glycine max
  Coding DNA Sequence Number=SeqID_19230
  Subcellular localization annotation: CTP_CleavageSite=19; ConfidenceScore=5.02e-01
MTLPYISSHSEDPQARGTGAMGVGSVRHPPSLPPFSPAKLGFESPWKARPNPAGRAAIGAVTRRHYSSRFPARVVHAPPSFRRKLAQLVSAASSFSSKLVSGVGFWFWQALVPARAFFYPLFCWVSVVDQKWLLLDQFSPFLEPQQSRLQN

SEQ ID NO: 136009 - protein, 440 aa, Glycine max
  Coding DNA Sequence Number=SeqID_19231
  Homolog annotation: Hit_ID=Q8LFZ9; Match level="QueryCoverage=99%, HitCoverage=100%, E-value=1e-140, Identity=59%"; Hit description =Sucrase-like protein
  Pfam annotation: Domain name=Suc_Fer-like; Domain location=74-288; Score=300.7; E_value=2.6e-87; Accession=PF06999.3; Description =Sucraseferredoxin-like
MASNREREESLTFTIPSSSSHSSPITVSDQLDSYLADPRSASGSFQNDGLLSSGDASAADPDFGFSRPDFRQSPLVGTVEFYRRHVFLCYKNPRVWPPRIEAAEFDRLPRLLHAAVVARKSHMKKETRLTICEGHDGTETSNGDVLIFPDMVRYRRLTHFDVETFVEEVLVKDGEWLPGTPEALRGSYVFVCSHGSRDRRCGVCGPVLVSRFREEVELHGLQGKVFVSPCSHIGASQYAGNVIVFGPSMNGEVTGHWYGYVTPDDVPSLLQHQIIKGEILDPLWRGQMGLSVDEQKKKQEQRLLLNDLRNLEDRTLGCRAQDNFVSCCQSNGVSCCQSNGVGCCQSNGDSFFCQNHVLLERRMDPDVIESEAKLSADDKSSETVISRINRINSGKGASRKFPSMTTWLIGWEQEDTYAALAVFCAAVSVVVAYNCYKQLR

SEQ ID NO: 136010 - protein, 153 aa, Glycine max
  Coding DNA Sequence Number=SeqID_19232
  Gene Ontology: Mol. function=transporter activity; Cellular component= intracellular; Biological process=transport
  Homolog annotation: Hit_ID=Q1S959; Match level="QueryCoverage=96%, HitCoverage=43%, E-value=6e-58, Identity=72%"; Hit description =Cellular retinaldehyde binding/alpha-tocopherol transport; Cellular ...
  Homolog annotation: Hit description=retinaldehyde-binding/triple function, N-terminal
LLTAISTIDDLNYPEKTDAYYIVNVPYVFSACWKVVKPLLQERTRRKVHVLKGCGMEELLKVMDYASLPHFCRKKDSRVPRHHVAGNTENCFSFDHVFHKQIYNYITQQAIFIESLLPIRQDSFHVDLPDPDPDDAKIAKTIETEFHKIIIID

SEQ ID NO: 136011 - protein, 56 aa, Glycine max
  Coding DNA Sequence Number=SeqID_19233
  Gene Ontology: Mol. function=transporter activity; Cellular component= intracellular; Biological process=transport
  Homolog annotation: Hit_ID=Q1S959; Match level="QueryCoverage=96%, HitCoverage=15%, E-value=2e-18, Identity=72%"; Hit description =Cellular retinaldehyde binding/alpha-tocopherol transport; Cellular ...
  Homolog annotation: Hit description=retinaldehyde-binding/triple function, N-terminal
MAGCKASFARKNKEESSRTERLWHGGITEGNGLCIPPSFLQKEGFEGAPTSCSWKY

SEQ ID NO: 136012 - protein, 89 aa, Glycine max
  Coding DNA Sequence Number=SeqID_19234
MLPPLAAIYLPSCGFHMTILRKLEPPLQWPVVPVGPSYHDKYVGDPWYRFLAEGDFVHGDELLFYYRSHEDIWEMVIRKQRNWGDNDDW

SEQ ID NO: 136013 - protein, 179 aa, Glycine max
  Coding DNA Sequence Number=SeqID_19235
MTSHSSLTTIKGPSNFLAAIRFSAAFRVSKNIIEVPLSYHRQWRPYYPTLKEFRRTHGIDDNVIMRFFAADKNTSFEVDVIGPIHRQSRPRSVLPPTTFNFLFGSQKVIPVRRGYGKCNQWQITMHDGVPSVAQPWFQHLSENNLMAGDEVIFFFRFDEHVWEVLFRKEVVWDDEDLSS

SEQ ID NO: 136014 - protein, 131 aa, Glycine max
  Coding DNA Sequence Number=SeqID_19236
  Gene Ontology: Mol. function=v-SNARE activity; Cellular component =endoplasmic reticulum; Biological process=ER to Golgi vesicle -mediated transport
  Homolog annotation: Hit_ID=O22151; Match level="QueryCoverage=86%, HitCoverage=46%, E-value=1e-42, Identity=78%"; Hit description=Golgi SNARE 12 protein
MRDPNLELQESGWEELRKEARKIEGDLDVKLSSYAKLGARFTQGGSGSGYVDSGSPPIGSSRSWKSMEMEIQSLLEKLLDINDSMSRCAASAGPATSVTQKLARHRDILHEFTQFNVSTFYQFKKNGSLAV

SEQ ID NO: 136015 - protein, 543 aa, Glycine max
  Coding DNA Sequence Number=SeqID_19237
  Gene Ontology: Mol. function=transporter activity; Cellular component= integral to membrane; Biological process=transport
  Homolog annotation: Hit_ID=Q9CAT6; Match level="QueryCoverage=96%, HitCoverage=97%, E-value=1e-148, Identity=51%"; Hit description =Putative transporter; 29320-27598
  Pfam annotation: Domain name=MFS_1; Domain location=89-485; Score =51.2; E_value=3.6e-12; Accession=PF07690.6; Description=Major Facilitator Superfamily
  Pfam annotation: Domain name=Sugar_tr; Domain location=86-521; Score=- 10.4; E_value=1.5e-06; Accession=PF00083.14; Description=Sugar (and other) transporter
  Pfam module annotation: Pfam domain module=MFS_1::Sugar_tr; Domain location=89-485::86-521
MEEEQKLVKEGTNLEGSESETKLELTVDEVVEEYVGSLGFSQMVHVLLVSLAWIFDAQSTLATIFSDAQPPVWRCKTGLCQGNNNNNSTGSVCGLVPGTWEWVGGNTSSIIAEWNLVCDRRFLAAVPASVYFLGSLIGSGVYGHLSDSLLGRKKTVQLSCILTSITAFATSLSPNIWIYAFFRFANGFARSGIGISCLVLTTESVGCKWRGQVGQYGFFFFTIGFLTLPLVAYPTRTCWRNLYKLLSLLPLAYSVLLLPLVSESPRWLLIRGRSKEALQVLDKFARLNGKKKLPDNLSLVNPCGSQNGESDETSPNNNKENLWTTKWAAIRMVTVMLSGFGVGFVYYGVQLNVENLNFNLYVSVAINALMEIPAVVIGTFLLGFTNRRLLLSMSSYIAAVSSILCTFLSHKGSTSKVHNNNSGNWGQLIIEAIGFMGASTAFDILYIYCVELFPTNVRNFAVSMLRQALMLGASVAPLLVVLGRLSPSISFLVFGVLAISSGVLSICLPETRNAPLYETLKQQEEEEKHNWVSHNDCALEMGK

SEQ ID NO: 136016 - protein, 150 aa, Glycine max
  Coding DNA Sequence Number=SeqID_19238
MKVKAGRIPQIKDQNEEEKESQKANSQKANEDIHPSKGVEVKKVQNPIVPKSIQDDLNVKNIVDVLAKLRTVNSSLEQESSKKEKMKKESFEKGREVEATPDIGELSTFSIPFPPLPTESINIEPPKVSMDISNIHIPTPPFSTKPLLKQ

SEQ ID NO: 136017 - protein, 774 aa, Glycine max
  Coding DNA Sequence Number=SeqID_19239
  Gene Ontology: Mol. function=amylo-alpha-1,6-glucosidase activity; Cellular component=membrane; Biological process=Golgi to plasma membrane transport
  Homolog annotation: Hit_ID=Q5JLH8; Match level="QueryCoverage=98%, HitCoverage=99%, E-value=0.0, Identity=65%"; Hit description =Putative ERD4 protein
  Pfam annotation: Domain name=DUF221; Domain location=303-730; Score =635.8; E_value=3.6e-188; Accession=PF02714.6; Description=Domain of unknown function DUF221
MTTLSDIGVAAAINISSALLFFVAFAILRLQPWNDRVYFPKWYLKGLRTDPVHGRPLVSKFINLDWRAYLGSLNWMPEALRMPEPELIDHAGLDSAVYLRIYLIGLKIFVPIAFLAWIVLVPVNCTSTGLEGAQMKNITSSDIDKLSISNVHRGSERFWGHIVMAYTFTFWTCYVLLKEYEKVATMRLGFLAAEKRRPDQFTVLVRNIPPDPDESVSELVEHFFLVNHPGHYLTHQVVYDANKLAKLVKKKKKLKNWLVYYQNKLERTSKRPEIKTGFLGLWGKKVDAIDHHITEIDKLSKEIVEERENVTNDPKAIMPAAFVSFKTRWAAAVCAQTQQTRNPTLWLTEWAPEPRDVYWRNLPIPYVSLTVRRLITAVAFFFLTFFFMIPIAFVQTLASLDGIQKAAPWLKPLVDIPFIKSFIQGFLPGIVLKLFLIFLPTILMIMSKFEGYGSISSLERRSASRYYLFNFVNIFLGNILTGTAFQQLSSFIHQPANQYPVTIGTAIPLKASFFITYIMIDGWASIAAEVLMLKPLIVYHLKNFFLVKTEKDREEAMDPGSIGFNTGEPRIQLYFLLGLVYAAVTPAVLPFIIVFFGLAYLVFRHQIINVYNQEYESGAAFWPDVHFRIVMALLVSQIVLMGLLTTKKAASSTPFLVVLPILTIWFHRYCKGRFESAFVKFPLQEAMMKDTLERTTEPNLNLKGYLQNAYVHPVFKDSMDDDDDEEDILSMDLETESVTVRTKRQSRRNTPLPSKNNDASSPSLSDGIGNHPEP

SEQ ID NO: 136018 - protein, 131 aa, Glycine max
  Coding DNA Sequence Number=SeqID_19240
MDSNISLSNNTHRCKEKGNVSTFNLKLIHTTKLAYELHSFRFSDHSRDKDHDARQRSYLFAKLQDNTYPPPYGLEHISFGYNLSSATATTVLAQLIAVIGLGNYEDIETKSGTRRLDHVVETRSRIHQVEG

SEQ ID NO: 136019 - protein, 82 aa, Glycine max
  Coding DNA Sequence Number=SeqID_19241
  Gene Ontology: Mol. function=transporter activity; Cellular component= intracellular; Biological process=transport
  Homolog annotation: Hit_ID=Q1S959; Match level="QueryCoverage=90%, HitCoverage=26%, E-value=1e-22, Identity=59%"; Hit description =Cellular retinaldehyde binding/alpha-tocopherol transport; Cellular ...
  Homolog annotation: Hit description=retinaldehyde-binding/triple function, N-terminal
MCIINQEAIKQLQSLMENLDEQQKNTFQIMHRGYPTETLVRFLKARDGNVVKAHKMKPIPPDLYRRLRDSQLVGMSGFSKEV

SEQ ID NO: 136020 - protein, 171 aa, Glycine max
  Coding DNA Sequence Number=SeqID_19242
  Gene Ontology: Mol. function=oligopeptide transporter activity; Cellular component=integral to membrane; Biological process =oligopeptide transport
  Homolog annotation: Hit_ID=Q1SHX0; Match level="QueryCoverage=84%, HitCoverage=18%, E-value=3e-67, Identity=84%"; Hit description =Ribosomal protein S2; Oligopeptide transporter OPT superfamily
MAGVVDNQHDSKLGIPDESEEVDDSPIEQVRLTVPTTDDPTQPALTFRTWTLGLASCIILSFVNQFFGYRTNPLYISSVSAQILSLPVGKLMAATLPTKPIRVPLTKWSFSLNPGPFNLKEHALITIFASAGSSGVYAINIITIVKAFYHRNIHPLAAFLLALSTQVNIHY

SEQ ID NO: 136021 - protein, 95 aa, Glycine max
  Coding DNA Sequence Number=SeqID_19243
  Gene Ontology: Mol. function=signal transducer activity; Biological process=G-protein coupled receptor protein signaling pathway
  Homolog annotation: Hit_ID=P93163; Match level="QueryCoverage=53%, HitCoverage=14%, E-value=1e-15, Identity=73%"; Hit description =Guanine nucleotide-binding protein alpha-2 subunit
MALAFKIWNNRSNRISYKTLFQIGFDEAELKSYLPVMHANLLHDGSKQFAKNDVDSSKYVITNGNKRVILDQVGEFADGVAVKEVVKKLFAYARS

SEQ ID NO: 136022 - protein, 132 aa, Glycine max
  Coding DNA Sequence Number=SeqID_19244
MLGIWILAKNSIDFKIDSIEVHNQATSFMINKNYQWTLFWEYLVDLRTRIKVSRLLGDFNDISKPSEVRGGNSFTWFRGLASCSIAKRLDPAMSYTHWSTHRQLPEERHPECSRKKLLPEDFHCLPEEASSG

SEQ ID NO: 136023 - protein, 182 aa, Glycine max
  Coding DNA Sequence Number=SeqID_19245
  Gene Ontology: Mol. function=oligopeptide transporter activity; Cellular component=integral to membrane; Biological process =oligopeptide transport
  Homolog annotation: Hit_ID=Q1SHX0; Match level="QueryCoverage=99%, HitCoverage=25%, E-value=1e-80, Identity=80%"; Hit description =Ribosomal protein S2; Oligopeptide transporter OPT superfamily
MYVLVPISYWNNLYDAKKFPIISSHTFDSSGATYNVTRVLNDKTFDIDMDSYNNYSKLYLSITFAFDYGLSFATLTATIAHVALFHGKTIYQMWKKTTSALKGQQLGDVHTRIMKRNYEQVPEWWLWQATPIAMVGSPNVSCNCVSFHFANWGHSSNNKHASRTQRDYRVNNWVHLPRKATC

SEQ ID NO: 136024 - protein, 773 aa, Glycine max
  Coding DNA Sequence Number=SeqID_19246
  Gene Ontology: Mol. function=uridine kinase activity; Biological process=biosynthetic process
  Homolog annotation: Hit_ID=Q6EP64; Match level="QueryCoverage=81%, HitCoverage=88%, E-value=6e-48, Identity=27%"; Hit description =Hydroxyproline-rich glycoprotein family protein-like
  Pfam annotation: Domain name=DUF1296; Domain location=15-75; Score =139.2; E_value=1.1e-38; Accession=PF06972.2; Description=Protein of unknown function (DUF1296)
MSGGGGSSSCARVPIPNNVRKIIQDIREITGKQHTDDEIYAVLRECSMDPNETAQKLLYLDTFHEVRRRRDRKKEGLSSRASDEPRLKQGGQGRGGRGGSGGYSSNFPGTISPPFRDGGGGRNQANRRENGVNHIAERSHAPSTQPFSQKTKTNTTSQATRVSAVAPQGAANQSNGKSGHDSGGQSPIVSVPKSTSAAKDTGHQENVQPQAAVVAAASSSTQTFGSVTSSNQGMSVSSSDQLQTSVSDVHSSLDPVVASSVSRSLGVSGAISREVVSNRISAGPNHVRGSKVVHEVNDLSASKNEKYGSMNSASKTNSPQKLNEVENNHLSEPSQLPSPSPNDSLRPSSSSGSQSPLANTTEVSTSEACVQSSAELRQHVTFPNHFQVSKALKSGLTFGSFDTLGPSEKSNSETDGDNNASPALELSDEAATSSNQSASLTAQGDHLDYPHSSSYLIEKAPATNGNPITGTDTKVDQSKKEVLLAPEGQQIPTVQTAQNYGLNFISSMLGTQQVQFEGTEPQSQDTSRFPNFVNASSQAVSPSPTPPLQNSIPVTPQSVSIFRPPYPANFFPYGHYYPPIYVSPIHQFLNHNGFPQQPSAGSMYLPAAAGIKFPLPQFKAGANTGNAAHIGIPSGSFITPPVGYAPGQTVNTGSSTGNEDLVVSQLKENQIYTTGQLSEGSAVWIPAPGQDMSSLQVNSLYNLGPQGQHLTFPPTQAAQGAFAGMYQAGQTIASPSTLLQQSQAVAGPVETVGPPSGSYQQPQPAQINWNSNF

SEQ ID NO: 136025 - protein, 808 aa, Glycine max
  Coding DNA Sequence Number=SeqID_19247
  Gene Ontology: Mol. function=protein serine/threonine kinase activity; Cellular component=nucleus; Biological process=protein amino acid phosphorylation
  Homolog annotation: Hit_ID=UPI000034F1DC; Match level="QueryCoverage =91%, HitCoverage=92%, E-value=0.0, Identity=55%"; Hit description =ATP binding / kinase/ protein kinase/ protein serine/threonine kinase/ protein-tyrosine kinase
  Pfam annotation: Domain name=Pkinase; Domain location=76-381; Score =176.1; E_value=8.9e-50; Accession=PF00069.15; Description=Protein kinase domain
  Pfam annotation: Domain name=Pkinase_Tyr; Domain location=76-381; Score=44.7; E_value=3.3e-15; Accession=PF07714.7; Description =Protein tyrosine kinase
  Pfam module annotation: Pfam domain module=Pkinase::Pkinase_Tyr; Domain location=76-381::76-381
MVPIRIRERERIHNIRLKRKKLEDIPEETELPIDTNPAELEEASLHLETDLEILSRAMDMGLWALCLGYSTNPADYKLLEEVGYGATGTVYRAIYLPFNQLVAIKSFDLDRCNVNLDDLRREAQTMSLIDHPNVVRALCSFAVDRSLWVVMPFMDQGSCLHLIKIAYSHGFHEDVIGSILKETLKALHYLHRHGHIHGDVKAGNILLDTSASVRLADFGVSACLYDNAGDRHRSRNTFVGTPCCLADQCPRDKEKIFIVEIIRLRKKDKDDQQRKFMHFRKHLSTLFLNWMAPEMLQPGSGYNSKADIWSFGITALELAHGHAPFSKYPPMKVLLMTIQNAPPGLDYDRDKKFSKEMVAMCLVKDQTKRPSAEKLLKHSFFKHAKPPELSVKKLFADLPPLWNRVKALQLKDAAQLAVKKMPSTEEEAISRSQYQQGVSAWNFDIDDLKAQASLVRDDDDIAEMREEAEKKFFTNYKAIAIDSQSGTVKMNSEKSPQNKITSQVGAFDIKQTEQDEYLNKKEKNPKSDLQEPGLPKNIIWKRNGSITEATTSTLEKDIGMCKIKGQSRKIRQTQSGPLLPGTVLSHSALERGRTLERLENGNQLLGEKNNHEARRAPSFSGPLMLPMRASANSLSAPIKSSGGFIDSLDDKSKANLVQIKGRFSVTSENLDLVKDIPVSSVSRRSSQGSVSPLQKSASVSDWMLDSKQMAHLSSIESISLHQFISPPKILSPTDLIMNLLNSLQSAEAIEVSQNGKLPPLPRSSEINGSVDTAASERERLLLLKISELQTQMITLTGELTAEKLKHMQ

SEQ ID NO: 136026 - protein, 1319 aa, Glycine max
  Coding DNA Sequence Number=SeqID_19248
  Gene Ontology: Mol. function=RNA-directed DNA polymerase activity; Cellular component=chromatin; Biological process=chromatin assembly or disassembly
  Pfam annotation: Domain name=RVP_2; Domain location=330-452; Score= -57.7; E_value=0.031; Accession=PF08284.2; Description=Retroviral aspartyl protease
  Pfam annotation: Domain name=rve; Domain location=956-1081; Score =13.4; E_value=0.00045; Accession=PF00665.16; Description=Integrase core domain
  Pfam annotation: Domain name=zf-H2C2; Domain location=897-938; Score =23.3; E_value=0.00029; Accession=PF09337.1; Description=His(2) -Cys(2) zinc finger
  Pfam module annotation: Pfam domain module=RVP_2::rve::zf-H2C2; Domain location=330-452::956-1081::897-938
MGNTEKAINEAAEELSIQAISQADTGEPNTRVQIASTGTLETSFCYFNTYHLGAIVDYSMPDSPLTLEEAIRKLTTHQISLAETLQTMTLKLDELLHRLPPVLPDPVASSSSPTPAAPPAITHKIKLEVPRFDGTDPMGWIFKITQFFEYHQTLENERLTVASFYMDGWALAWLQWMNAPSQYEDPTGTHFKLTQRGTVAEYLATFEDLANRTIGLPPPFLLNCFVSGLTPEIHREIQAYHPLTLVQAAGLACLQEEKILDARPHLRPKPPPPLPSPSLTQPLPLKTIIPNPTPLLPSPPRPSPPTDDDPSSPHILQPNLQPEPETPQPDPAQISFNSLAGNVALETLRFMGTIGNHHVVLLVDGGSTQNFIQHQLVSQLSLTPRTTTPLRVMVGNSQQLECTSVCESVSVTIQATQFIVDLHVLPIAGANVVVGVQWLKSLGPVLTDYNSLRMKFFHAGTFVELQGDTETTLNSLSSSQFHRLLHNQPKSLYFHVAILHDDNSMVNPDIDPIIQELIDRFHLLFQAPEQLPPARPTDHRIHLVPHATPVNLRNMMVHGVSVWTIGPYSLTVKDRFPIPTIDELLDELGGARCFSKLDLLQAQVEYLGHMVSFAEVQPVPSKISAIQQWPIPQTTRVVRSFLGLAGFYRRFIKGYASIAAPLVVITTLDMFQWSAEAQAAFDNLKCALSEAPVLALPDFSLPFTVETDASGVGMREVLSQQGHPIAFYSKPFTAKLLGASTYVKELFAITAAVKRWRQYLLGHHFIIITDHKSLKELLTQAIQTPEQHTYLAQLMGYDYQIVYHSDNHNQAADALSRLPEQGSPSLMILSVPCLTLISELCQQLESLPEYVEHRNAIMQSPLSHPHFSITNNLILHKNRIWLPRGFPMIPTLITEYHCTPTGGHMGIAKTLARITENFYWQGLRDDVTQFVSQCLPCQQKKYEMKKSAGLLCPLSIPHRPWEDLSLDFIVGLPLYHGNTMILVVVDRFSKGIHLGMLPSSHTAHTVATLFMDIVGKIHGLSRSLVSSDGQMEVMNRVIEQYLRAFVHSKPRTWGKLLLWVEWCHNTAWNAATGSTPYEITFWRKPFNFPDYLTGSSKIDAVEDMLKEREETFRIIRKKLLKAQATMKKTVDTKHCEVEYRPGDWVLLRLCPHRQASAKRSPEMKGKLAKRFYGPFEVTERIGPVAYRLKLPEQAPTYPVFHCSLLKPFRGNPTSPETSEQSPTGSWEVLVQWEGLSPDETSWEDWNSLRQEYHLEDKVILQGPPDDSMGNTEKAINEAAEELSTQAISQADTGEPNTRVQIASKSKRKVMRPAYLKDFM

SEQ ID NO: 136027 - protein, 1282 aa, Glycine max
  Coding DNA Sequence Number=SeqID_19249
  Gene Ontology: Mol. function=RNA-directed DNA polymerase activity; Biological process=RNA-dependent DNA replication
MTILNGLSLDIEAEKTVAFVAQSGWGTSTMIVRTQEPGLIIGTILDNIVYRKNASEDEVRKAYKKETKDSSGCVVAPNKSQQQPMKAYIGDGYCSPMNKAHPKTEGGGSSVMCRVSCARTSLTEKGPYMGSSRNHLRKGREKILNRSLERDEANAKLSEAMRNKPNTRCGSAKKMQTEPNEAKTGSLEKKHDEEVHELHAMECGGACNGERIRGGAFNRRVTPNKKELSVSPSPLSLFGRLPVTLPPFESRSRLHVTLESPSIGLSGYIAGGQDTPSACLASQENTAPQVLDKKPWSFSASTRVPAHQVFVKMSGCPTVGKGEASMPWINLFKDNRKPSKGFDLKFSSPSSEDVVLLDEDDFQHLEKVWGHSLIGYVVGRFPGKKALLECCQKWGVKFSYSTHENGWLVFKFDSDDMNHVLSASPYFIFQRPLLLKVMPLFFDFANEELSKIPVWVKLRNLPLELWNPQALGKNLSKIGSPIRTDRLTAFKGSISFARALVEVDASLDLIEEVHCKLPTVKQDNKTTTSEGPTAGSPSVQSQDAEVVAFTETNPNNPFGKSKEDQVGLSTQPCMMQPQATDNIPALQTPFDISGVENSKRDFNSILSPKDRFNGVDISAYEMQDFVDCYSELGLGNLNSHRSMYTRTNGRVWSKLDRALCNQLWLNSFENSSCEVVGFESISDHAPLVVTTKVLVPKDGRSHQVPGCCMFKVCKRLKTLKSPLKLLFKQEFSHIANRVNHTRGQVILLRKAESRNVAQLIKNSTSSQSKIANALLNHFKALFSAQELHHPASLAVYNSGPKIPIDCFAFLLSPITKQDVWNVILRMDNNKASVNDGYNALFFKKVWNIIGDDIFAVVNEFFMSGKLLKQINHALIALIPKSDQASQVNHFRPISCYNLMYKIISKILANRIAPMLEHIIGASQSAFLKNRKMMDNIFLVQELLRKYVRKRISPRCLLKIDLHKAYDYISWEFLDWMLKFVSFPAQFCSWIMECITTTSFSVVVNGSIYDHFKGQRGLRQGDPLSPYLFVLYLEYFSRDPQSLKDNINFQFHPTCVVVQLSHLAFADDIMLLSKGDLPSVSAIFAKLHHFCNILGLSIRTNKSPIYSAGVDQDLVWTASLLDTWVFPFYLPDSMSATMLPCFLRLQALFRVETVKLSYAWKVELIRAVIQGIVNFWICIFPLPQSVLDRINASCHNFLWGKAELLAGRAYDYIRGAKPAVNWNSVVWNPAIPPKMSFILWLAIKNRLLTLDRAAFLNKGLLCPLCRTDAESHAHLFFSCKISL

SEQ ID NO: 136028 - protein, 227 aa, Glycine max
  Coding DNA Sequence Number=SeqID_19250
  Gene Ontology: Mol. function=nucleic acid binding; Biological process= DNA integration
  Homolog annotation: Hit_ID=Q1RWN2; Match level="QueryCoverage=69%, HitCoverage=13%, E-value=4e-48, Identity=55%"; Hit description =Peptidase S8 and S53, subtilisin, kexin, sedolisin; Integrase, catalytic region; Zinc finger, CCHC-type
MASESSFVQPAIPKFDGHCDHWALLMENFLRMEGTPLTEVERKYIDDQKLKDLKAKNYLFQALDRSILETILNKDTSKNIWDSLKQKYQGTSRVKRAQSQALRKEFEILHMKEGESVNDYFARTLTIANKMKANGENKGDVAVVEKILRSMTPKFDYVKKRRPCRLLIQINMQNRDEVVEALDEEEEDEAEDVANRDLTNPLWSATLVINSDISAGNVQTKERRPTM

SEQ ID NO: 136029 - protein, 823 aa, Glycine max
  Coding DNA Sequence Number=SeqID_19251
  Gene Ontology: Mol. function=nucleic acid binding; Cellular component= intracellular; Biological process=DNA integration
  Pfam annotation: Domain name=rve; Domain location=31-186; Score=27.2; E_value=3.2e-05; Accession=PF00665.16; Description=Integrase core domain
  Pfam module annotation: Pfam domain module=RVT_2::rve; Domain location=369-584::31-186
MNDNTYTVTGVFFVPDLRNNLLSIGQLQEKGLSILFQHGKCKIWTFEFSGFKYALPAEYGIWFANNENTNKTVPGLLGREAITSFIPKEEYLEGYTEKSEALSVFKKFKILVEKEADSLIRTAYTPQQNGIAERKNRTIMNMVRSMLSEKKMPKTFWAEAATWSVHILNRSPTLAVINKTPEEAWSGVKPSVKYFRVFGCISHVHVPDAKRTKLDDKSLCCVLLGVSEVSKAYKLYDPISQKIIISRDVVFDEDKSWDWDKQYEETILCDLDWGDKDVEAVVEEEHEVRHNTDTPKEDIIISSDSMAEVNTSSPVQRRCRRPPLWMEDYETGEGLSEGSTEANLAMSATGESDPTHFDAAVQIAKWRKAMDEEMEAINKNGTWELMELPDGAKKVGVKWIYKTKFKENGEVDKYKARLVVKGYAQEYGVGYTEVFALVARMETIRLVVALAAQKGWPIYQLDVKSAFLHGELDETVYVDQPCGYEQKGEEHKVYKLKKALYGLKQAPRAWYSHIEAYFLKEGFENSMKHEFDMTDLGNMRYFLGLEVMQRIDGIFLCQKKYALEMLQRFGMDKSNSVQTPIVPGVKLTKDDTGVKVDKTYYKQIVGSLMYLTSTRPDMMFVVNLISRYMENPTELHLLAAKRVLRYLKGTTEFGIFYKKGGNKELLAYTDNDYAGDLDDRKSTSGYVFLLCSAAVSWSSKKQPIVSLSTTEAEFIGAASCACQAIWLKRVLGKLCKMQDQATVIRCDSSSAIKLSKNPVMHGRCKHIDVRLHFLRDLTKAGTIKMMHCGTQEQVADIMTKPLKLDTFLKLRRSLGMCSESDIN

SEQ ID NO: 136030 - protein, 350 aa, Glycine max
  Coding DNA Sequence Number=SeqID_19252
MEHNGDKGNFLIWDATCIKMFDKTAAECRDELIAICSARCNDRLNDTVVGDDIKVFPPCVDEILSKNWAVRFKYHSQLRQSSVLYVSEEPHYIQTLTTTLGLKGEASMGKAIVVEPESSPPIYHPTVDGYYFRKDAACSMPLKQMGTGYGRYKVFILHCYYRQVSNNSFIVLPTPKPNSARTMSSVISTASTVNFIQIPLACHRQWRPTYPLYITFDYNGEKHFIKVRRDGNKFYFADGLKDFRRALGIHEGMVVHFATPDRNTSFYMHFMPPLDRQTSGRPYSITRTYIFTVDITNHIISTPTPLVLPPNAVDIIGHRYQYLTVEAPRGHQIWRMSIQDGLQTLTTPWY

SEQ ID NO: 136031 - protein, 669 aa, Glycine max
  Coding DNA Sequence Number=SeqID_19253
  Gene Ontology: Mol. function=nucleotidyltransferase activity; Cellular component=integral to membrane; Biological process=aromatic amino acid family biosynthetic process
  Homolog annotation: Hit_ID=Q6R3L0; Match level="QueryCoverage=94%, HitCoverage=94%, E-value=0.0, Identity=66%"; Hit description=Metal -nicotianamine transporter YSL1
  Pfam annotation: Domain name=OPT; Domain location=42-654; Score =503.4; E_value=2.6e-148; Accession=PF03169.6; Description=OPT oligopeptide transporter protein
MMSAPANLETGGEEKKLEIEKEKEVESQVEVADTESKPWKEQITVRGLVVSMVLGIIYSIIAMKLNLSAGIVPNFNASAALLAFLFVRSWNKVLQKAGFISKPFTRQENTIIQTCAVSCYSIAVHGGFASYLLGLNRKTYELSGVGAEGNNPNTVRDPGYAWMTAFLFVVCFVGLFILIPLRKIMIVDLKLTFPSGLATAVLINGFHTQGDKMAKKQVGGFLKYFSISFMWGFFKWFFSGTQGCGFAQFPTFGLKAWKQTFYFDFNMTYVGAGMICPHLVNLSLLLGAVLSFGVVWPLIDLRKGDWFPTNLDESSMKALYGYKVFLTVALILGDGLYNFVKILVSSILSVHEKIKNRKNAVSGDQQGDNGEELKKKQVFLRDNISMWIGTGGYIVLSVVAIIVIPQMFPQLKWFYVVVAYILAPSLAFCNAYGTGLTDMNMAHNYGKVALFVIAAMSGRDNGVVAGLVGCGLVKSVVSVACTLMLDFKTAYYTCTSPKAMFICQLVGTALGCVIAPLSFFLFYKAFDVGNPHGEFKAPYALIYRNMAVLGVEGFSALPHHCLQLCYGFFAFAVAVNMVRDLSPKKIGKWMPLPMVMAIPFLVGAYFAIDMALGTLVVYVWHKLNSKKAEAMIPATASGLICGEGLWALPASILALSKIKPPICMNFLAS

SEQ ID NO: 136032 - protein, 67 aa, Glycine max
  Coding DNA Sequence Number=SeqID_19254
MTPLMKKIQDLQAPHGATSTRVKTPTMKIHFQHQLFRTFYIGSKTDVESANVECINVNIGFVKPMLT

SEQ ID NO: 136033 - protein, 115 aa, Glycine max
  Coding DNA Sequence Number=SeqID_19255
MSLQSRKRSPACDKDELRQKEKEEERPRSLNANHNGLPKSIPTLSGTLSFPSFLRVAKDVPQSISGRDELHKHELHNVVAVTEVQASLRQRRTQAEGERRRTIGFERAGCAISYF

SEQ ID NO: 136034 - protein, 125 aa, Glycine max
  Coding DNA Sequence Number=SeqID_19256
  Gene Ontology: Mol. function=nucleic acid binding; Biological process= DNA integration
MSKSNFTSVFLDHDLAMLEEKFVTIIDVSSNEEKVYNKTWERSNRLSLMLMRMTVADSIKTTLPKIESAKKFMGLVGEYSQTAEKSVVGTLMSTLTTMKFDGSPTMYEHVIEMTNIVARLKTLGI

SEQ ID NO: 136035 - protein, 110 aa, Glycine max
  Coding DNA Sequence Number=SeqID_19257
MGLDGVADSVDRRTNMMVFHFACRERIDDYSKLRVIILYDISITERQSQQLGNKQQLKEKKEREGKKKKAKMPPDVIQFRPTVAPLQFSSPTKRTSPTRRTGNQWHNYYF

SEQ ID NO: 136036 - protein, 64 aa, Glycine max
  Coding DNA Sequence Number=SeqID_19258
MNWRGSCLLFATLLVEKILLCVTSNLKRSTAFSVARNNIEEGEIERRRSGKVVTVYVKGARIGE

SEQ ID NO: 136037 - protein, 147 aa, Glycine max
  Coding DNA Sequence Number=SeqID_19259
MSSQTHKIYGLPMPVTYNCQSEHPSRGIYISSSETNEFRHGMLLISARTLMSLSKAMTSESPPYASKKAHIGQEQQKQKKKEVNTESSCPINQHRPKALPHYTQDIDGEESDNCSEYANYTTTTWGLFPRFCLLNPMPGLRIVDKVQ

SEQ ID NO: 136038 - protein, 185 aa, Glycine max
  Coding DNA Sequence Number=SeqID_19260
  Gene Ontology: Mol. function=nucleic acid binding; Cellular component= intracellular; Biological process=chromatin modification
  Homolog annotation: Hit_ID=Q1H8M0; Match level="QueryCoverage=99%, HitCoverage=90%, E-value=4e-47, Identity=58%"; Hit description=Cys2 -His2 zinc finger protein
EDKVYVNDNHVDGGSQENAAKSEIVTPEGDNLGEWLSLGIKGDNIPLEAAEQNPADSQSRPLHNKVFSCIYCTRKFYSSQAFGGHQNAHKREKQAAKRSYRSHMMLTTTSMGLAYSSLASRSLGIQPHSLVHEPSRERSAMAASFSDAGYWNGMASWTPPSMLEQAGHFSWPGSLQLELPKQESD

SEQ ID NO: 136039 - protein, 236 aa, Glycine max
  Coding DNA Sequence Number=SeqID_19261
  Gene Ontology: Mol. function=RNA-directed DNA polymerase activity; Biological process=RNA-dependent DNA replication
MKHPNGKAFGDIPLPNTLGGPQYHPQPQSLHFAWERLPLAIVEREKFDHIEGRLRAIEGSRDYAFFDMVELCLVPDVIIPPKFKVPDFNKYKGTTCPKNHLKMYNRKMGAYLKNEKLLMHFFQKSLTRAAYQYNSDMALDRMQLQNMCKKEGESFKEYIQRWRDLAAQVGLPMMEREMITMIVDTLPVFYYVKMVGYMPSSFADLVFTGKRIEVRLRRGKFDYLALMNEKPGANRE

SEQ ID NO: 136040 - protein, 133 aa, Glycine max
  Coding DNA Sequence Number=SeqID_19262
MAYSLVDDAASYLFSFVFRCISRWKITIKGPQSSSRRPCILMQSYPSSLLDRRLQEDWARAAKEGSRLLMYLRMVPLLTYSPLSSTATPWLKITIEGPHRSLKIQPHRSFSSKLPSSGIRAQELQVGCSLNLH

SEQ ID NO: 136041 - protein, 189 aa, Glycine max
  Coding DNA Sequence Number=SeqID_19263
MSSWSFQLLDAEDRPLGALDGVTGGSAEIVAQDVLGGSGTLNLDRRKDIDWMSHRVQATYIGGAASWAVGTYLLSSPSEKHSAFGISYEVGLLTKMNVISEDTVDARYSLPVGTPVITTVVALIQSTGETRISVTSSASVLTSAMTWEAGTSKLTIVNDLLQVAGYWSLWCDGSGLFRLEPYTDPAKRP

SEQ ID NO: 136042 - protein, 160 aa, Glycine max
  Coding DNA Sequence Number=SeqID_19264
MAVPGLDRPDDELPRHRDLFDRSVDAAAVGIAEHEDRLVDLHERREIGDVRRLLIADRVIGDSTRHLDYTRERLARVGDRKPSAGVLLQRPLPPRRDLHARIERQTRSAAEAAPTRQPERPRARLHDGLRDRRSALRSDRRGPVVNIAEAQRLPVDQRRR

SEQ ID NO: 136043 - protein, 75 aa, Glycine max
  Coding DNA Sequence Number=SeqID_19265
MGQSVYYRDSVQNKAFGMKVARPGKLLLHSEATLLAQASWLLHHEVILVAKQVRGQKKCKNELFSLPLSIFRLLS

SEQ ID NO: 136044 - protein, 167 aa, Glycine max
  Coding DNA Sequence Number=SeqID_19266
MGEVDEVQEQMKADMEAMKEQMATMMEAMMSMKKIMEVNAAAVAATSAIAEVDPTPPSGLNQINHPTLDMVVQNKHAFPPYGLPPNYTPPNVAHTPDVNNSTPIVIGSQQPQSDHAHVSQLMGETHEIPHHNLSDFEPCIGYATEGQAVSDVPLPNTLESPQIRSQP

SEQ ID NO: 136045 - protein, 112 aa, Glycine max
  Coding DNA Sequence Number=SeqID_19267
  Subcellular localization annotation: CTP_CleavageSite=37; ConfidenceScore=5.21e-01
MAPPARSYPLHGLKLPITVLFIFFLSFLPSKSGGSVMVESTREGLEESKMVIGSKPPACVNKCKSCRPCMATLVVPNHQKRKKGFKVSSRGDDDTYYLLSWKCKCGNKLFQP

SEQ ID NO: 136046 - protein, 92 aa, Glycine max
  Coding DNA Sequence Number=SeqID_19268
MKNDVEVDYGRNSVLPQPCFSLLLSDFSQYMKAKPLPSAPSRLFIGNEGTWLISSSPRRAGYFTPKSFRGLGKPKASPGSEKAPKGPFCPPF

SEQ ID NO: 136047 - protein, 109 aa, Glycine max
  Coding DNA Sequence Number=SeqID_19269
MGAGASTEPQGHESQGVGGIQRPGVKTTMGSDGMKGWCCFGPHKADGVRIKRKSHKQLVSHACTCRAARNCSDQHNHVIASPYTSISLPLSPPLFIVQSFHSTPLHLII

SEQ ID NO: 136048 - protein, 114 aa, Glycine max
  Coding DNA Sequence Number=SeqID_19270
MVIEENHTHLVALVEPRISGAYSNLVVNKVGVDGAFHEKVGGRRLDYNVSSKMLQCLSSYELMDMDFFGPFLTLSKGSLKKHIDRVVANKSWQVAFLNSKVIHLALPAYDHRGL

SEQ ID NO: 136049 - protein, 119 aa, Glycine max
  Coding DNA Sequence Number=SeqID_19271
  Homolog annotation: Hit_ID=Q9LW01; Match level="QueryCoverage=98%, HitCoverage=98%, E-value=1e-10, Identity=35%"; Hit description =Arabidopsis thaliana genomic DNA, chromosome 3, P1 clone: MSJ11
  Subcellular localization annotation: CTP_CleavageSite=49; ConfidenceScore=5.70e-01
MALVSVTTANSSKHILLRTLSRSHAFSFSLHRQFQPLSSSSAVLRRLPRCHAASPGPPLPPSENDSSRHLKGADVATSLSKIQDRIQIFFAVLFWMSLFFWASAWDGRNRPDKGSRFRR

SEQ ID NO: 136050 - protein, 62 aa, Glycine max
  Coding DNA Sequence Number=SeqID_19272
VRDCNTSYFHQSFLAGRRCNRIDALLDAKNVWVCDGSQIHTMILNHYKSLFQCEDHMLTYLT

SEQ ID NO: 136051 - protein, 219 aa, Glycine max
  Coding DNA Sequence Number=SeqID_19273
  Gene Ontology: Mol. function=translation initiation factor activity; Biological process=cellular metabolic process
  Homolog annotation: Hit_ID=Q84YE3; Match level="QueryCoverage=78%, HitCoverage=78%, E-value=2e-22, Identity=38%"; Hit description =Hypothetical protein 15A
  Pfam annotation: Domain name=DUF567; Domain location=4-185; Score =250.5; E_value=3.6e-72; Accession=PF04525.3; Description=Protein of unknown function (DUF567)
MKEELVVQEGYLFKEETKLTVLKTSLFFSGDGFAVYDSKGNLVFRFDSYGPLARDKDELVLMDPHGRSLLTLRRKKPSLHQRWEGFKGERKDGDKPVFSVKRSSIIGRSRTSVAVEVYDSPGVEYLIEGCFPQRCCKVFNAAKELVAEIRRKVDPTTSVMLGKEVFWLCVKPAFDAAFAMGIVLVLDQINGENYFDDRIVEPAVHPATEDPGFVSPVPV

SEQ ID NO: 136052 - protein, 229 aa, Glycine max
  Coding DNA Sequence Number=SeqID_19274
MDGNPPSAQKKAKSSKRKKGECSQGAINCLDTWFTNEGKNSDYKLIYVVKNMKGTFYLELVKVFYTCACVDLGGNFISTVNGVDMVIDDAVWKEVVGLDMVGRLTAEDRLIVYLITYILTPRPSNHAQETDDDLQIVYGLKSGIQMNWVLHIEDIMLKCHCIVDYEISYDVLASRFIDYFKVHVSNEIVDYTKASSEITKRHLKKLGMRYANLKWIMIGETAEGNINEM

SEQ ID NO: 136053 - protein, 94 aa, Glycine max
  Coding DNA Sequence Number=SeqID_19275
MELCEIQKQREKVEKAYYEMKATKEVVENTSKEQVEKEARVKQQAVGDATKITEVLVDLTIYEKADEIFQQIYMNLRPSRLTPHMKPLQWKTRF

SEQ ID NO: 136054 - protein, 122 aa, Glycine max
  Coding DNA Sequence Number=SeqID_19276
MVVAKEGVNISCTPSITSGKSSHIPIRRNSKQVQITNSLPTDGINNLLNIHVVNIMDEHLLLRTSASSSTLQLQESQKKRKPRITHESKRKIKSPLKKKLRDRVQKTEMLSSEDGRFMFTIG

SEQ ID NO: 136055 - protein, 123 aa, Glycine max
  Coding DNA Sequence Number=SeqID_19277
  Homolog annotation: Hit_ID=Q1SDN9; Match level="QueryCoverage=52%, HitCoverage=52%, E-value=2e-07, Identity=44%"; Hit description =Polynucleotidyl transferase, Ribonuclease H fold
MMRVVTLIKPPPQKEGSLFKTLELAQFVTKGVLQTKVGICIRGHQGNFIQAITIFSYGVPEPRAAEAWALLKAMEWIAELNMMNVVFEVDCSKVEADGVLHGCKGVLDFIVLSLNVKSAYLII

SEQ ID NO: 136056 - protein, 111 aa, Glycine max
  Coding DNA Sequence Number=SeqID_19278
  Gene Ontology: Mol. function=protein binding; Biological process=two -component signal transduction system (phosphorelay)
  Homolog annotation: Hit_ID=Q104N3; Match level="QueryCoverage=58%, HitCoverage=50%, E-value=9e-23, Identity=74%"; Hit description=AHP6a
MGIHLNQFMGSSSSIGAKRVRNVCVAFRAATEQNNRAGCLRALEMLEHEYCYLKNKLHELFQIEQQRALAAGVRLRARISGYRQAKRYPAFVLCCVGNRKKGSTPLALWIL

SEQ ID NO: 136057 - protein, 133 aa, Glycine max
  Coding DNA Sequence Number=SeqID_19279
MRIPFLEHAPASHASPSRRRVEYLHFATLESLKKSRRFTLVNLKKLVYQNEPFIMAEQAKHVFYVQDPCNERWLEVLHRKTIGVNIEDDDSTVDTCLNPFFGQMPTNANGEEEVDDVLENHNDHDEGELINIV

SEQ ID NO: 136058 - protein, 58 aa, Glycine max
  Coding DNA Sequence Number=SeqID_19280
MARTKKSGQMTSEVAKEIADRIGTFVAHGRQDVLTTTIRRPEHPGRVCAIRASVTIKH

SEQ ID NO: 136059 - protein, 72 aa, Glycine max
  Coding DNA Sequence Number=SeqID_19281
  Subcellular localization annotation: CTP_CleavageSite=36; ConfidenceScore=5.21e-01
MDSHSLLRLRLVILLLVSAQRKVVSIPQGRTQKRVTQTNVGCMSMIVLADWSMLRKFKMLMLAFLYPLKRFS

SEQ ID NO: 136060 - protein, 188 aa, Glycine max
  Coding DNA Sequence Number=SeqID_19282
KDKELRGIHNGIIGGYHEWLKVHTRGLDWLAKLKVVSEESFEAPEEDEEVQALKNELGKARLAKEKFKLATTDIRKECAGLREENATATRALEQETKRARREEHGRNKFRGALWGSKRSLFQRLCKTETNMLAIITKYQEELSLATAHEHRVADEYAQVYAEKEARGRAKAVANTYSAPRRSTNFSAI

SEQ ID NO: 136061 - protein, 76 aa, Glycine max
  Coding DNA Sequence Number=SeqID_19283
IDCSKEPYLAKGRSYLAGQRRQGYCSGYYGDSFCHRNPDAKGMYPILYSKRDRRVPGQVKLDSHSKLKLELKFNES

SEQ ID NO: 136062 - protein, 147 aa, Glycine max
  Coding DNA Sequence Number=SeqID_19284
MWQARIRKEESMKLDRLTQQMSDKIKVVQMPQFDESPILKSRRRMAEFNVENGMKNLRIIVSDEDNRQLKMIKPLARIMVFKAKFQCTKWGKIVVLVGMVQFILEGSTTMEENKPESKETYMILEANGENYITQDITHDDPIKQELR

SEQ ID NO: 136063 - protein, 73 aa, Glycine max
  Coding DNA Sequence Number=SeqID_19285
MPLGHDSDTFNMVVRQAFDDGLHECTTTLVHTMMVIIIPQRAKASASQFSATVVLDFNMFMVRLIQVIILRKL

SEQ ID NO: 136064 - protein, 90 aa, Glycine max
  Coding DNA Sequence Number=SeqID_19286
MQSQELVLPPEPEVCPSTARVSTKESYVDPLGNDPDTDSSLESRVKQVPRIKKSFNQSNYFDDAKDSSLESRVKQVPRIKELFNQESRFK

SEQ ID NO: 136065 - protein, 181 aa, Glycine max
  Coding DNA Sequence Number=SeqID_19287
MIDLLQHKPLQPRNAHCYIDNGGCTSSVPSPGLKSYLGFTLAFEKLCALHNFFLSINIFFYFLSVARGLLVVVTPAFCLRVVGIFQFSKPLKNHSKILKRCISGCDLQTIVGMNYLSLTIMRKVNHRRSPSRMSLSLLAIVDAILPRKGPITRTMSKRLQEDWARAAEEGPRVLMNLRVDF

SEQ ID NO: 136066 - protein, 75 aa, Glycine max
  Coding DNA Sequence Number=SeqID_19288
MATTFSYVGLPCRLTLFLVLLSSRLGSSVYLVIIINVAPCRALKWRRRKGDWRRHFKEKISQEQAHHHKKSWIRA

SEQ ID NO: 136067 - protein, 185 aa, Glycine max
  Coding DNA Sequence Number=SeqID_19289
THLLLEVASPLSLPFSIPLPFIFQEAKESIDEEDPRPTSSNGACINSVSGPPMWMSSDLEINRIIMSKDWEAFQKKGLAELDFAMLTLAGVKGYLTYVASEAYAQRKQEENVRLKEENIHLKKGKVAHLKGEMVNGELIPTLPMALGIVNEDFVLQETEDSRTRDDSMANDFIQTPETNADHGTS

SEQ ID NO: 136068 - protein, 53 aa, Glycine max
  Coding DNA Sequence Number=SeqID_19290
MARLLLMLACIEEQEQIFGFTKNRCLFLEVRKKRMHLRKNISTRQLQGNKQDS

SEQ ID NO: 136069 - protein, 190 aa, Glycine max
  Coding DNA Sequence Number=SeqID_19291
  Homolog annotation: Hit_ID=Q1SVD1; Match level="QueryCoverage=36%, HitCoverage=7%, E-value=3e-07, Identity=39%"; Hit description=Zinc finger, CCHC-type
METTEKKKDKDRSSIIFYECKKPGNFKSECLDLDKTNHKKRYFKPRDKKVLMSTWEELDDTSSNEETKEEEEVNLYMMANIVLEGSNFESNEENEQGSIRIMATWKQVGHMTSKCSHLPKARLSNAFRTNQKGSKKIWVPKEKIIPVVDIFNHNKSTPIMVPGQWLLTSHDRRRAYVPMSDSHAWWNSHF

SEQ ID NO: 136070 - protein, 134 aa, Glycine max
  Coding DNA Sequence Number=SeqID_19292
  Homolog annotation: Hit_ID=Q0GPH3; Match level="QueryCoverage=40%, HitCoverage=28%, E-value=9e-20, Identity=81%"; Hit description=BZIP transcription factor bZIP73A
MVRCWYADWSVPNIWLSNLKCPCGMTGLVNRIQEQMQQTNNVPLNLKVNKPVRVKLGKLKLLKVKLRATKIIGLNYLLPLDPCPYPSHYSMVQNTIPTFELHKLSNQFYGLQNPAKVLADFSPAQSSCISSNSS

SEQ ID NO: 136071 - protein, 301 aa, Glycine max
  Coding DNA Sequence Number=SeqID_19293
DDFKTELERRNLHKRLTYLADGTIDLALVKEFYVNLYSSEGPSPKQARVRGHLVKIDVENLNTFLETHVVLEEGETLPTYSRYCRLPIDYREIEATLCILGKGVLSYSNLAPTSHTSDLTVDKARLIFGLVSRMDMNIGVFISSQMNSVAQSNSSRLRFPALITGLCRARGVVSDSLTFERPSPVINLAYIRKNCWNLDDMTVFIRGTRRARPTDLPSTSAASTPASTSAAPSVPTQMDSQYFEAMLQSIHKGQINLLQSLQVVVPPGSIPSIEQFLERDASSEVTIPEPFIVEEEAGETQ

SEQ ID NO: 136072 - protein, 338 aa, Glycine max
  Coding DNA Sequence Number=SeqID_19294
MNILELRPLRWSYYLILFVDGFYIRPVDDVLLRVMVLLIPGTENMDVLIGERGFLVCRGSGLDGYGMGVGLASNSCLPLLFQRRGDHMLVSPLLDDRVLFLLPWDDKRVVLPLTLPDWSSQWTSPLGLYWIGGFRLLMSFLGLFLLGHNFLFLFLLGLLSCLNQALLLSKNPLNLFSESKDLQSFVFISHCSGQFLLPPLLNIILINKRDKRQSQKEEQNGLFMKVSDSKFAQARSSSLGLRCNFNPKQATRLGKSMPSPLSHNSLGRATACLGEFPCTPWLFSINSHAWLKRKIVQQSKTIEKTHKKKEKRKSGAEALHGAEALQSCDHGSLPSLFL

SEQ ID NO: 136073 - protein, 244 aa, Glycine max
  Coding DNA Sequence Number=SeqID_19295
  Gene Ontology: Mol. function=receptor activity; Cellular component =integral to membrane; Biological process=ion transport
  Homolog annotation: Hit_ID=Q2HPK7; Match level="QueryCoverage=85%, HitCoverage=77%, E-value=7e-95, Identity=80%"; Hit description =Putative transmembrane receptor
MTLLPLSKFRIPVKLQFKFIFKLQGLCGSLFLFVIDDKIRIVSLWLELVASKEIESKGGQLSSNHTGPRITIGGNSLQGINDNPGEVNVTDNDDIVVPEESKLHQINSGLAVGPSGLTEVLDGPDNGEKHSAATDDVNKEEDLFPGSPVMAVGPILVNNDLSNVGNDLKGDDNDENLFFLILKEGFEEGPASANQDNESEERDALEEAENVKDDIPTVGASGALDVGFVLGLAQEIQGFQDNHG

SEQ ID NO: 136074 - protein, 46 aa, Glycine max
  Coding DNA Sequence Number=SeqID_19296
MERDFGHFLEELLYVRDSRERRRIELEEEVVLRAGDEFVSDCEVLE

SEQ ID NO: 136075 - protein, 886 aa, Glycine max
  Coding DNA Sequence Number=SeqID_19297
  Gene Ontology: Mol. function=protein binding; Cellular component =membrane; Biological process=defense response
  Homolog annotation: Hit_ID=Q1SWW3; Match level="QueryCoverage=99%, HitCoverage=98%, E-value=0.0, Identity=57%"; Hit description=Disease resistance protein
  Pfam annotation: Domain name=LRR_1; Domain location=598-619; Score =11.1; E_value=2.3; Accession=PF00560.23; Description=Leucine Rich Repeat
  Pfam annotation: Domain name=LRR_1; Domain location=621-643; Score =11.3; E_value=2.2; Accession=PF00560.23; Description=Leucine Rich Repeat
  Pfam annotation: Domain name=LRR_1; Domain location=645-667; Score =9.3; E_value=5.1; Accession=PF00560.23; Description=Leucine Rich Repeat
  Pfam annotation: Domain name=LRR_1; Domain location=776-798; Score =2.7; E_value=90; Accession=PF00560.23; Description=Leucine Rich Repeat
  Pfam annotation: Domain name=LRR_1; Domain location=800-822; Score =8.3; E_value=7.9; Accession=PF00560.23; Description=Leucine Rich Repeat
  Pfam annotation: Domain name=LRR_1; Domain location=824-846; Score =4.3; E_value=45; Accession=PF00560.23; Description=Leucine Rich Repeat
  Pfam annotation: Domain name=LRR_1; Domain location=847-874; Score =5.1; E_value=32; Accession=PF00560.23; Description=Leucine Rich Repeat
  Pfam annotation: Domain name=NACHT; Domain location=191-344; Score= -25.7; E_value=0.0058; Accession=PF05729.3; Description=NACHT domain
  Pfam annotation: Domain name=NB-ARC; Domain location=150-453; Score =289.6; E_value=6.1e-84; Accession=PF00931.13; Description=NB-ARC domain
  Pfam module annotation: Pfam domain module=LRR_1::LRR_1::LRR_1::LRR _1::LRR_1::LRR_1::LRR_1::NACHT::NB-ARC; Domain location=598-619::621 -643::645-667::776-798::800-822::824-846::847-874::191-344::150-453
MAEAVLEVALGNLSSLIGKELELYLGFDHDLERLASLLTTIKATLEDAEEKQFSDRAIKDWLQKLKDAAHILDEILDEYATEALKLEYHEIKCGLSNKVQSSCLSAFHPNHVVFRYKIAKKMKRISERLERIAEERIKFHLTEMVSERSGIIEWRQTSSFITEPQVYGREEDTDKIVDFLIGDASHLEDLSVYPIVGLSGLGKTTLAQLIFNCERVVNHFELRIWVCVSEDFSLKRMTKAIIEATTGHASEDLDLEPLQRRLQDLLQRKRYLLVLDDVWDEVQENWQRLKSVLACGAKGASILVTTRLPKVAAIMGTMPPHELSMLSDNDCWELFKHRAFGPNEVEQVELVIIGKEIVKKCRGVPLAAKALGGLLRFKRDEKEWIYVKESNLWSLPNNENSVMPALRLSYLNLPIKLRQCFAYCAIFPKDEIIKKQYLIELWMANGFISSNEILDAEDVGDGVWNELYWRSFFQDIEKDEFDKVTSFKMHDLVHDLAQFVAEEVCCITNDNGVTTLSKRSHHLSYYRWLSSERADSIQMHQVKSLRTYILQPLLDIRRTWPLAYTDELSPHVLKCYSLRVLHCERRGKLSSSIGHLKHLRYLNLSRGGFKTLPESLCKLWNLQILKLDYCVYLQNLPNNLTSLTALQQLSLNDCFSISSLPPQIGKLTSLRNLSMCIVGKERGFLLEELGPLKLKGDLHIKHLERVKSVSDAKEANMSSKKLNELWLSWDRNEVCELQENVEEILEVLQPDIQQLQSLGVVRYKGSHFPQWMSSPSLKQLAIGRCREVKCLQEVLQHMTSLHSLQLYNLPKLESLPDCFGNLTLLRHLSIKNCPKLMCLPTSLSLSSLKSLTIYGCPELEKRCEKEIGEDWPKIAHILQIDFYNWQ

SEQ ID NO: 136076 - protein, 283 aa, Glycine max
  Coding DNA Sequence Number=SeqID_19298
  Gene Ontology: Mol. function=nucleic acid binding; Biological process= DNA integration
MSWVLKVPFRSKDSTACGGLTASSDNSWWSWVEEEMGLGPGEKKAPRTPQQDGVVERKNRSLEEPARTMLNINHLPRYFWADAEAQGKFLSEVKRWNKESLVAKGYNQQEDINFGETYAPVAKLEAIRLLLAYACVVDFKIIKIQIMYTSLRKLFVDLNKLQGNDMRDLATFFLNKSLREQLDHGTFLCQTKYYKKLLKKFKMDKSNEVATPMATNCYLSADEKGKSIDQTRYQAITNSLLYLIASRPGIMFSVCMCSRYQSSLKESYLLTIKMIMKYLKGKH

SEQ ID NO: 136077 - protein, 180 aa, Glycine max
  Coding DNA Sequence Number=SeqID_19299
  Gene Ontology: Mol. function=structural constituent of ribosome; Cellular component=cytosolic ribosome (sensu Eukaryota); Biological process=translation
  Homolog annotation: Hit_ID=Q9MAP3; Match level="QueryCoverage=53%, HitCoverage=54%, E-value=7e-38, Identity=67%"; Hit description=50S ribosomal protein L11, chloroplast precursor
  Pfam annotation: Domain name=Ribosomal_L11; Domain location=105-167; Score=78.4; E_value=2.2e-20; Accession=PF00298.9; Description =Ribosomal protein L11, RNA binding domain
  Pfam annotation: Domain name=Ribosomal_L11_N; Domain location=67-119; Score=89.7; E_value=9.1e-24; Accession=PF03946.4; Description =Ribosomal protein L11, N-terminal domain
  Pfam module annotation: Pfam domain module=Ribosomal_L11::Ribosomal _L11_N; Domain location=105-167::67-119
  Subcellular localization annotation: CTP_CleavageSite=54; ConfidenceScore=5.82e-01
MASTLFACPSLCSSSSSIFSTSVKFSLNPNKISLPFAGNKKPLSAPIRRRFNVIAMAPPKPGGKAKKAGKATPAPPVGPALGSKGVNIMAFCKDYNARTADKPGYVIPVEITVYDGSKDPKAEKVGKVTIDQLRTSAAEKLPDLNCSSIESAMRIIAGTAANMGIVVDPPVLEPKQKEFV

SEQ ID NO: 136078 - protein, 390 aa, Glycine max
  Coding DNA Sequence Number=SeqID_19300
  Homolog annotation: Hit_ID=Q1T1Y0; Match level="QueryCoverage=18%, HitCoverage=17%, E-value=2e-07, Identity=50%"; Hit description =Ankyrin
  Pfam annotation: Domain name=DUF1723; Domain location=231-275; Score =25.8; E_value=0.00016; Accession=PF08330.1; Description=Protein of unknown function (DUF1723)
  Subcellular localization annotation: CTP_CleavageSite=49; ConfidenceScore=5.03e-01
MAETKSKRMKSIGHKPITLKPSLKKEKETIKSHSSSKGKRITKSPSPLPSSKSQGFFFPELLEYHGFKKLVEMKGTYYPGFVRFIYTTTNIDGDTGYLCAKVVGLSSEGTMVNDRGMKDVGVTFNKITKYKNLMKDPSTYTAIMSKGKGKERFGICLLFLEHRLLACVLTWIITPMYQLEPLPQLRLATDRIIGPPFERGLVDLSYLQSYGDHCVGNAWIHHELKLVSHGALVLPLLTHLEETFSFHLPVREMTITLDDVSCLLHFPVTSRPIDHIPSLFDREVVKILRMTHLSIPIETKASAVANTCVRVRLTERLDDLQMDVIVWCPYEDHKDIRPFTQQTHFSGFTRCKTDVRPYHLENAEWQKNIIPLGDVVPPRGPWPCTYDYLP

SEQ ID NO: 136079 - protein, 78 aa, Glycine max
  Coding DNA Sequence Number=SeqID_19301
MEVPTGAGTDGEGRAKVEGAGVEVEAGVEEGGAAESGPLALDLAKDSKVKELDTTPLAMHKAMIRAGKLSLEELDWAI

SEQ ID NO: 136080 - protein, 65 aa, Glycine max
  Coding DNA Sequence Number=SeqID_19302
MASWDLLIDWSSKVYIKLEDAHVKVVKSQERTILDKMNKERLSDKEYWGYNLRGRLRVMPKWPRE

SEQ ID NO: 136081 - protein, 125 aa, Glycine max
  Coding DNA Sequence Number=SeqID_19303
MRETHEVPRDHTLADFEPHLGYVPLRGWHFVVYPYQTLWGASVSPITITFAFCKERLRAIEGGGDYAVADMVELFLVPNIVIPQKFKVPDFDKYKGTTCPKNHLNMYCRKMGAYAKDDIFLMHFF

SEQ ID NO: 136082 - protein, 81 aa, Glycine max
  Coding DNA Sequence Number=SeqID_19304
MSRLEDANISRKGADDDAQMMTLVTACNRALSLTDSKMRLFRSLGQKTLTSPGKSEDADIFGEGADDDVSHCMLSGFESYG

SEQ ID NO: 136083 - protein, 440 aa, Glycine max
  Coding DNA Sequence Number=SeqID_19305
  Gene Ontology: Mol. function=transferase activity, transferring phosphorus-containing groups; Cellular component=membrane; Biological process=two-component signal transduction system (phosphorelay)
  Homolog annotation: Hit_ID=Q0K3V3; Match level="QueryCoverage=59%, HitCoverage=46%, E-value=2e-83, Identity=61%"; Hit description =Signal transduction histidine kinase containing a receiver domain
  Pfam annotation: Domain name=ECH; Domain location=3-98; Score=-57.7; E_value=0.0047; Accession=PF00378.10; Description=Enoyl-CoA hydrataseisomerase family
AFGELLRSQPQVTLVKLAGLARGGGAEFVAAADMAFAARETAGLAQCEALMGITPGGGATQYLTSRMTRGRALEVILGAELFDAATAERYGWINRALPAAELDDFVDLLARNIAALPEGVIAAAKQAMPVPDLQAGFYREHDAWAGLPVRKPRRGSATLKACCGILPAKAPPRASPPPTASAAHAAWPAPAVCAAPDSLPARPLAISAFEQRFQDVETALAGTQALVAQHGERRKTVVDDGEGFLGGGRAAHGDAPGAHQALPGGGHQRIVVHHQAGAAQRRIAGRRGGVVVGGRGFRRFVFADVLREAHPEARTFAFDGVHAVLHLHQLGAARHHRQPQPVAGAVDFPRQLGAVVRGEDFAFLFVGDAHAGVPHFHQALGAARADSDQHAAPLRVAQGVLDQVDQRLPHQQRVAHHADAPFRPPGAQRQGAAVGLFAEQ

SEQ ID NO: 136084 - protein, 155 aa, Glycine max
  Coding DNA Sequence Number=SeqID_19306
MTQELVARGDTLRLSAPRHSVTPSVIDEQRPIWSSAPFPEMSSFSDGDFSSLTSYPELQAAGPMIRGDTLRLFAPFCHPEAAGPMTSRDQVWSFCTLVSSRGGGPDDTRRYLTVIRTLVSSRGGGPDDTRKYPSGYPYKHSFAICKTERVIACRD

SEQ ID NO: 136085 - protein, 167 aa, Glycine max
  Coding DNA Sequence Number=SeqID_19307
  Homolog annotation: Hit_ID=Q1T493; Match level="QueryCoverage=98%, HitCoverage=30%, E-value=3e-19, Identity=30%"; Hit description =Nucleic acid-binding, OB-fold, subgroup
MVIILTHARIKDAQGSYPASVSNSFKASKLLINDPILEIQEFKERLLDLGFEVSPVLLPGDQASSQVLGGSQLSSKDSFLSKAEVKSISKINDIFEDVVCVTVGIISKIVMDNHSWCYPACLQCHRKTDIQTGPFTCGCGKDNDQPVLRYRVEVMVTQNNESSKFLL

SEQ ID NO: 136086 - protein, 119 aa, Glycine max
  Coding DNA Sequence Number=SeqID_19308
MGEICVLSRQCVADYIEWFYMISYLFMNPTQPGDPPRHPFVVHNDIFVEPDIPQHSVAATTMDEAPAYCLKGWNGYIRIVTKGKEAYNVMEDCLRIARGVTADRNVYVRSRRRWRMEDA

SEQ ID NO: 136087 - protein, 151 aa, Glycine max
  Coding DNA Sequence Number=SeqID_19309
  Gene Ontology: Mol. function=nucleic acid binding
MVEKDPSLKVVMIQETICSKYPYILSYRKAWKAKQKAIVRVFGDWDESFSILPKFLKFIQGVSEPLIQVDRAHLYGKYHGTLLIATTQDRNNNVLPYAFAIVESETLLAWKCKKFNKKNALIFYVDMTSKEQGVRDRGSNNMSMEQPKAKA

SEQ ID NO: 136088 - protein, 187 aa, Glycine max
  Coding DNA Sequence Number=SeqID_19310
MEGPISTVIIGGAGSGAGASVEAGVEVEASEGLKDSNVSESGTTPRVMHRAVITARNLSLEELDWAIYEICPEMMELKSMLDYDNTLQVWARVVRSFLRSFQGMPLAFKTNPRLGMQSFEASSYGSGCVWQNLEYVEYHSSGSKTTGTRLAQAYSNSEAWWLRETGSLSRNHNTKSLYDTDLTKLTC

SEQ ID NO: 136089 - protein, 104 aa, Glycine max
  Coding DNA Sequence Number=SeqID_19311
MSPPNLGQICLEPSFSMDNALLQPKTRSNTGAADESYRMSCFGSGVGLDGWCGSNVFQDYFDDAKESRVKRIPKIQDTRFKNQVSRIKIQDSRSRFKNQESRED

SEQ ID NO: 136090 - protein, 50 aa, Glycine max
  Coding DNA Sequence Number=SeqID_19312
MEDFMAQVAWLGVQPSPMGGDMTTVQDTWDPWPSPAQDTPLCWIKWPQNN

SEQ ID NO: 136091 - protein, 109 aa, Glycine max
  Coding DNA Sequence Number=SeqID_19313
  Subcellular localization annotation: CTP_CleavageSite=22; ConfidenceScore=5.14e-01
MRERIPSSTNFCMNPLSRPALRRGHEKASRMRQGCVFFRRKTRGVATNVYSGKTLEKPKDDGLRILKMKVQELFTHWKALDLERSLLGSIKARLPLLRILNCDEELRPM

SEQ ID NO: 136092 - protein, 76 aa, Glycine max
  Coding DNA Sequence Number=SeqID_19314
VTSVEVKVLWVGGDCCVGWFVVGGTPTRSIAHENGFVAMIMRSDTKIGIRGMTSYTRCRKCGCPFKLCGKPVVGGP

SEQ ID NO: 136093 - protein, 1829 aa, Glycine max
  Coding DNA Sequence Number=SeqID_19315
  Gene Ontology: Mol. function=RNA-directed DNA polymerase activity; Cellular component=chromatin; Biological process=chromatin assembly or disassembly
  Pfam annotation: Domain name=Chromo; Domain location=1719-1773; Score= 30.5; E_value=5.8e-06; Accession=PF00385.14; Description='chromo' (CHRromatin Organisation MOdifier
  Pfam annotation: Domain name=RVP_2; Domain location=701-824; Score= -41.9; E_value=0.0018; Accession=PF08284.2; Description=Retroviral aspartyl protease
  Pfam annotation: Domain name=RnaseH; Domain location=1194-1309; Score= -20.3; E_value=0.0045; Accession=PF00075.14; Description=RNase H
  Pfam annotation: Domain name=rve; Domain location=1447-1572; Score =57.9; E_value=3.3e-14; Accession=PF00665.16; Description=Integrase core domain
  Pfam module annotation: Pfam domain module=Chromo::RVP_2::RVT _1::Retrotrans_gag::RnaseH::rve; Domain location=1719-1773::701 -824::934-1103::403-493::1194-1309::1447-1572
MPPMKFVVKKAWSSGGCGRVGALEMGSCPGPIETPALLLSTRKGLPHFISPDLLTSLPSPDSHLLQISPLHFLEGLASTTISKLGGLHQMLGLHQYGMAAVARDSIQCLPESKGATKLGASFETPCGRLLIKPKDYVEMISCMRPNIWATLADEVPAWVTDKRNKTSVDRTVRWLDDCLALNPVVGSVFGAIVGGTNLDERKRCAEEVAKRNVSGLLILGALFLLHSFGATVCFHCCLLGDRDVDFDVGPKPKVWRVYQRKRVRGEKEGQWGHLIIGDYRESLRALGELVVKPTMGDRLDALETQMGDVTTTLQALAQQMQQHAQQMQQQSLVLTELSKQIGQKATETQKSERSVEDHVNGESRLAGKKVKLPVFEGDDPVAWITRAEIYFDVQNTADEMRVKLARLNMEGSTIHWFNLLLETEDYLTWEKLKKALIARYGGRRLENPFEELSNLRQIGSVEEFVESFELLSSQVGRLPEEQYLGYFMSGLKPQIRRRVRTLNPVTRMQMMRMAKDVEDELREDDDEGERSYGRKQGVDRVGRNDWAGSSQRQRSGSSFNPKETNRSTNTGWNNPTMKSGLMGSNQNSSPSMLSTGRKGDTERRGGSTDRWKGVRSIHNDEMAERRAKGLCFKCGGKYHPTLHKCPERAMRLLILGEGESLNEEGEIVSLEAEESVDGEEEVDAVCNVIGVLGSMGEYRTMKIGGKLENVDVVVLIDSGASHNFISPKLTTALGLSVTPIVERKIKLGDGHKVSSQGVCEGIKLVLGALEVSVDALVLDLGGLDVVLGVSWLCTLGKVMMDWKNLTMQFWHQGKTIVLQGQGENQERQCFLNSFLEDRQGRVGEEWWLSSQRQKVGGKEMMDEGLKEVLSKFTEVFQDSIRLPPRRSQSHQIKLFPDHGPVNVRPYRYPHHQKEEIERQVKELLEAGVIRQSMSAFSSPVILVKKKDNSWRMCVDYRALNKATIPDKYPIPIVDELLDELFGATIFSKIDLKSGYHQIRVHEEDVHKTAFRTHNGHYEYLVMPFGLMNAPATFQSTMNDIFRPFLRKFVLVFFDDILIYSQNMLDHYNHLEQVLAVLVSNCFVANQAKCKFGYEQVDYLGHIISGKGVAVDPEKVKCIRDWPPPKNVKGVRGFLGLTGYYRKFIKDYGKVAKPLTELTKKDNFLWGKEATEAFENLKDIMTTSPVLVLPNFALPFEVECDAAGRGIGAVLMQNRQPIAFFSKALSAGNLAKSVYEKELMALVLSIQHWRHYLLGKQFVVYTDHKSLKHFLQQRVTSPDQQCWVAKLLGYQFEVKYKPGLENKAADALSRCHGEVEMNVLVSSPTWLEGQKLLQEIAQDTQIQKMIVELTAKPDAKPGFSVQQGVLFYQGRLVIPADSPSIPVLLEEFHSTPMGGHSGFLRTYRRLAANIYWTGMQKRIRDFVRACDVCQRQKYAATTPGGLLQPLPIPNAIWEDLSIDFITGLPKSRGFEAVLVVVDRLSKYSHFILLKHPYTAKSVAELFVKEGTQLKMSSAYHPETDGQTEVINRCLESYLRCFASEQPKAWAHWIPWAEFWYNTTYHESIGKSPFEVVYGRPPPALTRFLSNETKVAAVALELTERDEALNQLKLHLLKAQQQMKAYADRKRRDLHFEIGEWVFLKLRPHRQQSVVKRINQKLAARFYGPFQVIAKVGEVAYKLKLPDQSRIHPVFHVSVLKKAVGNYQVQGELPRELEINLEEDIYPDKILGSRITLQDGVAIPQSLVQWKNKTVDDVTWEDDFFLKGQFPDFSLEDKAIFKEGGIDRDVDFDVGPKPKVWRVYQRKRVRGEKEGQWGHLIIGDYRESLRALGNW

SEQ ID NO: 136094 - protein, 187 aa, Glycine max
  Coding DNA Sequence Number=SeqID_19316
MTALGGATSHHRPNPRRLQLSNAELVAPISDVCVPSIILQRDPLIDDATKNSLATPLSVSGVGFPKDGCSILLAANLYLRDPVTLNLSWQKKRPFLDCLSLHAVLSSQQISSQLLQNSISVFKPLLTSSTSDVGSNPLKIKGYWIGGFGLGEGIDERPALLSAIIYCNLNKVDASDGTLLLANLTTE

SEQ ID NO: 136095 - protein, 393 aa, Glycine max
  Coding DNA Sequence Number=SeqID_19317
  Homolog annotation: Hit_ID=Q1T1F7; Match level="QueryCoverage=70%, HitCoverage=76%, E-value=1e-12, Identity=36%"; Hit description=IMP dehydrogenase/GMP reductase
  Pfam annotation: Domain name=DUF1723; Domain location=120-169; Score =38.7; E_value=2e-08; Accession=PF08330.1; Description=Protein of unknown function (DUF1723)
MVRTRGLGRGLGRVIASARKQWEVVPVAKDDPMVTKDVHAYVEETGDDVEGFSSESCDPSMLTNYGDHVAFIVWNGKERPELKLSSHGRKVQKFGRPAPKIEGLVAATRLSPLIACSVNTGDRGLIFTFVERWHKKTSNFHLSIGELTITLDDVASLFHLTIISAFHDFESLYVNEAVLMLVELLEVSREEARAETTQYLSQSESYAWGVAALVHMYDHLNDAWLHHPIKCWIYEHFPSVSECLNDLDYDEISPHAYRWIATKASSKSLSASTYRKHLDGLTIADVCWMPYSEHYGVIYNGSRCHQTPTREGGAEIWICSDHSSTDYEFHVPFEDIDDKWMHYSDYPTVAGQLCVVPRQCASDNMMTHMWEPHIPEVPVAPAAPPAHVPSDVE

SEQ ID NO: 136096 - protein, 75 aa, Glycine max
  Coding DNA Sequence Number=SeqID_19318
MALELELELELQGNLFFKVVGGEGKRLLRLKRGGGVCKGVSWGEWGVRYGSIYSGGRREEGMEVEVRHVGGGDHV

SEQ ID NO: 136097 - protein, 162 aa, Glycine max
  Coding DNA Sequence Number=SeqID_19319
  Subcellular localization annotation: CTP_CleavageSite=38; ConfidenceScore=5.01e-01
MENHEGQIGASFSTKTASQVGRFRSDGKVPFGVGFQWRTMVVRGGYWWLWVVRKKLGMLEMLLGKRKRKKWHFSKATRNTKAKTLKCFCSRKRKRFSHSRCRIEVHNGQITDICPLNHHTEFRENPTVKECRRALLPRQLQVASLRSFSREASLRSFLVRLL

SEQ ID NO: 136098 - protein, 82 aa, Glycine max
  Coding DNA Sequence Number=SeqID_19320
  Subcellular localization annotation: CTP_CleavageSite=33; ConfidenceScore=5.14e-01
MERIQILSWHQSQLLRLPSTTTAAAKFSGETKMAASGPVFSFSGTPTITTAKLNWKNYLSWSASVELWFLSQGHYDHLGGIL

SEQ ID NO: 136099 - protein, 321 aa, Glycine max
  Coding DNA Sequence Number=SeqID_19321
MTASSNLTQGSNLPNVVAATVLLEFNGKRFAPSPSPRSKDKEALGDLAFIDAANSLHQKEPITSLSGPFWFTKLWLNLIFRKHLRQDARFSLALELEGARLVYYTSTGKPLEQSFRKYIKVLMKMIDFTKDLAPVVHLLIARPECLKKTFLIETPVPKKISEDDDASNDESGDKEPKQGKGKKVKLPKKTKSSTMTKLVNPPLKLDQGKECKVENIKTSKEKVSEDSMSIPKDGSVVNISSSQEQEVESDQDRNPINPIAEDLMENMVEVEIENMINVDPSPTTEIELDEASCYLCLRNFPSYEKLSSFSMRTFRWGSVCI

SEQ ID NO: 136100 - protein, 81 aa, Glycine max
  Coding DNA Sequence Number=SeqID_19322
MESLAFQQGGEDSSQHDIVCGVQANLRDVDIWVFVWFTGVIVRFNGHAFPIGRQGSLHDVGDERILVLLCWVSDLTLTFVA

SEQ ID NO: 136101 - protein, 123 aa, Glycine max
  Coding DNA Sequence Number=SeqID_19323
MSSFGRTFFWRSYRKKVLPEELIVLPEDPSSRKATGRRRTFFRTSYQKKVLPEEKVILQEEPSSSSFSRRTSSGSLSERTFCSTGRTFFRRSYQKKFFQEFQNLSSLPFSDNFHVFYPKAIIS

SEQ ID NO: 136102 - protein, 89 aa, Glycine max
  Coding DNA Sequence Number=SeqID_19324
MGCSQFCITKPTSLFRASKGLEEQNCLQIRVCIASCLICNGWRSVPVYFTDPWHRFLTENDLMGEDEVVFYYRPNQHVGDHLQEGAHMG

SEQ ID NO: 136103 - protein, 60 aa, Glycine max
  Coding DNA Sequence Number=SeqID_19325
MLQRYGLNVNGKSTRFRNNKIFQNNTKDQAESFDDAKGLHESYASQRFTQDKAIRVNQDG

SEQ ID NO: 136104 - protein, 169 aa, Glycine max
  Coding DNA Sequence Number=SeqID_19326
  Gene Ontology: Mol. function=RNA-directed DNA polymerase activity; Cellular component=extracellular region; Biological process=RNA -dependent DNA replication
  Homolog annotation: Hit_ID=Q1SQP0; Match level="QueryCoverage=62%, HitCoverage=26%, E-value=1e-23, Identity=42%"; Hit description=RNA -directed DNA polymerase
MAKVSILSTEFPPIFGRKRRGWRFLVRVTKAALDSGQVIDWRQSAFLEGRHLLHCVLIANKAIEEARRSRRKCLMLKVDYEKAYDSVQWGFLFYIMRSTIDQFIPQRGLRQGDPLAPFLFIIVAKGLARLMREAEKKGMYAGFLVVKDKMEVDFFNMQMTLCVLEMQQC

SEQ ID NO: 136105 - protein, 259 aa, Glycine max
  Coding DNA Sequence Number=SeqID_19327
MASRKRRAPTSRPQEPYDTSRFVSEVAWERYEQNIHARNILLERNVELQGKLIKFDVATLNEFLKTPVVLEPGERYSTYSRFCHTHPDPQELAARLCIPGVLSYSNLAPTSHMSDLNMDMARLVYGLVMKMDMDARARGPSDASSSTPAPTLAPAPALVPSLAPSGPFTSSTNVIVPMLQSLHHGLCLVAWPGVQPSSSGEVIDEDGAAETGVDTDYVADVAAAQGTWDPWPTPAQHTLMPAQDAPTTPHDDPAPAQDD

SEQ ID NO: 136106 - protein, 228 aa, Glycine max
  Coding DNA Sequence Number=SeqID_19328
  Homolog annotation: Hit_ID=Q9SK32; Match level="QueryCoverage=49%, HitCoverage=22%, E-value=3e-18, Identity=43%"; Hit description =Expressed protein
  Pfam annotation: Domain name=DUF1723; Domain location=2-51; Score =75.0; E_value=2.4e-19; Accession=PF08330.1; Description=Protein of unknown function (DUF1723)
IDINQHLITAMVERWMPETHTFHFPHGEATITLEDVTLQLSLKIDGLPIIGASTSDVCVSCQALLGGIAPDKYINGKMIYLTWLRENFQELPVDADDVVIEQDARAHIMMLKGHSQRFATTINTPSSTYIPPSSSSCYCSSLPTQMHGKSHEDKEEDDDNNNTNNNDDNDGDFVPQQQQTITHDHPRIRKGRGHRTRGQQQPPTNQIQQDEKPRRTSRRTRCDTSFLY

SEQ ID NO: 136107 - protein, 201 aa, Glycine max
  Coding DNA Sequence Number=SeqID_19329
MRSEASTASSPNYIEVPRAYHTQWAPYYPAYVQIEYNGARHLIKHKKNGQQYYLADGLKDFRRNIDIHEGVLVHFVAPDNYASFHLAFMPLLHTQSCGRPPATTRTYVFTVDVTDAIISEHTPLFLPTAAANFLDASTQCMTVRHRGGIRHIWSISMHNGLQYVDDPVGSPHSINRMRCSQFCITKPTSLFRKNTPSIQSE

SEQ ID NO: 136108 - protein, 83 aa, Glycine max
  Coding DNA Sequence Number=SeqID_19330
MSYHLSRNSLSESTWHSHLGKLGSKCRGHPIVHRQLPAPHGDQPESQGSSKPSDMPPSRSIFPHEKLRVLIDQVCTISMQYEV

SEQ ID NO: 136109 - protein, 68 aa, Glycine max
  Coding DNA Sequence Number=SeqID_19331
MPFIDFSEEFVTGSMLSLDITVVSQLEVKTCGVLCMARIRIKPSPLSPWARWAQPVVDGLARQPTILK

SEQ ID NO: 136110 - protein, 91 aa, Glycine max
  Coding DNA Sequence Number=SeqID_19332
MMNLKLKSFEKWDAPEENHREGRRGRLKFFSEIINQEAQQPHPGEGNAPEKNPHCVIVVLPEKDEESMVAEHGSVSTIVTGDYDDDDELDE

SEQ ID NO: 136111 - protein, 36 aa, Glycine max
  Coding DNA Sequence Number=SeqID_19333
FDHDGKKIEAFVGSKSITQSVVSRCPSAQYSLKQFT

SEQ ID NO: 136112 - protein, 616 aa, Glycine max
  Coding DNA Sequence Number=SeqID_19334
  Gene Ontology: Mol. function=6-phosphogluconolactonase activity; Cellular component=cytoplasm; Biological process=carbohydrate metabolic process
  Homolog annotation: Hit_ID=Q6D1E1; Match level="QueryCoverage=60%, HitCoverage=97%, E-value=9e-69, Identity=40%"; Hit description =Putative exported protein
  Pfam annotation: Domain name=DUF1289; Domain location=4-59; Score =51.9; E_value=2.1e-12; Accession=PF06945.3; Description=Protein of unknown function (DUF1289)
  Pfam annotation: Domain name=MFS_1; Domain location=8-370; Score= -8.6; E_value=0.00078; Accession=PF07690.6; Description=Major Facilitator Superfamily
  Pfam module annotation: Pfam domain module=DUF1289::MFS_1; Domain location=4-59::8-370
MAAKSPCIDLCVFDTKTGWCEGCGRTRGETQSWSKLSPYHRKATERALPARLKALKTREALKFVLALQTGAIAGFLVFSLLADKWGRRPMFLLYLFIGAVAVGMYLATTQPLILMVAIFMAGFGVNGIFAGSGPFLAEIIGDTQSRGFLMGLAYNGGRLGGFIAPLLIGFVASVGGFTAGLATTVIAFLAAMVVAKACDTAEHLTRCQVFSQLCGIPTVARIITAKSCTTSRPRQACWRSAQENTMINSLRTVTLLAAMTVSAPLLAQTFVYVSAAADGTIARYTLDARSGALQLLGHTEAGGKVMPMALSADHKTLYAAIRSKPLQLASWQIDSQSGELNHRRTVPAAASYPYISTDRQGRFLLGASYDGDVVQVYRLTASGTIATPPVGSYKTGHAAHSVIVDASGRHAYVGNLGTDRVLQLRLGANGTLSALGKGGVATAADNGPRHSVLSPDNRYLYNIGEMGGIITQFRRETSGELIKVAETPNAVAAQYHLQHGRERPPGYSDSTPRIWSADIQLTPDGRFLYVSERTSSTVSGYRVNQQDGKLTLIGSWPVEKQPRGMAISADGRWLVVSGEKSAVIGSYAIEARSGALQRVGEAPAGRDANWVTIVSY

SEQ ID NO: 136113 - protein, 533 aa, Glycine max
  Coding DNA Sequence Number=SeqID_19335
  Gene Ontology: Mol. function=protein serine/threonine kinase activity; Cellular component=integral to membrane; Biological process=protein amino acid phosphorylation
  Homolog annotation: Hit_ID=Q1T066; Match level="QueryCoverage=93%, HitCoverage=77%, E-value=0.0, Identity=81%"; Hit description=Leucine- rich repeat, typical subtype
  Pfam annotation: Domain name=LRRNT_2; Domain location=26-66; Score =52.0; E_value=2e-12; Accession=PF08263.3; Description=Leucine rich repeat N-terminal domain
  Pfam annotation: Domain name=LRR_1; Domain location=126-148; Score =19.9; E_value=0.0091; Accession=PF00560.23; Description=Leucine Rich Repeat
  Pfam annotation: Domain name=LRR_1; Domain location=150-172; Score =15.8; E_value=0.16; Accession=PF00560.23; Description=Leucine Rich Repeat
  Pfam annotation: Domain name=LRR_1; Domain location=174-195; Score =15.3; E_value=0.22; Accession=PF00560.23; Description=Leucine Rich Repeat
  Pfam annotation: Domain name=Pkinase; Domain location=300-525; Score =85.0; E_value=2.3e-22; Accession=PF00069.15; Description=Protein kinase domain
  Pfam annotation: Domain name=Pkinase_Tyr; Domain location=300-518; Score=70.3; E_value=6.1e-18; Accession=PF07714.7; Description =Protein tyrosine kinase
  Pfam module annotation: Pfam domain module=LRRNT_2::LRR_1::LRR_1::LRR_ 1::Pkinase::Pkinase_Tyr; Domain location=26-66::126-148::150-172::174- 195::300-525::300-518
MPLSCLLLLLLFFLSRHTLSSASQPRNPEVEALINIKGGLNDPHGVLNNWDEYSVDACSWTMITCSSDYLVIGLGAPSQSLSGTLSPAIENLTNLRQVVLTADECRLLQNNNISGNIPPELGNLPKLQTLDLSNNRFSGLIPASLSQLNSLQYLRLNNNNLSGSFPVSLAKTPQLAFLDLSYNNLSGPLPKFPASIVGNPLVCGSSTTEGCSGSATLMPISFSQVSSEGKHKSKRLAIAFGVSLGCASLILLLFGLLWYRKKRQHGVILYISDYKEEGVLSLGNLKKFTFRELLHATDNFSSKNILGAGGFGNVYRGKLGDGTMVAVKRLKDVNGSAGESQFQTELEMISLAVHRNLLRLIGYCATSSEKLLVYPYMSNGSVASRLRGKPALDWNTRKRIAIGAARGLLYLHEQCDPKIIHRDVKAANVLLDDYCEAVVGDFGLAKLLDHADSHVTTAVRGTVGHIAPEYLSTGQSSEKTDVFGFGILLLELITGMTALEFGKTVNQKGAMLEWVSLFSQPNNSVCCIPDYMT

SEQ ID NO: 136114 - protein, 343 aa, Glycine max
  Coding DNA Sequence Number=SeqID_19336
  Gene Ontology: Mol. function=cysteine-type endopeptidase activity; Cellular component=endoplasmic reticulum; Biological process =proteolysis
  Homolog annotation: Hit_ID=Q6Y1E6; Match level="QueryCoverage=99%, HitCoverage=100%, E-value=1e-162, Identity=79%"; Hit description =Cysteine protease 8
  Pfam annotation: Domain name=Inhibitor_I29; Domain location=39-96; Score=106.4; E_value=8.3e-29; Accession=PF08246.2; Description =Cathepsin propeptide inhibitor domain (
  Pfam annotation: Domain name=Peptidase_C1; Domain location=125-342; Score=461.5; E_value=1.1e-135; Accession=PF00112.13; Description =Papain family cysteine protease
  Pfam module annotation: Pfam domain module=Inhibitor_I29::Peptidase _C1; Domain location=39-96::125-342
MVAKNQFYHISLALLFCLGFWAFQVTSRTLQDASMYERHEEWMARYAKVYKDPEEREKRFKIFKENVNYIEAFNNAADKPYKLGINQFADLTNEEFIAPRNKFKGHMCSSITRTTTFKYENVTALPSTVDWRQKGAVTPIKDQGQCGCCWAFSAVAATEGIHALNSGKLISLSEQEVVDCDTKGEDQGCAGGFMDGAFKFIIQNHGLNTEANYPYKAVDGKCNANEAANHAATITGYEDVPVNNEKALQKAVANQPVSVAIDASGSDFQFYKTGVFTGSCGTQLDHGVTAVGYGVSADGTQYWLVKNSWGTEWGEEGYIMMQRGVKAQEGLCGIAMMASYPTA

SEQ ID NO: 136115 - protein, 217 aa, Glycine max
  Coding DNA Sequence Number=SeqID_19337
  Gene Ontology: Mol. function=DNA binding; Cellular component =mitochondrion; Biological process=DNA integration
FGIFDHHFFGIEILSRTDDLHLSQSHYALTILERANMIDCKPMRTPLEAMAKMMSNNTPLDDPCYFCGLVGALQYLTLIHFDISYSGCPTTRHSTTDYCIFLGRNPISWSAKKQPTVSHSKTEAKYEAMENIVAELTFLLKDLYISLACTPLLFCDSISALHKTINPVFQDHNKHIELDCHFICKRVALVNLVTHHIPTNDQVADQFLSLCPILDLV

SEQ ID NO: 136116 - protein, 182 aa, Glycine max
  Coding DNA Sequence Number=SeqID_19338
MAMLSLLLCLRPLRPLFLGQARRPHCTLVAYDKATSVAEQDHHKKICGAPCDSPSANYVLLHQTTTSSPTTATTTSSPAATAAAPSPPPRWRQLPPPPPPPLPGQQPPCATATLLLLSFFLSLFIAFFWVFYVQDLFFFCLYYVVTDFERVGLDRLVVWDDVADVGFAVAEGCRGVVVGWSD

SEQ ID NO: 136117 - protein, 117 aa, Glycine max
  Coding DNA Sequence Number=SeqID_19339
MKEVEEWQWRREVVGLVVVVVVGVGVVASEEAEKEQPPSPPERKSLSQSSVKKLWSGGGGRSWRRESRTDFLVMVLLCDGGGLVVGNESAMRPTGLTEEEWSERTKTQQKRKHRHRN

SEQ ID NO: 136118 - protein, 147 aa, Glycine max
  Coding DNA Sequence Number=SeqID_19340
MERSMIDAASGGALGDMTPTEARNLIEKMASNSQQFSARNDAIVLRGVHEVVTDSSSSAENKKLEGWRNHPNLRWTSPPQQHQSVLSFQNVAGPSKPYVPPPMQQQQRQQAVEAPFQPSLEELVRQITIQNMQFQQETRASIQSLTN

SEQ ID NO: 136119 - protein, 253 aa, Glycine max
  Coding DNA Sequence Number=SeqID_19341
  Gene Ontology: Mol. function=transferase activity; Cellular component= cytoplasm; Biological process=glutamine metabolic process
  Homolog annotation: Hit_ID=Q6ETL5; Match level="QueryCoverage=96%, HitCoverage=83%, E-value=2e-73, Identity=52%"; Hit description =Putative glutamine amidotransferase class-I domain-containing protein
  Pfam annotation: Domain name=GATase; Domain location=17-213; Score= -16.0; E_value=7.2e-06; Accession=PF00117.18; Description=Glutamine amidotransferase class-I
  Pfam annotation: Domain name=Peptidase_C26; Domain location=15-201; Score=-109.7; E_value=0.045; Accession=PF07722.3; Description =Peptidase C26
  Pfam module annotation: Pfam domain module=GATase::Peptidase_C26; Domain location=17-213::15-201
MVTEGEISSRRYALLLAVNDSEYVKKAYGGYYNVYVEAFGEEGDTWDLFRVYDGDFPDFSDLNKYHGFVITGSPSDAYGNDYWILKLCFMLQTLDAMQKKVLGICFGHQVLCRALGGRVCKSNTSWDVGFRQVHFMKDLTRSYRYLAEHEMMTESLSIIEVHQDEVYEVPLGAEVIASSDKTRVEMFAISDHILGIQGHPEYSRDILFNLIGRLQNMNVIEGGLAEDLKCRFQSAEADKKCWGKICRNFLGGK

SEQ ID NO: 136120 - protein, 92 aa, Glycine max
  Coding DNA Sequence Number=SeqID_19342
MAPLMGGCFWLWWQLKQQCQQQQQHQRHQNMATDYGIQQWPGKAKQPINWARNTKTDTKTKKVELRVTNASLVYLQVSYQLCSKPPLFSQSF

SEQ ID NO: 136121 - protein, 358 aa, Glycine max
  Coding DNA Sequence Number=SeqID_19343
  Gene Ontology: Mol. function=adenosylmethionine decarboxylase activity; Cellular component=cellular_component; Biological process =spermidine biosynthetic process
  Homolog annotation: Hit_ID=Q42829; Match level="QueryCoverage=93%, HitCoverage=89%, E-value=3e-93, Identity=52%"; Hit description=S -adenosylmethionine decarboxylase proenzyme (EC 4.1.1.50) (AdoMetDC) (SamDC) [Contains: ...
  Homolog annotation: Hit description=S-adenosylmethionine decarboxylase alpha chain; S- adenosylmethionine decarboxylase beta chain]
  Pfam annotation: Domain name=SAM_decarbox; Domain location=6-327; Score=481.2; E_value=1.3e-141; Accession=PF01536.7; Description =Adenosylmethionine decarboxylase
MVESEKTEAGFEGFEKRVEISFSFSESGEPKKLGLRALSGAQIKSILEAARCSIVSQLSNSELDSYVLSESSLFVFPLKIILKTCGTTRLLLSVKPILDLAASLSLSVFAVKYSRGSFLFPNDQPAPHDTFLNEVALLNHYFAHLNAKAYVIGNPNRCWHLYSACGEAATLSLTVEICMTGLDRDKARVFHKEWGGGKMTEMSGISEIVQSHVICDFEFEPCGYSMNGIEGAAFSTVHVTPENGFSYGSYEVQGLDPGSNGFGALVRKVLKCFCPSDFSVAVTCEVGAEDWAMSDADVEGYCCQNVVKQQLLPGKGCLVYRTYSARGRGRGSPKIAIVKCSNEIEKEELVLSSCLTST

SEQ ID NO: 136122 - protein, 89 aa, Glycine max
  Coding DNA Sequence Number=SeqID_19344
MAKGTEESFSYSLVDWLQNPVECRRKSIRLCMNRMSRGGISGRFSVGSCVDANMVEICLAIACLMVNFFKLDLEITWKLLSVKFMDRHV

SEQ ID NO: 136123 - protein, 337 aa, Glycine max
  Coding DNA Sequence Number=SeqID_19345
  Gene Ontology: Mol. function=receptor activity; Cellular component =integral to membrane; Biological process=response to sucrose stimulus
  Homolog annotation: Hit_ID=Q84N34; Match level="QueryCoverage=97%, HitCoverage=93%, E-value=1e-103, Identity=55%"; Hit description=HHP2
  Pfam annotation: Domain name=HlyIII; Domain location=49-319; Score =234.7; E_value=2.1e-67; Accession=PF03006.10; Description=Haemolysin- III related
GENIPAKSKRFKRQLVKFEELPEYLKDSEFILDYYRSEWPVKEALWSIFAWHNETLNIWTHVGGFLIFAVLAAMSATSELWNLLRWNDRSSTALGLSTTAAEMNGSNSDAFPDLHFRHVLDSSILGEMKGSGVETIPRWPWFVFLAGGMGCLACSSLSHLLACHSKGYNLFFWRLDYAGISLMIVCSFFAPIYYVFFCNPYARLFYLASISVLGVLAIITLLAPSLSTPRFRPLRASLFLSMGFSGIIPAAHAVVLFWGHPHILVALGYELAMAILYATGAGFYVARIPERWKPGAFDITGHSHQIFHVFVVLGALAHSVAILVILDFRHGSPTCVH

SEQ ID NO: 136124 - protein, 113 aa, Glycine max
  Coding DNA Sequence Number=SeqID_19346
  Homolog annotation: Hit_ID=Q10Q38; Match level="QueryCoverage=57%, HitCoverage=52%, E-value=3e-14, Identity=56%"; Hit description =Expressed protein
MEVSGRSCGVLGLPYCVPVRKNGRRFVTTLAKRNESQEKSKGPSFTLRVSKSTIARGAIGLFGLGFVDAGYSGDWSRIGVITPQTEDLLKLAAFLVVPLCIFLIFFLPSEQNS

SEQ ID NO: 136125 - protein, 234 aa, Glycine max
  Coding DNA Sequence Number=SeqID_19347
  Pfam annotation: Domain name=RNase_H1_sml; Domain location=48-133; Score=-11.4; E_value=0.0029; Accession=PF08615.1; Description =Ribonuclease H1 small subunit
MDLKRDGNGIEDLSGGGLPLQEVHFRGYSKEQHSLFLTVTLFASYLRRKLSLLGHDSRPKTGNAETEQESKTAEIGVQVAKAKRRICRPTYLKGYVYQDTKATFQDITYWNHDYIPSHNDELFRAFHWLIVANAKNRFLTKRKFKLSPKWDGPFQVLERINNNAYKLDLPEEYRVSTTFNIFDLIPFVGGVDIEEEKKELKNLRSNPLQRGGNDAILSRKESVIRVMSKRLQED

SEQ ID NO: 136126 - protein, 153 aa, Glycine max
  Coding DNA Sequence Number=SeqID_19348
  Homolog annotation: Hit_ID=P23326; Match level="QueryCoverage=35%, HitCoverage=33%, E-value=7e-20, Identity=85%"; Hit description=50S ribosomal protein L35, chloroplast precursor
  Pfam annotation: Domain name=Ribosomal_L35p; Domain location=70-130; Score=70.1; E_value=7.1e-18; Accession=PF01632.9; Description =Ribosomal protein L35
  Subcellular localization annotation: CTP_CleavageSite=64; ConfidenceScore=5.80e-01
MASVSFAVGLLPYASVRFPVLSNANSLKLSSSASISTPILQQKLCSLLSPLPLSPRPRPLTIVSAKGYKMKTHKASAKRFRVTGRGKIVRRRAGKQHLLVKKNTKRKSRLSKMVIFTLSRGYSVPIFNELSKIAHVRSLDNGILVMDRFCDGP

SEQ ID NO: 136127 - protein, 360 aa, Glycine max
  Coding DNA Sequence Number=SeqID_19349
  Gene Ontology: Mol. function=DNA-directed RNA polymerase activity; Cellular component=chloroplast; Biological process=transcription
  Homolog annotation: Hit_ID=Q52GZ3; Match level="QueryCoverage=89%, HitCoverage=27%, E-value=1e-117, Identity=67%"; Hit description=DNA -dependent RNA polymerase
  Pfam annotation: Domain name=RNA_pol; Domain location=2-336; Score =203.0; E_value=6.8e-58; Accession=PF00940.10; Description=DNA -dependent RNA polymerase
MICQLEAAAVNLVASEKPADVYSEIAVRVHDIMRKDCIKDPAAYPNALLAKVLIDQIDRKLVKQTVMTSVYGVTFVGAREQIKRRLEEKGLITDEKLLFAAACYAAKVTLTALGEIFGAARVIMGWLGDCAKVIAFENQPVRWTTPLGLPVVQPYCKTERHLSLHCETPEQCPAIRQCNGHTPSMAQILRSTSFKQHRFIGVITTLVNLTIDLQIKTSLQFLALRREGNAVDAKKQRSAFPPNFVHSLDGSHMMMTALACRDAGLCFAGVHDSFWTHACDVEKMSQILREKFVELYSMPILENLLEGFETSYPGLTFPPLPERRGFDSKKDPRLLSGKGLEGSLLLLECSEHYLAGLKES

SEQ ID NO: 136128 - protein, 953 aa, Glycine max
  Coding DNA Sequence Number=SeqID_19350
  Gene Ontology: Mol. function=integrase activity; Biological process =DNA integration
  Homolog annotation: Hit_ID=Q1SL72; Match level="QueryCoverage=99%, HitCoverage=82%, E-value=0.0, Identity=79%"; Hit description =Ubiquitin
  Pfam annotation: Domain name=DUF593; Domain location=592-674; Score= -29.2; E_value=0.047; Accession=PF04576.6; Description=Protein of unknown function, DUF593
MSSSVTGSIVHQGQLLVHIAENGHSFELDCNENTLVESVMRSIQSVTGINFGDQLVLCLDMKLESQRPLSAYKLPSDEREVFIFNKARLQNNSPVPPPEQVDIPSHLEPPPPASSHDPHPLDDASDPALKALPSYERQFRYHYHRGHVIYTGTMMKYEHCERLLREQMVQERAVEVARGNLDQYYRMINQNYGDFMKRYMQQCRMHSDLLVNFGKDIEKLRSIKLHPALQTANRKCLLDLVKEENLRKSVENCTSSHKQFENKVSQFKQTFGEVKRRAEELLSSRDFLPIKNLEQAIKEHQRYINEQKSIMQSLSKDVNTVKKLVDDCLSSQLSSSLRPHDAVSALGPMYDVHDKNHLPKMQACDRAISKLLEFCKENKNEMNLFVHNYMQNITYVSYLIKDQKLQFPVFKEAMARQDGLFMDLKLFHGIGPAYRACLAEIVRRKASMKLYMGMAGQMAERLAIKREAELRRREEFLRLHSSCIPKEVLASMGLFDTPNQCDVNIAPFDGGLLNIDISDVERYAPEYLTGVTSKLDKQGSSKSSSALSSDSSHLAEAVDITGDSIERDDSEDLLDGSELLEIAGTCKMEVENAKLKAELAGRIALICSLCPELEYESLDDERVNNILRNAAEKTQEALHLKDEYIKHVQSMLKMKQMLCVSYEKRIQELEQKLSDQYVQGQKMSSVNDAADLPLVAGKTDNYKSESISGEANMPCISTSEPMDEVSCISSSLDAKLGLFMFTEHTGKALDGVDENMLDSSGVQNPQLDSSMMEPHREEAQSGDKDKKGKIIVQLGMSLTNSSTGENMPVSHDLVPCDSAVCQDLESKVNDEKVLELQSALADKSNQLNETETKLKTVMEKVAVLRRELEASQKLLDESQMNCAHLENCLHEAREEAQTQKSSADRRASEYSLLRASVIKTRSFFERLKTCVYSPGGVAGFADSLRNLAQSLAK

SEQ ID NO: 136129 - protein, 157 aa, Glycine max
  Coding DNA Sequence Number=SeqID_19351
  Gene Ontology: Mol. function=transcription factor activity; Cellular component=intracellular; Biological process=regulation of transcription, DNA-dependent
  Homolog annotation: Hit_ID=Q8YCU2; Match level="QueryCoverage=89%, HitCoverage=50%, E-value=5e-46, Identity=64%"; Hit description =TRANSCRIPTIONAL REGULATOR, DEOR FAMILY
  Pfam annotation: Domain name=DeoR; Domain location=1-125; Score=72.6; E_value=1.3e-18; Accession=PF00455.13; Description=Bacterial regulatory proteins, deoR family
MARLLPAKAPLTVITNSLTLMNELRNGRDITLMGLGGQFHHWCNAFMGRMTRDEIASLRADVFFVSMSAIIDDAVFHQSAETVETKRAMFEAAQKRILMMDNTKFERRALHRFAHLSEFDVVIVNQGTPVPVLRRLQELGVNVVVAPMKTGQGRTEA

SEQ ID NO: 136130 - protein, 669 aa, Glycine max
  Coding DNA Sequence Number=SeqID_19352
  Gene Ontology: Mol. function=transporter activity; Cellular component= membrane; Biological process=transport
  Homolog annotation: Hit_ID=Q66AC8; Match level="QueryCoverage=47%, HitCoverage=100%, E-value=1e-140, Identity=79%"; Hit description =Putative ABC transporter, periplasmic ribose/sugar-binding protein precursor
  Pfam annotation: Domain name=BPD_transp_2; Domain location=64-365; Score=171.5; E_value=2.2e-48; Accession=PF02653.6; Description =Branched-chain amino acid transport system  permease component
  Pfam annotation: Domain name=Peripla_BP_1; Domain location=380-643; Score=-17.0; E_value=1.4e-05; Accession=PF00532.11; Description =Periplasmic binding proteins and sugar b
  Pfam module annotation: Pfam domain module=BPD_transp_2::Peripla_BP _1; Domain location=64-365::380-643
  Subcellular localization annotation: CTP_CleavageSite=20; ConfidenceScore=5.03e-01
MKNGANGMTDRTQTLDSAPRVAKPASGKRLNLARLLLEGRAFIALLVIIATFSLLSPNYFTGANFLTMASHVAIFGLPAIGMLLVILNGGIDLSVGSTLGLAGVMAGFMMQGINLEALGVVLYLPVWAVAILTLVLGALVGLVNGVLIAIFRVPAFVATLGTMYVARGIALLITNGLTYNKLSGSEALGNTGFDWLGFNRLFNIPVGVLVLGAVALACGFLLSRSAFGRWLYASGGNERAADLSGVPVKRIKISVYVLSGICAAMAGLVLSSQLTSAGPTAGTTYELTAIAAVVIGGAALTGGRDGFHWRRDCAGGIAQHPAIRPAQSLTLRALAGWRASNRKTNLYPNNNGAPMFTKRLFIAAAAMAISTFALPSWANNGLMTIIVNDPSNPYWLTEGQVAQKAAEKLGYSAKVSAHKGDTNTESQLIDTAITNKSKAIILDPANADGSIGSVKKAIAANIPVFVINAELNQSGLAKAQLVSNNAQGAAVGAMEWVKQVGDSASYVELVGPPSDNNAATRANGFDTVLSQYPTLKKVGQEVANWDRTQGFNKMQSLLQANPNIKGVISGNDEMALGAIAALKEAGKLSQVKVGGFDGSPDAVDAVKAGTLAYTVMQPVAQFAQKAVEQADTFLKTGKTGVAQEKQLFDCILITKDNAGDFVSPFVLKQ

SEQ ID NO: 136131 - protein, 108 aa, Glycine max
  Coding DNA Sequence Number=SeqID_19353
  Gene Ontology: Mol. function=transcription factor activity; Cellular component=intracellular; Biological process=regulation of transcription, DNA-dependent
  Homolog annotation: Hit_ID=Q8YCU2; Match level="QueryCoverage=84%, HitCoverage=32%, E-value=3e-27, Identity=67%"; Hit description =TRANSCRIPTIONAL REGULATOR, DEOR FAMILY
  Pfam annotation: Domain name=HTH_11; Domain location=30-80; Score =11.6; E_value=0.0048; Accession=PF08279.2; Description=HTH domain
  Pfam annotation: Domain name=HTH_DeoR; Domain location=30-85; Score =45.0; E_value=2.6e-10; Accession=PF08220.3; Description=DeoR-like helix-turn-helix domain
  Pfam module annotation: Pfam domain module=HTH_11::HTH_DeoR; Domain location=30-80::30-85
MAHNPQETSAGHFLNETLPGDSRQARQLARRQLIAEAVMAEGAVRIEDITERFGISLMTAHRDIDEMVERGLLHKSRGVVSATPTSLVESSDLYRATRQLEEKQAIAE

SEQ ID NO: 136132 - protein, 458 aa, Glycine max
  Coding DNA Sequence Number=SeqID_19354
  Gene Ontology: Mol. function=transporter activity; Cellular component= integral to membrane; Biological process=transport
  Homolog annotation: Hit_ID=Q8ZPK2; Match level="QueryCoverage=58%, HitCoverage=88%, E-value=1e-117, Identity=77%"; Hit description =Putative periplasmic component
  Pfam annotation: Domain name=OpuAC; Domain location=32-304; Score =272.5; E_value=8.2e-79; Accession=PF04069.3; Description=Substrate binding domain of ABC-type glycine betaine transport system
MATANLLARWVKRTALVLTATLTLSHSALAATPIVMATKSFTEQHILSAMTVMWLQKKGFQVIPKTNIATTIGRNAMINKQIDMTWEYTGTSLIIFNHINKPMSSEEAYKTVKQLDAKLGLVWLNPAPMNNTYAFAMQRQRADAEGISTMSQLVAKLEQVRNTDPDHNWKLGLDLEFAGRSDGLKPLQKAYNMPLDRPQIRQMDPGLVYNAVRDGFVDAGLIYTTDGRVKGFDLKVLEDDKHFFPSYNVTPVVRQDVLESHPGLEAALNALSPLITDEAITEMNKRVDIDHQSPQQVAPHLAGAGGGGFCHPRRRAAGHSDCPLQMAGNTGAGHRHHRADHPDHCAIWPDDSVVFTDRSGNWRPAGDYRGVPLFTAADCAQYPYRAGKPAARAARSRPRYWHDLLAAPALGGNSDGAAGDFWRYPYRRGDERRRNGHCSGDRCRRPGPATAGRHQRQR

SEQ ID NO: 136133 - protein, 770 aa, Glycine max
  Coding DNA Sequence Number=SeqID_19355
  Homolog annotation: Hit_ID=P43531; Match level="QueryCoverage=31%, HitCoverage=77%, E-value=2e-89, Identity=60%"; Hit description=Inner membrane transport protein ynfM
  Pfam annotation: Domain name=ROK; Domain location=650-770; Score= -40.2; E_value=0.0006; Accession=PF00480.10; Description=ROK family
PAVMGSCCGCVLPARESAVPAQAKSGVSVIEKSLSRAEGGYRADGPGRVKSPEKTATAVGWQERTALRMHHMIVVITGMLIDIIANQQCQHQQGADKQGYARPAVAVPEHAAQGAGHAGAHVVAEQPLATEWAAKKPAVNSIMPGKISHSELKAVSSRPASMIAVAPVITGPRPKRLVIAPAFGELHEPVRYTTDSSPTTAWLSDHGALSKRRKLISKLRGRSEAGRKWRDAGRIFQNISAPASAQQPMTPMAIRHEKKSVSTPDSKRPLMPPIELPLMYSPMEKAMTRGCISSLSVQIAASISAVTITDLRPIASDSGPVNSRPSAISPGESGKTGREQRQRHAHKLRRSTFNPFSSGIGGNRLRGQAVLIKRYSLGRATHSTSSIQQMSEYCGTGGRARGAHSSRSAGRVAYWLYLLGAVYRTGVGCAVSLSATLAGRAYSDAGVQHAAAAGAAARGATRSGRHAQYAAAGGSSAPPGGTALYGEILALLHRYQIKPYITQEVGEAMTILGLVATGLGVSILPASAAPAECADEQYDDAAAAQCRGMNPRKRENIREQGVNLDSQPGHIDQIKQTNAGAVYRLIDHYGPISRIELSKRAQLAPASITKIVREMLDAHLVQETEFQEPGSRGRPAIGLILDTLAWHYLAVRLQPGFITLTLRDLSSRALQEDRLPLPASADTPLLQTLQELVNAFFIRHQQKLERLTAIAITLPGLINAASGVVHRMPGYEVQDMPLGETLAQRTGLPVFVQHDISAWTLAEALFGASR

SEQ ID NO: 136134 - protein, 129 aa, Glycine max
  Coding DNA Sequence Number=SeqID_19356
  Homolog annotation: Hit_ID=P31122; Match level="QueryCoverage=29%, HitCoverage=9%, E-value=4e-10, Identity=81%"; Hit description=Sugar efflux transporter
  Subcellular localization annotation: CTP_CleavageSite=49; ConfidenceScore=5.44e-01
MSDSRPTGTNSVVLKTKAAIASSTTRSQAVLRETVVDCIEFKSAKRRVRGQERTRVLPARESAVPAQAKSGVSVIEKSLSRAEGGYRAGGPGRVKSPEKTATAVGRQERTALRMHHMIVVITGMLIDII

SEQ ID NO: 136135 - protein, 429 aa, Glycine max
  Coding DNA Sequence Number=SeqID_19357
  Gene Ontology: Mol. function=nucleoside-triphosphatase activity; Cellular component=membrane; Biological process=regulation of transcription, DNA-dependent
  Homolog annotation: Hit_ID=Q8X626; Match level="QueryCoverage=54%, HitCoverage=15%, E-value=7e-53, Identity=47%"; Hit description =Member of ATP-dependent helicase superfamily II
MAGVLFAVILTALMRNKRPSWTARRAVRHGLRELLRFIKEIERNGSSLLGRQRFIGLMLDKVNVVLPRLHLDPQSDMAPAGMLLTEVWLGVNSFDYYARHQALLSRYQLDSGQMFHELGLFLKRRLKSLQTPPHEDLQEELDVLLMQLEQLAQRDEALMLPLFHLFSIRLYLFPQLSWPVATPRQAERLQQHRYRLQPQHNAPIANHHQCAATAGRPHATDAERPRQLHAKGIGGIQHRQRHRRMCGLRAAELAQPVDGRIFSKLRAAHAGNKAAAQQPSGILHAAQQRLQRRKAAGNLLCHGGTARDHAKAVEHIFSQRQGAFGIGQRLPHNQRPASGHAVERGLRSSTAAGRETGPTVATARRTGRAWTRRVAGGAELAQRGPGIHGQIAAPYQFPHRGKDFAGIDRLFRLRHHARQQLAGEPAAAV

SEQ ID NO: 136136 - protein, 561 aa, Glycine max
  Coding DNA Sequence Number=SeqID_19358
  Gene Ontology: Mol. function=nucleoside-triphosphatase activity; Cellular component=membrane; Biological process=regulation of transcription, DNA-dependent
  Homolog annotation: Hit_ID=Q6D6U1; Match level="QueryCoverage=96%, HitCoverage=35%, E-value=1e-155, Identity=53%"; Hit description =Probable ATP-dependent helicase
  Pfam annotation: Domain name=DEAD_assoc; Domain location=98-286; Score=298.3; E_value=1.4e-86; Accession=PF08494.1; Description=DEADH associated
MVYESRINDIITLGATSWRIQQITHDQVVVVPAPGRSARLPFWHGDSLGRSATLGEAIGRYLRHAASGVLPGSDNLDASARHNIRALIDEQIAATGLVPDDRNLLIERCRDETGDWRVILHSPYGQRVHAPWALAIAERIGRQMGLDPAVVASDDGIVARFPDSEGRVPGAELFLFAPDELQRQVTAAVGHSALFAARFRECAARALLLPRRNPGKRSPLWQQRLRAGQLLEVARQFDDFPILIETARECLQDVYDLPALHQLMARIQQGEVKLTEVTTDTPSPFAAPLLFGYVAEFMYASDAPQAERRASMLALDSTLLSDLLGQVEMHELLAPEVVARVEQELQRTVPDYQASTQEAVVDLLRELGPLTVPEITVRYNGEAALMPLLTALQQAQRIIQVTIAAEARWAVAEDGVRLRDALGTALPADLPAGLLAPVARPLHDLLNRYLRTHAVATSLQIAVRFGLGRVVVDDTLEELRQQQRVLKGDFLSPAVDASTQWVAESVFRRLRVRSLQAAREATRPVEAPAYVAFLLERQGLLSDVAASAAQGAFAGINGVVR

SEQ ID NO: 136137 - protein, 261 aa, Glycine max
  Coding DNA Sequence Number=SeqID_19359
  Gene Ontology: Mol. function=nucleoside-triphosphatase activity; Cellular component=membrane; Biological process=regulation of transcription, DNA-dependent
  Homolog annotation: Hit_ID=Q8X626; Match level="QueryCoverage=99%, HitCoverage=18%, E-value=4e-74, Identity=62%"; Hit description =Member of ATP-dependent helicase superfamily II
  Pfam annotation: Domain name=Helicase_C; Domain location=181-255; Score=8.5; E_value=0.0025; Accession=PF00271.21; Description =Helicase conserved C-terminal domain
SKARETLRGISTVIIDEVHAVAGSKRGAHLALSLERLDVLLAQPAQRIGLSATVRPPEAVAAFLGGAGATRIVNPPAQRPLQLTITVPVEDMTDIQQRPDARAAQESSLAAGSIWPHIEAGILDEVLRHRATLVFTNSRGLAEKLTARLNELYARRATPEHGVTEPAFAYGSFSGGTEKRATPAEAYIARSHHGSVSKEQRLEIENALKAGELRCVVATSSLELGIDMARCSVLAGPVTRWGVRRKALSGHARAAIWLMRP

SEQ ID NO: 136138 - protein, 475 aa, Glycine max
  Coding DNA Sequence Number=SeqID_19360
  Gene Ontology: Mol. function=nucleobase transporter activity; Cellular component=membrane; Biological process=nucleobase, nucleoside, nucleotide and nucleic acid transport
  Homolog annotation: Hit_ID=Q4KJN7; Match level="QueryCoverage=94%, HitCoverage=91%, E-value=1e-127, Identity=51%"; Hit description =Cytosine/purine/uracil/thiamine/allantoin permease family protein
  Pfam annotation: Domain name=Transp_cyt_pur; Domain location=26-448; Score=107.4; E_value=4.3e-29; Accession=PF02133.6; Description =Permease for cytosinepurines, uracil, thiamine, allantoin
MSAQIPAADYSGAEKQRLSETRSIDYIPLSERHGHPFSQFTLWFGGNLQITAIVTGALAVVLGGDVVWSIVGLLVGQIVGAAIMSLHAIQGPRLGLPQMITSRMQFGVFGAVIPLVLVCIMYVGFSASGTVLAGQALAKLVNVSNAAGMIIFSAIIIVIAVLGYRVIHKLGKVASVIGVLAFVYLFITLLSSHDLAAVWQNQHFSVASFLLAVSLSSSWQIAFCPYVSDYSRYLPVDVSAKKLFSSVFFGTVLGTQASMTLGVIVAAIAGKAFSGNEVGYIVGLGSSATMAMVIYFAICFGKITFTTLNAYGSFISLTTIVSGFRQQTAISRGGRILFVVLMVTLSCIIALLSEPAFLKSFTHFLLFLLAFFVPWSAISLTDFYLITQGKVDVPALSQPDGRYGRWNWAGIIIYFLGVLVQLPFIDNPLHHGSLTWIFAGNDVSWIIGWFVTALLWLAARRFDRRGKLADSVYPQ

SEQ ID NO: 136139 - protein, 356 aa, Glycine max
  Coding DNA Sequence Number=SeqID_19361
  Gene Ontology: Mol. function=nucleoside-triphosphatase activity; Cellular component=membrane; Biological process=regulation of transcription, DNA-dependent
  Homolog annotation: Hit_ID=Q8X626; Match level="QueryCoverage=100%, HitCoverage=23%, E-value=1e-113, Identity=60%"; Hit description =Member of ATP-dependent helicase superfamily II
  Pfam annotation: Domain name=DEAD; Domain location=30-221; Score =145.4; E_value=1.5e-40; Accession=PF00270.19; Description=DEADDEAH box helicase
  Pfam annotation: Domain name=ResIII; Domain location=26-219; Score= -1.2; E_value=5.9e-05; Accession=PF04851.6; Description=Type III restriction enzyme, res subunit
  Pfam module annotation: Pfam domain module=DEAD::ResIII; Domain location=30-221::26-219
  Subcellular localization annotation: CTP_CleavageSite=32; ConfidenceScore=5.11e-01
MQESWMPASALSLFTPATQQWFRRTFPAATPVQQEAWRAIASGQHCLVIAPTGSGKTLAAFLHAIDALFRERSRDEPVARSHKTRILYISPVKALAADVQRNLALPLAGVAAQRAELGEADITLEVGMRSGDTLSAERAKLQRRPPDILITTPESLFLLLTSKARETLRGISTVIIDEVHAVAGSKRGAHLALSLERLDVLLAQPAQRIGLSATVRPPEAVAAFLGGAGIVRIVNPPAQRPLQLTITVPVEDMTDIQQRPDARAAQESSLAAGSIWPHIEAGILDEVLRHRATLVFTNSRGLAEKLTARLNELYARRSAPEHGVTEPALAYGSFSGGTEKRATPAEAYIARSHHGS

SEQ ID NO: 136140 - protein, 100 aa, Glycine max
  Coding DNA Sequence Number=SeqID_19362
  Gene Ontology: Mol. function=DNA-directed RNA polymerase activity; Biological process=transcription
  Homolog annotation: Hit_ID=P69243; Match level="QueryCoverage=79%, HitCoverage=8%, E-value=2e-31, Identity=75%"; Hit description=DNA -directed RNA polymerase 3A, chloroplast precursor
MAMIVCLICYHTLSRYEKGGHLFLPSYIMRTHGSKKQQDVMKNVERKQMQKVFEALDTLGNTKWRVNRRLLNVVESLWAGGGNIAGLIDRKDVSINSNNF

SEQ ID NO: 136141 - protein, 63 aa, Glycine max
  Coding DNA Sequence Number=SeqID_19363
MHSDRQTDATCLQIRRQKILKNYGVIECDPLVLAGMDKSVKHMLMPYMPMLVPPKKWKGYGSY

SEQ ID NO: 136142 - protein, 193 aa, Glycine max
  Coding DNA Sequence Number=SeqID_19364
  Gene Ontology: Mol. function=serine-type endopeptidase activity
  Homolog annotation: Hit_ID=Q2HW42; Match level="QueryCoverage=21%, HitCoverage=4%, E-value=3e-12, Identity=85%"; Hit description =Phospholipase D/Transphosphatidylase; Pleckstrin-like
MEVILGNVTSYFDSAKQLVNGIPLPLDLGSNIDDVKVKVTTAADSLSKKAKENSRMIHKVIDGVRLALVTVAVVMIFVAFLGLLFSLLALSCPVYSLVVIGWILVTGTLLLCAAFLFVPKFISREPLVSIADLTLFIYEELAVNVHYMECFGSFAPIRGLTEDGSQAQWFVDGQETFEAIATSIQDAKSVVHQ

SEQ ID NO: 136143 - protein, 465 aa, Glycine max
  Coding DNA Sequence Number=SeqID_19365
  Gene Ontology: Mol. function=protein kinase activity; Cellular component=integral to membrane; Biological process=protein amino acid phosphorylation
  Homolog annotation: Hit_ID=Q1T089; Match level="QueryCoverage=99%, HitCoverage=53%, E-value=0.0, Identity=54%"; Hit description=Protein kinase
  Pfam annotation: Domain name=LRRNT_2; Domain location=2-31; Score =12.3; E_value=0.044; Accession=PF08263.3; Description=Leucine rich repeat N-terminal domain
  Pfam annotation: Domain name=LRR_1; Domain location=108-130; Score =15.7; E_value=0.17; Accession=PF00560.23; Description=Leucine Rich Repeat
  Pfam annotation: Domain name=LRR_1; Domain location=133-154; Score =8.0; E_value=9; Accession=PF00560.23; Description=Leucine Rich Repeat
  Pfam annotation: Domain name=LRR_1; Domain location=158-180; Score =6.5; E_value=17; Accession=PF00560.23; Description=Leucine Rich Repeat
  Pfam annotation: Domain name=LRR_1; Domain location=182-205; Score =10.9; E_value=2.5; Accession=PF00560.23; Description=Leucine Rich Repeat
  Pfam annotation: Domain name=LRR_1; Domain location=207-234; Score =12.6; E_value=1.2; Accession=PF00560.23; Description=Leucine Rich Repeat
  Pfam annotation: Domain name=LRR_1; Domain location=239-261; Score =10.6; E_value=2.9; Accession=PF00560.23; Description=Leucine Rich Repeat
  Pfam annotation: Domain name=LRR_1; Domain location=265-287; Score =10.4; E_value=3.2; Accession=PF00560.23; Description=Leucine Rich Repeat
  Pfam annotation: Domain name=LRR_1; Domain location=289-311; Score =17.1; E_value=0.063; Accession=PF00560.23; Description=Leucine Rich Repeat
  Pfam annotation: Domain name=LRR_1; Domain location=313-335; Score =14.8; E_value=0.31; Accession=PF00560.23; Description=Leucine Rich Repeat
  Pfam annotation: Domain name=LRR_1; Domain location=337-359; Score =15.9; E_value=0.14; Accession=PF00560.23; Description=Leucine Rich Repeat
  Pfam annotation: Domain name=LRR_1; Domain location=36-58; Score=6.0; E_value=22; Accession=PF00560.23; Description=Leucine Rich Repeat
  Pfam annotation: Domain name=LRR_1; Domain location=361-383; Score =15.8; E_value=0.15; Accession=PF00560.23; Description=Leucine Rich Repeat
  Pfam annotation: Domain name=LRR_1; Domain location=385-407; Score =19.7; E_value=0.01; Accession=PF00560.23; Description=Leucine Rich Repeat
  Pfam annotation: Domain name=LRR_1; Domain location=434-456; Score =2.7; E_value=87; Accession=PF00560.23; Description=Leucine Rich Repeat
  Pfam annotation: Domain name=LRR_1; Domain location=60-82; Score =18.4; E_value=0.027; Accession=PF00560.23; Description=Leucine Rich Repeat
  Pfam annotation: Domain name=LRR_1; Domain location=84-106; Score =17.8; E_value=0.038; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1; Domain location=2-31::108-130::133-154::158 -180::...
  Pfam module annotation: Domain location=182-205::207-234::239 -261::265-287::289-311::313-335::337-359::36-58::361-383::385 -407::434-456::60-82::84-106
MSGIVSDPQNALESWKSPGVHVCDWSGVRCNNASDMIIELDLSGSSLGGTISPALANISSLQILDLSGNCLVGHIPKELGYLVQLRQLSLSGNFLQGHIPSEFGSLHNLYYLDLGSNHLEGEIPPSLFCNGTSLSYVDLSNNSLGGQIPFNKGCILKDLRFLLLWSNKLVGQVPLALANSTRLKWLDLELNMLSGELPSKIVSNWPQLQFLYLSYNNFTSHDGNTNLEPFFASLVNLSHFQELELAGNNLGGKLPHNIGDLIPTSLQQLHLEKNLIYGSIPSQIGNLVNLTFLKLSSNLINGSIPPSLSNMNRLERIYLSNNSLSGEIPSTLGAIKHLGLLDLSRNKLSGSIPDSFANLSQLRRLLLYDNQLSGTIPPSLGKCVNLEILDLSHNKITGLIPEEVADLSGLKLYLNLSNNNLHGSLPLELSKMDMVLAIDVSMNNLSGSIPPQLESCTALEYLNLS

SEQ ID NO: 136144 - protein, 347 aa, Glycine max
  Coding DNA Sequence Number=SeqID_19366
  Gene Ontology: Mol. function=DNA-directed RNA polymerase activity; Cellular component=chloroplast; Biological process=transcription
  Homolog annotation: Hit_ID=P69243; Match level="QueryCoverage=88%, HitCoverage=33%, E-value=6e-71, Identity=47%"; Hit description=DNA -directed RNA polymerase 3A, chloroplast precursor
  Subcellular localization annotation: CTP_CleavageSite=56; ConfidenceScore=5.47e-01
MAFATSFSTPHLQRGIHPTKSQSLHHFLFFPNPIFCCFPSSIPLTIKTPRTQFHLSASVHDNCVQKLENLHEPVNGVHQTEPPDPPQRIFIQNSPWILNDLLLNDIEEEKKLNLLRRRQIKAETEALEKMVEEYRELEREMREKNLTPNLPHVKALFLGWFDPLKEAIEAEQKSKRSKKHKAAFAPHIDSLPAAKLAVIVMHKVMGLVTQEYRRAGCVLLVDAAVQIGMAVEQEVRIHKFLEKTRSHQSKKTEAGDEDSMDNDKQKLRKHVNGLIKRRRLKQVQMLLKEKESGPWGRDTQAKLGSRLIELLIETAFVHSPVNQSADTPPDIRPAFRHKFKAISKNPE

SEQ ID NO: 136145 - protein, 205 aa, Glycine max
  Coding DNA Sequence Number=SeqID_19367
  Gene Ontology: Mol. function=calcium ion binding; Cellular component =cytosol; Biological process=pathogenesis
  Homolog annotation: Hit_ID=Q1SL75; Match level="QueryCoverage=76%, HitCoverage=90%, E-value=2e-72, Identity=86%"; Hit description =Calcium-binding EF-hand
MGNTSSMLTQYDIEEVQQHCKNAFTQQEIVSLYQRFCQLDRNNCGFIPSDEFLSIPEFAVNPLSQSLLRMLDGLNFKEFVAFLSAFSPRATLHHKIECKLVYDTDCNGKVTFHDMLRALRDLSGPFMSEQQREDVLTQVLEEAGYAKDSSLVLSDFMKGKTAYNIPPPYLRIAKSLWVMGEYDLTIYFKDMESFYQNMILMLVRT

SEQ ID NO: 136146 - protein, 357 aa, Glycine max
  Coding DNA Sequence Number=SeqID_19368
  Gene Ontology: Mol. function=protein kinase activity; Cellular component=integral to membrane; Biological process=protein amino acid phosphorylation
  Homolog annotation: Hit_ID=Q1T089; Match level="QueryCoverage=96%, HitCoverage=35%, E-value=1e-132, Identity=69%"; Hit description =Protein kinase
  Pfam annotation: Domain name=Pkinase; Domain location=53-341; Score =159.5; E_value=8.9e-45; Accession=PF00069.15; Description=Protein kinase domain
  Pfam annotation: Domain name=Pkinase_Tyr; Domain location=53-341; Score=128.1; E_value=2.4e-35; Accession=PF07714.7; Description =Protein tyrosine kinase
  Pfam annotation: Domain name=RIO1; Domain location=66-212; Score= -95.0; E_value=0.057; Accession=PF01163.12; Description=RIO1 family
  Pfam module annotation: Pfam domain module=Pkinase::Pkinase _Tyr::RIO1; Domain location=53-341::53-341::66-212
MPFRYFMVTIKSKLRNRIAVVRRGDLEDVEEGTKDHKYPRISYKQLREATGGFTASSLIGSGRFGQVYEGMLQDNTRVAVKVLDTTHGEISRSFRREYQILKKIRHRNLIRIITICCRPEFNALVFPLMPNGSLEKHLYPSQRLNVVQLVRICSDVAEGMSYLHHYSPVKVVHCDLKPSNILLDEDMTALVTDFGISRLVLSDENTSTSDSASFSSTHGLLCGSVGYIAPEYGMGKHVSTEGDVYSFGVLVLEMVSGRRPTDVLSHEGSSLCDWIKKQYTHQHQLENFVEQALHRFSHCGVPNHRVKIWKDVILELVEVGLVCTQYNPSTRPTMHDIAQEMERLKDNLTKSNLPPHQ

SEQ ID NO: 136147 - protein, 412 aa, Glycine max
  Coding DNA Sequence Number=SeqID_19369
  Homolog annotation: Hit_ID=Q9ZUH9; Match level="QueryCoverage=76%, HitCoverage=91%, E-value=2e-15, Identity=27%"; Hit description =Expressed protein
  Pfam annotation: Domain name=DUF593; Domain location=17-110; Score =149.1; E_value=1.1e-41; Accession=PF04576.6; Description=Protein of unknown function, DUF593
MVIFVGISDWFMAESDITAMKETLRAQQQLLQKLYAELDEEREASATAASEAMDMIVRLQGEKAAVKMEASHYRRMAEEKIGHAEASLEVFEELMYQKEMEITSLEYQALAYKNKLLTLGSDFNASDFEFDEDLLLSRHDQQHNGENGHASNAVRRLSSLPPIPLKNNLRSARKRDRSPSPVPIPVSDMVPNMLESDTDQEVSSPSFDLPRKSVDYGHGTLDAYWDQIQKLDEKVKVISDCKESGGEKRATLRSRRGRSCSVFSQASTKITCDLKDRVAAPTTTSSDKVNHSEGTSDGEAVAIPSCPGNSVHDVFEVPQTSQKHKASGHGKRRLERWSSEADNRLTKPDSVSEEAAKLHVKHDMDKLKSMLRGNREIKIPSTKDMKTIVWQKKKGWKGIAMLMLSFKVASEK

SEQ ID NO: 136148 - protein, 484 aa, Glycine max
  Coding DNA Sequence Number=SeqID_19370
  Homolog annotation: Hit_ID=Q69P50; Match level="QueryCoverage=98%, HitCoverage=78%, E-value=3e-38, Identity=30%"; Hit description =Streptococcal hemagglutinin-like protein
  Pfam annotation: Domain name=DUF566; Domain location=232-482; Score= -69.6; E_value=7.3e-05; Accession=PF04484.3; Description=Family of unknown function (DUF566)
MDVCESEQALRKHRTRTRQPLVPAEKNNAITTTRRSGTREITSRYRSPSPTPATPSGPRRCPSPSLTRATTPASSKLLPKRAQSAERKRPATPPSPPSPSTPVQDSSIDVHLSSRRVSGSRMPEALWPSTMRSLSVSFQSDTISIPVIKKEKPVTSASDRTLRPNSNVAHKQVETPNVRKATPERKRSPLKGKNASDHTENSKPVDGLHSRLIDQHRWPSRIGGKVCSSASNRGIDHADKTTRMLNSSVLGTGVSSLRRLSLPGEARRPLQKASSNGARLMLLVESGRIVCEAKPVDDSFQVLRPHKFVPAITLDKTGLAAAGVRSQSLSNPGSRLPSPSKTSVLSSSSSRGVSPLRSRPSTPPRGASPSRIRPANSSNQSNNAISVLSFIADFKKGKKGAAFIEDAHQLRLLYNRYLQWRFVNAQAEDVFYIQNVTAEKIVYSKSFYKNLFNGSEITVQRMAHYFVYMGINYQEEDQSPATAA

SEQ ID NO: 136149 - protein, 152 aa, Glycine max
  Coding DNA Sequence Number=SeqID_19371
  Gene Ontology: Mol. function=translation initiation factor activity; Cellular component=chloroplast; Biological process=translational initiation
  Homolog annotation: Hit_ID=O82234; Match level="QueryCoverage=66%, HitCoverage=33%, E-value=7e-35, Identity=68%"; Hit description =Putative chloroplast initiation factor 3
  Pfam annotation: Domain name=IF3_C; Domain location=1-77; Score =108.2; E_value=2.4e-29; Accession=PF00707.12; Description =Translation initiation factor IF-3, C-terminal domain
YNIDEHDYSVRLKAAQKFLKDGNKVKVIVNLKGRENEFRNMAIALITRFQNDVGELGIEETKNFRDRNIFIILVPNKVAVQKTQEPPKKRDKSAADEVSLTAIFAYFYFNPVHVKLVTGRRVHYPYLDQDKKHMVLTKVLEGNPSILLIMPA

SEQ ID NO: 136150 - protein, 615 aa, Glycine max
  Coding DNA Sequence Number=SeqID_19372
  Gene Ontology: Mol. function=binding; Cellular component =intracellular; Biological process=metabolic process
  Homolog annotation: Hit_ID=Q1SL83; Match level="QueryCoverage=99%, HitCoverage=95%, E-value=0.0, Identity=51%"; Hit description =Tetratricopeptide-like helical
  Pfam annotation: Domain name=PPR; Domain location=108-142; Score =33.5; E_value=7.3e-07; Accession=PF01535.11; Description=PPR repeat
  Pfam annotation: Domain name=PPR; Domain location=209-243; Score =42.6; E_value=1.4e-09; Accession=PF01535.11; Description=PPR repeat
  Pfam annotation: Domain name=PPR; Domain location=244-278; Score =11.8; E_value=0.3; Accession=PF01535.11; Description=PPR repeat
  Pfam annotation: Domain name=PPR; Domain location=310-344; Score =50.2; E_value=6.7e-12; Accession=PF01535.11; Description=PPR repeat
  Pfam annotation: Domain name=PPR; Domain location=345-379; Score =12.6; E_value=0.24; Accession=PF01535.11; Description=PPR repeat
  Pfam annotation: Domain name=PPR; Domain location=381-414; Score =13.7; E_value=0.18; Accession=PF01535.11; Description=PPR repeat
  Pfam annotation: Domain name=PPR; Domain location=7-41; Score=35.3; E_ value=2.1e-07; Accession=PF01535.11; Description=PPR repeat
  Pfam module annotation: Pfam domain module=PPR::PPR::PPR::PPR::PPR::PP R::PPR; Domain location=108-142::209-243::244-278::310-344::345 -379::381-414::7-41
MPDRDTVLWNTMITGLVRNCCYDDSVQVFKDMVAQGVRLDSTTVATVLPAVAEMQEVKVGMGIQCLALKLGFHFDDYVLTGLISVFSKCEDVDTARLLFGMIRKPDLVSYNALISGFSCNGETECAVKYFRELLVSGQRVSSSTMVGLIPVSSPFGHLHLACCIQGFCVKSGTILQPSVSTALTTIYSRLNEIDLARQLFDESSEKTVAAWNAMISGYAQSGLTEMAISLFQEMMTTEFTPNPVTITSILSACAQLGALSFGKSVHQLIKSKNLEQNIYVSTALIDMYAKCGNISEASQLFDLTSEKNTVTWNTMIFGYGLHGYGDEALKLFNEMLHLGFQPSSVTFLSVLYACSHAGLVREGDEIFHAMVNKYRIEPLAEHYACMVDILGRAGQLEKALEFIRKMPVEPGPAVWGTLLGACMIHKDTNLARVASERLFELDPGNVGYYVLLSNIYSVERNFPKAASVREAVKKRNLSKTPGCTLIEVNGTPHVFVCGDRSHSQTTSIYAKLEELTGKMREMGYQSETVTALHDVEEEEKELMFNVHSEKLAIAFGLITTEPGTEIRIIKNLRVCLDCHAATKFISKITERVIVVRDANRFHHFKDGICSCGDYW

SEQ ID NO: 136151 - protein, 136 aa, Glycine max
  Coding DNA Sequence Number=SeqID_19373
  Homolog annotation: Hit_ID=Q1SL83; Match level="QueryCoverage=91%, HitCoverage=16%, E-value=2e-45, Identity=72%"; Hit description =Tetratricopeptide-like helical
MRVQTHAKVVVGGSADGEGIGEVVGGECRVFEEMGVEGNGGGVGGKGEAFDEYVEEEDVGFGNGEEECTCVARGADVEELLGELGDGGEVVLVTVADELRVGFGKVREGARFADEGEERVAANVPTNHLQAPQHLS

SEQ ID NO: 136152 - protein, 78 aa, Glycine max
  Coding DNA Sequence Number=SeqID_19374
MAEGIRKIAKKTLGESRGWGSNNKKSWCNERVQNKVKDLKAKMQVLAGKETKKVVSKVKVRALEGLYQSLDTKDGKRN

SEQ ID NO: 136153 - protein, 187 aa, Glycine max
  Coding DNA Sequence Number=SeqID_19375
  Homolog annotation: Hit_ID=Q1RZB1; Match level="QueryCoverage=28%, HitCoverage=19%, E-value=5e-16, Identity=81%"; Hit description =Initiation factor 3
  Pfam annotation: Domain name=IF3_N; Domain location=90-141; Score =33.8; E_value=1.1e-08; Accession=PF05198.6; Description=Translation initiation factor IF-3, N-terminal domain
  Subcellular localization annotation: CTP_CleavageSite=52; ConfidenceScore=5.58e-01
MAGITTSPFKLSHFPTLFSSSDSKLFGLPLSNPYSLKFDPSSLSTTSLSYVKARYYGGGGGPPRSPNDSRFRKSSDSDDDDKALDLSTLRSDTVRLIDQSQNMVGVVSIDDAIQMAEDVELDLVILSPDADPPVVRIMDYSINILVVDGCIKWSNKGVHISVSNSHFWASIDNLAVNDLPAYMFNNN

SEQ ID NO: 136154 - protein, 91 aa, Glycine max
  Coding DNA Sequence Number=SeqID_19376
MKTRNNMNKYVGSRGCTMLQRRGGREWHMPLLECCYNNIGVASSNMDRGGDGDGVVGAVVMGWVGFMVKFEFEFQIMLVLNQFVGKIMRLT

SEQ ID NO: 136155 - protein, 200 aa, Glycine max
  Coding DNA Sequence Number=SeqID_19377
MEFQYRDGQNQRTPLAMPFSGVAYFSGNPLEGYEFMPGGFPDNVPTPNVFPTTMLINAEEAFRQELVKKQIRREREEEEIRKKIISRETTLAHRRELEEEVKREMMSERMGGIPMQRTEGFLFPDRVYVNLESSYQRMMNHVNHINIFGRPQPQLPGQVDTRQPYTLTNTEKDKVIILAKPNVDDYGAKRKAMAPLAVDE

SEQ ID NO: 136156 - protein, 338 aa, Glycine max
  Coding DNA Sequence Number=SeqID_19378
  Homolog annotation: Hit_ID=Q9FJM6; Match level="QueryCoverage=92%, HitCoverage=93%, E-value=3e-81, Identity=49%"; Hit description =Arabidopsis thaliana genomic DNA, chromosome 5, P1 clone:MTI20
MAENEDARRSDESLKLALAISLLRSKVLKSVKESSALSPSQSDALLRWKRKAKERKQEILRLREDLKDAQDASHCDLFPESAALRFKERRRRVGSSSSSSQQRNSLGLIEEDETEQLRASVDFLVEICDSVSSVDDSKFANLAHQAVDFILVTLKNLLSMGRNLELVEGIINSLVTRLIRQMCSSLSENGSQHTGTNAQFCIQHLIRKLGSKPYIGQRAILAVCQRILVLAERLLFSDPFDDGFPHMHESMFIMIQLIEFLVTDYLLEWSKAEDFDNMLLEDWVTSIVQARKALELLESRNGLYALYMDRVTGELAKQLGGVSSFLKLKPDIINCLFR

SEQ ID NO: 136157 - protein, 132 aa, Glycine max
  Coding DNA Sequence Number=SeqID_19379
MVNPNPILDPSSPFYVHSNENPGALLVSSPRVGDNHHSSWSIALTMALKSKNELPFGDGTLPSRRKKLDLRARKFIFSGFKSGTKGSSNAFLAWTIDVTQSSRSTVSIIVTTQLARIIDWYDRNGTKIYSSS

SEQ ID NO: 136158 - protein, 157 aa, Glycine max
  Coding DNA Sequence Number=SeqID_19380
  Subcellular localization annotation: CTP_CleavageSite=57; ConfidenceScore=5.07e-01
MEFKYRAAQDRRTSSPQPYPLSTGTYVSDRPLRGCEFSSGGYPGNVPAPRVFRTPVPVNAGEAFRRELEKKQIRREILAREMTRRRELEEEVRREIALERVLGIPFRERAWVSLNQDQGMNNPVNNNIFGGSQPSLSPQIDISRQQTNKDKVIILFS

SEQ ID NO: 136159 - protein, 71 aa, Glycine max
  Coding DNA Sequence Number=SeqID_19381
MDVKEMVMYLNPNDNIFGWVLFVQAIKSVGMVDFLVGLLPHGKEGKPNSPIKRLDNFQGMLPLYGRPCASE

SEQ ID NO: 136160 - protein, 303 aa, Glycine max
  Coding DNA Sequence Number=SeqID_19382
  Gene Ontology: Mol. function=nucleic acid binding; Cellular component= intracellular
  Homolog annotation: Hit_ID=Q1RZD5; Match level="QueryCoverage=99%, HitCoverage=61%, E-value=6e-23, Identity=32%"; Hit description=Zinc finger, C2H2-type
  Subcellular localization annotation: CTP_CleavageSite=48; ConfidenceScore=5.36e-01
MEFKYRDGQIQRTPSPLRHPLPSNTYVSNRLLQGGFPRNVSVPRVFLMAMPINVNEVFQRELEKEKIWRELEKEGIRREIIAHEMAFAQRRELEDEVRKEIELERTFRISMQRSDVIRFREPISVPFNHSMGPLNDITMFGGLPFHLLSQASKQINKDKVIILPDDHCGEKRKAMTLAIDDNESLQKKSKKEWSCELCQISATSLKGLNDHIQGKKHKANKESTRTQKIGLDSRPESETLHPCLTPADTCKLESKEKGQVVQKSKGLGLDSRPESETLHPCLTPADTCKLESKEKGQVVQKSK

SEQ ID NO: 136161 - protein, 165 aa, Glycine max
  Coding DNA Sequence Number=SeqID_19383
  Gene Ontology: Mol. function=nucleobase transporter activity; Cellular component=membrane; Biological process=nucleobase, nucleoside, nucleotide and nucleic acid transport
  Homolog annotation: Hit_ID=Q9HU84; Match level="QueryCoverage=77%, HitCoverage=26%, E-value=3e-40, Identity=60%"; Hit description =Probable transporter
MSAQIPATDYSGAEKQRLSETRSIDYIPLSERHGHPFSQFTLWFGGNLQITAIVTGALAVVLGGDVVWSIVGLLVGQIVGAAIMSLHAIQGPRLGLPQMITSRMQFGVFGAVIPLVLVCIMYVGFSASGTVLAGQALGEAGQRQQCSRADHLQRHHHRDCGARLS

SEQ ID NO: 136162 - protein, 195 aa, Glycine max
  Coding DNA Sequence Number=SeqID_19384
  Gene Ontology: Mol. function=N-acetyltransferase activity; Biological process=metabolic process
  Homolog annotation: Hit_ID=Q82F62; Match level="QueryCoverage=62%, HitCoverage=82%, E-value=3e-12, Identity=38%"; Hit description =Putative acetyltransferase
MRLHADRSLEIVMTLAMLSVNVRSLAGQPGEGIMQAVIETERLRLEPFALSHLAGLRAMDDDPEIMRYINEGQVKSEDETLATIERVQQRWQRYASGPSGTGAAGNWLATVAQQSGERVCHRSRYGDCAVCYRADRRGLSGGGGTSGKPCIPSGDAAAGARTSGSGAIYHAINCAAIKHAPGKGALNTLVRARLP

SEQ ID NO: 136163 - protein, 131 aa, Glycine max
  Coding DNA Sequence Number=SeqID_19385
  Homolog annotation: Hit_ID=Q7N0F9; Match level="QueryCoverage=97%, HitCoverage=67%, E-value=5e-24, Identity=51%"; Hit description =Similar to unknown protein of Photorhabdus
MTAIERLNAFDRQGRYVFAVRDLAKVFYDDSDKAFNAGLNRLVKDGILQRASRGVYVYAYARSKDAYTLERIVQTLRRGEYSYLSLESALSAYGVISQIPMRRLTVMTTGRSEEHITPLWRDRIHAYQTIA

SEQ ID NO: 136164 - protein, 405 aa, Glycine max
  Coding DNA Sequence Number=SeqID_19386
  Homolog annotation: Hit_ID=Q7N990; Match level="QueryCoverage=62%, HitCoverage=82%, E-value=2e-83, Identity=59%"; Hit description =Similar to unknown protein of Photorhabdus
  Pfam annotation: Domain name=DUF1814; Domain location=29-244; Score =107.1; E_value=5.2e-29; Accession=PF08843.1; Description=Domain of unknown function (DUF1814)
  Pfam annotation: Domain name=PA_decarbox; Domain location=244-405; Score=284.1; E_value=2.6e-82; Accession=PF05870.2; Description =Phenolic acid decarboxylase (PAD)
  Pfam module annotation: Pfam domain module=DUF1814::PA_decarbox; Domain location=29-244::244-405
MNQKVSFTELVAKAMASAQLEGMRNVVEKELLHYDILYCLDKAGLLQNLTFQGGTSLRLCYDGNRFSEDLDFAGGINFSGADLKNMKVCIEDYLGTRYGLEVTVKEPAELRRQPGYEEIRVDKWQVSVTTAPEKRDMPKQPIKVEVANIPAYSRKPLPLSRNYPVLPDGYSDTLVMCESLDEIMSDKLISLVATTKYLRYRDVWDLPWLMQQGAAYDVGWIRQKIEDYRIPDYEKLLKQRLADLSAFVGTHFVYTYDNGWKYEWYARNATTCDYRIHQGLVGGRWVTNQSMNAVQFAPGIYKVDWHEPTGTCVSLLFDINRKVIHGTIFFPQWIAGEGQHPEKTICYQNEFIEDMHRFRDEGPAYPYVVIPEFAKVTYMKNEGPDNDAVINMPPGQMPEDYFKDK

SEQ ID NO: 136165 - protein, 329 aa, Glycine max
  Coding DNA Sequence Number=SeqID_19387
  Gene Ontology: Mol. function=transcription factor activity; Biological process=regulation of transcription, DNA-dependent
  Homolog annotation: Hit_ID=Q4K7Y9; Match level="QueryCoverage=79%, HitCoverage=95%, E-value=9e-58, Identity=48%"; Hit description =Transcriptional regulator, LysR family
  Pfam annotation: Domain name=HTH_1; Domain location=3-62; Score=70.2; E_value=6.8e-18; Accession=PF00126.17; Description=Bacterial regulatory helix-turn-helix protein, lysR family
  Pfam annotation: Domain name=LysR_substrate; Domain location=84-273; Score=42.9; E_value=1.1e-09; Accession=PF03466.10; Description=LysR substrate binding domain
  Pfam module annotation: Pfam domain module=HTH_1::LysR_substrate; Domain location=3-62::84-273
MDKRQLKAFICVFEERNITRAAQLLNLTQPALSATIKLLEEELATTLFIRRPRGVEVTEDARVLYPQARKMLSDMQALVTRFRQPSDCLPLKIGVEGDVAPAQLAQLLTAIRQHFPTVLLSVEPGCVGDIRLACESLRCEDELFMPLFEEHYVLAYPASHALNQLETLTHDQLHPLPWVMVPTDESHQRLLPFYGTGAAAANAGSYALALDLAEAGFGVTIAPAPLVAARHRLAWRALPGQPLMRRVGICYAVQAQANPATRCAAGRTGSKRISAGSSCQIWRQNCRRVRPSAAHGRAPAAVRRARPGHFPASAESARYSRPAAWRGDR

SEQ ID NO: 136166 - protein, 69 aa, Glycine max
  Coding DNA Sequence Number=SeqID_19388
KKWSVKWMKRRERGIGEKKASRQGEGVVIKMQLLLWKSRDRDRSNGGAEEVCLFNNYLNTKLIFGLGCN

SEQ ID NO: 136167 - protein, 183 aa, Glycine max
  Coding DNA Sequence Number=SeqID_19389
MSFMFLTYRMLLLKIYLSVSNTVSRKIAPTKFDYEPAFNFDKIDHIDAEVDSFISIKFEENGVASWEKSNTTAISNMSKKVRVESQVLDKDAKESKSVVEHGKSNNAFRWRKRMGRLVHFIPWKRSNKGGGVGHVEGVKFDVAIVMEGHFRRTIKVATLGSTVEGINREKLHRLHEIDYTDTK

SEQ ID NO: 136168 - protein, 166 aa, Glycine max
  Coding DNA Sequence Number=SeqID_19390
  Gene Ontology: Mol. function=RNA-directed DNA polymerase activity; Cellular component=membrane; Biological process=RNA-dependent DNA replication
MKSSERSSHGREGTGRGQNHVKFSLLRAKVFVTLIWPLVGDEWNSDQVLNDSTIRVILRIICNGLLEFNEFLVYEVLREGFVVNENVIKEDDDEFSQMRGTDAIHHLLESGGSKVKLREPGSASKLILQLLYSGDRKPALDRDCVQYLIVNTKPPRPIVFLNQERK

SEQ ID NO: 136169 - protein, 81 aa, Glycine max
  Coding DNA Sequence Number=SeqID_19391
  Gene Ontology: Mol. function=structural constituent of ribosome; Cellular component=ribonucleoprotein complex; Biological process =translation
  Homolog annotation: Hit_ID=Q2PMQ2; Match level="QueryCoverage=98%, HitCoverage=57%, E-value=3e-28, Identity=83%"; Hit description =Chloroplast 30S ribosomal protein S11
  Pfam annotation: Domain name=Ribosomal_S11; Domain location=2-80; Score=66.7; E_value=7.2e-17; Accession=PF00411.9; Description =Ribosomal protein S11
MYEVRYTKGDTFFVAQTAAKNAIRTVSDQGMQRAKVMIKGPSLKRDATLRAIRRSGILLNFIRVVTPMPHNGCRSPKKRRV

SEQ ID NO: 136170 - protein, 109 aa, Glycine max
  Coding DNA Sequence Number=SeqID_19392
MVVQWWFRQVDLVKGRLVVGGIGVSVVVWTNKYGEWEVGGGPGVVLESRSGEEEASGAAVVVWASKSDEQEAGGGVVVVYVNISAKWEVGGGTMVVLVSGSNEGRSVRV

SEQ ID NO: 136171 - protein, 147 aa, Glycine max
  Coding DNA Sequence Number=SeqID_19393
MAATMKALAFVALLVTINAIVCESRVARKDLGLDLGGVGIGVGAGVGLGLGGGGGAGSGAGAGSGSGSGSSSYSSSGSSSSSSGSGSGAGSEAGSYAGSHAGSGSSRAGSEAGSYAGSHAGSGSYGGNGKNRASPCVQYAIVSLKGG

SEQ ID NO: 136172 - protein, 73 aa, Glycine max
  Coding DNA Sequence Number=SeqID_19394
MAEEAKGAPSRSAAEEGEAAMRETLVKVAAEDFVETSHLVVVKGCGDVKRPIREEIFRTINFKINGKIKSKTF

SEQ ID NO: 136173 - protein, 130 aa, Glycine max
  Coding DNA Sequence Number=SeqID_19395
  Gene Ontology: Mol. function=catalytic activity; Cellular component =cytosol
  Homolog annotation: Hit_ID=Q6ETL6; Match level="QueryCoverage=70%, HitCoverage=35%, E-value=7e-25, Identity=66%"; Hit description =Putative metal-dependent phosphohydrolase HD domain-containing protein
MAIVHDIAEGMLMLALCYLSVPAIVGDITPLDGVSKAEKNQREQAALDHMCKVLGGGSTAMEIAELWMEYEANSSPEAKFVKDLDKVEMILQALEYEVVLVELLVNSSNNTYYNIDCQGIYASDAKFNAC

SEQ ID NO: 136174 - protein, 262 aa, Glycine max
  Coding DNA Sequence Number=SeqID_19396
  Gene Ontology: Mol. function=5'-nucleotidase activity; Cellular component=cytosol
  Homolog annotation: Hit_ID=Q69QI6; Match level="QueryCoverage=73%, HitCoverage=31%, E-value=3e-64, Identity=62%"; Hit description =Nucleotidase-like protein
  Subcellular localization annotation: CTP_CleavageSite=29; ConfidenceScore=5.34e-01
MASLRIRNLLRFSIHGTLLSSSPLRPGFSGSSRSYSVVESSKHFLLKSDDEEIFALRRKFEAAKQSFLSIPDALREMPKMNPKGIYVNKNVRLDQLQVYGFDYDYTLAHYSSDLQTLIYDLAKEYLVNEVSSDNTVLLYDYGSFPYSSCCSFQLRYPEVCTSFKYDPTFPIRGLYYDKSKGCLMKLDFFGSIEPDGCFFGRRRLSHTEIRDIYGTRHIGRDHARSLVGLMDFFCFSEVSSLLSCHSIITSAFVMCNVGALPQ

SEQ ID NO: 136175 - protein, 137 aa, Glycine max
  Coding DNA Sequence Number=SeqID_19397
  Gene Ontology: Mol. function=hydrolase activity; Biological process =metabolic process
  Homolog annotation: Hit_ID=Q69QI6; Match level="QueryCoverage=96%, HitCoverage=24%, E-value=1e-49, Identity=68%"; Hit description =Nucleotidase-like protein
  Pfam annotation: Domain name=5_nucleotid; Domain location=1-137; Score=-116.1; E_value=3.5e-06; Accession=PF05761.4; Description=5' nucleotidase family
ACLLADIVQYFVDAKLEFDASYIYEDVIRAIDHVHRSGLVHRGILSDPHRYLVKNGKILRYLKMLRERGKKLFLLTNSPYYFVDGGMRFMLEDSLDCRDSWTELFDVVIAKANKPQFYTSEHPFRIIVMKGETEDTI

SEQ ID NO: 136176 - protein, 387 aa, Glycine max
  Coding DNA Sequence Number=SeqID_19398
  Gene Ontology: Mol. function=peptidase activity; Cellular component =cellulose and pectin-containing cell wall; Biological process =proteolysis
  Homolog annotation: Hit_ID=Q6XBF8; Match level="QueryCoverage=86%, HitCoverage=91%, E-value=2e-24, Identity=25%"; Hit description=CDR1
  Pfam annotation: Domain name=Asp; Domain location=91-356; Score= -142.7; E_value=3.5e-05; Accession=PF00026.14; Description=Eukaryotic aspartyl protease
MDLKLSQEIVVMATPLVYRLVSLPFIFHFTLTTATIITSSINPVFLIHYESTLSLYNSKDTTWDHYSHKMLKQTSSNEYISNLVPSPRNVVFLINFSIGEPPVPSLAVMDTGSSFTWVMCHPCSSCSQQSVPIFDLSKSSTYALTFSECNKCDVVNCECPCSVEYVGSGSSKGIYAREQLTSETIDENAFKVPSLIFGCGREFSTSSNGYPYQGINGVFGLGSGRFSLLPSFGNLRNINHKFNILVLGDKANMQGDLTNLNVINGLYYVNLEAISIGGRKLDINPTVFEVENLLEGVLVLAQQDKHNPYTLCYSGVGAVLDLDVTSMFIQTTENEFCMAVLPGDYFRDDYESFSPIGMLAQQNYNVGYDLNGMRVYFQRFDCELLDG

SEQ ID NO: 136177 - protein, 457 aa, Glycine max
  Coding DNA Sequence Number=SeqID_19399
  Gene Ontology: Mol. function=calcium ion binding
  Homolog annotation: Hit_ID=Q16D93; Match level="QueryCoverage=42%, HitCoverage=49%, E-value=4e-28, Identity=40%"; Hit description =ATPase, AFG1 family protein
  Pfam annotation: Domain name=AFG1_ATPase; Domain location=83-353; Score=-11.6; E_value=2.7e-12; Accession=PF03969.6; Description=AFG1 -like ATPase
MRNVLRSLRQLRPAFQRQDCVLIIVNVAEEPPCHIGKSCHIHSSAFRFVDHAETNFKNHLFTTTTRPLSTDAAKLTNRETSKAGPLVEYERRITNGELVEGDACQVDTLTELQRLYDELVESADICQLDRNSEKPVRSGWLWSRLLSHPSYSPVKGLYLYGGVGTDNLYEGGLQRDLFLPFIAALKERCVVHEIGSSIDYRKMTSGEQGFYLVGTDLSGFLKEKFQQLIGEGTATPTPQEVEVVMGRTLHVPLGANGCAYFPFEEICDRPLGAADYFGLFKKFHTLVLDGIPIFGLHNKSAAHRFVTLVDVMYENKARLLCTAEGSPKDLFEKIVTVSEAKNLAPRTSSRSRKNDDSNLCVDNELGFAKDRTISREPSMPFSDINYYEEMDYLHMMRHDLDIKWNMKPCFRNVAPKDLLNIIFILLRAFCLSSLSSSRSELKAVVLELLDAVACNLP

SEQ ID NO: 136178 - protein, 183 aa, Glycine max
  Coding DNA Sequence Number=SeqID_19400
  Gene Ontology: Mol. function=protein serine/threonine kinase activity; Cellular component=integral to membrane; Biological process=protein amino acid phosphorylation
  Homolog annotation: Hit_ID=Q1T066; Match level="QueryCoverage=72%, HitCoverage=20%, E-value=2e-47, Identity=72%"; Hit description =Leucine-rich repeat, typical subtype
MDELNFILIEYTVNIVAICKPNPLVPPSSQKNATLSVGELVDTWQVVYLLVRKILHEKRVAVLVDKELGDNYDRIEVGEMLQVALLCTQYLTAHRPKMSEVVRMLEGDGLAEKWASSHNYGNQDMNSSHSHSNSNNSNTSSRPTSASKHDDDVNDRSSMLGMTMDDDDEQSLESYAMELSGPR

SEQ ID NO: 136179 - protein, 120 aa, Glycine max
  Coding DNA Sequence Number=SeqID_19401
LYHLVLITTHFGFLMLPKGERNGVELNCHHQKGGDCRSKDFAFEVLMMPYVCDILMPYENALLKFNSRQKSKNTRYNIKKISSVLGREFQIETVKGLTKKFKQKCLIQEIYSLVIDYQRM

SEQ ID NO: 136180 - protein, 666 aa, Glycine max
  Coding DNA Sequence Number=SeqID_19402
  Homolog annotation: Hit_ID=Q1RVN3; Match level="QueryCoverage=11%, HitCoverage=11%, E-value=1e-09, Identity=42%"; Hit description =Nucleotide-binding, alpha-beta plait
MGESLRDREVAQDSETNRGGLLTGTLLEQNTKMMILKEGTTSIYRRVNGFRSVAGGRLEQRQETSIEGISEERTSLNMTKVEKVSDHQHGEEWGKVWEVFIPKTKNKQGLRYGFVRFKGDDNTHAGIVNRTELKIMERRELQNRRREPIPYPRLKSYVEVVKDNHLKDGKISKELMSGEVDTEVKKDLVTIQTSKTNTSWLDNIWVGRLKNKAIFEKVDEEVQGVFGMEMKSTYWGDDLILLHDLDDDKAQELIRRERESGGTPLISIQRWSPDLQPSHRLTWLYIWGVPLKAWDVEHFATLVSGCGEFIELDEETKERKRMDVARVLVRTTEKPNIARSLLAIVDGMSRMAVTETFPPSPFTTALVDSDEDPTTRISDALNLWSTENEHPTDDDVSSNHCGTSLSHPAGLTVDGMNKDECNGPPFPHLHANGMVDPRNFCPSQTYDSTEEIPLEDNDKAATEKLNCFQANQINSTDNTLQSFDVVNRDSNFMPSNDRDAGIRDQTSVEDKVDQKLGLVPKGPFPKGGVAEIVKVYARRKEGAMEKYKAQTSSDPTSCAIREATKPSKVDLGDDSIAHTVVDAQLQPNTATLDTYLFQPQLNSSLSNNPNKKCEENQEEAFWDVARDLGLTFDDNSGNIVKLKNVSKQADTPTALQPVKGKDQLDP

SEQ ID NO: 136181 - protein, 109 aa, Glycine max
  Coding DNA Sequence Number=SeqID_19403
  Gene Ontology: Mol. function=RNA-directed DNA polymerase activity; Cellular component=nucleus; Biological process=RNA-dependent DNA replication
MFKQDEEKIAFMTDTSNYYYSIMPFGLKNVGAMYQRLMDKIFTNLLGRNLEVYVDNMKVKRRSSISHPDDLVEILVETRKHNMRLNPEKMHIQSKRQEILGLYADSQGN

SEQ ID NO: 136182 - protein, 158 aa, Glycine max
  Coding DNA Sequence Number=SeqID_19404
MENLWKESTALREQYQRLQHDHQTLSISTAVVHQNHEGATLYWYTCLPKNLIDSFGTLIKRFRAQYATSRPYHLIAIALANIQQEESRPLHNFMERFSSISIWIRGLSLEVALTSMIIGLKSGPFSNSLCKKPPTTMDELRERVVGFIHMEEMTAFWE

SEQ ID NO: 136183 - protein, 133 aa, Glycine max
  Coding DNA Sequence Number=SeqID_19405
MERKPTKSMSPIILIDEDFRDIDRCHNDLMVVKIEVANFLVCKVLLDQWKLYRRPLLVGYAHLLTTFRDKKGSKSIMIKYLLVNPCTSYNALTGRPLFNELEAIISTPHITMKFPSENERIIVIRANQMIIRE

SEQ ID NO: 136184 - protein, 42 aa, Glycine max
  Coding DNA Sequence Number=SeqID_19406
MCFTQKGTYESTFTFLTRLDKDNIRAIDMTKFDQLKELDNGL

SEQ ID NO: 136185 - protein, 140 aa, Glycine max
  Coding DNA Sequence Number=SeqID_19407
MDSNLCPFTLLDRKAHAEKAEKVPTEKDKWKQKENPQDDWVPPPLPVTIGIIIWEGHGPSGGGPLKKKRLESILMVVPFAIESHLAFLLMKEGVSYPWGKNYNPKARIQASMLSQSNQDMLREVGHRVPMDSIARFTARS

SEQ ID NO: 136186 - protein, 142 aa, Glycine max
  Coding DNA Sequence Number=SeqID_19408
MEVVCADETLLKLVEESRESLAHIETKLKELETREEALKIRFTTNENSTKALHEEIEHLNKEFSLFKAAIKKMEEKLKTNLGEVEAEILKTHEAKFNKALRQVKYFFKDASTSLLNVDKDTTSQGELVDEVDILAEEVPNLS

SEQ ID NO: 136187 - protein, 62 aa, Glycine max
  Coding DNA Sequence Number=SeqID_19409
METLPTPSEVTLVPFARVTRCGNFGGDIEIEKCKLLKYWSLKMIELDCWTSIEGILNTLQKT

SEQ ID NO: 136188 - protein, 462 aa, Glycine max
  Coding DNA Sequence Number=SeqID_19410
  Homolog annotation: Hit_ID=Q1RV13; Match level="QueryCoverage=28%, HitCoverage=43%, E-value=7e-22, Identity=36%"; Hit description=IMP dehydrogenase/GMP reductase
MLQVGILCTLNLSCPANLSNMRKQVGTQESMRSVGVIGLSLLSNCDSDDDDASLYDIYCRMKWRFDLLEMVLEIAFEKLASNFEKQLQVCALRESLYKMNGLPICCWQSSSISVLVNGSPTEEFVSQKGIRQGDPLAPFLFLVLAEGLSGLIREPKIKDSFLDMKESITLKAILWSFELALGLKVNFSKSSLMVGADARKLSTWQPVIEKVRKKLTPWRRRHLSFGGRICLVSKKFFVGARGEEKKVAWVKWDVGVVVIRGVPNGDFGMLSGLERKLCVPPSIDFTQQKNSNIVDMGFWCGKEWRWDLLWRRPWFTWEQSLVQKLMGVIGEFGPYKNEMLERIEVSINNYGDYLFPQSIWSRCYAWLGDMRALPSECKQHLWQHAWNVRGPNSNLVWWAVWASVVWEIWKQRNNIIFNQGHWDLDSVMDAIQYRVWSCCKSGSCELFATIEVAIDQGQGVIL

SEQ ID NO: 136189 - protein, 116 aa, Glycine max
  Coding DNA Sequence Number=SeqID_19411
MSFSEEGSACSDDGRMLSPEVRPIGESSNDDHTHPHGGSDVASNQVSDICIGDVVSGIVIPLDVGPAIPIGGVATRKGPHPYFGVRLTLMEDEAESPRPNPPQNVIDLDLETTIIQ

SEQ ID NO: 136190 - protein, 293 aa, Glycine max
  Coding DNA Sequence Number=SeqID_19412
  Gene Ontology: Mol. function=binding; Cellular component=membrane; Biological process=photosynthesis
  Homolog annotation: Hit_ID=Q7YW78; Match level="QueryCoverage=84%, HitCoverage=61%, E-value=3e-25, Identity=28%"; Hit description=Small glutamine-rich tetratricopeptide
  Pfam annotation: Domain name=TPR_1; Domain location=15-48; Score =24.5; E_value=0.00039; Accession=PF00515.18; Description =Tetratricopeptide repeat
  Pfam annotation: Domain name=TPR_1; Domain location=49-82; Score =42.6; E_value=1.3e-09; Accession=PF00515.18; Description =Tetratricopeptide repeat
  Pfam annotation: Domain name=TPR_1; Domain location=83-117; Score =5.7; E_value=1.1; Accession=PF00515.18; Description=Tetratricopeptide repeat
  Pfam annotation: Domain name=TPR_2; Domain location=15-48; Score =16.4; E_value=0.1; Accession=PF07719.7; Description=Tetratricopeptide repeat
  Pfam annotation: Domain name=TPR_2; Domain location=49-82; Score =28.3; E_value=2.7e-05; Accession=PF07719.7; Description =Tetratricopeptide repeat
  Pfam module annotation: Pfam domain module=TPR_1::TPR_1::TPR_1::TPR _2::TPR_2; Domain location=15-48::49-82::83-117::15-48::49-82
MERCDCHQFSLKNLAESLKTLGNKAMQSKKYSDAIELYNCAIAVHEKSAVYYCNRAAAYTQINKYTEAIQDCLRSIEIDPNYTKAYSRLGLVYYAQGNYRDAIHKGFRKVEIVWRMLALLLLYTVTFKALQLDPNNESVKENIRVAERKLLEEQHRAYPNQLNIFFLFHSLKNTRSSQEFPNQSAQGGSRSHGEPPPFSSMPFNPRDIASMFMNFTNATNAQQQGSHSQERQEDSNGSGASEPEIRIGGNISVNMEDMPEDITGAFQSMMEMLSGAAPPGQPQDQMNGRAAPN

SEQ ID NO: 136191 - protein, 91 aa, Glycine max
  Coding DNA Sequence Number=SeqID_19413
  Subcellular localization annotation: CTP_CleavageSite=43; ConfidenceScore=5.23e-01
MASRTSSVGRTVSFSGTPVITSVKLSVCGAKYLRNSLEHSEASAMVSTRGMRGCGNHGGHGGGGGGGGNTNSDLRCSYCKKRAIPKTNATT

SEQ ID NO: 136192 - protein, 703 aa, Glycine max
  Coding DNA Sequence Number=SeqID_19414
MAHNHIATDSPLSRRIVRAFLYFLNSGIVEPGPGVDAEGIEVARECLAEAFKLNSSPVAGDDVKSDSLIDIFKSLEANKQCETSKSDVGPLPDSADASSSFLGENPARGKNHSEASKSTVNSLHTYLLMALALGQAERAIVSERDKDQEWITVRRGRANITTFYFTRFHDYLTEKDLWAQFKRWGDRDNIVLGGLKMYVNVPRYGRRKKRIEEQIVKHGIMQEGHSKAATEGRLARTRFRNPSMTYAKVVFASNNDVEVRRNYQPPHLRATESHSSIHLEVSEGERGKYTDTWVGRLKNLGSFERVDEDLPWELGVNVAPKYIGDDMVLLLGLSDSKAEEITTAELQHGTTPFYSLQKWNLTMRSGHRLVWVQCWGVPLEVWDIGHLRKLVAAFGDLIEVDDDVEELRRMDRARILIKTPWKPFLQHSVAAHIGGETHLVQIVEEGSSGNGTRAPGRRCVTDSSEEIDSDDDVSETWRTAVESSAYSQLAPNDIDGDRPVDNDDNQLNLLPDDPCHVVYPAGITHDSRAYLPSLDTRVKPQKEIGKKQDPMVQPEIDSEVHVGEGNTCESPKRKDMGSRVPKGGSGITDKEGAVAQKGEAPDILEGANISPNGPNNKFNFESGPTTDVGSPNHTTPSTPHPFLHTHSTSVHLLTGCIKKRARSVKKHIIQDVGNSLIHQHPISGDVSAAMDPGHPHMDINNTN

SEQ ID NO: 136193 - protein, 242 aa, Glycine max
  Coding DNA Sequence Number=SeqID_19415
  Gene Ontology: Mol. function=cysteine-type peptidase activity; Biological process=proteolysis
  Pfam annotation: Domain name=Transposase_21; Domain location=127-241; Score=54.7; E_value=2.8e-19; Accession=PF02992.5; Description =Transposase family tnp2
  Subcellular localization annotation: CTP_CleavageSite=59; ConfidenceScore=5.32e-01
MLTNSVFKNIYCLRTLIHLFSCASSSSSQLLHSIRLRLRRRLSYALTPIPLHSRFLSVSTSLVPPYLAGVSCLRQVQEVFDIVARARYGQSDKSFTSLLQVVQDMLPEENALPKSYYQAKKILCLMDGRNCNGMLRHQVDSSQWKKINRLYPNFDKKARNLRLGLVTDGMNPYGSLSIQHSSWPILLVIYNLPPWLCMKQKYVMLSMMISGTRQLGNDINVYLNPMIADLIKLWDERAVYRV

SEQ ID NO: 136194 - protein, 129 aa, Glycine max
  Coding DNA Sequence Number=SeqID_19416
MADNNNNNNKFIVGGASLTKPPGITRENYSYWKERVEIVHEVHLQNQDHPQKKDFDALKSRETNYTREEKNSFLKALKVKMVESNGSDNSLGDSTDDEVDLMSRKFKSMMKKKGKFQHSSKRNETRFKK

SEQ ID NO: 136195 - protein, 214 aa, Glycine max
  Coding DNA Sequence Number=SeqID_19417
MTKANEYIIDVSQSTIMDEDRLKHVGEAYEDSPGIDPFNYPYSYTKEVYPDEGKGRCSRANNNKGLICALNVVLHWDRTTFSETFQIENIDLEAPEESPSFIDWEQTNYGPKLRMKLSAYKEEIRSIQASFRRIERDLYHALKALKKKTKLTSMDWSAVKRFFKLKGHCSGLEPDEKPLANEALAQAYEDSDYAEKGPMKWHLIGDYCYKKTIG

SEQ ID NO: 136196 - protein, 101 aa, Glycine max
  Coding DNA Sequence Number=SeqID_19418
  Homolog annotation: Hit_ID=Q1S3B4; Match level="QueryCoverage=40%, HitCoverage=9%, E-value=4e-07, Identity=58%"; Hit description =Integrase, catalytic region
MTKPYFFPPKHNILVGPSISMCNYCNGLEVETTSLDSKEDMIKSKGKDPLEGLGGPMTRARARKAKEALQQVLSILFEYKPKFQGEKSKVVSCIMAQMEED

SEQ ID NO: 136197 - protein, 160 aa, Glycine max
  Coding DNA Sequence Number=SeqID_19419
MVGSVRTCMPKLLKFTCQITSYSSPFISAVSCQCCEPDEDSSLGSIKTTVTRHLAANEGTPLNKENTNVNERGKSTETSASEVVNTNSCVVSGVCLHVGVENVRVVGKVSLELVRKKKKATMRVVEREVGDRGGGAAKEGEVVGVERGEVGEDIEEGEEE

SEQ ID NO: 136198 - protein, 119 aa, Glycine max
  Coding DNA Sequence Number=SeqID_19420
  Homolog annotation: Hit_ID=Q9MBC0; Match level="QueryCoverage=52%, HitCoverage=15%, E-value=5e-07, Identity=48%"; Hit description =Polygalacturonase
MVFPHSMVTIALVLMLASYVKAHVGLFDIRKYGAIPNGDTTMDLQNAWRDACVSMTPSKVVVPSAPLIELVRNHVPSWEDAQEMGVEEKSSEYQEPRDLRSNPFQGGGNDAILPRKGIG

SEQ ID NO: 136199 - protein, 97 aa, Glycine max
  Coding DNA Sequence Number=SeqID_19421
MSLPSDVHVSSIIKRGASGDWEICSSVVFRIGSFAKHVKKEGVETRIVITERAGWTKSVSYLCFPLISDERFFLQKAVASRGSNLARLGELSSPGRA

SEQ ID NO: 136200 - protein, 66 aa, Glycine max
  Coding DNA Sequence Number=SeqID_19422
MAHKGGWLTIQERWWLMEAQVQVMTGGAGVWVTIRGGWFARWVVGVEGCAGLEVIIGGGVGVVGVR

SEQ ID NO: 136201 - protein, 195 aa, Glycine max
  Coding DNA Sequence Number=SeqID_19423
MDSFENLLDENFKVDVKVNENNILANDVEENEIDDECKRPNRRFGNLSSSVWNFLTNLLAILMGNRGPNASITLLLSYEKVKNRNNNLDKSKAEIKSTQRKSKECREEESKHKFYTGSTTTRVYIQSSSNLLRFPFLVKILYKQRATKDVSSLVLFEQPSRCTLYLKRTTKDVPSLVFTITTKKLLASYTEFSDD

SEQ ID NO: 136202 - protein, 476 aa, Glycine max
  Coding DNA Sequence Number=SeqID_19424
  Gene Ontology: Mol. function=transition metal ion binding; Cellular component=proton-transporting two-sector ATPase complex; Biological process=ATP synthesis coupled proton transport
  Homolog annotation: Hit_ID=Q07NA8; Match level="QueryCoverage=97%, HitCoverage=11%, E-value=1e-116, Identity=49%"; Hit description =Filamentous haemagglutinin family outer membrane protein precursor
LRAGRDVIGADVTALNTSGTDISGIEAGRDIIRSNLTVAGPGNVEVSAGRQLRQEEAGSIVSLGGVVQGDARPGASIAVTAGNQGIDFDALRTHYLDPANLADSSQSLAAQPGKAVKIYDKELREWLQQRFGLAVDGAEALAAFDRLPKEQQRIFLRQVYYAELREGGREYTDAEGPRFGSYLRGREAIATLMPDKDATGATIQRTGDILMYGGSGVRTEAGGNIELMAPGGQIVVGVQGVVPPASAGLVTQGQGDIRLFSQDSVLLGLSRVMTTFGGDILAWSEQGDINAGRGSQTTLLYTPPRRVYDGWGNVILSPQAPASGAGIATLNPIAEVRPGDVDLIAPLGTIDAGEAGIRVSGNINLAALQVLNAANIQVQGESKGLPVLATVNVNALASASAAANSASQAAQDVMRKSQDDARRNQPSVISVQILGFGSGTSSINPPARGNTANAGYDADSAFQFPQASRDEGTQRR

SEQ ID NO: 136203 - protein, 198 aa, Glycine max
  Coding DNA Sequence Number=SeqID_19425
  Gene Ontology: Cellular component=mitochondrion
  Homolog annotation: Hit_ID=Q5VMT5; Match level="QueryCoverage=94%, HitCoverage=16%, E-value=2e-15, Identity=39%"; Hit description =Putative Spo76 protein
  Pfam annotation: Domain name=HEAT; Domain location=22-57; Score=9.9; E_value=2.6; Accession=PF02985.12; Description=HEAT repeat
  Pfam annotation: Domain name=HEAT; Domain location=62-99; Score=10.1; E_value=2.5; Accession=PF02985.12; Description=HEAT repeat
  Pfam module annotation: Pfam domain module=HEAT::HEAT; Domain location=22-57::62-99
MGSELKEYYYEIFSKVFQCAPQMLLAVIPSLTKGLSAAEVDVRIKAVNLVGKLFALQHPVVQKYHELFVEFLKRFSDKSVDITVRKSALQKLIKIYRDYCKKCYEGSMTISDHFEEIPCKIMMLCYDKDCKEFQNMEFVLANDLFPEDLSVEERTKHWMHMFSLFSFPHEKALDNILTQKRRFQNEMKSYLAMRKKLK

SEQ ID NO: 136204 - protein, 114 aa, Glycine max
  Coding DNA Sequence Number=SeqID_19426
MDESSLQLVSEIGRRLAHRTRPNKDFIVKSLAKAANALSLIKQSSQPRTAKEVQAAKKQEDTLKPLANAVVCGGLLQHADKEVRLLVAVCVTDLFRIMAPVPPFEDKHLRYVGP

SEQ ID NO: 136205 - protein, 141 aa, Glycine max
  Coding DNA Sequence Number=SeqID_19427
MHQRAASGNLQDISHFYSVGSMSIFLLLLRLLLLKIVMRGNHVPAVGSLGRHYQCQRIICVAPGQCAADYMQWFYMISNPFMSSAQARDPPRHPRVLRDDIFIELDIPQHQVAATAMDKAPADSPAHVEQPRHAVVKYIFN

SEQ ID NO: 136206 - protein, 61 aa, Glycine max
  Coding DNA Sequence Number=SeqID_19428
  Subcellular localization annotation: CTP_CleavageSite=54; ConfidenceScore=5.30e-01
MPIFPEKASPTDDQGGGFVMYSSSSGLPSPWSSARPTSSKKIGLPPGHAMVTLNCFRVGQG

SEQ ID NO: 136207 - protein, 92 aa, Glycine max
  Coding DNA Sequence Number=SeqID_19429
MTKGLTTRFHGTMAELSNSRSLINSSSNAIKREVEGDVFFKFFYRRTFLPLHITCWVHQQFCWVHKEKPIIDTKLLDPDLDVLGYNLQLEGD

SEQ ID NO: 136208 - protein, 202 aa, Glycine max
  Coding DNA Sequence Number=SeqID_19430
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=94%, HitCoverage=15%, E-value=4e-49, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKSEFDMTDLGLFSRFMKDPKQSHLFATKRILRYLKGTSDYGVLFPKKRTNAELSCLDTQILIGVEIRFCGAPISWCSKKQDVIALSSCEAECITSCHAACQALWLRSLLGKMHLGLKSAMQLLVENKSTINLAKNPIAHGRSKHIETKHHFLRDLVNKGRLELCFYKFEQQAGDILTKPMKIGRFKKLTKMLNVVPLETFN

SEQ ID NO: 136209 - protein, 70 aa, Glycine max
  Coding DNA Sequence Number=SeqID_19431
MVPYDRDAINQFLGNPMILEEGQQCKYTSRRERATGKSVSNLEGVNLSIGGALRNLPQEASGQQPPPFLL

SEQ ID NO: 136210 - protein, 314 aa, Glycine max
  Coding DNA Sequence Number=SeqID_19432
  Gene Ontology: Mol. function=nucleic acid binding; Biological process= DNA integration
MWVTKMQSKFEGDPTVIESGIAVLLKFQVALDIMMSGCEKVSEGSSVVEIATHTKNEKKDYETLFLLHQSVDTTNIDKITTTTIVKEAWKILEKCHEGAKKVKMENDEKITDYFAIVINLTNSMKGYCENIPKVKIVEKVFQTLPLSLIILAIVDDLKDLDSVKRSTDQEFVAQVLRKGGADKRSKQEWLTNFDDNKKCKVKFTDNKTLCAEGVGNVMIKRKDVVSDSWLWHLRFDHLNFKSLSLLKSKEMLLGVVHSDVRGPFENSKLLVDKQYEKQIKILRDDDGGEYTSKEFEDYCKGVGIQHEVTAPYAH

SEQ ID NO: 136211 - protein, 316 aa, Glycine max
  Coding DNA Sequence Number=SeqID_19433
  Gene Ontology: Mol. function=transition metal ion binding
  Pfam annotation: Domain name=Transposase_23; Domain location=219-281; Score=-16.6; E_value=0.075; Accession=PF03017.5; Description =TNP1ENSPM transposase
GYHINKYLFYTKSLDDKSAMQNSGVDLRAESQHFATIHDDNPRQASMPYFGVIEEIWELYYVKFIVCAFKCKWVDSNMGVRTNDFEFTLVDLKKLAYQNEPFIMAKQAKQMFYVQDPCDERWSMALHRKNIGLNLEDDDSTLDTCLTPFSTQMPNINGEEEVDDDVLIVAIGRLEHFGHARAAGAGGLLLPPKPEVSPSSAHFSIKGSSVKLSGQNPDTGESDKCGLYVDNNSPRLVALGRVYVGSTTIHNIPLGNDQVKVDVDVVPYANARVPIPTQVDKHKAEGPMKPVERLEPNDDPLYQMALTIPELFLKPM

SEQ ID NO: 136212 - protein, 87 aa, Glycine max
  Coding DNA Sequence Number=SeqID_19434
MAMSHVGRRPNVPTVSSCSPEIEGGRIIVTKIGSLDREVIKGRTLLQRQEVPPPLRHETLNLSKEEDSLSEAPWRVYSVEEPLMEMR

SEQ ID NO: 136213 - protein, 208 aa, Glycine max
  Coding DNA Sequence Number=SeqID_19435
MKLTGKIGWVSLNSMPKKLIEFNPNVFHHFKDYFFEVLAIHVMADGIMGDFAWRLLVKQGGPASGTVPPSTVAPTARERGQPTNEEVTRATRVDAPTTSAGSVAVSSSTAAIPLSVGVATNAPMMSPPPALAPLVPSFVVLVTALPSSSSHPHISFGHLYTPSDVDSLWGANYKPEQKNPIGFVSTFDKNLIRSAGVQNATDSAKVFL

SEQ ID NO: 136214 - protein, 166 aa, Glycine max
  Coding DNA Sequence Number=SeqID_19436
MKSKKWPGSGKRLPSSEEHGHKIQRFNHEPFNLMTSYGEFEAKLAKTLKQVHPWLQLHMLVKPKVHPWLMHTVSNTCHSMNDSLLKIQDGRVSGRFSKGSSNPRSTLGELHRLVKTQGKHDPGPRLTKPKVHPWNTLGRNSYKNPRFTLGNHSYKNPRHPIGQLTP

SEQ ID NO: 136215 - protein, 308 aa, Glycine max
  Coding DNA Sequence Number=SeqID_19437
MGAQTMEIVKRGGKNDCKLLTLPAFLCEVRLSDFLDASRTVHLQNSSAFVEVHVVFVELFEDLFQICHDQRHSPIAEVDILSDGCRFLLIWSVHPDLVISKDINDMSMLMVGEVPVELCSLPRFSVIAWIYIEFNVKAVLVDNQGSDWRPFVNTHDLSNAIRCGVRFGRLPSGRIRCHLQSFCVALSCLLLIYLNNHDLSHQAPEELALNEGGHKVDVASGLYSFPCEGEEWADVRLDDVGGSILVDEDLGHHEVGDYDGDNHAVILVDRVDTLEVSISEIDVDVLDGVEVALVRLARLSSIGESACN

SEQ ID NO: 136216 - protein, 33 aa, Glycine max
  Coding DNA Sequence Number=SeqID_19438
HRGTHRIAHASQGSSHPYPSRGGGARRCEGSGS

SEQ ID NO: 136217 - protein, 64 aa, Glycine max
  Coding DNA Sequence Number=SeqID_19439
MDRSTCLNGFRLSACFSRSADGLKCQRSVALSGWLAKPEDWLSERMKISTSQTFLINLKLRGNG

SEQ ID NO: 136218 - protein, 193 aa, Glycine max
  Coding DNA Sequence Number=SeqID_19440
  Gene Ontology: Mol. function=RNA-directed DNA polymerase activity; Cellular component=chromatin; Biological process=chromatin assembly or disassembly
VQKAKCDVSFMEKLEHHITGVHWAWPNRGYAWPSEALIGHSPSEDLLPPSTPRYHQPIKHYHHPTSSKTRDNTWQFCINYRASNTITVKDRFPLPTIDELLKNLGHATWFSKVDLAQGFHQIRMVESDISKMVFRTHQGHYKFVGEFYLKLPQCTFGQRRIDYLGHIVSTNGVEPEPSKIEVMPDWPIPTSLT

SEQ ID NO: 136219 - protein, 384 aa, Glycine max
  Coding DNA Sequence Number=SeqID_19441
  Gene Ontology: Mol. function=nucleoside-triphosphatase activity; Cellular component=membrane; Biological process=cell cycle
  Homolog annotation: Hit_ID=Q10NR0; Match level="QueryCoverage=84%, HitCoverage=26%, E-value=8e-16, Identity=26%"; Hit description=AT hook motif family protein, expressed
MSGPVSSGCHADPVEVSLNNELTPFTFSVCQSLDKLPQNSDSLVNTEIPESFSKAAVQNLRDGNTETSTVCNVIDECGHADFKWKSKFAESSPSMAMDMVHLWRKHRICQKDLGQHDNPELGVIQVVKLTSGLTNLISEADLLFHGHQQKQCGIMEPLMSLSDEAIYSWYYEQMMMSTVAVHGFCFYAKRISDVGSKFGFMNEVDLTSEMLACTTNVMALGNLSRQDQTKSTSIHAKKQLETYFSNLMKNRTCLSNAIRSIIPARSSLSMKGLAFNEYISSLRQISFSEGFRISHGSENMRKRRRVAPHYLSRGRMALSPEIISLIEYVIVVTMNSASPVGRPHDTKDPFFHELYYLLILLLLLFLFLLLKVGEQIRIKKLASA

SEQ ID NO: 136220 - protein, 118 aa, Glycine max
  Coding DNA Sequence Number=SeqID_19442
MKATTNHLNKRGCPNDGQICIDGGLAPPREIFSNSISPPITSLLIDGVLRVHWSSPQVVVETLEFGITRFFYINPMTELGSHVARLPRGYRSIMMKKECTTSKVEILSSKRLVEAVEV

SEQ ID NO: 136221 - protein, 169 aa, Glycine max
  Coding DNA Sequence Number=SeqID_19443
  Gene Ontology: Mol. function=DNA binding; Cellular component=oxygen evolving complex; Biological process=DNA integration
MADHNWQKTMLAEMAMLDANNTWELVPLPPNKSTVGCCWVYKVKITLDGTIDHYKARLVAKGYSQIFGLDYEEVYMDQPSGFLSPVTPPLFVSFVSLYGLKQSPRAWFGRFSSAVLEFGMTHCEVDHSVIFLHSKSGLCFYLVYVDDIVITGDDSTGILHLKSHLHRQF

SEQ ID NO: 136222 - protein, 126 aa, Glycine max
  Coding DNA Sequence Number=SeqID_19444
MREAIRNSLKRCQIGGWEGMSEVGEFDGGVAGELVRQIVDHVPIYDQITSSTKEKKCKNLNRYLAEKLPLPPYPKDQPPLSPLNQEVILDHPNHLHFPKVFLIHGPFHFDQKVSAFQYLDKEEFPF

SEQ ID NO: 136223 - protein, 107 aa, Glycine max
  Coding DNA Sequence Number=SeqID_19445
  Gene Ontology: Mol. function=DNA binding; Cellular component =mitochondrion; Biological process=DNA integration
MEAIPSEITWLRQLFQELKFGDTQDTRLLCDNQVVLHIASKSIFHEQTKHIEINCHFVREKVLSGEIITNFVSSGDQLADMFTKYLKGSRVDNICNKLGSYDIYAHA

SEQ ID NO: 136224 - protein, 115 aa, Glycine max
  Coding DNA Sequence Number=SeqID_19446
  Homolog annotation: Hit_ID=Q0KIN0; Match level="QueryCoverage=62%, HitCoverage=4%, E-value=2e-08, Identity=46%"; Hit description =Integrase core domain containing protein
MPFTTNVTTFYKQCGQFFIVVALAGLTSDLDAIRNQILSSPTVPTYDLVQEQLLCLSIPHTFGPFSTSTGDSSAFVSHSSHHGGRGDGRGIHCHYCKNWVHVEEDCHIKARQLSR

SEQ ID NO: 136225 - protein, 126 aa, Glycine max
  Coding DNA Sequence Number=SeqID_19447
MERNRMKVLFRIQDGIRNLIIENQWRHAVNHMKSSKRSTPPKTKWDIIVKKGKARCLKKSRKRKEIGYLSYDQRHWNQESKVQERRTKKQRLQDYQTEPEVTCDASFVGCSKLEKLIILSNRDSNL

SEQ ID NO: 136226 - protein, 256 aa, Glycine max
  Coding DNA Sequence Number=SeqID_19448
  Gene Ontology: Mol. function=nucleoside-triphosphatase activity; Cellular component=membrane; Biological process=cell cycle
  Homolog annotation: Hit_ID=Q10NR0; Match level="QueryCoverage=63%, HitCoverage=13%, E-value=3e-26, Identity=41%"; Hit description=AT hook motif family protein, expressed
MGLRNQVTHCKNPFCQSVLWLLDHTESPHKKTVKLLPSPALPNGIEAEEMGDGVIELITISDDEACSLGGTSPRLRGKSNVFTCGSVQTLILVEDVDILFPEDRGCIAAIQHISETAKGPIILTSNSNNGGLPDSFARLHVSFSLPLPDELLCHMYMVCVTEEVNINPLLLKNFIQSCDGDIRKTIMQLQFWFQSKKYKKDRKVQKVYGSLPFDLEACHQIIPKMLPCDYPSELSKLIEKEIANSITIMEDNSCSQ

SEQ ID NO: 136227 - protein, 174 aa, Glycine max
  Coding DNA Sequence Number=SeqID_19449
MGLGFSQYSPSCPTFLSLKILQKAAHRSVGIHPASVSQILPIGKKGYCWAVKKVGEGRRHMPLVIGPLICERNQWCLVEMHIGIWEVLCFGSYKLTTSGHISNADNQHSSQREFGKGQSSDGKEINAEAFSTVMVQRWAGRVYMIKMILIPFMKTMKKGQEVNFEDVNVYFWMA

SEQ ID NO: 136228 - protein, 65 aa, Glycine max
  Coding DNA Sequence Number=SeqID_19450
  Gene Ontology: Mol. function=RNA-directed DNA polymerase activity; Biological process=RNA-dependent DNA replication
  Homolog annotation: Hit_ID=Q1STC2; Match level="QueryCoverage=87%, HitCoverage=28%, E-value=8e-16, Identity=60%"; Hit description =NBS/LRR resistance protein-like protein-related
MPLKIVLGRSTAEAIYLIRKLMKKYGSKERDLHMVFVDLEKAYDHVSRDVLWKTSEKKGMHMAHI

SEQ ID NO: 136229 - protein, 139 aa, Glycine max
  Coding DNA Sequence Number=SeqID_19451
MLDGASPLDWSDWTFLDKTTVADFGTESSNLFVMEGSIESLNFDNLPSSIRPSSASSSHNAMSCSSQLSIQPDSMLEISPPNSAVLANEQAIWPLKPEDAKVDLDLEVNENTFSGHQGIFRKSDTEPLSKFLQERLTQA

SEQ ID NO: 136230 - protein, 135 aa, Glycine max
  Coding DNA Sequence Number=SeqID_19452
  Gene Ontology: Mol. function=nucleoside-triphosphatase activity; Cellular component=membrane; Biological process=cell cycle
MKGSCDLGTPKRRKAEPEEQCSPAAENTKKRKSSAKLTPRKRASKNSTPKKNSTPKKNGSAVGSPDSAWKIDLRLEAKLSAEEDSRMFAGRKIHPFFSLWKVEKQNQGQEHALSAVKREGRGITCGPIHIFENVQ

SEQ ID NO: 136231 - protein, 122 aa, Glycine max
  Coding DNA Sequence Number=SeqID_19453
MTNANYPQESLHSVSNENLRCACVFVFVCDEGLGRTELRFPKVMPLWWEFNSWVREDRVLHCRPMDNFFQHSSIAASKPSDQQVQQLKKIQAELWEKANLHESIMRQKSRTKWIKEGDRNSL

SEQ ID NO: 136232 - protein, 45 aa, Glycine max
  Coding DNA Sequence Number=SeqID_19454
MDTSEPYTGAMKGTMHKPQVNLRIMTKDNDWYLKALHWGNEGHRA

SEQ ID NO: 136233 - protein, 83 aa, Glycine max
  Coding DNA Sequence Number=SeqID_19455
MWRLQSSFFHLHSVAIDLQDAKDSIDEEDTRPTSSTWSYITSSHMDHTKIKQDHKLKRFTLKSVLNDSCFSQNLRITLSPGYG

SEQ ID NO: 136234 - protein, 110 aa, Glycine max
  Coding DNA Sequence Number=SeqID_19456
MEMYIKSTQYRLWLIITNGHKPIPRPEVEWAYTNLVIMELNTKACYTLTCTFSINKNNKNKDHMPKRDFTALKSRETISKKEEKRDPLKLLKFLWLSLMSPKIVVKNPKQ

SEQ ID NO: 136235 - protein, 165 aa, Glycine max
  Coding DNA Sequence Number=SeqID_19457
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=O48901; Match level="QueryCoverage=79%, HitCoverage=16%, E-value=3e-44, Identity=55%"; Hit description=DNA polymerase delta catalytic subunit
  Pfam annotation: Domain name=DNA_pol_B_exo; Domain location=1-150; Score=-63.4; E_value=0.00085; Accession=PF03104.9; Description=DNA polymerase family B, exonuclease domain
MELCGGIYEEIAGKSSQHYFAGNCWYSKLVSHAPEGEYSEMSPFRMLSFYIEFAGRKGHFPEPTHDPVIQDLIHEVDPDIIIGYNICKFHLPYVIKRVVNLKIAEFPILGRIRNSRVRVKDTTFSSRESKEVTVEGRLQFDLLQLLSILFCFNYLVLRHTEFIAQ

SEQ ID NO: 136236 - protein, 365 aa, Glycine max
  Coding DNA Sequence Number=SeqID_19458
  Homolog annotation: Hit_ID=Q93ZR1; Match level="QueryCoverage=39%, HitCoverage=25%, E-value=6e-48, Identity=70%"; Hit description =Probable histone acetyltransferase ELO3
IVGHLGAFDVELHGCVPEQKHTRAQSQIESLVKHIVDNVENFITEELRVQIKSTKNGLTLTLILRGIQNRRHEQQSSGGGGGNAAEEHDILRPRMMVILLCDILSIFVSASWYRLRDGDSSNGTIFSSTFAGLGLKGDYEAHCLSKEEGHVCAIAEIMSSMVDLFHKGQNMDLNALKSMACCKYRLSRVPKLVEMIVALPDAERETLFPKLLSKPVRTASGIVVVTVRSKPHQCPHFATTRNICVYCPGEPDLTPSSSTVPNLTPIMNQPACVQFVRGLTARELCLNTLEGTSFVVQVEGTSTWVVVTENKRGYISYGSVQVEGTSTWLFKENKQGCIPCGSLLVKAFTRLKRNLKDRRSLRDWM

SEQ ID NO: 136237 - protein, 191 aa, Glycine max
  Coding DNA Sequence Number=SeqID_19459
  Homolog annotation: Hit_ID=Q2RAU4; Match level="QueryCoverage=42%, HitCoverage=6%, E-value=6e-12, Identity=37%"; Hit description=HEAT repeat family protein, expressed
MRLRLWLWLQGPRPSQSLDVIFDVTKVFVLPNTDADEPTNNFALVSHPQTESSKDDQHAPPQMNMSWSRVQPQLEVDLVVALGMDLLEYPFCSCVLSATSAHNLPRPTLVVCNLMEQVIGECHSGQIGDEVDANGGFPPGLLVAQVNHVMGKQQLQSNGILLRKLGILNVIQAMELAPELAYPLYIAASVD

SEQ ID NO: 136238 - protein, 989 aa, Glycine max
  Coding DNA Sequence Number=SeqID_19460
  Gene Ontology: Mol. function=ionotropic glutamate receptor activity; Cellular component=integral to membrane; Biological process=ion transport
  Homolog annotation: Hit_ID=Q93YT1; Match level="QueryCoverage=73%, HitCoverage=81%, E-value=0.0, Identity=62%"; Hit description =Glutamate receptor 3.2 precursor
  Pfam annotation: Domain name=ANF_receptor; Domain location=272-631; Score=280.5; E_value=3.4e-81; Accession=PF01094.18; Description =Receptor family ligand binding region
  Pfam annotation: Domain name=Lig_chan; Domain location=812-989; Score= 62.9; E_value=1e-15; Accession=PF00060.17; Description=Ligand-gated ion channel
  Pfam annotation: Domain name=SBP_bac_3; Domain location=693-989; Score=-73.5; E_value=0.0033; Accession=PF00497.10; Description =Bacterial extracellular solute-binding proteins, family 3
  Pfam module annotation: Pfam domain module=ANF_receptor::Lig _chan::SBP_bac_3; Domain location=272-631::812-989::693-989
DHGGVKSVFSGDKIFDEPNWGTFDTNDDIDSVWGFNASSFTKEERDLDRAGNNYFFDSGELGLNPIKTGSPQAGDFFQRSSGFGFDDSVPSTPLYSSSSSPQRPKEWLETAFDFSRFDSFRTHDSVSLPARETTEQYDSVRNSVDFDHAYGFPAFDDSDPFGSGPFRTSSDNQTPRRGSDNWNFPTVASGGVGCQSCYLEPVTCNSKWPLLFRLRHRPTYCVGLDVALCPRDVNLHSTSGFLLSLSPATIKGHDDVVKIGAIFTLKTINGRVSKIAIQAAEKDVNSDPRILGGRKLSITIHDSNFSGFLGFIGALKFLVTDTVAIIGPQSSVMAHVLSHLANELHVPLLSSTALDPTLTPLQYPYFLQTAPSDHFHMNAVADLISYFGWREVIAVFSDDDQSRNGITVLGDKLAERRCKLSYKAALPPDPTATPSHVTGQLVKIKSMESRVIVLNTFAQTGLLVFEVAQKLGMMSKGYVWIATAWLSTVLDSTTSLPSNTCNSIQGVITFRPHTPHSRKKQAFISRWKHISNGSIGLNPYGLYAYDSVWMIAEALKLFFDRNGTISFSNNTNLSGTREETLDFGALSVFDGGKELLDNILRINMTGLTGPIQFGSDRSPLNPSYDILNVIATGYRRVGYWSNYSGLSVITPEKLHAEPANRSISSQHLNRVIWPGNTTEKPRGWVFPNNGRQLRIGIPNRVSYQDMVSQINGTNAVQGYCIDIFLAAIKLLPYAVQYKFILFGDGHNNPSYYNLVNMITSDVFDAAVGDIAIVTDRTKIVDFTQPYIESGLVVVAPVKKLKSNAWAFLRPFTPQMWGVTAFFFLFVGAVVWILEHRTNDEFRGFSFSTMFFAHRENTVSPLGRVVLIIWLFVVLIINSSYTASLTSILTVQQLSSPITGIDSLISSSDRIGFQVGSFAANYLTEQLNIPKHRLVPLGSPEEYAVALESGTVAAVVDERPYVELFLSNHCQFSIRGQEFTKSGWGFVSVF

SEQ ID NO: 136239 - protein, 798 aa, Glycine max
  Coding DNA Sequence Number=SeqID_19461
  Gene Ontology: Mol. function=GTP binding; Cellular component=exocyst; Biological process=vesicle docking during exocytosis
  Homolog annotation: Hit_ID=Q8S213; Match level="QueryCoverage=98%, HitCoverage=99%, E-value=0.0, Identity=57%"; Hit description=SEC15 (S. cerevisiae)-like protein
  Pfam annotation: Domain name=Sec15; Domain location=455-798; Score =73.4; E_value=7.4e-19; Accession=PF04091.3; Description=Exocyst complex subunit Sec15-like
MLSSKPPRRKVVPANGDDSADKLDQLLLSSAICNNEDLGPFIRKTFASGKPETLHHHLRHFARSKESEIEEVCKAHYQDFILAVDDLRSLLSDVDSLKSSLSDSNSRLQHVACPLLSSLDAFVETRNVSKNVNLAIDSVRTCVKLMEVCTRANRHLADDNFYMALKCVDAIEREYLDQTASSTLRRMLEKKIPEIRSYIERKVNKEFGDWLVEIRVVSRNLGQLAIGQASAARQREEDLRIKQRQAEEQSRLSVRDCIYALEEEEEDGIVAGGIGEDGGGAAGFDLTSLYRAYHIHQTLGLEDRFKQYYFENRKLQLTSDFQVSSMTPFLESHQTFFAQIAGFFVVEDRVLRTGGGLISKMEVENLWDIAVSKMCSVLEDQFSRMQTANHLLLIKDYVSLLGVTLRRYGYPIDALLDVLSKHRDKYHELLLSDCRKQIAEAVVADKFEQMLMKKEYEYSMHVLSFQIQTSDIIPAFPYVAPFSSTVPDCCRIVRSFIEDSVSFMSYGGQLEFYEVVKKYLDRLLSEVLDEALVKLINTSINGVSQAMQMAANMVVLERACDFFFRHAAQLSGVPLRMVERSRRQFPLRKARDAAEDMLSGLLKAKVDGFMTLIENVNWMCDEAPQSGNEYVNEVIIYLEILVSTAQQILPSQVLKRVLQEVFAHISEKIVGTLVSDSVKRFNVNAINGIEVDIRLLESFSDNQASLFSDGDVDVLKASLASSKQLINLLLSNHPENFLNPVIRERSYNTLDHKKVVIVSEKLRDPSDRLFGTFGSRGARQNPKRKSLDTLIKRLRDVS

SEQ ID NO: 136240 - protein, 530 aa, Glycine max
  Coding DNA Sequence Number=SeqID_19462
  Gene Ontology: Mol. function=protein serine/threonine kinase activity; Cellular component=chloroplast; Biological process=protein amino acid phosphorylation
  Homolog annotation: Hit_ID=P46573; Match level="QueryCoverage=59%, HitCoverage=77%, E-value=1e-113, Identity=62%"; Hit description =Protein kinase APK1B, chloroplast precursor
  Pfam annotation: Domain name=Pkinase; Domain location=211-490; Score =136.0; E_value=1e-37; Accession=PF00069.15; Description=Protein kinase domain
  Pfam annotation: Domain name=Pkinase_Tyr; Domain location=211-490; Score=133.7; E_value=5.1e-37; Accession=PF07714.7; Description =Protein tyrosine kinase
  Pfam module annotation: Pfam domain module=Pkinase::Pkinase_Tyr; Domain location=211-490::211-490
MRSTPCIHHSPILYPYVGSDSWNEACGDDALRGAEETDLIEELDTAGVEGGEEVRAGLGVDEGATNLCADDEAVLLDAEAEAVGEDVDSAADVQGAELQGEGLVDLMLRRLRVQGTASMGNCWGSPPHNPTPTTTGNLSTGTTGTSQAISSGSYTTTTTTTTTSSGSGSSSINSKFSVSSGGQPYPNGQILPTSNLRIFTFAELKAATRNFRADTVLGEGGFGKVYKGWLEEKATSKTGSGTVIAVKKLNSESLQGLEEWQSEVNFLGRLSHPNLVKLLGYCLEESELLLVYEFMQKGSLENHLFGRGSAVQPLPWDIRLKIAIGAARGLAFLHTSEKVIYRDFKASNILLDGSYNAKISDFGLAKLGPSASQSHVTTRVMGTHGYAAPEYVATGHLYVKSDVYGFGVVLVEILTGLRALDSNRPSGQHKLTEWVKPYLHDRRKLKGIMDSRLEGKFPSKAAFRIAQLSMKCLASEPKHRPSMKDVLENLERIQAANEKPVEPKFRSTHAASRQGHQAVHHRSPRQDGSN

SEQ ID NO: 136241 - protein, 346 aa, Glycine max
  Coding DNA Sequence Number=SeqID_19463
  Gene Ontology: Mol. function=hedgehog receptor activity; Cellular component=integral to membrane; Biological process=cholesterol transport
  Homolog annotation: Hit_ID=UPI000034F451; Match level="QueryCoverage =72%, HitCoverage=17%, E-value=1e-83, Identity=60%"; Hit description =hedgehog receptor
MKQSYLIPEHICKGDLPSLKKTMEQLRYHYFLRCTEAEYRSLAAATADILWIQTLLGELAVPHLTPMLIIATIPESKHGKPPSIITEENIELLFEIQEKVDGIRANYSGLLVSLSDICLKPLGDDCASQSILQYFQMDPDNYDNYGGVEHAEYCFQHYTSTETCFSAFKAPLEPTTALGGFSGNNYSEASAFVITYPVNNAITKVGDENGKAIAWEKAFIQLAKPLQISLSKKKNRPNDSRKEKPGVSVFVTLACSSEEELLPMVQSSNLTLSFSTESSIEEELKRESTADVITILVSYIVMFAYISVTLGDRPPHPSSLFLSSKKFALMFYPALLRNPALMLEDQ

SEQ ID NO: 136242 - protein, 136 aa, Glycine max
  Coding DNA Sequence Number=SeqID_19464
MKDVLENLERIQAANEKPVEPKFRSTHAANRQDLYGKSMTNECGARPEGGLDCFANMISDANAVPDANTIYYRDSPNNERKKLAPTRKSVVATIPLKNPFFFNNVDLLLQLGCGCSPSWRSAQKRSGASAVEKQRG

SEQ ID NO: 136243 - protein, 358 aa, Glycine max
  Coding DNA Sequence Number=SeqID_19465
  Gene Ontology: Mol. function=hedgehog receptor activity; Cellular component=membrane; Biological process=cholesterol transport
  Homolog annotation: Hit_ID=UPI000034F451; Match level="QueryCoverage =62%, HitCoverage=20%, E-value=5e-91, Identity=62%"; Hit description =hedgehog receptor
MADLYITTLISRASLVPTSSYIAKPAASWLDDFLVWISPEAFSCCRKFTNDSYCPPDDQCFRHSDLVNDRPSTAQFREKLPWFLDALPSADCAKGGHGAYTNSVDLNGYEGGVIQASEFRTYHTPVNRQGDYVNAIRAARDFSARISSSLKMDIFPYSVFYIFFEQYLDIWKLALINISIALGWCYFCCLSDHHIQGVMAILGIQLNAVSVVNLIMSIGIAVEFCVHIVHAFTVSLGDRSQRAKTALCTMGASVFRLTICIMTFGKIMDCAFVFVRDILLSISKYIVCHDLFLPLFLVLTLKVYYFQMYLALVLIGFLHGLVFLPVVLSLFGPPLRYTVIKEQLEDMPSASSEQPLIR

SEQ ID NO: 136244 - protein, 188 aa, Glycine max
  Coding DNA Sequence Number=SeqID_19466
MTEGCGEGFCLANLPGFSMCPVVGFGPWLGLGKPLVEILPPGQLRGFCPLLAWLGSAVLGYGPVLSFGLVGPLLPPVISFVARILPTLACAPLAKSVPRWWIIMQNEREPTNGSLFWPNIVEEERDTGLIGEGRIKATRAESQWIVAARPLCHLQYPVAYLSRLQRILPAARWELRFKASRRANPPHE

SEQ ID NO: 136245 - protein, 53 aa, Glycine max
  Coding DNA Sequence Number=SeqID_19467
MDGILISSVVSLADSRFTRPDMGFHPTKLNFVPSDADEAPLDVSICLHAFGIV

SEQ ID NO: 136246 - protein, 80 aa, Glycine max
  Coding DNA Sequence Number=SeqID_19468
MRKGPLKEGGTEAIDSVGTLRTCLKIYLWPSPTVVLSAHQALSEQPNAGAKRGVKHEGAETVTRAKPGYVPTARSNRSTG

SEQ ID NO: 136247 - protein, 47 aa, Glycine max
  Coding DNA Sequence Number=SeqID_19469
MVGYFMCLPHGLKDMCMISLGLWALNGYGCRVVDILIGKVNAKVMHE

SEQ ID NO: 136248 - protein, 34 aa, Glycine max
  Coding DNA Sequence Number=SeqID_19470
MKTKRVCHIASGCEKGASWEAPLTVANERILPYP

SEQ ID NO: 136249 - protein, 425 aa, Glycine max
  Coding DNA Sequence Number=SeqID_19471
  Gene Ontology: Mol. function=protein dimerization activity; Biological process=electron transport
  Homolog annotation: Hit_ID=Q1S735; Match level="QueryCoverage=88%, HitCoverage=83%, E-value=1e-77, Identity=49%"; Hit description =Probable transposase [imported]-Arabidopsis thaliana-related
  Pfam annotation: Domain name=DUF659; Domain location=163-298; Score =84.6; E_value=3.1e-22; Accession=PF04937.6; Description=Protein of unknown function (DUF 659)
  Pfam annotation: Domain name=zf-C2HC_plant; Domain location=1-29; Score=4.2; E_value=0.013; Accession=PF07567.3; Description=Protein of unknown function, DUF1544
  Pfam module annotation: Pfam domain module=DUF659::zf-C2HC_plant; Domain location=163-298::1-29
GGGINRFKAHLARKKGQVEACKKVLANVQHEMKQLLEQIEKSKKRKVQQEQSNESNTFEMDENPVRIIEELRGTPKPISSKSQKGKNTPYVDDYFMPRTIPEAQPSLKSVLHNKQIIEKCDKAIAKWMIDALVSFNAINLAYYQPMIDAISSMSPGYKATNFYRIRGPLLNMWVDEVRKLVESYKEVWKETRCTLMANGWTDRSRRTLINFLVYFPKGTIFLRSVDVSYASKIAEMLFKLFKEMVLYVGAENVVHIVTDNAANYVATDSILVQKDALRAMVTSRDWIGSTYAKDSKAKKFVEQILDSSYYKDREEMVRRFHRYKRKVEPYLEVLDRRWDSQLCKDLHVVGYWLNPACRFNAEEFEKYRNTQSSILEVIDSEAHSPLSEELSPLSALGNPRRGLVKRFRAQCATNSPSLEFVPSLA

SEQ ID NO: 136250 - protein, 159 aa, Glycine max
  Coding DNA Sequence Number=SeqID_19472
MINKHQIDCLTKILKPKPEFFGADVDASELQWCIKSCWRTTLTFYQTKYRGSESPKCTKLSCRVNIRGYLPNVDSTFLPLARAGLLQDFEGEANCHPQAVVPGLCATHDVAVIDQEGTSKVQEVSPLPDHIDLYSEVSTVARLSDDALLLLDAIEGVKI

SEQ ID NO: 136251 - protein, 124 aa, Glycine max
  Coding DNA Sequence Number=SeqID_19473
MENGKRWGSELGLGLTKSKGTVKKLQQNLDKHVAYMSSKTKENKALSGRVVDLEQQVKVIGKKMKDLTLEKKMTKEELGTARDEMAEMKEALAKMESELREKEKVESTLKAKLDEAKRLIGFNL

SEQ ID NO: 136252 - protein, 88 aa, Glycine max
  Coding DNA Sequence Number=SeqID_19474
MNTINDEANNKMIRVFVQELQEQHAADSKSLNVMRFLGEKIKNKKVEETSVSLSEAYALSEDHPLSEALSSLSGLRGSRRKYVIHARA

SEQ ID NO: 136253 - protein, 131 aa, Glycine max
  Coding DNA Sequence Number=SeqID_19475
  Gene Ontology: Mol. function=protein binding
  Homolog annotation: Hit_ID=Q949G7; Match level="QueryCoverage=50%, HitCoverage=7%, E-value=2e-12, Identity=56%"; Hit description=HcrVf3 protein
MDEFGELVLTARIFVCFCCKDLVCGTRARCKDLVCGTRARCKDLSVWGAYSCSQGLILSELGNHPPSFLSSMESLRNLDLSLSGFMGLIPHQLGKLSNLQHLNLGYNYALQIDNLNWISRLSSLEYLDLSG

SEQ ID NO: 136254 - protein, 294 aa, Glycine max
  Coding DNA Sequence Number=SeqID_19476
  Gene Ontology: Mol. function=receptor activity; Biological process =protein amino acid phosphorylation
  Homolog annotation: Hit_ID=Q6H663; Match level="QueryCoverage=82%, HitCoverage=81%, E-value=2e-57, Identity=44%"; Hit description =Receptor-like protein kinase-like
  Pfam annotation: Domain name=DUF26; Domain location=195-249; Score =55.1; E_value=2.3e-13; Accession=PF01657.8; Description=Domain of unknown function DUF26
  Pfam annotation: Domain name=DUF26; Domain location=95-149; Score =59.1; E_value=1.5e-14; Accession=PF01657.8; Description=Domain of unknown function DUF26
  Pfam module annotation: Pfam domain module=DUF26::DUF26; Domain location=195-249::95-149
MFITLQLVSTNRIILALKLSYLVFLFSSIPKAKGYTTRAHIFIYAGCSQEKYQPNTPFEANLNSFLSSVSGSSSDTSYNSFAIGNGSSSPPEGSIYGLYQCRADLRPNECSKCVKSCVDQIGLICPLAFGASLQLEGCYIRYEHVDFLGKPDTSLWYKRCSKAVANDAEFFRRRDDVLADLQVANGFGVSTSGFVEGFALCLGDLSMADCSSCLQEAVGKLRSICGSAASADVFLAQCYARYWEAGYYDEAESSKDDDQVGKSVAIIVGILAGLAILVVILSICKRAMGNHLIS

SEQ ID NO: 136255 - protein, 168 aa, Glycine max
  Coding DNA Sequence Number=SeqID_19477
  Subcellular localization annotation: CTP_CleavageSite=80; ConfidenceScore=5.06e-01
MTSFLQSPSSSFRQPLHAPQPPLNNDLHPEHPFFSDRKHKPRTSNLLATPPGFPQQIRKPLRFSNHSIQNLGRWWASRLRHEGVGGNKKFRSSGVKKSLNNLKPMSSSYIKAKSPPSPDQALFTTSIEASLGRQALSDNFSNTTKTRWLRQLVEGSVRCKSECGIERK

SEQ ID NO: 136256 - protein, 104 aa, Glycine max
  Coding DNA Sequence Number=SeqID_19478
MACFSGPPDNNHNKSSNNHMIFSHRTIINGLCYLATFVYGINSVGLFLYSGQLAIDTTGRGSSGKETESKITQQPGLSNASVDNNNNNNKLSSTKEDQSSNNSL

SEQ ID NO: 136257 - protein, 168 aa, Glycine max
  Coding DNA Sequence Number=SeqID_19479
MAQRQPTKARSGDRGHLEAEGERTSVRLAEDASRVKKDSVHELEALEKGPVLGHWKVFPTRAEHQRGIVHCEEGLLDKEKQRQKQKGVRVTTVLKVAVGTGARCADTCWLKVLFGKVRCVKEDTHEDTSEVFWGNTDWIWTDQRLSSLSMVLPTRNDPVMPVSIFNNE

SEQ ID NO: 136258 - protein, 282 aa, Glycine max
  Coding DNA Sequence Number=SeqID_19480
MDPGLLRLLNSGKLLYLTVARPGFSRKGHADIVGYVDVDWASSANHSFMEVLVRFAGFGPEEDEWINIRKHVRPRSLPCESSECVVVIPGDLILCFQEGKEQALYFDAHVLDAQRRRHDVRGCRCRFLVRYDHDQSEEIVPLRKICRRPETDYRLQQLHAVNEAAPMDQQKTGMDPAANVNAVRATTTETAANVNAVRATTTETVPKQLIAANIHMETVPVVQTNVPQPPQSMDMGVDQKKAETNTDVQAGNSIITPGSVLTNIITTSGVPKVSSQTQNMVE

SEQ ID NO: 136259 - protein, 122 aa, Glycine max
  Coding DNA Sequence Number=SeqID_19481
  Gene Ontology: Mol. function=transferase activity
  Homolog annotation: Hit_ID=Q1SYS4; Match level="QueryCoverage=60%, HitCoverage=39%, E-value=3e-11, Identity=42%"; Hit description =Polynucleotidyl transferase, Ribonuclease H fold
MAKIVEAIDHHLVVKLKINVLCCINVALNAPMGRFLSCRVVLIEVGRDSAGSVKASLLPLRKVLESLLNCDCCWLVLIVPYLTVSLLPEAPKNGGEFDTKILLLVTCKAIDTKIQPFGSCSI

SEQ ID NO: 136260 - protein, 147 aa, Glycine max
  Coding DNA Sequence Number=SeqID_19482
MEEGEDIQCMFSNFQAILNELRSLGRTFNNYDHIDKILRSLFRKGRLQDEGLKKWKSLALSIQKTKKVSSSKESSSKSTSRSSSRALSVENSFDEESEDKFDEDGEHAFISRKIQKMWKNKSGSKWKNISKVLGLDILMYKWTGSLC

SEQ ID NO: 136261 - protein, 324 aa, Glycine max
  Coding DNA Sequence Number=SeqID_19483
MSSAIKCYPDATTLATTYPPRLLISKANNIKVVVDKVCPRLPILDATKRKGFKLYFYEEIPTRQMKVDMVNYSKNWSSIFSGKKLVQALDAYDTKTFWNQIVWHDTLKSSSSGYDGSANDNHQDFIQVLHLAKTYHFDNACVYYTKDANNYSIINCLRNLLTIFHETTYDLSMMDEQDFLDHVTKLCDAQKEEEQCYGRNPKLMSLSTKQSTTSNEATSREKDAPNIVIVYSTSSSPTPFNYALPTVVTRDQVQEMIGQAIYAKCHYNAILQPWSRVTQKLATNPNVYVGCCFFFTPIVAAPTLVQDIIQQSPLVEPPPPPPPM

SEQ ID NO: 136262 - protein, 252 aa, Glycine max
  Coding DNA Sequence Number=SeqID_19484
  Homolog annotation: Hit_ID=Q1SKD7; Match level="QueryCoverage=86%, HitCoverage=56%, E-value=1e-15, Identity=25%"; Hit description =Ankyrin
MAPKKISAKRARKAATGEGSSAAPQVEIEFDGCHFRSKEHQCCFEVIKDWSFLKERRVQILDGESAEFHAKVSRRHWTQVIEPMAKYDPEVVMEFYANAWPTKEGVMDKHSGVRGQWIPYDIDAINQFLGHPLILEEGQRCKYTERRSQFSGFDEEAIDQLLCSPGHDFARSIVGRQVRIMHTSMTTLTQICMTLLLSNILPSDHNSDLTLPKCQLVYSIMTQISVHMAQLISDAIHQFVDITPPRYPVDPE

SEQ ID NO: 136263 - protein, 59 aa, Glycine max
  Coding DNA Sequence Number=SeqID_19485
MIQREWRKELAFPVTRNVVDSDSKCPFASSKVQGRVVIDYTNMVIDYQIATLLEITACN

SEQ ID NO: 136264 - protein, 239 aa, Glycine max
  Coding DNA Sequence Number=SeqID_19486
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=100%, HitCoverage=16%, E-value=6e-72, Identity=50%"; Hit description=Chromo
MADNTRMKELATDVKKNADDIKKLYDEVQIQFERFGAVTDARFQTMEDLQSSTDGKLDKINEALLMLLRNSSQTSSHGVTNSNKAPFQVRNVKLDFPRFDGKNVMEWIFRAEQFFDYYETPDKDRLTITSVHLDQDVVPWFQMIQRTHPFNSWAEFTRALELDFGPSIYDCPRATLFKLSQTGTVSDYYRQFTALANRVYGLSTDALVDCFISGLNPDIRRDVMVHTPINIVKAVSLAK

SEQ ID NO: 136265 - protein, 46 aa, Glycine max
  Coding DNA Sequence Number=SeqID_19487
MAWSTTWRVTSTTTLSGTLNPLGNAQKHQSTQGQQPIEGFRYFLSS

SEQ ID NO: 136266 - protein, 61 aa, Glycine max
  Coding DNA Sequence Number=SeqID_19488
MDGQTKMQRNEKLGPRFNGPYQAIQENGEIAYMLQLPATRRLQPIFHDIWLKKAVSGSYSA

SEQ ID NO: 136267 - protein, 293 aa, Glycine max
  Coding DNA Sequence Number=SeqID_19489
  Homolog annotation: Hit_ID=Q683B0; Match level="QueryCoverage=79%, HitCoverage=51%, E-value=4e-25, Identity=36%"; Hit description=MRNA, complete cds, clone: RAFL21-63-G01
MASIDMDIMADHKVSKYSMNPKNPLNLLKVLKHEENGTQISLTSHVELRQTLMSVSANCHLIERLFFESSKTGRDDSLKAQTCFELVNNCPHLTSLSLRGFKLHDCKVRVLVKGFRKLKYVDFSTSYSITGNFLRNLGSCNGGNLLEVLILRDCMHLKEMEVAKLLTAILAGDFKLLDISNREGLASEADWYHRCYNSSIMPIKQVLEARPDMCLVAEYPSAEGSYIETFDADMNSEISLPSQLSSHTSDGSIFMSTSESSYNSDQGSGNEDGQDANYVIYEESSDEIDFLSL

SEQ ID NO: 136268 - protein, 118 aa, Glycine max
  Coding DNA Sequence Number=SeqID_19490
MGIFGQSILHAKVLSLSLAVDRPLMKSMETSLHIWVRVGNGCRRLVRDWRYCSYNSEDILIIGDIVRIRRMTTALEVDVKTGARCAGSRRCLPKSGTKKRMHVRACQIFDVATITTVV

SEQ ID NO: 136269 - protein, 430 aa, Glycine max
  Coding DNA Sequence Number=SeqID_19491
  Gene Ontology: Mol. function=ion channel activity; Cellular component= spliceosome; Biological process=RNA splicing
  Homolog annotation: Hit_ID=Q6YTU8; Match level="QueryCoverage=75%, HitCoverage=75%, E-value=1e-132, Identity=73%"; Hit description =Putative potassium channel regulatory factor
  Pfam annotation: Domain name=PRP4; Domain location=92-121; Score =54.4; E_value=3.8e-13; Accession=PF08799.1; Description=pre-mRNA processing factor 4 (PRP4) l
  Pfam annotation: Domain name=Prp18; Domain location=212-356; Score =327.9; E_value=1.8e-95; Accession=PF02840.6; Description=Prp18 domain
  Pfam module annotation: Pfam domain module=PRP4::Prp18; Domain location=92-121::212-356
KRQSRAQDTGGKKFFKRSEIQQKEIQKLRQQEKRELEAKSLKRLATSSDTAATAPSSSSTASSSASSTIASASASLTDEQNIDNLVLPKPEVIRRLRFLKQPVTLFGEDDDARLDRLKYVLKAGVFEVDSDMTEGQTNDFLRDIAELRKRQKTGILGERKRQKADDGAAQDREGGAGDDDLSDCGSSEGAEADKDLKRMKANFEELCDEDKILVFFKKLLNEWKQELREMPEAEKRTAKGKSMVATFKQCARYLNPLFKFCRKKVLPDDIRQALLLMVECCMKRDYLAAMDHYIKLAIGNAPWPIGVTMVGIHERSAREKIYTNSVAHIMNDETTRKYLQSVKRLMTFCQRRYPTLPSKAVEFNSLANGSDLHSLLAEERFSGGNQASEERLRIMPAPRDIYEVSHVMVHVALRREAPALKRIGSICSGT

SEQ ID NO: 136270 - protein, 174 aa, Glycine max
  Coding DNA Sequence Number=SeqID_19492
MANKNVALLLLVCLVVAAGVEARRPYAVVRDECFGYCWHGCIFPSSYCNWWCDKVCKYPIDFGDDGLNHVDSVGHGGGHRYPVPTEEDYEHRPAALSPESPLSSRAGRVTLAQSMLAYILSFVMQNYLLPKGTCKAIDTSGKGAKYLPPGQACVGSHERIQQVMGSNLILKLPS

SEQ ID NO: 136271 - protein, 76 aa, Glycine max
  Coding DNA Sequence Number=SeqID_19493
MYAVRAHRERGMYLPIELESCLGSAPWMTIDPANHPPLLRHRLHDPRRVNGLHHHLSVALCISDCLRCLLLPPNSN

SEQ ID NO: 136272 - protein, 109 aa, Glycine max
  Coding DNA Sequence Number=SeqID_19494
  Gene Ontology: Mol. function=catalytic activity; Biological process =trehalose biosynthetic process
  Homolog annotation: Hit_ID=Q45RR4; Match level="QueryCoverage=70%, HitCoverage=59%, E-value=2e-25, Identity=72%"; Hit description =Trehalose-6-phosphate phosphatase
MSRCFPFPPPGYTNKGYEKEGYNRGRGITDKALAEKVRLVLNEYPQLRLTQGRKVLEICLTIKWDNGKALEFLLESLGYENSNDVFPIYIGDDRTDEDAFRVTNAATPS

SEQ ID NO: 136273 - protein, 37 aa, Glycine max
  Coding DNA Sequence Number=SeqID_19495
MVEIDGGKAKKIVAAKPANRRHLHKPSLADQVSRVRY

SEQ ID NO: 136274 - protein, 165 aa, Glycine max
  Coding DNA Sequence Number=SeqID_19496
  Gene Ontology: Mol. function=N-acetyltransferase activity; Biological process=metabolic process
  Homolog annotation: Hit_ID=Q94F75; Match level="QueryCoverage=41%, HitCoverage=39%, E-value=2e-27, Identity=81%"; Hit description =Silencing group B protein
  Pfam annotation: Domain name=Acetyltransf_1; Domain location=13-82; Score=27.2; E_value=5.8e-05; Accession=PF00583.14; Description =Acetyltransferase (GNAT) family
MTYLARWPGYFHVAEGPGNRIMGYIMGKVEGQGESWHGHVTAVTVAPEYRRQQLAKKLMNLLEDISDNIKPRCTLSLPHGAAVKLCLGDLLVMGSNPETASLHMQGFSATYHHMQACSHSICPDRLVKVVFCLPAVVPSHIGLPLCLFQNFYWPLLDLLWVTLLT

SEQ ID NO: 136275 - protein, 37 aa, Glycine max
  Coding DNA Sequence Number=SeqID_19497
MDHLPPVCFLITQQESVCRQGPYSVLAECLMRKIYVV

SEQ ID NO: 136276 - protein, 41 aa, Glycine max
  Coding DNA Sequence Number=SeqID_19498
MIIWEGACGEDGVWDKFREIGGELSMEEFNRRRYGGHWLCY

SEQ ID NO: 136277 - protein, 134 aa, Glycine max
  Coding DNA Sequence Number=SeqID_19499
MDYAALKHICKDPEMFDTLKTDGEFKHFKLGNDEKIKVEGIENICTFCRYQYDFYEGDDITRVQICWFKVGCKVYKGRYLVLRGQKNKGDLCYLDGQALKRNHDSKVKKKMKFSNVVEVLGDASVRGGVCLLSN

SEQ ID NO: 136278 - protein, 360 aa, Glycine max
  Coding DNA Sequence Number=SeqID_19500
  Gene Ontology: Mol. function=ATPase activity, coupled to transmembrane movement of substances; Cellular component=integral to membrane; Biological process=transport
  Homolog annotation: Hit_ID=Q2LD89; Match level="QueryCoverage=99%, HitCoverage=95%, E-value=5e-90, Identity=66%"; Hit description=SitC
  Pfam annotation: Domain name=ABC-3; Domain location=9-270; Score =239.9; E_value=5.5e-69; Accession=PF00950.8; Description=ABC 3 transport family
  Pfam annotation: Domain name=FecCD; Domain location=17-214; Score= -190.3; E_value=0.0093; Accession=PF01032.9; Description=FecCD transport family
  Pfam module annotation: Pfam domain module=ABC-3::FecCD; Domain location=9-270::17-214
MSVLLEPFGYEYMLNAMWVSAMVGGLCAFLSCYLMLKGWSLIGDALSHSIVPGVAGAYMLGLPFSLGAFLSGGLAAGSMLFLNQRSRLKEDAIIGLIFSSFFGLGLFMVSLNPTSVNIQTIVLGNILAIAPEDIVQLAIIGVVSMLVLLFKWKDLMVTFFDENHARAIGLRPERLKILFFTLLAVSTVAALQTVGAFLHYQLPWRMGELLSRRRDRRHYRGRPDAAVPAGVRLCAEARAARQPPPGASGARDPPMIALLLEPFQFAFMNNALLISLLVAVPCALLSVFLVLKGWALMGDAMSHAVFPGVVLAWMMGLPLALGAFVAGLFCAVATGYLKDNSRIKQILIWGSSFPACSVPG

SEQ ID NO: 136279 - protein, 251 aa, Glycine max
  Coding DNA Sequence Number=SeqID_19501
  Gene Ontology: Mol. function=metalloendopeptidase activity; Cellular component=extracellular region; Biological process=proteolysis
  Homolog annotation: Hit_ID=Q1XMP8; Match level="QueryCoverage=90%, HitCoverage=25%, E-value=1e-29, Identity=35%"; Hit description =Peptidase M4, thermolysin:Fibronectin, type III:Propeptide, peptidase M4 and M36 precursor
MEVANVCSGTPGTYTLPYYFTTPTVIYCPMKSGSSASEYISKVTVKPSGKPTMESSTDATTYSDFTADTSKFIQLIQGSTGNTYNEGIAVWIDFDRNGSFDINERILVSSPNTTTPITGTFSVPSDAFISTTDYKYVVMRVAMQRDGIPVNCTGFANGEVEDYTVRISKNPVPNATNQTEILIYPNPVHTILNVKNISKRANYKIYNAAGQLVTSGIILNNKIDVSSLIHGVYVIDIDDTQGTAQKKFIKE

SEQ ID NO: 136280 - protein, 268 aa, Glycine max
  Coding DNA Sequence Number=SeqID_19502
  Gene Ontology: Mol. function=hydrolase activity, acting on ester bonds; Biological process=biosynthetic process
  Homolog annotation: Hit_ID=Q8ZR37; Match level="QueryCoverage=99%, HitCoverage=26%, E-value=4e-81, Identity=76%"; Hit description =Enterobactin synthetase, component F
GRAATTDILRLKIVADSSAFSQLAQAAGQVQRTDLALALVALWLGRLTGRLDYAAGFIFMRRMGSVALTATGPVLNVLPLAVNIDPQESLPGLALRLASQLKKMRRHQRYDAEQILRDSGKAAGNEALFGPVLNVKVFDYQLELDGVEAITHTLATGPVNDLELALFPDEQGGLSIEILASKQRYDETTLKGHVARLNAMLVQFAANPDLRSGRQRGGGPPAFGIPDAGPARHCGSRRRVVTAGHRLPGRPPADDAGGRKAVPADYHR

SEQ ID NO: 136281 - protein, 108 aa, Glycine max
  Coding DNA Sequence Number=SeqID_19503
MDRERIVDSSMLQGEIPIVKILKENFDDSSQITFKLDSSDLFHKTLKMWSAILRGLVFTSFGEHRGGAAPECVIGGSLVRWREECVEVLKGGVQRRVFWEKEQKIGVY

SEQ ID NO: 136282 - protein, 120 aa, Glycine max
  Coding DNA Sequence Number=SeqID_19504
  Gene Ontology: Cellular component=clathrin vesicle coat; Biological process=intracellular protein transport
  Homolog annotation: Hit_ID=Q9SKU1; Match level="QueryCoverage=76%, HitCoverage=27%, E-value=7e-30, Identity=68%"; Hit description =Expressed protein
LFLASREKFHAEADKNYWKTIGELIPHEVPAIEKRGKKDKVKKPSIAVIQGPKPGKPTDLSRMRHILLKLKHNLPSHMKPKPPPSETKKDAKTGPLDGASTSSNPPKVVLVAIPEAVAAA

SEQ ID NO: 136283 - protein, 268 aa, Glycine max
  Coding DNA Sequence Number=SeqID_19505
  Gene Ontology: Mol. function=sodium:dicarboxylate symporter activity; Cellular component=membrane; Biological process=dicarboxylic acid transport
  Homolog annotation: Hit_ID=Q3QBH0; Match level="QueryCoverage=54%, HitCoverage=97%, E-value=4e-62, Identity=84%"; Hit description =Hypothetical protein precursor
IWRHRRHGDAVLYPEDVSLVAGAVDFAARVDEIQCNPQADNRAQTARRKGNSGITQPAKVIYQHAHGELAEYHRHRGDGGADALYGKHHNHDIGHAKHRAEELPFGYVQQRDRMLRLKEKYEQGGHQCADGKGQKRAFEYPHAAAELSVNRGLNAQRSAAANGEKNHNQCHTLPLCDQNQCRNDEPQCNNALRIYLSVRRAQQTVVVNDQAFKDLTGQNPNHGHCDADGGCRNGQDDHVHRAEHAAEQLPAGLGKKRGAVTRAKKQHQ

SEQ ID NO: 136284 - protein, 124 aa, Glycine max
  Coding DNA Sequence Number=SeqID_19506
  Gene Ontology: Mol. function=transcription factor activity; Biological process=regulation of transcription, DNA-dependent
  Homolog annotation: Hit_ID=Q1QB45; Match level="QueryCoverage=99%, HitCoverage=39%, E-value=6e-40, Identity=61%"; Hit description =Transcriptional regulator, LysR family
  Pfam annotation: Domain name=HTH_1; Domain location=9-68; Score=60.2; E_value=6.7e-15; Accession=PF00126.17; Description=Bacterial regulatory helix-turn-helix protein, lysR family
MFDASNINVRALLIFIEVYEAQNFSVVARRQGISASQISRVIHQLEDALGQQLFYRNTRAVIPTESGHLFIRYARAMVENVEEARRELDERSSEPSGTIRINGPVFFGQRHVAPGLAELTERYP

SEQ ID NO: 136285 - protein, 74 aa, Glycine max
  Coding DNA Sequence Number=SeqID_19507
MGCLKEYEDVKMEKTHVGGPYAERASPLTQFTVNADLCKRALQGTGQPTYPPLFETHQHSHAYPYTQPHPLTWV

SEQ ID NO: 136286 - protein, 50 aa, Glycine max
  Coding DNA Sequence Number=SeqID_19508
MAASECYSVGGWRKIKVVGLDYSLYVWRVDGLTLPVAWKNSHIHYNYKPH

SEQ ID NO: 136287 - protein, 87 aa, Glycine max
  Coding DNA Sequence Number=SeqID_19509
MANEKIKRGRGEIRFHPIFPHSLQNSPKAPQGPTGPPFLQQLQDFSAPLCHLLHSFHPTQAMALKKLYVKRARKAIAGEGSSAAPQA

SEQ ID NO: 136288 - protein, 172 aa, Glycine max
  Coding DNA Sequence Number=SeqID_19510
MADVEAVVVRLLLVLPRLLCLPWHTILLNERPVDGGLNELCRRDRYPIELAEACDQCFKFQCHIRLLWVHWVSQRCNTYKLVDDIRDKLCYMNNDLGSRRSKLWSLGRMLLSRSVIQIWFKVVMLVRMIYTRLSITFRAKSCLEEHSSWPMASSSKPDDGSLLVGLLWRLDL

SEQ ID NO: 136289 - protein, 76 aa, Glycine max
  Coding DNA Sequence Number=SeqID_19511
METIDAHFSSSYWRMYNYTGGCSTASWHKGGRRYSCGSACLATLYREMCRAIDPDAKTMGGVRHCCNLGHDGVAVD

SEQ ID NO: 136290 - protein, 43 aa, Glycine max
  Coding DNA Sequence Number=SeqID_19512
MTAIIDKCIMFQDITTLLLSIVAGIMFQDITTLLLDPKHLRTQ

SEQ ID NO: 136291 - protein, 63 aa, Glycine max
  Coding DNA Sequence Number=SeqID_19513
MAVLKVTTLCPCKGCNNRIHMPVLKNKGVNDMGIDRGKGMVIVKGTMDVAALAKKLSEKLRGR

SEQ ID NO: 136292 - protein, 392 aa, Glycine max
  Coding DNA Sequence Number=SeqID_19514
  Gene Ontology: Mol. function=carbohydrate binding; Biological process= carbohydrate metabolic process
  Homolog annotation: Hit_ID=Q1SPM1; Match level="QueryCoverage=99%, HitCoverage=72%, E-value=1e-121, Identity=60%"; Hit description =Glycoside hydrolase, starch-binding
  Pfam annotation: Domain name=CBM_20; Domain location=92-183; Score =24.8; E_value=4.2e-07; Accession=PF00686.10; Description=Starch binding domain
  Subcellular localization annotation: CTP_CleavageSite=26; ConfidenceScore=5.34e-01
MKALTSSCSKTVVDTLGPFSPRVCLRVSYRPEFCFTLRSKNEKKSCNSLLLKLVRNKGVVYPVHAVPPKNQVDLDTAEPQAQQSEQTNESKFVRVSFQLEKNCNFGEQFLIVGDDPVLGSWDPLEALPMTWFEGHVWAVELDMPAGKSFQFKFILKGKGGDIIWQPGLDRMIHTWETMNRIIVLEDWENAELQKIIEEDQLAEPNEEPQVDLEVPTLAETLENPQEELDSNASEISAVEDTQIHAEEKPLAEPVMQQNTDTISSSIEKPMAIVAENISSSEDLINSTSQKSNKKNIILQPKEESADSPGNDDIIHDLGHNGNAASLENQEKTIVESSLFDLEGGPVLVPGLIIEPTEPTDQAGQSEVQEMTNTDTSVGAFETQDQNIPEVNA

SEQ ID NO: 136293 - protein, 151 aa, Glycine max
  Coding DNA Sequence Number=SeqID_19515
MVLQSPTSSGKISFLLAGVKLPKDCEKNESKKKRSQIEVVKCNGDLKTKSQLAKEKKNMVVNPLVRDLPYPYAPTKKDKKRQYVRFLEIFKRLQDLSPKLQDLGSFTIPITIGDLKVGRALLDLGATINVMPHFYLANIGDPDVKPTRMTL

SEQ ID NO: 136294 - protein, 95 aa, Glycine max
  Coding DNA Sequence Number=SeqID_19516
MASYALSVRLPPYLLSTAIALSVKITFNVFESMNQPKDEESCSWVDVLDEVVVDTRKKLHISCPFEKVLIDALEALNDEDEKVIEECMPSLDVLK

SEQ ID NO: 136295 - protein, 66 aa, Glycine max
  Coding DNA Sequence Number=SeqID_19517
  Gene Ontology: Mol. function=catalytic activity; Biological process =carbohydrate metabolic process
  Homolog annotation: Hit_ID=Q941R1; Match level="QueryCoverage=92%, HitCoverage=15%, E-value=2e-15, Identity=62%"; Hit description =Transaldolase ToTAL2
MDLADLECYGVENPNARLSCFVNKAFADVGSDMAKLVLGCVSIEVDVRLAYDTHAIIRKVFDYMLH

SEQ ID NO: 136296 - protein, 98 aa, Glycine max
  Coding DNA Sequence Number=SeqID_19518
MFSSMNQIVFAEETNDPVSDHRIHYSSHTIEDDGIAVKDVSAVPGLEISINDSSQLMLSFHGQVQAMLLLLGGNELTLGSQCVELSPPSSSVIASREF

SEQ ID NO: 136297 - protein, 147 aa, Glycine max
  Coding DNA Sequence Number=SeqID_19519
  Gene Ontology: Cellular component=clathrin vesicle coat; Biological process=intracellular protein transport
  Homolog annotation: Hit_ID=O04209; Match level="QueryCoverage=59%, HitCoverage=34%, E-value=7e-22, Identity=57%"; Hit description =Expressed protein
  Subcellular localization annotation: CTP_CleavageSite=47; ConfidenceScore=5.57e-01
MAALWPATPSPTSTRSRTPPVTPPRLSVARRTMPVETSSPPPIYSVAAFSPEQNGKGVDGGFGASDGPILPPPTNMVAKEGFALREWRMQNAIQLEEKEKKEKEMRSQIIEEAEEYKIEFYRKREVNAEKNKASNREREKVEIHFFD

SEQ ID NO: 136298 - protein, 81 aa, Glycine max
  Coding DNA Sequence Number=SeqID_19520
MFTKNSSACFDLLVALSGYLGITSQNPKIMKDSNSAYDFSEINGFSTKPSILYHSGEVLVAASRLLPACYEVHIVEALALR

SEQ ID NO: 136299 - protein, 97 aa, Glycine max
  Coding DNA Sequence Number=SeqID_19521
MEAKAQKWWPRGENLQNPWVLHFLNEGGEFWVERNSPSPRFYVSRCKGARQGKLTPPPPFFLGKTQVASQLRFPLVRSWAWDDDPSIMGVASTPICP

SEQ ID NO: 136300 - protein, 176 aa, Glycine max
  Coding DNA Sequence Number=SeqID_19522
  Gene Ontology: Mol. function=metal ion binding; Cellular component =mitochondrial intermembrane space protein transporter complex; Biological process=protein import into mitochondrial inner membrane
  Homolog annotation: Hit_ID=Q9XGY5; Match level="QueryCoverage=58%, HitCoverage=92%, E-value=1e-11, Identity=46%"; Hit description =Mitochondrial import inner membrane translocase subunit Tim13
  Pfam annotation: Domain name=zf-Tim10_DDP; Domain location=21-108; Score=57.8; E_value=3.6e-14; Accession=PF02953.6; Description =Tim10DDP family zinc finger
MDSFSNPSSGSSHQLSAHDLKNQLKNQLAIEYAQQFLEEKGEDIGGWKEEIVMGIGISGMGTVGRKCFEKCVTKPGSSLGGSESSCISRCVDRYIEATGIISKAKDLGGVQGLQQSNPYHHVDTKWHVGQINWVKAITDGSVTQKGKQVACAGVFRDMHCSAPHGMAKWHSQVNSG

SEQ ID NO: 136301 - protein, 376 aa, Glycine max
  Coding DNA Sequence Number=SeqID_19523
  Homolog annotation: Hit_ID=Q1STP6; Match level="QueryCoverage=50%, HitCoverage=100%, E-value=4e-70, Identity=70%"; Hit description =Harpin-induced 1
  Pfam annotation: Domain name=Hin1; Domain location=215-354; Score =56.5; E_value=8.8e-14; Accession=PF07320.4; Description=Harpin -induced protein 1 (Hin1)
MFFFAESPNDILKPRRNIEPSLSLSLPLSSLSLWEEQSRRSNRKQNHRTHSEPPVLRSSGAKNRSATRTAPPRPKTAPLHMCPSRMGATLLRPAAIAAATAAIDNYVNTTYSDCSDFSDYSLALNLVLRFCQAKKQYHHSAFNGSSVEQPLKCNPTHPRSTVSLLNFRDCRLSFDNGSFEGTSRIKVGSGKGRKVCLTVTGVVIAIVLLIVILALTVFKAKHPVTIVDSTKLEDFHVSLDPVKLRVDLNVTLGVDVSVKNPNKVGFQYSDSAAHLNYRGQLIGEVPISAGEISSGETKGFNLTHTIMADRLLSNSQLLSDVTSGTLPLSTFVRMSGKVSILGFIKVHVVSSTSCDVAINLSNGTVGNQECQYKTKL

SEQ ID NO: 136302 - protein, 110 aa, Glycine max
  Coding DNA Sequence Number=SeqID_19524
MAELGQCEPGDAGQEGEDGNKQRFRYYEGVRQKSKDLSICSTIQQDLIEDGTMAFRYFCTTNISIQHHHHHAYAKNLVSFFNSRMQSPTPMRNNKNKCATENLFVDLTEK

SEQ ID NO: 136303 - protein, 63 aa, Glycine max
  Coding DNA Sequence Number=SeqID_19525
  Subcellular localization annotation: CTP_CleavageSite=22; ConfidenceScore=5.27e-01
MAVPSTSPRLASGNGGIVHVTSCNANGNGGSSFIASTISDFHAKQTPSVITFKRDPFSKSDGG

SEQ ID NO: 136304 - protein, 281 aa, Glycine max
  Coding DNA Sequence Number=SeqID_19526
  Gene Ontology: Mol. function=helicase activity; Biological process =protein amino acid phosphorylation
  Homolog annotation: Hit_ID=Q5VR06; Match level="QueryCoverage=64%, HitCoverage=13%, E-value=2e-38, Identity=42%"; Hit description =Helicase-like protein
  Pfam annotation: Domain name=DUF889; Domain location=1-201; Score =143.7; E_value=4.9e-40; Accession=PF05970.5; Description=Eukaryotic protein of unknown function (DUF889)
MRLLSSASGQPNNQELKQFSDWLLDIGDGKVGQDNDGFFEITIPNEFLITDYTDPIHAIVAATYPNLIHNYSNIDYLQNGVVLASKKDIIDKINDYVLSLIPNDEKEYCSADSIDKLDELLNSAFGLLTLEFMNSLQTSGIPNHKLKLKVGTPIMLIQNLDQADGLCNGTRLIITKLGSNVVESKRSSDCLATIRFTAPLHVQKGVCFAWKSLMVLAIKLDPPLPLALQDVTWTIPPFPLARRGDVDGLAFSSSEIRGASRDEAQPRVTDLQCLGLQLCSV

SEQ ID NO: 136305 - protein, 202 aa, Glycine max
  Coding DNA Sequence Number=SeqID_19527
  Homolog annotation: Hit_ID=Q9SVL6; Match level="QueryCoverage=99%, HitCoverage=98%, E-value=4e-75, Identity=66%"; Hit description =Putative cold acclimation protein
  Pfam annotation: Domain name=WCOR413; Domain location=9-192; Score =369.6; E_value=4.9e-108; Accession=PF05562.2; Description=Cold acclimation protein WCOR413
MGRILQEYVAMKTDAVVASLIDSDIQELKVAAKKLLHDATMLGGKGFGTSFFKWIASFAAIYLLILDSTNWRTNMLTALLVPYIFFSFPESLFHFLRGEVGKWIAFIAVVLRLFFPRHFPDWLEIPGSMILILTVAPDIFAHRLRNNWIGLAIDLFIGSYLLQQHIRATGGFKNSFTQKHGISNTLGILFLIVYPICAFIIH

SEQ ID NO: 136306 - protein, 188 aa, Glycine max
  Coding DNA Sequence Number=SeqID_19528
  Subcellular localization annotation: CTP_CleavageSite=25; ConfidenceScore=5.30e-01
MASISWGAPLESSPSSFPRPLPITLSKARANPLVLTMICKCLPQIPSLSYTISKECVPNNIYLVDMGNEYSFGVRNCFRTDYKLAIVKVALGQKGEKLEGAVAGVSLSLGHALSKYHPLSKASTRLARKRNLEGNLPCKYALSTSSAHPTSHLSLLALSALDSLSQSSLTRAKHENGAKRAFEDKKPF

SEQ ID NO: 136307 - protein, 115 aa, Glycine max
  Coding DNA Sequence Number=SeqID_19529
  Subcellular localization annotation: CTP_CleavageSite=58; ConfidenceScore=5.30e-01
MRHLRSVFILTILSTPPLPLNFVFPSPPPKTLSFSRIPPNLSQKNNDLGLIHRWIVVKFEHQRDKYSFHIDSGMKASIPSPLSNARKPYQNNQKKSLRNLRKTIRDAAITVRIHT

SEQ ID NO: 136308 - protein, 222 aa, Glycine max
  Coding DNA Sequence Number=SeqID_19530
  Gene Ontology: Mol. function=oxidoreductase activity; Cellular component=membrane; Biological process=response to oxidative stress
  Homolog annotation: Hit_ID=Q9ZP15; Match level="QueryCoverage=78%, HitCoverage=53%, E-value=1e-75, Identity=81%"; Hit description =Peroxidase precursor
  Pfam annotation: Domain name=peroxidase; Domain location=44-213; Score=202.6; E_value=9.5e-58; Accession=PF00141.13; Description =Peroxidase
MGRLNLLLVWSLSLTLFLNYLHPTSAQLSPNHYANICPNLESIVRQAVTNKFQQTFVTVPATLRLFFHDCFVQGCDASVLIASTGNNQAEKDHQDNLSLAGDGFDTVIKAKAAVDAVPQCRNKVSCADILALATRDVIALSGGPSYTVELGRFDGLVSRASDVNGRLPQPTNNLNQLNSLFAANGLTQTDMIALSGNPRATVYKWVPLAFVHAIRLVRVVDI

SEQ ID NO: 136309 - protein, 127 aa, Glycine max
  Coding DNA Sequence Number=SeqID_19531
MALGVTAARPGELLLQPEVTLLAHGSSARPENNQRVQGNSPRRAAAHPGDLWLNAKVTSSLEARSLAQGNQIPFEHVQTSKRTIRVTRPTSTTRAVTERRRHDDTVAESKRVAVTRWHSGGEEENMW

SEQ ID NO: 136310 - protein, 440 aa, Glycine max
  Coding DNA Sequence Number=SeqID_19532
  Gene Ontology: Cellular component=nucleus
  Homolog annotation: Hit_ID=Q9FN12; Match level="QueryCoverage=73%, HitCoverage=93%, E-value=2e-46, Identity=38%"; Hit description =Arabidopsis thaliana genomic DNA, chromosome 5, TAC clone:K8K14
MVSIEVSSRETEGVGSEVRGFDEEVLEEVGFPNPSVEVVTQKHRHVLTKKKMVRSDATPPLEFVFMNKELENKVFLYVRMHVPRSASVISWGSIMPAVRYFSPEETIEQKLQIERRLGSVKTCKYFNLLERFLSFKISKREFDRICIATIGRENVPLHNHFLKSILRKACLSKTAGPRESKLESSWNVKTPNGCSNLQMLCKDFPQSPRKGRTPNLRDRKSRDRPCPFGPHGKNNSIGFEDSIPKIHEQQSIVNLQSAGSRLALSVEDGEEIDQDYEILNLFKKSPIQAPLAIPTYNRRPPQKHLSQGLSSGTVSDTCQSIAQLPDTCSLMKRLEQKLEIEGLKISTDAASLLNNALDVYLKRLIKPCLDLAASKLVNKFSGPIQPGLNELPMRRCVQKSIGSPSVSISDFRTAVELNPTILGEDWSLNLEKVCLHALED

SEQ ID NO: 136311 - protein, 239 aa, Glycine max
  Coding DNA Sequence Number=SeqID_19533
  Gene Ontology: Mol. function=oxidoreductase activity; Cellular component=vacuole; Biological process=response to oxidative stress
  Homolog annotation: Hit_ID=Q9ZP15; Match level="QueryCoverage=52%, HitCoverage=39%, E-value=9e-58, Identity=83%"; Hit description =Peroxidase precursor
MNLTTLCKSPRTKIATCVVVYLQNMHCLRLYMINQSLNLKHRTIGTNFPISCSLNSNATQFGHSSHKVGVENVGTGSKGINGVPRPWVREEDLVRGEEALSLLKVLVINIVEFTRSCWVHVDGNPRIHVSWAHLLQLGYVLLVQCWVHWGAVYSTGELAAVGESKDLNTRVRFLAAALAVQLASKLTCVKLGFLCCLIEWLLMHKWLCFIIFNTRIFYYPLHPKMIEGHDWLLNKERKI

SEQ ID NO: 136312 - protein, 265 aa, Glycine max
  Coding DNA Sequence Number=SeqID_19534
  Homolog annotation: Hit_ID=P0AA63; Match level="QueryCoverage=42%, HitCoverage=70%, E-value=3e-43, Identity=60%"; Hit description=Inner membrane protein yqjA
GDGLPGNATAFDGGGQPRLLGELHPGTLAGQYADRAKLAIAFTVALSPASPSPVPQARVISAANWPLYRLRTYPTANDCRSADVVPDAAAGCAAGLRSDRLPGCTVEEKTQQSELSMVIKRPSWRQLRWMLGGSLLLCASVWLWLTVSQHESTLAIRPVSQGVAMPDGFSVWHHLDANGIRFKSITPQKDGLLIKFDSNAQGAAAKEVLGRALPHGYIIALVDEENSATAWLSRLRDAPRHCGNRLARIVDWIGYITDIPSHNGR

SEQ ID NO: 136313 - protein, 290 aa, Glycine max
  Coding DNA Sequence Number=SeqID_19535
  Gene Ontology: Mol. function=RNA-directed DNA polymerase activity; Cellular component=chromatin; Biological process=chromatin assembly or disassembly
  Subcellular localization annotation: CTP_CleavageSite=57; ConfidenceScore=5.14e-01
MEEAIAKLASNQLHVTSKLDDLIQRITMLESNQHHSPAPSSSSANPQTPSRSSSFPRMKLEVPRFDGSDPSGWTFKINQFFDCHSTPEPERLVVSSFAMEGLALAWFQWLIRSGQVSSWIGLLHALEARFAPSQYEDPTGSLCKLTQQGSVSAYLSQFEMLANRIIGLLAPFLLSCFMSGLAPEIRREVQALHPLTLVQAMGLARLQEEKLADQHRGAYDGPCTCNPNPISTLLLPLPPTSPLLPSRAKPPPPHVRRLSSEEITMRREKGLCFKCDEKFTRGHKCSSRRP

SEQ ID NO: 136314 - protein, 197 aa, Glycine max
  Coding DNA Sequence Number=SeqID_19536
  Gene Ontology: Mol. function=chromatin binding; Cellular component =chromatin; Biological process=chromatin assembly or disassembly
  Homolog annotation: Hit_ID=Q1SAV4; Match level="QueryCoverage=65%, HitCoverage=36%, E-value=2e-35, Identity=52%"; Hit description =Integrase, catalytic region
  Pfam annotation: Domain name=rve; Domain location=40-191; Score=21.5; E_value=9.5e-05; Accession=PF00665.16; Description=Integrase core domain
MGLTKTLSRIGQNFIWPGMKKDAQDFVLVCLQCQQTKYDHQKSPGLLYFIGGLPASRGYTVILVMVDRFSKGVHLGVLRPNYITSTVSILFMEIVGKLHGMPRSLVSDCDPLFVSRFWQELFKLSGTKLRMSSAYHPQSDKQTEVMNMDVLKQPIQSTDQNQEISDKEASAMHSRSKRQITRPHYLKDFITNSNKGC

SEQ ID NO: 136315 - protein, 134 aa, Glycine max
  Coding DNA Sequence Number=SeqID_19537
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=94%, HitCoverage=8%, E-value=1e-33, Identity=55%"; Hit description=Chromo
MIVDNSHADAGNVRLNDEWLREVRQAQNWGCANCFLEFVKSKLGLHRPLKLVFDQEASQRRYNRGITFNEATIETRETQESVQGSCRPRNSPRLNRFYLGGNKFNTSSRNYMAQVFNLLLDEGTLREFEEEASF

SEQ ID NO: 136316 - protein, 120 aa, Glycine max
  Coding DNA Sequence Number=SeqID_19538
MRGQDIYSSQDKATTLPSSSECEEAKGAESSEEIYPQEEGLPLVVKEKCKEALSEIQLAKRTVFTFRLSDFFGCGETEKELSLTRKPSCGAFDEILRGCEEASLLWRAKSSVGSSYGVLD

SEQ ID NO: 136317 - protein, 107 aa, Glycine max
  Coding DNA Sequence Number=SeqID_19539
MAGTKIGAITIRLSTVKEERGKYHVHYYIFGLALKNISTTPLAKTAIAKLTAIEMSKQCLESTATSLTFIKLLPWVVYENIVFDFSGPSLKIGNPLIVEEDEWDAKG

SEQ ID NO: 136318 - protein, 655 aa, Glycine max
  Coding DNA Sequence Number=SeqID_19540
  Gene Ontology: Mol. function=signal transducer activity; Cellular component=membrane; Biological process=response to light stimulus
  Homolog annotation: Hit_ID=Q9FJY3; Match level="QueryCoverage=97%, HitCoverage=99%, E-value=0.0, Identity=57%"; Hit description =Photoreceptor-interacting protein-like
  Pfam annotation: Domain name=BTB; Domain location=17-146; Score= -10.9; E_value=0.04; Accession=PF00651.21; Description=BTBPOZ domain
  Pfam annotation: Domain name=NPH3; Domain location=224-484; Score =372.1; E_value=8.4e-109; Accession=PF03000.5; Description=NPH3 family
  Pfam module annotation: Pfam domain module=BTB::NPH3; Domain location= 17-146::224-484
MSSAEKPSSKGQAWFCTTGLPSDIVVEVDDMTFHLHKFPLMSKSRKLHLLITQQEAATHSSAAQQQQENEDEDEIVEEQCHVTFTGFPGGSEAFEMAAKFCYGVKIDLTPSNVAALRCAGEFLEMTEDYSEDNLVSKTERFLSQHVLKSLKDSVKTLKSCDSLMPMAENLGITQRCVDSVVSRTSSSDPALFGWPVSDASSASKQVIWNGLDGAGRRKASAGAGESWFEDLALLRLPLFKRLILAMRTAELSPEIIETCVMYYAKKYIPGVSRSNRKPLPSSSSSSSVATEAEQKEILETLVSNLPLEKSSKAATATRFLFGLLRTTNILNASEACRDALEKKIGLQLEEATLDDLLVPSYSYLNETLYDVDCVERILSQFLEGLEARTAAETTEDAAATRSPALMLVGKLIDGYLSEIASDANLKPEKFYNFAISLPDEARLFDDGLYRAVDVYLKAHPWVSEEEREKICGLLDCQKLTLEACTHAAQNERLPLRAVVQVLFFEQLQLRHAIAGTLMAAEAAAEPGRQSAALEREAEGGGREGLGLDLEHVQERNGTWRVAVRENQVLRLDMDSMRTRVHQLERECSSMKRVIAKFDKSDGGAAGGWRASLGRKFGCKFKTQVCDSHESTAVDTRKGRHHQQQQPQQQQHPHHV

SEQ ID NO: 136319 - protein, 92 aa, Glycine max
  Coding DNA Sequence Number=SeqID_19541
MDPSSSTSSHHSDSDWPIAIRKELDLLAMIDEMHTIKNNDGSILLRSGPMVRFIAKTNVTSTITVTMITIGIFVVVTLANITTIIIITQKHS

SEQ ID NO: 136320 - protein, 405 aa, Glycine max
  Coding DNA Sequence Number=SeqID_19542
  Gene Ontology: Mol. function=methionine-tRNA ligase activity; Cellular component=cytosol; Biological process=methionyl-tRNA aminoacylation
  Homolog annotation: Hit_ID=Q1SE68; Match level="QueryCoverage=97%, HitCoverage=49%, E-value=0.0, Identity=84%"; Hit description =Aminoacyl-tRNA synthetase, class Ia; Nucleic acid-binding, OB-fold, subgroup
  Pfam annotation: Domain name=tRNA-synt_1g; Domain location=1-191; Score=64.8; E_value=6.2e-22; Accession=PF09334.1; Description=tRNA synthetases class I (M)
MSVFGGWSQNAIQTTNSWLREGLRSRCITRDLKWGVSVPHEKYSDKVFYVWFDAPIGYVSITSCYTRDWEKWWKNPENVELYQFMGKDNVPFHTVMFPSTLLATGENWTLMKTISVTEYLNYEAGKFSKSKGIGVFGNDVKDTSIPVEVWRYYLLTNRPEVSDTLFTWPDLQAKLNCELLNNLGNFIHRVLSFIAKPAGRGYDSVIPSIPDDVSGESHIQTKIFADKVVAYIDQYIEAMEKVKLKQGLKTAMSISSEGNAYLQEAEFWRLYKENRPLCSLVMKTAVGIVYLLACLLEPFIPSFTREVFKQLNLPAVTHVSLCQDKGDIDRVKRPWDIISAGHKIGTPEPLFRELKDEEVEFYRKKFAGSQADRTVRAEAEAENVAGQLKKTKLSIIGKEEISLNP

SEQ ID NO: 136321 - protein, 104 aa, Glycine max
  Coding DNA Sequence Number=SeqID_19543
  Gene Ontology: Mol. function=methionine-tRNA ligase activity; Cellular component=soluble fraction; Biological process=methionyl -tRNA aminoacylation
  Homolog annotation: Hit_ID=Q1SE68; Match level="QueryCoverage=99%, HitCoverage=12%, E-value=3e-47, Identity=87%"; Hit description =Aminoacyl-tRNA synthetase, class Ia; Nucleic acid-binding, OB-fold, subgroup
  Pfam annotation: Domain name=tRNA-synt_1g; Domain location=18-104; Score=-283.2; E_value=0.011; Accession=PF09334.1; Description=tRNA synthetases class I (M)
MAENVKGSKLPMEGKRNILITSALPYVNNVPHLGNIIGCVLSADVFARYCRLRGYNAIYICGTDEYGTATETKAMEENCSPKEICDKYIPCYSQGGLQLVQYKF

SEQ ID NO: 136322 - protein, 120 aa, Glycine max
  Coding DNA Sequence Number=SeqID_19544
  Gene Ontology: Mol. function=ribonuclease H activity; Biological process=RNA-dependent DNA replication
  Homolog annotation: Hit_ID=Q2HRG4; Match level="QueryCoverage=71%, HitCoverage=6%, E-value=9e-17, Identity=47%"; Hit description =Ribonuclease H
MQIYIVNQITSQCQFIQTYFKGSSSTRDPHNIIWSAPISPFVKLNIDGSSLGNPGSLGFGGIVRDSRGFWFSGFYGHFDHTTNIHVELLAILNGMRHAWNNGFRHIIIETDSLVAIHLIE

SEQ ID NO: 136323 - protein, 261 aa, Glycine max
  Coding DNA Sequence Number=SeqID_19545
  Gene Ontology: Mol. function=Ran GTPase binding; Cellular component =microtubule associated complex; Biological process=protein complex assembly
  Homolog annotation: Hit_ID=Q6ZI83; Match level="QueryCoverage=95%, HitCoverage=70%, E-value=3e-50, Identity=37%"; Hit description =RanBPM-like
  Pfam annotation: Domain name=SPRY; Domain location=4-95; Score=3.4; E_ value=0.015; Accession=PF00622.18; Description=SPRY domain
MADEIKIKTWWEDLIAGHESSHGVLYSGDEDTGSTFLSGDVIGAGINYSTNEFFFCKNGELVHSVPNNLSNRGLYPTIAVLSQHEEMHVNFGQKPFAFNLKDFEARERRKQQQKIEEISLSPQVTYSLIRSYLLHSGYEDTFNSFDVVPSSPITDEQTNTLNHRSTLRQLIMNGNVDGAFAKVHEWYPQIVEDCIALRAYEMPLEVLANAVNAFVLSTDPHMEEAKDCLHSPLERLLKQLTACKRYEGEDFLVEKEFSKRD

SEQ ID NO: 136324 - protein, 133 aa, Glycine max
  Coding DNA Sequence Number=SeqID_19546
CAFGAATACAWMRSIISGKSALKDLKDTDIVSDIVDPAHSVKDITDLCVQYIRAGCQDIVSDIVRAVMQVGSATFIIRVIKHSGICSGNSKILQVASRFQDVKTSHVTSAFCSPCLHAPTAVKQFTAASSISY

SEQ ID NO: 136325 - protein, 223 aa, Glycine max
  Coding DNA Sequence Number=SeqID_19547
  Homolog annotation: Hit_ID=Q6YXT2; Match level="QueryCoverage=73%, HitCoverage=27%, E-value=2e-14, Identity=35%"; Hit description =Calmodulin-binding protein family-like
MSAKYLEVVKRGSHPNKGWSLDEIRIVCSTPIVVQSRMILFGSQLKIQNHPPLPHATISPKSAFGCANSTFETSKSLRVFYASEMELSEDYTWSFLCFWLINICGSGFHSKSRRGSNIVDDWDEKHHIVKELKAMLMQRKEVSTIKRDKTLSQAFSQQVLILFKFGGMVGHHQLEMKMSWKRDQNGYIGGWPQSHRRIEEGLQLIKETPLRLWKLTHLSLIHI

SEQ ID NO: 136326 - protein, 72 aa, Glycine max
  Coding DNA Sequence Number=SeqID_19548
MKNKKVKAAGVSLSEAYALSEFRKKAIKEYVRDATEEKQGKKAPKISAFKKILCFRVISRFLEAKALVGKFC

SEQ ID NO: 136327 - protein, 52 aa, Glycine max
  Coding DNA Sequence Number=SeqID_19549
MPLPSASSQITAQGRKCARSMSHRFFTVTDEASWVGPFIGDECVDGEGGWIK

SEQ ID NO: 136328 - protein, 396 aa, Glycine max
  Coding DNA Sequence Number=SeqID_19550
MRLNCLGQFLLCKLFITLHHLHSRTPCTVLTFLPLLILLPLPHYLAIQEPYDTTIFISEAAWEMHSQNVHSRNILPERNVTLYVTEYDEFRRELERRGWHKALTRQMDGHIDIALVKEFYANLYDPEEKSPRQVRVWGKLINFDATSLNAFLEMPSVLQLGEQGALEAPEEGVDYSGADLECPAYSNLAPTFHTPDLNMDRARPDLTDGPVKLLSARLPSPHHRLVCGQRSHIRLPHLRVSQPWTYKARARGFEGPSSSAPPAPASTSTPFAPAPSAAPASVPTPASTSAQSSDLTSVHNLAQHRPIISMEEFTSQVAWLGVQPSPLGEGEASTTHEPQPQLEVTPEVTLEATPRTSPVTTPLVEVADEEDGATDTDYATDMAAAQSTWDPWPTTA

SEQ ID NO: 136329 - protein, 115 aa, Glycine max
  Coding DNA Sequence Number=SeqID_19551
MTILKIKEKKSVSSRRRGKRRQSFEMTLMILKFLEVKRRYSNEKMRKIITIAIMIHELPFSIVEDEVWLLSFRYANSDFQKVKFYISNAINYIELQDCLFNLCRKRSTLYLCSFN

SEQ ID NO: 136330 - protein, 67 aa, Glycine max
  Coding DNA Sequence Number=SeqID_19552
MIFTSFYFVTTQAQTSSGKQNASLSINVVPAPVEPHHVDLAEDVREEVLKRSFADSPRFVEESILPC

SEQ ID NO: 136331 - protein, 45 aa, Glycine max
  Coding DNA Sequence Number=SeqID_19553
MNPLANHGGGAVNAVESGRPRRQSVKFRDMSGVERKRQCAIRKVL

SEQ ID NO: 136332 - protein, 326 aa, Glycine max
  Coding DNA Sequence Number=SeqID_19554
  Gene Ontology: Mol. function=tryptophan-tRNA ligase activity; Cellular component=soluble fraction; Biological process=tRNA aminoacylation for protein translation
  Homolog annotation: Hit_ID=Q5JKV2; Match level="QueryCoverage=69%, HitCoverage=56%, E-value=1e-92, Identity=72%"; Hit description =Putative tryptophanyl-tRNA synthetase
  Pfam annotation: Domain name=tRNA-synt_1b; Domain location=51-323; Score=203.5; E_value=5e-58; Accession=PF00579.15; Description=tRNA synthetases class I (W and Y)
  Subcellular localization annotation: CTP_CleavageSite=23; ConfidenceScore=5.64e-01
MSVSHFAVLSSCCCPRLAPSLSRASTLRSRIRCCTTLTATSSETPTPTFVKKRVVSGVQPTGSIHLGNYFGAIKNWVALQNVYDTLFFIVDLHAVRDVQAMKHGHWKSHGHRQYNTVPITLPYDTQQLSKATRSTAAIYLACGVDPSKASVFVQSHVRAHVELMWLLSSTTPIGWLNKMIQFKEKSRKAGDEEVGVALLTYPVLMASDILLYQSDFVPVGEDQKQHLELTRDLAERVPEPLIPPAGARIMSLTDGLSKMSKSAPSDQSRINILDPKDLKETLEVNQYSDLRCKGLRQYAGYDDWWGCAWLSGDVVLTIQICLFLVS

SEQ ID NO: 136333 - protein, 289 aa, Glycine max
  Coding DNA Sequence Number=SeqID_19555
  Gene Ontology: Mol. function=ATP-dependent peptidase activity; Cellular component=integral to membrane; Biological process=ATP -dependent proteolysis
  Homolog annotation: Hit_ID=Q5JKW4; Match level="QueryCoverage=71%, HitCoverage=80%, E-value=2e-28, Identity=40%"; Hit description=ATP -dependent protease La (LON) domain-containing protein-like
MERERLQIQVIRQLDLEDLEVEEVDHSDEDDTDDEPDEEYALFPSQYNSDTSPPPPSSAEFNFDTYIAPSHTYLGDVEDTRHRIAFLDGGAILNLPLFCLRGVVLFPGATLPLRVIEPRLVAAVERALTQDDIPYTIGVVDMWKRMVGMPDMDSLIKKPDVLSFHIASKIPVSESTRQEFLDIDSIAYRLRREIELLESIDLIRCKSCETIIAKRSDMLIMSSEGPLSAYVNSGGYVHEIMTLYKANGLALTGSAVADHSWFPGDILHLLSRFWEKKGGESAVSLCFSS

SEQ ID NO: 136334 - protein, 106 aa, Glycine max
  Coding DNA Sequence Number=SeqID_19556
  Gene Ontology: Mol. function=protein binding; Biological process=two -component signal transduction system (phosphorelay)
  Homolog annotation: Hit_ID=Q9LU15; Match level="QueryCoverage=85%, HitCoverage=72%, E-value=3e-26, Identity=61%"; Hit description =Histidine-containing phosphotransfer protein 4
MITKFLALPKSRHEKGFLDEQFIQLEELQDDVNPNFAEEIVTLFYSDSVRLIYNIERALMSNPPNFTKLDGYMLQFKGSCSSIGAKKVKNECTRFSEYCAAENFEG

SEQ ID NO: 136335 - protein, 553 aa, Glycine max
  Coding DNA Sequence Number=SeqID_19557
  Gene Ontology: Mol. function=signal transducer activity; Cellular component=membrane; Biological process=response to light stimulus
  Homolog annotation: Hit_ID=Q1SC08; Match level="QueryCoverage=99%, HitCoverage=80%, E-value=0.0, Identity=65%"; Hit description =BTB/POZ; NPH3
  Pfam annotation: Domain name=NPH3; Domain location=88-402; Score =344.4; E_value=1.9e-100; Accession=PF03000.5; Description=NPH3 family
MTEDYSVGNLVGRADSYLNEVALKTISGAVSILHMSERFLPIAEKAKLVSRCIDAIAFIASKETQFCSPMRGDIIGTDGMASHQRPVVHWWAEDLTVLRIDIFQRVLIAMMARGFKQFALGPIIMLYAQKSLRGLEIFGKGRKKIEVEAQEEHEKRVVLETLVSLLPREKNAMSVSFLSMLLRAAIYLETTVACRLDLEKRMALQLGQAVLDDLLIPSYSFTGDTLFDVDTVQRIMMNFLQSEKEDRSPYNADDECFSPPQSDVYRVGKLMENYLAEIATDRNLAVSKFITVAELIPEQSRPTEDGMYRAIDIYLKELQPRFSILQNNVRFLSSTMHIHSGFTTFELALDFDFISVDLPGLSNLTQVKTGLNNPKAHPVLSDMEKKKVCSVMDCQKLSREACAHAAQNDRLPVQMVVQVLYYEQQRLRDSMDGNAGWDSPNFRDKVNSSPNELNLVSNELSILRRENEDLKLEIVKLKMKLKEIERTSIRSASSSPVIFASPSADKPPLPRKSFINSVSKKLGRLSPFSRGNAATTLLKGHVKPDKNRRHSIS

SEQ ID NO: 136336 - protein, 208 aa, Glycine max
  Coding DNA Sequence Number=SeqID_19558
  Homolog annotation: Hit_ID=Q10IX1; Match level="QueryCoverage=98%, HitCoverage=98%, E-value=2e-12, Identity=31%"; Hit description =Expressed protein
MEKLVRSCDKEYMRMAMLKHEETFKEQVYELHRLYQIQKILMQNMDARRGIEVTKEEWYFKNAIGLTCKGAQEKPQMKIDLERPAEEHIAESEDGVLEVIDETEIELTLAPSSYNRRKKVETPLTSDSGHSLSSSSSGSSHVNKTRCHGTHTTRENSSGSIIRLVEVPGSTPAYQSGIRNSFDIEEQLRQERLKQSPWLFQVLNLNMT

SEQ ID NO: 136337 - protein, 320 aa, Glycine max
  Coding DNA Sequence Number=SeqID_19559
  Gene Ontology: Mol. function=DNA binding; Cellular component=nucleus; Biological process=regulation of transcription, DNA-dependent
  Homolog annotation: Hit_ID=Q9SNV3; Match level="QueryCoverage=90%, HitCoverage=97%, E-value=1e-25, Identity=30%"; Hit description =Squamosa promoter binding protein-homologue 5
  Pfam annotation: Domain name=SBP; Domain location=81-152; Score=37.3; E_value=5.3e-08; Accession=PF03110.5; Description=SBP domain
  Subcellular localization annotation: CTP_CleavageSite=45; ConfidenceScore=5.62e-01
AAAGAMSSGSVTKAPPPSSSSSPNSSSESLDGLKFGQKIYFEDVSVAATTTTQGAYKTSRVVSSPSSASKKGRGGSLQPPRCQVEGCKVDLSGAKAYYSRHKVCTMHSKFPTVIVADNSGRAGGFLMEFASYPKVTLRNTLPTQRSAEPALGNHAATLTWQGSSDTPSEFFLQESGSGGTSFLGSKHPLLESYTGVTDSNCALSLLSRQTWGSRNTAPATSVELNNNLLNFNGTSMTQFSAASSQTAAIHQLPNATSWLYLKGVGSGDCSPEGVPDLGLGQISPPLDSHLHGELNVSQQGRRHYMDLGESRACESSHWSL

SEQ ID NO: 136338 - protein, 67 aa, Glycine max
  Coding DNA Sequence Number=SeqID_19560
MDHLRVNEWRNIPNFLLLCGSHTMTLHAVTLHSTSLLVRILHCVRPCGLNNLKRDRLRMQKKQQQSI

SEQ ID NO: 136339 - protein, 51 aa, Glycine max
  Coding DNA Sequence Number=SeqID_19561
MKRASEWAYSHEILSDVTVQVGEVSFSLHKDHSMESNDFYFLAIVKQLLLA

SEQ ID NO: 136340 - protein, 68 aa, Glycine max
  Coding DNA Sequence Number=SeqID_19562
MTYDRLAPEEPVLTGWIAGLFILTDTVVLSLICAILFNLIITTKKYQNDNDKDKHSTTTSAVHQSRIQ

SEQ ID NO: 136341 - protein, 289 aa, Glycine max
  Coding DNA Sequence Number=SeqID_19563
  Gene Ontology: Mol. function=RNA-directed DNA polymerase activity; Biological process=RNA-dependent DNA replication
MVSTRFGIRSETPLADSHPHPATMIDAHTLQQLQNRNAEMEQCHEEELTKLEAHVRCPRGDEQSAHTLAKCTQGESHPRHTGNTADDLSPSYMHHQATWTVRWHPFINHIMEVDIPLGWKPLNLERYDGTIDPYEHLDAFLTQANLYTNDDAILCCVFLSSLKGATLTWYGGLPPRSIGSFDTLVELFNAQYATSRSHRMTSSTLANLRQANNESLQKFMDRFRCTTLQIQNLNLEVALHSMLLALPGKFVHNLCRKPPGSMGELFERAKSYIQMEQMSQFLSEVRQTE

SEQ ID NO: 136342 - protein, 76 aa, Glycine max
  Coding DNA Sequence Number=SeqID_19564
MPQKQHVEANSPGGSKYIDGIIENSGQATKESAFQIEMKEDEKQSKKFAPKGNDKAPLGAWNWSVIIVGISISTFP

SEQ ID NO: 136343 - protein, 388 aa, Glycine max
  Coding DNA Sequence Number=SeqID_19565
  Gene Ontology: Mol. function=ribonuclease III activity; Biological process=RNA processing
  Homolog annotation: Hit_ID=Q1SEC6; Match level="QueryCoverage=87%, HitCoverage=91%, E-value=1e-121, Identity=51%"; Hit description =Ribonuclease III
  Pfam annotation: Domain name=Ribonuclease_3; Domain location=192-282; Score=48.9; E_value=1.7e-11; Accession=PF00636.16; Description=RNase3 domain
  Subcellular localization annotation: CTP_CleavageSite=49; ConfidenceScore=5.73e-01
MVSNPKSHFHSNVHTSPMELSSSFTHSHNLFSFSSSLTPTLRRQTLRVSAVTIDPPQELPKNSPQRLLKELAERKRPSPRTPRAPPRRFILTRPLDDKRVADRFLNSPQLALNTFPLLSSCLPFSPLDHLDKSWMENHLMEAKQALGYPLEPSLTLGDDSGPAMELDTLLYLAFQHESCERSRARHVRFGHSRLFFLGQYVLELALAEYFLQRYPRESPAPMRERVFELIGKRSLPRWIKGAALHNLVFPYDDMDKLVRKEREATVKSVFWALFGAIYLCFGMPEVYRVLFEVFGMDPDAEDCQPKLRRQLEDIDHPPADALFAHPRLFRACVPPGMHRFRGNLWDYDCRPQIMRVLGYPLKMTDRIPEITKARNIELDLGLQAITLT

SEQ ID NO: 136344 - protein, 164 aa, Glycine max
  Coding DNA Sequence Number=SeqID_19566
  Gene Ontology: Mol. function=ribonuclease III activity; Biological process=RNA processing
  Homolog annotation: Hit_ID=Q1SEC6; Match level="QueryCoverage=84%, HitCoverage=26%, E-value=3e-61, Identity=77%"; Hit description =Ribonuclease III
  Pfam annotation: Domain name=Ribonuclease_3; Domain location=49-142; Score=-12.5; E_value=0.061; Accession=PF00636.16; Description=RNase3 domain
MKSVDQLGCSLAPVLFCSEFDAIEFLVDFQLCFLHPSKYKFDHPRFCYERLEYLGQKIQDLVMAERLLMKHLDAPGLWLQNRHRRFLMNKYCGRYLRAKNLHHFIIYNEKVQDAYQRAYRLKYPVTTSVQQALHGLSYAVYGKRDVRRLMFEVFDFEQTQPEAM

SEQ ID NO: 136345 - protein, 289 aa, Glycine max
  Coding DNA Sequence Number=SeqID_19567
  Homolog annotation: Hit_ID=Q9LKM6; Match level="QueryCoverage=38%, HitCoverage=35%, E-value=9e-61, Identity=97%"; Hit description =Casein kinase II alpha subunit
  Pfam annotation: Domain name=Pkinase; Domain location=111-289; Score=- 11.1; E_value=6.7e-08; Accession=PF00069.15; Description=Protein kinase domain
MPPNSGGMAGCEWRRHGGHDGYGGMAENSGFLGFIFAVGVGLTRPNPTRYFVQKRSPTTMDSTERSPSHATQPRPRTQPQPRSDDPVFPPHDPATTTRRAPAHHAHGERRRRRRRQRCYSLQRTATCSCEIFVLPSEIFNIILQIKREIKILQNLCGGPNIVKLLDIVRDQHSKTPSLIFEYVNSTDFKVLYPTLTDYDIRYYIYELLKAIDYCHSQGIMHRDVKPHNVMIDHELRKLRLIDWGLAEFYHPGKEYNGMMEVLAYGGGHSDSDNDGSGNQWWLWQQQQCG

SEQ ID NO: 136346 - protein, 220 aa, Glycine max
  Coding DNA Sequence Number=SeqID_19568
  Homolog annotation: Hit_ID=O21999; Match level="QueryCoverage=35%, HitCoverage=51%, E-value=2e-22, Identity=72%"; Hit description=LacZ -alpha
GAEPMENASNAAFVRFLAFCWPFAHMFFPALSPDSVDNRITAFEKRKSAQYANRLSPRVGRFINAAGTTGFPTGKRAVSATQLIYDHDYEFELGTLDYNEFRVLVFKCKWVDGNTVVHQDELGFTLVDLNKVDYMDEAFIMAEQARQVFYVQDPFDSRLSVVLQGRTSMQAWHWPSFYNVVTGKTLALPNLIALQHIPLSPAGVIAKRPAPIALPNSCAA

SEQ ID NO: 136347 - protein, 63 aa, Glycine max
  Coding DNA Sequence Number=SeqID_19569
  Homolog annotation: Hit_ID=O64818; Match level="QueryCoverage=85%, HitCoverage=70%, E-value=1e-20, Identity=89%"; Hit description =Expressed protein
  Pfam annotation: Domain name=DUF1909; Domain location=4-63; Score =60.9; E_value=4.2e-15; Accession=PF08927.1; Description=Domain of unknown function (DUF1909)
MGGGNAQKSKMAREKNLEKQKAAAKGSQLDSNKKAMSIQCKVCMQTFICTTSEVKWVVRDERG

SEQ ID NO: 136348 - protein, 87 aa, Glycine max
  Coding DNA Sequence Number=SeqID_19570
MENHSWCYAACIQCNKKTNIDNTPFTCACGKYNQQAMLRYRLEVMVYHKEECTKFLLSNRECTDLIGQSVDEVNRLKIAGIHMEATG

SEQ ID NO: 136349 - protein, 153 aa, Glycine max
  Coding DNA Sequence Number=SeqID_19571
  Gene Ontology: Mol. function=transition metal ion binding; Biological process=proteolysis
  Pfam annotation: Domain name=Transposase_21; Domain location=2-109; Score=-145.2; E_value=0.033; Accession=PF02992.5; Description =Transposase family tnp2
MGVLVFNGFRNETFHFCAMLFCTINDFLGYENLSGYSVKGHRACSICEKDTSYIQLKHGLPAGSTTEYYIWKDPKEGKNKSCIWKKRSILFDLPYWVDLDVKHCIDVMYVEKNVCDGVIGMLLNIQGKTKDALITRQDLAKMGIRASLHPMSD

SEQ ID NO: 136350 - protein, 68 aa, Glycine max
  Coding DNA Sequence Number=SeqID_19572
MTFVIPIKQIKCLQIMMVWEINMKILRMGWTLTPQPYYPDFSNHFTINKVVKTEEVRRKTKIVSLKEH

SEQ ID NO: 136351 - protein, 88 aa, Glycine max
  Coding DNA Sequence Number=SeqID_19573
MTEGCDEGFCLANLPGDAFSPWGNFFEAKKQMMADAKVGGAGLWPRAKFRIGWPPPPPRDQFCQDFANFGLRCAPLAKSVPQWWIIMS

SEQ ID NO: 136352 - protein, 89 aa, Glycine max; identical to SEQ ID NO: 126206
  Coding DNA Sequence Number=SeqID_19574
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q1SEC9; Match level="QueryCoverage=73%, HitCoverage=16%, E-value=2e-27, Identity=86%"; Hit description=2OG -Fe(II) oxygenase

SEQ ID NO: 136353 - protein, 170 aa, Glycine max
  Coding DNA Sequence Number=SeqID_19575
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q1SEC9; Match level="QueryCoverage=99%, HitCoverage=34%, E-value=1e-44, Identity=57%"; Hit description=2OG -Fe(II) oxygenase
  Subcellular localization annotation: CTP_CleavageSite=56; ConfidenceScore=5.43e-01
MKAKTVKGNWSLRTNKLSFPYVFLVCIFFFLAGFFGFTLFSHSQVFLLSFNYFAVSDFLVFCFLLENIDIISIAENSQGDGDGLRPRQRLLEPGNEAEYNLMPVRDLGDDSITSIPFQVLSWRPRALYFPNFATAEQCENIIDVAKDGLKPSTLALRQGETEENTKGIRT

SEQ ID NO: 136354 - protein, 101 aa, Glycine max
  Coding DNA Sequence Number=SeqID_19576
MVVSLFLTHLFLEVASQSPFLLLHFAAIDLQVAKTPLMKKIQGLQALHGTTSCKTMRGPPFDGHCICRRWVTHSIHPFVFQRNMSDLMPTMKIKWKNCAEH

SEQ ID NO: 136355 - protein, 72 aa, Glycine max
  Coding DNA Sequence Number=SeqID_19577
MDVYRHVCWRHIQAVTGGMGVTSGSCEMAEWPSRQSQERNMCGYKVESYVQGHFAKAKSETCAGTSFLFFHW

SEQ ID NO: 136356 - protein, 37 aa, Glycine max
  Coding DNA Sequence Number=SeqID_19578
MAVLSCKGGCMESPVIIYSICSQNHQPEYWQFCREGK

SEQ ID NO: 136357 - protein, 123 aa, Glycine max
  Coding DNA Sequence Number=SeqID_19579
  Subcellular localization annotation: CTP_CleavageSite=70; ConfidenceScore=5.22e-01
KNCWNLDDPSITFRGPRKTRGKRSEAPSSYALPIYAPSTSTLASLTPALASAPTPSGPSTSLHKGQIIIMQSLQSSGLQPIMSMDEFISQVAWPGVQPSPLGGSEAFATQEPVPEEDEPIPPE

SEQ ID NO: 136358 - protein, 362 aa, Glycine max
  Coding DNA Sequence Number=SeqID_19580
  Gene Ontology: Mol. function=protein binding; Cellular component =membrane; Biological process=defense response
  Homolog annotation: Hit_ID=Q1SW19; Match level="QueryCoverage=99%, HitCoverage=42%, E-value=1e-67, Identity=39%"; Hit description =Disease resistance protein
  Pfam annotation: Domain name=LRR_1; Domain location=119-140; Score =12.9; E_value=1.1; Accession=PF00560.23; Description=Leucine Rich Repeat
  Pfam annotation: Domain name=LRR_1; Domain location=232-254; Score =6.1; E_value=21; Accession=PF00560.23; Description=Leucine Rich Repeat
  Pfam annotation: Domain name=LRR_1; Domain location=256-282; Score =5.6; E_value=25; Accession=PF00560.23; Description=Leucine Rich Repeat
  Pfam annotation: Domain name=LRR_1; Domain location=305-327; Score =4.9; E_value=35; Accession=PF00560.23; Description=Leucine Rich Repeat
  Pfam annotation: Domain name=LRR_1; Domain location=73-94; Score=6.9; E_value=15; Accession=PF00560.23; Description=Leucine Rich Repeat
  Pfam annotation: Domain name=LRR_1; Domain location=96-117; Score =8.4; E_value=7.6; Accession=PF00560.23; Description=Leucine Rich Repeat
  Pfam module annotation: Pfam domain module=LRR_1::LRR_1::LRR_1::LRR _1::LRR_1::LRR_1; Domain location=119-140::232-254::256-282::305 -327::73-94::96-117
MILRKVKDTGFCQYIDGPDQSVSSKIVRRLTIATDDFSGSIGSSPIRSILIMTGKYEKLSQDLVNKFPTNYMVLKVLDFEGSGLRYVPENLGNLCYLKYLSFRYTWITSLPKSIGKLQNLETLDIRDTRVSKMPEEIRKLTKLRQLLSYYTGLIQWKDIGGMTSLQEIPPVIIDDDGVVIGEMPLLEKLHIYTADWSEVIDLYITSPMSTLRQLVLWGTLTRLPNWILQFPNLVQLSLVGSKLTNDAFNSLKNMPRLLFLDLSYNAYEGETLNFQGGGFQKLKRLQLRYLDQLKCILIDRGALCSVEEIVLQDLSQLKTVPSGIQHLEKLKDLYINYMPTELVQRIAPDGGEDHWIIQDLPH

SEQ ID NO: 136359 - protein, 54 aa, Glycine max
  Coding DNA Sequence Number=SeqID_19581
MDFTFSSMNLTHKRAKALQAKMGFPFQSWLLCSKLSSRILDTLQFQCKVHPGNK

SEQ ID NO: 136360 - protein, 58 aa, Glycine max
  Coding DNA Sequence Number=SeqID_19582
MGEKEVYPNLKFRSPTRRDAFHDSENALLSRFGAEMVTKGWSFVGQQWWMREKKKKAV

SEQ ID NO: 136361 - protein, 76 aa, Glycine max
  Coding DNA Sequence Number=SeqID_19583
MAKAPVQVAIPLVSPVAEATQPRVTCERDVPIMLAFCMKFPCRAATGGMGVASGSCEMAECMSPVKLATLCRAVAK

SEQ ID NO: 136362 - protein, 125 aa, Glycine max
  Coding DNA Sequence Number=SeqID_19584
MSEWNFSFVVELPNSMFTFIHPVQSIIEEVNFDDEAPVVVANVAMEGRAHAKIEAKRWKILGEHLFKKYVDAFLDSSSDNESRISSFASLKRKKKLPNRRGRRSKKMKNAAIVKDAQAKGECIIW

SEQ ID NO: 136363 - protein, 119 aa, Glycine max
  Coding DNA Sequence Number=SeqID_19585
MVALEGDYGARERIEMTLDWESRVRFMESKLSMVLSLSGGGSGGRTRRGTREDVVAKDVSKGGQGEVVVGGKVGIVGSENGERGAVQKIRGEGRGGGKEGGDLGELRHDGEEEGDLGEL

SEQ ID NO: 136364 - protein, 118 aa, Glycine max
  Coding DNA Sequence Number=SeqID_19586
MGPRYTWFRIIMCNISLPALIPDHFHVSSSNILLIDSIGEYILRGALAVVLSDAIFDKDAIAQHDLDKIQKLAHSAALEQINLVEVKYPLELFKDALPVQFDYAESNGVSSYAYSLMS

SEQ ID NO: 136365 - protein, 162 aa, Glycine max
  Coding DNA Sequence Number=SeqID_19587
  Gene Ontology: Mol. function=protein serine/threonine kinase activity; Cellular component=plasma membrane; Biological process =protein amino acid phosphorylation
  Homolog annotation: Hit_ID=Q8VX01; Match level="QueryCoverage=95%, HitCoverage=40%, E-value=9e-70, Identity=77%"; Hit description =Casein kinase II alpha subunit precursor
  Pfam annotation: Domain name=Pkinase; Domain location=1-160; Score= -93.1; E_value=0.0051; Accession=PF00069.15; Description=Protein kinase domain
MHRDVKPHNVMIDHEQRKLRLIDWGLAEFYHPGKEYNVRVASRYFLSNVSKPHEYKILSYMIFRKEPFFYGHDNYDQLVKIAKVLGTDGLSAYLDKYRIELDPHLAALIGRHSRKPWAKFINVENHHMAVPEAVDFVDKLLRYDHQERPTAKEAMASDVISL

SEQ ID NO: 136366 - protein, 106 aa, Glycine max
  Coding DNA Sequence Number=SeqID_19588
MVVTTNCGGNGGGGGSSDDVSIGGDKDGISDGDNDDGDNSNVDSVDGNGDDSGGSSVGGISISCGDDNNNTSGGGDGDNGIDSSDDNDGGDDDGNDDSNKKCDHQM

SEQ ID NO: 136367 - protein, 480 aa, Glycine max
  Coding DNA Sequence Number=SeqID_19589
MVYLTGISQHAVSEEGSPLFHSLEKWNPRVRVGDRLTWVYVWGVPLQAWSSKHLRKITAAVGEFVDMDDEAEDRRRLDRARVLIKTSWMPQIQHTIDVAIGEETFKVTVTEECGGGDRSKYGSNTSVGGSSEEIDSDESYLDGTNLVAARLNNLETTLENLPEFVPLEDHGVLALPSGQYTSEDPLGNEEDRTCCSAFDHQIHGKRMDIPEKAPTVTDKGHRAENSRHYQGKGSPIISVEPQNVNKNGNGDRGEGREVSSLGDGVHELRIDDIWSPHGCNSTNCQAVDFLVNGSCLGQNCGAFKGPTNGLGLSEGNNQFIQHTSKEFDGNTGLFSQNNKAITESGWVVYSRKRRGKKKFMVGQPVPLPTSEITQPNLLDQDTQQGVLQKKLQCSQQGVQTYEADFVDSSHDSDVNQNNEEGGTNPEPHNQQYQQALDIWCKARQLGVSGMEDQQVIIDQLMKMEERDGLEAQKRGVSTML

SEQ ID NO: 136368 - protein, 246 aa, Glycine max
  Coding DNA Sequence Number=SeqID_19590
  Gene Ontology: Mol. function=protein-tyrosine kinase activity; Cellular component=integral to membrane; Biological process=protein amino acid phosphorylation
  Homolog annotation: Hit_ID=Q2HRX4; Match level="QueryCoverage=98%, HitCoverage=76%, E-value=2e-90, Identity=67%"; Hit description =Tyrosine protein kinase, active site
  Pfam annotation: Domain name=Pkinase; Domain location=1-237; Score =46.0; E_value=2.7e-11; Accession=PF00069.15; Description=Protein kinase domain
  Pfam annotation: Domain name=Pkinase_Tyr; Domain location=1-237; Score=10.4; E_value=4.2e-13; Accession=PF07714.7; Description =Protein tyrosine kinase
  Pfam module annotation: Pfam domain module=Pkinase::Pkinase_Tyr; Domain location=1-237::1-237
MSNIKAFTSEIQALAKIRHRNIVKLYGFCSHSRVSFLVYEFLEKGSMNKILKDDEQAIAFNWNRRMNAIKDVANALCYMHHDCSPPIVHRDISSKNVLLDLEYVAHVSDFGTAKLLNPDSTNWTSLAGTFGYAAPELAYTMEVNDKSDVYSFGVLALEIVFGEHPVDFINSSLWTSSSNVMDLTFDIPSLMIKLDQRLPYPTNLAAKDIALIVKIANACLAESPSLRPTMKQVAKELAMSKSSSIH

SEQ ID NO: 136369 - protein, 113 aa, Glycine max
  Coding DNA Sequence Number=SeqID_19591
MRKRVGCMQEKRKLSARDISFITDIILKIPMVERNPLLIEEGDFTFGSFGVVGGWFCSVAEMKDSTMKNLAITEKKVQQHKPGDYVGIFFQLIDWKRKLYKKKLFSKKLFPPG

SEQ ID NO: 136370 - protein, 108 aa, Glycine max
  Coding DNA Sequence Number=SeqID_19592
MWDNSCYNRCFLCTRSEWPILDCPKRMKIAIGSTRGLTYLHDGYQTLLPQNKIPNNGIQHTHMSYNMRDKIETMKSEKKGTYREAGGRGRGGAWCRKGKEAFMERTKR

SEQ ID NO: 136371 - protein, 95 aa, Glycine max
  Coding DNA Sequence Number=SeqID_19593
MNLRNVSGMFGLNLHHLNLSVFMLKVDQNWCGNSYKLNDFRGCDKNLRYSSLMEYFKEGSVMVAETFDDYDDQRHKLINERDMLWVKKFSIDGDV

SEQ ID NO: 136372 - protein, 620 aa, Glycine max
  Coding DNA Sequence Number=SeqID_19594
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=92%, HitCoverage=73%, E-value=1e-154, Identity=47%"; Hit description =Tyrosine protein kinase, active site
  Pfam annotation: Domain name=LRRNT_2; Domain location=46-86; Score =33.1; E_value=9.5e-07; Accession=PF08263.3; Description=Leucine rich repeat N-terminal domain
  Pfam annotation: Domain name=LRR_1; Domain location=115-137; Score =14.6; E_value=0.37; Accession=PF00560.23; Description=Leucine Rich Repeat
  Pfam annotation: Domain name=LRR_1; Domain location=139-161; Score =10.9; E_value=2.5; Accession=PF00560.23; Description=Leucine Rich Repeat
  Pfam annotation: Domain name=LRR_1; Domain location=163-185; Score =16.0; E_value=0.14; Accession=PF00560.23; Description=Leucine Rich Repeat
  Pfam annotation: Domain name=LRR_1; Domain location=187-209; Score =8.9; E_value=6.2; Accession=PF00560.23; Description=Leucine Rich Repeat
  Pfam annotation: Domain name=LRR_1; Domain location=211-230; Score =9.4; E_value=4.9; Accession=PF00560.23; Description=Leucine Rich Repeat
  Pfam annotation: Domain name=LRR_1; Domain location=235-257; Score =5.7; E_value=25; Accession=PF00560.23; Description=Leucine Rich Repeat
  Pfam annotation: Domain name=LRR_1; Domain location=259-281; Score =11.8; E_value=1.8; Accession=PF00560.23; Description=Leucine Rich Repeat
  Pfam annotation: Domain name=LRR_1; Domain location=283-305; Score =9.0; E_value=6; Accession=PF00560.23; Description=Leucine Rich Repeat
  Pfam annotation: Domain name=LRR_1; Domain location=307-329; Score =16.1; E_value=0.13; Accession=PF00560.23; Description=Leucine Rich Repeat
  Pfam annotation: Domain name=LRR_1; Domain location=331-353; Score =15.7; E_value=0.17; Accession=PF00560.23; Description=Leucine Rich Repeat
  Pfam annotation: Domain name=LRR_1; Domain location=355-377; Score =7.9; E_value=9.7; Accession=PF00560.23; Description=Leucine Rich Repeat
  Pfam annotation: Domain name=LRR_1; Domain location=379-401; Score =13.2; E_value=0.95; Accession=PF00560.23; Description=Leucine Rich Repeat
  Pfam annotation: Domain name=LRR_1; Domain location=403-425; Score =13.7; E_value=0.68; Accession=PF00560.23; Description=Leucine Rich Repeat
  Pfam annotation: Domain name=LRR_1; Domain location=427-449; Score =14.8; E_value=0.32; Accession=PF00560.23; Description=Leucine Rich Repeat
  Pfam annotation: Domain name=LRR_1; Domain location=451-472; Score =17.8; E_value=0.039; Accession=PF00560.23; Description=Leucine Rich Repeat
  Pfam annotation: Domain name=LRR_1; Domain location=474-495; Score =13.0; E_value=1.1; Accession=PF00560.23; Description=Leucine Rich Repeat
  Pfam annotation: Domain name=LRR_1; Domain location=90-113; Score =1.6; E_value=1.4e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1; Domain location=46-86::115-137::139 -161::163-185:...
  Pfam module annotation: Domain location=:187-209::211-230::235 -257::259-281::283-305::307-329::331-353::355-377::379-401::403 -425::427-449::451-472::474-495::90-113
  Subcellular localization annotation: CTP_CleavageSite=35; ConfidenceScore=5.08e-01
MVFIFPTFHSMKLLSFWLLLIVMRFGAFIMATSLLATASSASLTLQHSEANALLKWKASLDNQSQALLSSWGGNSPCSNWLGIACDHSKSVSNITLRGIGLTGTLQTLNFSSLPNILILDMSHNSLNGSIPPQIGVLSQLTHLGLGVNNLSGPIPSTIGNLTKLTKLSLRSNKLSGPIPSTIGNLTKLSTLALFSNKLSGNIPIELNKLSNLKILSFSYNNFIGPLPHNICISGKLMNFTANDNFFTGPLPKSLKNCSSLVRLRLDQNQLTGNIADDFGVYPNLDYIDLSENKLYGHLSQNWGKCYKLTSLKISNNNLSGSIPVELSQATNLHVLHLTSNHFTGGIPEDLGKLTYLFDLSLDNNNLSRNVPIQIASLKNLKTLKLGANNFIGLIPNHLGNLVNLLHLNLSQNKFRASIPSEFGKLKYLRSLDLSKNFLSGTIAPLLRELKSLETLNLSHNNLSGDLSSLEEMVSLISVDISYNQLQGSLPNIPAFNNASMEELRNNKGLCGNVSSLEPCPTSSNRSPNNKTNKVILVLLPIGLGTLLLLFAFGVSYHLFRSSNIQEHCDAESPSKNLFVIWSLDGKMAYENIVKATEEFDNKHLIGVGGQGSVYKAEMHT

SEQ ID NO: 136373 - protein, 74 aa, Glycine max
  Coding DNA Sequence Number=SeqID_19595
MTLSPMKDKGEDFESHEIIKQRTLSPMKQASTKGLNLMRKQEIDSLRGPLILNLKDRTLDMGNWYIKRNLCTYS

SEQ ID NO: 136374 - protein, 387 aa, Glycine max
  Coding DNA Sequence Number=SeqID_19596
  Gene Ontology: Mol. function=transporter activity; Cellular component= periplasmic space; Biological process=transport
  Homolog annotation: Hit_ID=Q2P3T4; Match level="QueryCoverage=89%, HitCoverage=76%, E-value=1e-134, Identity=64%"; Hit description=ABC transporter sugar binding protein
  Pfam annotation: Domain name=SBP_bac_1; Domain location=20-345; Score= 123.9; E_value=4.4e-34; Accession=PF01547.15; Description=Bacterial extracellular solute-binding protein
MPTAPQARASNPMPNWIDRLRRWALPALAALAVAGCARTDPGTTTVRFWAMGREAEVVSELIHEFEAENPGIKVDVQNIPWTAAHEKLLTAFAADGLPDVCQLGNTWVPEFAELDALTPLQPFVQRSAVVDPKDYFQGIWDTNVIHGELVGVPWYVDTRLIFYRKDLLAKAGYDHPPRTWQEWDEQMAAIKRMQGPNRYAVLMPINEFEQQLSLALQQPDPLLRDDDTRGNFASPGFRRTLAFYANMFEQGWAPKMSETQISNVWDEFFRGFNVFYISGPWNIREFKKLQPKELEGQWGSAALPGPDGPGAGIPGGTSLVIFRKSQQKEASWRLIEFLSRPEIQARFHSIIGDLPPRRSTWNAPSLANDPLAAAFRDQLERVKPTPK

SEQ ID NO: 136375 - protein, 247 aa, Glycine max
  Coding DNA Sequence Number=SeqID_19597
  Homolog annotation: Hit_ID=Q2QVB3; Match level="QueryCoverage=61%, HitCoverage=35%, E-value=5e-29, Identity=44%"; Hit description =Expressed protein
  Subcellular localization annotation: CTP_CleavageSite=24; ConfidenceScore=5.19e-01
MQSPNPNDDDDLFTLSLSWNQPTRASNFPTLIMQPQPQPQNPFINPRLAPYTASNHNNMNAAVDRVQANAPVPSSLSRSRRRDGRSETIVPPFPWATNRRATVQTRKYLLENKILKIRGDMECRMCKRKYLMVLDLESKFSELWSFIQKEKESMHDRAPSVWLKPVLPRCYHCGQENSVQPSLAGTKKKAINWLFLLLGQMLGCCTLNHLKYFLKHTNRHRTGAKDRNLYSTYMGLCQQLVPEFFSS

SEQ ID NO: 136376 - protein, 311 aa, Glycine max
  Coding DNA Sequence Number=SeqID_19598
  Gene Ontology: Mol. function=DNA binding; Cellular component=nucleus; Biological process=regulation of transcription, DNA-dependent
  Homolog annotation: Hit_ID=Q70KC5; Match level="QueryCoverage=97%, HitCoverage=98%, E-value=1e-84, Identity=55%"; Hit description=MYB transcription factor
  Pfam annotation: Domain name=Myb_DNA-binding; Domain location=23-70; Score=38.8; E_value=1.9e-08; Accession=PF00249.21; Description=Myb -like DNA-binding domain
  Pfam annotation: Domain name=Myb_DNA-binding; Domain location=76-121; Score=51.5; E_value=2.9e-12; Accession=PF00249.21; Description=Myb -like DNA-binding domain
  Pfam module annotation: Pfam domain module=Myb_DNA-binding::Myb_DNA -binding; Domain location=23-70::76-121
MRKPDLMANKDKVNNNIKSKLRKGLWSPDEDERLIRYMLTNGQGCWSDIARNAGLQRCGKSCRLRWINYLRPDLKRGAFSPQEEDLIVHLHSILGNRWSQIAAHLPGRTDNEIKNFWNSTLKKRLKANTSTPSLNNSTGSSESNKDVLSGIMPFSEHDIMTMCMDSSSSISSMQATVLPDQFDPFSMLANNQCDMTNVSADFPNLTQIGMVEGHEGNYGILEPNKMGLGRDFSLPSLESRSIESNSVPIDVKSHNNHFNYGSFNHTDKIQGSKVEDLIEFGNHGQGEDLKMGEWDLENLMQDITSFPFLEF

SEQ ID NO: 136377 - protein, 77 aa, Glycine max
  Coding DNA Sequence Number=SeqID_19599
  Subcellular localization annotation: CTP_CleavageSite=16; ConfidenceScore=5.01e-01
MPPYVAPPPLQAMPPRAAPPQPHQCHLESLTLQARTTAPPCIFFSLHSLSIELARRNAKELKIRMQMGMRKVNVLSH

SEQ ID NO: 136378 - protein, 126 aa, Glycine max
  Coding DNA Sequence Number=SeqID_19600
MTVPSNFRGASDANGDGIRSYQKTHIGLLSLRLMPRLTVSNFCGYPYEFFVIVSAIVDCHGYPFDPTLMSSLAVYPYEDPYARNGYGVGHRTSEVHLGAQSQIANMYFVGFLKVESYIVFWVDPSF

SEQ ID NO: 136379 - protein, 118 aa, Glycine max
  Coding DNA Sequence Number=SeqID_19601
MDMFVDSKPSEALNKLPPSPINYVCNSFLSAHSYSPKMLYRCEGQYESQGTRHYCEDPKVLAAQAKEQYDKVNIVWLHEDNMYTCDAWVRLLGKICINTIRKRCFYDRNSMTVTLEPP

SEQ ID NO: 136380 - protein, 119 aa, Glycine max
  Coding DNA Sequence Number=SeqID_19602
  Gene Ontology: Mol. function=transporter activity; Cellular component= integral to membrane; Biological process=transport
  Homolog annotation: Hit_ID=Q70AP4; Match level="QueryCoverage=98%, HitCoverage=41%, E-value=1e-48, Identity=78%"; Hit description =Aquaporin
  Pfam annotation: Domain name=MIP; Domain location=46-119; Score= -121.6; E_value=0.075; Accession=PF00230.10; Description=Major intrinsic protein
MEGRDEDVRVGANRYGERQPIGTAAQTQDAKDYREAPPAPLFEPRELTSWSFYRAGIAEFVATFLFLYVTVLTVMGVAKSPSKCSTVGVQGIAWSFGGMIFALVYCTAEMGNTIQGAVI

SEQ ID NO: 136381 - protein, 76 aa, Glycine max
  Coding DNA Sequence Number=SeqID_19603
MMQGKTNQGMGTSLEGTRVPQACKKIEKTTQHNQGNEGAQHNREKKAMGYAKSYEKKYFIVALFCLHLITTKVDRS

SEQ ID NO: 136382 - protein, 83 aa, Glycine max
  Coding DNA Sequence Number=SeqID_19604
MQSQQPHSVKPNVAFSDARVSTKENYVDASRLDPDTDILDRCGLYVDVIPPHLVAFGRVYEGSSIVPHMPLANDMVNVGVEEV

SEQ ID NO: 136383 - protein, 75 aa, Glycine max
  Coding DNA Sequence Number=SeqID_19605
MVCKSISESSSDSEATSVQVFLGSLVDDPAWVGDPDKEELFLTVGSSRVNLNPFHVLHPPLKEVFDALGGMRTCL

SEQ ID NO: 136384 - protein, 76 aa, Glycine max
  Coding DNA Sequence Number=SeqID_19606
  Gene Ontology: Mol. function=amino acid transporter activity; Cellular component=integral to membrane; Biological process=auxin mediated signaling pathway
  Homolog annotation: Hit_ID=Q8L884; Match level="QueryCoverage=83%, HitCoverage=13%, E-value=8e-29, Identity=95%"; Hit description=Auxin transporter-like protein 4
MWKPQKFKYIYLLATLYVFTLTIPSAAAVYWAFGDELLNHSNAFSLLPKNRFRDAAVILMLIHQEYFRNDITPWEP

SEQ ID NO: 136385 - protein, 260 aa, Glycine max
  Coding DNA Sequence Number=SeqID_19607
  Gene Ontology: Mol. function=amino acid transporter activity; Cellular component=integral to membrane; Biological process=auxin mediated signaling pathway
  Homolog annotation: Hit_ID=Q9FEL7; Match level="QueryCoverage=98%, HitCoverage=52%, E-value=1e-130, Identity=86%"; Hit description =Auxin transporter-like protein 2
  Pfam annotation: Domain name=Aa_trans; Domain location=51-260; Score=- 63.2; E_value=3.4e-05; Accession=PF01490.8; Description=Transmembrane amino acid transporter protein
METMLPQNQAEEAIVTTSLNETESEVGMREEEKELQQQDHSMFNIKSFLWHGGSVWDAWFSCASNQVAQVLLTLPYSFSQLGMLSGILLQIFYGILGSWTAYLISVLYMEYRTRKEKENVSFKNHVIQWFEVLDGLLGPYWKAVGLAFNCTFLLFGSVIQLIACASNIYYINDHLDKRTWTYIFGACCATSVFIPSFHNYRIWSFLGLGMTTYTAWYLAIAALIHGQAENVTHTGPTKLVLYFTGATNILYTFGGHAVTV

SEQ ID NO: 136386 - protein, 168 aa, Glycine max
  Coding DNA Sequence Number=SeqID_19608
  Homolog annotation: Hit_ID=Q1RTB4; Match level="QueryCoverage=50%, HitCoverage=19%, E-value=2e-07, Identity=40%"; Hit description=IMP dehydrogenase/GMP reductase
MGTRVCINYNPVLAIRQLGYPMRGSPSEESTTPFITRGFSDPNARIFQRVRKAWSAVQRKDKEFRGSSNGIVGGYHKWLKARTQELDWLPKLKVSSEEEAETPDESEEVQALKVELERAQAVKEKFKTTAMMVRKECDELGDINVATAEALEWEIKRVRKEEWARNKF

SEQ ID NO: 136387 - protein, 255 aa, Glycine max
  Coding DNA Sequence Number=SeqID_19609
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=99%, E-value=1e-37, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MLVATPCIFLSWKMHPGLHVLTFRGLHIQTFKGLQALAFIGLHAPTFRGLHALTFSGLHVLAFRRLHVLTIEGLHILPFRGQQALTFVELHDLAFRGLHVLAFRGMHALAFRGLHIHIFKGLHALAFRGLHAFNFRGQHLLVFRGLFVLAFRGLHVLVIRGVHIFPFRGHHVHIFRGLHALAFRGLHALAFRGLHVLAFRELQLLTLRGQHVLTFKGLHALTFRGLHVLSFRGIHVLTFRGLHVLPFRGLQALTF

SEQ ID NO: 136388 - protein, 76 aa, Glycine max
  Coding DNA Sequence Number=SeqID_19610
MEQVSIGHRNLGMAFVDNWVVDKENGCYWLSNDIVGLVGNLAISASTLSPAKTKSAKLEGRQPLGPSMNGLRKVPS

SEQ ID NO: 136389 - protein, 96 aa, Glycine max
  Coding DNA Sequence Number=SeqID_19611
MGRAPPAMVEKGKLDHIEEWLKDIEGGKDCAFANLEEFFLVPEHGHSHGTTCPKNHLKTYYRKIGAYAKDEKLLIHSFQESLTGVVVTWYTSLEPS

SEQ ID NO: 136390 - protein, 146 aa, Glycine max
  Coding DNA Sequence Number=SeqID_19612
  Gene Ontology: Mol. function=transferase activity; Cellular component= oxygen evolving complex; Biological process=DNA integration
  Homolog annotation: Hit_ID=Q1SXA8; Match level="QueryCoverage=99%, HitCoverage=11%, E-value=1e-53, Identity=64%"; Hit description=Zinc finger, CCHC-type; Polynucleotidyl transferase, Ribonuclease H fold
MAFVSMIEPKNIKEAIIDDNWIIDMQEELNQFERNNVNKLDEHGIIIRNKARLVAKGYNQEEGIDYEETYAPIARLEAIRMLLAYGSIMNFKLYQMDVKSAFLNDLIQEEVYVEQPPGFEMLDKLNHVYKLKKALYGLKQAPRAWY

SEQ ID NO: 136391 - protein, 267 aa, Glycine max
  Coding DNA Sequence Number=SeqID_19613
  Gene Ontology: Mol. function=transposase activity; Biological process= transposition, DNA-mediated
  Homolog annotation: Hit_ID=Q75HL4; Match level="QueryCoverage=94%, HitCoverage=39%, E-value=6e-10, Identity=24%"; Hit description =Expressed protein
MECVLADVLRDQRNLGNKGDRGWERSALNAAAAVLSTSFNVNVTSDNVKNRIKLWRSWYGIVSDILGQSGFDWDGTKHMITVENENAWNEYCSSHKSAKPFRFKVLQNWDDIVDLCAKDRATGHGAETAMDADEAMSRETNEVEFMGLGATAIDLEEPSSNIKGKRQGSISSGTHPHKRKMRVKEGITASLDKMANSFNRMVEKMDGKVDDEDIQEVLREAALIPDINRQQWAKAIKWLADDPKQLAIVKALPIHQKTDYALTHLGE

SEQ ID NO: 136392 - protein, 62 aa, Glycine max
  Coding DNA Sequence Number=SeqID_19614
MALGVSSSFNAELVAAMKIIDIAWDRQWHSLWLETDSSLMISSPLDANLVRMFGAAFLFLLT

SEQ ID NO: 136393 - protein, 173 aa, Glycine max
  Coding DNA Sequence Number=SeqID_19615
  Gene Ontology: Mol. function=galactosyltransferase activity; Cellular component=Golgi stack
  Homolog annotation: Hit_ID=Q2HUE1; Match level="QueryCoverage=28%, HitCoverage=18%, E-value=3e-09, Identity=57%"; Hit description =Glycosyltransferase sugar-binding region containing DXD motif; Alpha 1,4-glycosyltransferase conserved region
MQEENGGVGNINHVVLVAPLNATEEERIGWFRGKLREFKILNSDELRRQFHARVLGFFVPRCESQIFMAWESSVGSFGARELLSIESLFKVHPEACLVILSRTLDSIHGYRILKPILDGGGGVVVERLGERPGFNFTILPPMAIYPEDWKKIGGLFMKPKTRGESKWVEAKLL

SEQ ID NO: 136394 - protein, 183 aa, Glycine max
  Coding DNA Sequence Number=SeqID_19616
MAKNVIRENIDILARDTSLGSSATSIGIIEPVPSLVIKQWQRTRAVKLPFVKWKNVSVVEWNQDLSSSLLPCNKQYTKCFSRGNKILQQQAIHLEVKDPTLILVALDWLGWNFQDSMNLASWNEYQIVLLDRFGDVYEDPMADLMKLRQTGSIIEYHEEFGSIVSRVDLSDEHQLSCFLGGLK

SEQ ID NO: 136395 - protein, 446 aa, Glycine max
  Coding DNA Sequence Number=SeqID_19617
  Gene Ontology: Mol. function=calcium ion binding; Cellular component =mitochondrion; Biological process=protein amino acid phosphorylation
  Homolog annotation: Hit_ID=Q8LHA7; Match level="QueryCoverage=82%, HitCoverage=80%, E-value=5e-41, Identity=29%"; Hit description =Pentatricopeptide repeat protein-like
  Pfam annotation: Domain name=PPR; Domain location=168-202; Score =51.8; E_value=2.4e-12; Accession=PF01535.11; Description=PPR repeat
  Pfam annotation: Domain name=PPR; Domain location=203-237; Score =21.6; E_value=0.0028; Accession=PF01535.11; Description=PPR repeat
  Pfam annotation: Domain name=PPR; Domain location=240-274; Score =39.4; E_value=1.2e-08; Accession=PF01535.11; Description=PPR repeat
  Pfam annotation: Domain name=PPR; Domain location=275-309; Score =30.0; E_value=8.2e-06; Accession=PF01535.11; Description=PPR repeat
  Pfam annotation: Domain name=PPR; Domain location=312-345; Score =21.5; E_value=0.003; Accession=PF01535.11; Description=PPR repeat
  Pfam annotation: Domain name=PPR; Domain location=359-393; Score=5.2; E_value=1.8; Accession=PF01535.11; Description=PPR repeat
  Pfam annotation: Domain name=PPR; Domain location=394-428; Score =25.9; E_value=0.00014; Accession=PF01535.11; Description=PPR repeat
  Pfam module annotation: Pfam domain module=PPR::PPR::PPR::PPR::PPR::PP R::PPR; Domain location=168-202::203-237::240-274::275-309::312 -345::359-393::394-428
MDVLPPFINSNKVLDLWDEEKDDEDAAEDDKEDDGLYRDFWDENNQVQVAMILKRFLDPPPSPTTTVNPFRVSASSLCDAVSLFHDPNSPPSEPACSTLIDNLRKYDVVVSVYRKMVAACVSPRFSYLSALTESFVITHHPSFALSVLSLMTKRGFGVNGGDFRPNLVTYSVLIDCYCKSGEVGEGFSLLEEMEREGLKADVFVHSSLISAFCGEGDVEKGRELFDEMLMRKEGEEPGTLTYNVVVNGLCKEDRVDDALRVVEMMAKKGKKPDVVTYNTLLKGLCGAAKIDEAMELWKLLLSEKFHVKLDVFTFNNLIQGLCKEGRVHDAAMIHYSMVEMWLQDVDVVFFNIIIDGTLKAGMLNLPRFSKLGMLYEAMALYEKMVSCGHVPDVVVFDSLLKGYGLKGETEKIISLLHQMADKDVVLDSKLTSTILACLCHMSRDLD

SEQ ID NO: 136396 - protein, 615 aa, Glycine max
  Coding DNA Sequence Number=SeqID_19618
  Gene Ontology: Mol. function=RNA-directed DNA polymerase activity; Cellular component=chromatin; Biological process=RNA-dependent DNA replication
MEDHLSHLYQVLLTMRTHCLYAKKSKCYFAIDKVEYLGHFITKEGVSTNRSKITTVQDWALPQNLKQLRSFLGLASYYRRFVSQYSAIAKPLTDMLKKDNFSWSSTAKEAFQELKQRLVASPVLALPDFSKEFVVEVDASGLGLGAVLMQNHHPIAFINRSLKTQQKSLSTCEKELLAVMFVVQKWRHYLLPKKFIIRTGHRSLKYILEQRLSIAFQQKWLVKLMAFDFNIEYREGRENVAADALSRLDSLKIMALQVHQPDSSMLSRIQQSWQKDPILQQLVSDLKNNSSSHKHYTWIRNELRRKGILVIGSHPQLRQGILSWFYASTCGGHSGRDATLQKMKNVIYWRGMSKAVKVFVFQCAICQRSKYDTAASPGLLQPLPIPEHVWQHITMDFIEGIQVQLSTAYHPQTDGQSEMWSKWLPLAEWWYNSTYHNTIKASLYEIVYGQAPPVHLTYLPRESKITLVDRSLQKREEMLKLLKFHMKRAHERIKQLADRGRSDKSFQIGDLVYARTNAKLAPKYYGPFPVEDKIGDVEYKLKLPLGSMVHNVFHVSQLKKFNGTTIAGNFSPSPLLDTSQKEPAAIIDRMTVKRSNRATTKVLVQWKHQLSEDAT

SEQ ID NO: 136397 - protein, 90 aa, Glycine max
  Coding DNA Sequence Number=SeqID_19619
MQRLTSSSAPFVIQGQRVRWQAEIPYGRPHLSSTKANEFDSIRMMLVFTLVFWRHSSPMMHEILLCWAGMIKFDSVWKRRGYPILSLSRH

SEQ ID NO: 136398 - protein, 101 aa, Glycine max
  Coding DNA Sequence Number=SeqID_19620
MNKNEKEISKKKAKDSIDEEDPRPRSSTWSYITIPMPQGVKNEQVTYIGDVDVDYDQIDKEISNIDVSRSAPIDFATYLQKGQYMHTRGIHQLQVDLMNHI

SEQ ID NO: 136399 - protein, 163 aa, Glycine max
  Coding DNA Sequence Number=SeqID_19621
MVITAPFVIQRRWARGHAETNYGHSVHLFAIQTQSCPMARRDKLWSSESSDKRAKTNYGHSGSASRVINAQRQIMVILRPLSFRSSESSGGRRQIMVIPHTFSSSKGDCVQWHAETNYGNSAPFHPGPIVSDGAQRKIMVILRLVSTKRNEFGSIWMMLVIRC

SEQ ID NO: 136400 - protein, 114 aa, Glycine max
  Coding DNA Sequence Number=SeqID_19622
  Homolog annotation: Hit_ID=Q45RR8; Match level="QueryCoverage=60%, HitCoverage=23%, E-value=3e-08, Identity=46%"; Hit description =Plastid division regulator MinD
MSALMATTKKPRRVRERLMLAVVVVLPTPPLLEVMTATRGVELESSGLRFHWRRVEGGLGFLGVRVLEGKRGEWGRWWRREEGGEMTLGRGEREREREKKKMNDDEEEAQWWSE

SEQ ID NO: 136401 - protein, 69 aa, Glycine max
  Coding DNA Sequence Number=SeqID_19623
MAEPMGMVFANTVGGTYAGWCLDAWHGHGDAADMHSCCCNGVMQLELAICMSRKQCVSPVVMVKHTWHT

SEQ ID NO: 136402 - protein, 316 aa, Glycine max
  Coding DNA Sequence Number=SeqID_19624
  Gene Ontology: Mol. function=transporter activity; Cellular component= membrane; Biological process=transport
  Homolog annotation: Hit_ID=Q4QJN6; Match level="QueryCoverage=98%, HitCoverage=48%, E-value=6e-79, Identity=44%"; Hit description =Predicted choline-glycine betaine transporter
  Pfam annotation: Domain name=BCCT; Domain location=1-316; Score =256.0; E_value=8e-74; Accession=PF02028.8; Description=BCCT family transporter
MGIGLIYFSVAEPMQHYSSEVFGNNHYVNRAKQAQLYTFFHWGIHAWAIYGIVGLSLSYFAYRYRLPLSLRSCFYPLLKDRINGKWGNVIDIFALCCTFFGITTTLGFGVVQINSGLHILGAIPENKFIYQIIIVFILISLAVFSAISGVNKGVKILSNINVISVIVLLLFVLILGPTVYLIGSFTEGLGNYINNFFDLTFSTHVYEKDTLPWFYDWTILYWAWWISWSPYVGLFIARISKGRTIKEFILAVLILPTLFNFIWMSVFGNSAIWFDFNIAHGGLKALQSMTLITALPFSIIVLLFIFPGPVNSGKNV

SEQ ID NO: 136403 - protein, 130 aa, Glycine max
  Coding DNA Sequence Number=SeqID_19625
MATADALERETKKAQKEEHDELKAYLRSKRNLSQQLSETEGNMWAIIDECKEKLNLAATHEQRLEDEYAKISAESEARERVIDSWHQEATMWTDRFALTLNRSQELPRLIAKAKAMADTYFAPKKIHRLL

SEQ ID NO: 136404 - protein, 47 aa, Glycine max
  Coding DNA Sequence Number=SeqID_19626
  Homolog annotation: Hit_ID=Q9S7B1; Match level="QueryCoverage=77%, HitCoverage=4%, E-value=1e-10, Identity=81%"; Hit description=Nodule inception protein
MKRGRESSKRNSDSSMQVKDGGVVGERIFGVGEGGYVGGETGLGCCQ

SEQ ID NO: 136405 - protein, 36 aa, Glycine max
  Coding DNA Sequence Number=SeqID_19627
MARSPVTRVLQEGGIDVVLGGLRVQEGDVEGSWLVL

SEQ ID NO: 136406 - protein, 298 aa, Glycine max
  Coding DNA Sequence Number=SeqID_19628
  Gene Ontology: Mol. function=DNA binding; Biological process =regulation of transcription
  Homolog annotation: Hit_ID=Q8H0N0; Match level="QueryCoverage=97%, HitCoverage=45%, E-value=3e-48, Identity=68%"; Hit description =Nodule inception protein
  Pfam annotation: Domain name=PB1; Domain location=188-273; Score =86.1; E_value=1e-22; Accession=PF00564.15; Description=PB1 domain
  Pfam annotation: Domain name=RWP-RK; Domain location=75-126; Score =100.2; E_value=6.3e-27; Accession=PF02042.6; Description=RWP-RK domain
  Pfam module annotation: Pfam domain module=PB1::RWP-RK; Domain location=188-273::75-126
MMEAQSQHIKGVCLSLEEEPKEEFKVTTTHYCNWDSTATSTYQAHDQVVFGEESHTHTFGGKRGRKPGEKRRTKAEKTISLPVLRQYFAGSLKDAAKSIGVCPTTLKRICRQHGITRWPSRKIKKVGHSLKKLQLVIDSVQGAEGAIQIGSFYNSFPELSSQSSKSNNNNNSSSPTAAAAAAQSPQQPLRVKATFADEKIRFSLQPHWGFTELQLEIARRFNLNDVSNGYLVLKYLDDDGEWVVLACDGDLEECKDLHTTSQSRTIRLALFQASPLNNLPNTYTFAAATPSSSLAVSL

SEQ ID NO: 136407 - protein, 102 aa, Glycine max
  Coding DNA Sequence Number=SeqID_19629
MVIFHHGDAAEDKGEEKKLHHQESALNKKLKKEASMEEKKEREKEKGGQHKIEGGKEGEKLNFEVCLTRLSFIKVTTSVTHASIYSLGSFLEKLPSEASLRS

SEQ ID NO: 136408 - protein, 417 aa, Glycine max
  Coding DNA Sequence Number=SeqID_19630
  Gene Ontology: Mol. function=DNA-directed RNA polymerase activity; Cellular component=chloroplast; Biological process=transcription
  Homolog annotation: Hit_ID=Q52GZ3; Match level="QueryCoverage=73%, HitCoverage=26%, E-value=5e-64, Identity=45%"; Hit description=DNA -dependent RNA polymerase
  Subcellular localization annotation: CTP_CleavageSite=51; ConfidenceScore=5.50e-01
MTLASSFPTPQVHAFDNPARRRRRSHFHIINRNKPHRTLHFLLIPTSPSPSSSLLFSCSSFPLTHSDPILQFRHHHLLSTDGNFIVEDLSAAVEEDVSPATTARIFVQEPPWLFLKGLLMQEEEMRQKDKEREKYNLLRRRQIEAETEAWEKMVEEYRELEREMREKMLAPNLPHVKSLLLGWFEPFRAAVEAEQTAHRARPKKQQDSIAPHVDDLPADKVAVIVMHKMMAMVMENEEGCVQLVHAAVHIGMALEQEVMALFWSQIVITRMGLIDWLHHGCRCRIVELDKPLMLKLFKTGLDFMVRIHKFVEGNKSSQSKKTEGDAEDSLDSDKEKQRNYLNSLLKKNRLREVQMILRKEECSPWSRDTQAKLGSRLVELLIDTAYVHSPVNQSADTPPDIRPAFRHGFKAVPWHPG

SEQ ID NO: 136409 - protein, 867 aa, Glycine max
  Coding DNA Sequence Number=SeqID_19631
  Homolog annotation: Hit_ID=Q52GZ3; Match level="QueryCoverage=14%, HitCoverage=12%, E-value=4e-39, Identity=59%"; Hit description=DNA -dependent RNA polymerase
  Pfam annotation: Domain name=Phage_B; Domain location=75-204; Score= -30.3; E_value=0.013; Accession=PF02304.6; Description=Scaffold protein B
MFLFLTRQKFSKKYGIIQCDPLVLVGLEKCAKHMLIPYMPMLIPPKKWKGYDKGGHLFLPSYIMRTHGSKKQQDVMKNVDGAQMQKVFEALDILGNTKWRVNRRVLGVVESIWAGGGNIAGLVDCKDDSSLLEKQIERERRERKVRERGRSQVRDHRGGTTNRDSSWRVLGERRSRDDDNDYSLVADDHRRHFNDHRDEQRGHCDNLQEGEWIQVKSRRRRSLSKREPAHGKGIAVKEKSLQVTFRGKKSSSTWRERADITSFYFSHFPDGEVFVSKKRNKQGHRYGFVRFKGVEDEDGMERRLDNRIYIQGMKLFVNKPKFQRDGNKVTEPLTASNHRMSKKNTEHGAYKQELRQAPTFNKLKSYAEVVTNRTNDRIEAQEPRIKIQTSQEKTKWLDNAWVGHLKNKAMFDRVDEEVRGMFGQEVKVSYWGDDLIILHGLTEVEATDFNRKEHTHGGTPLSLLQRWTPMLTPSYRLTWLCIWGVPLTVWDADTFACIVSVCGELVEMDEVTEEKSRVDLARVLIRTSEKPFIERTMLILVDGVQYSLDLREEMGVGWGRTLREAAVTQLPPSPFSTAIANSDEEPNTPFMHGFSAERVSGSLVGGSSACSSLSMEDHRRRRRTEGPYPTRRGNDTAIGAYMSSLLCHEQLPADAALTPSVAGQWECIDPNCLDMHPVDMAEPMSFCPSQQQTPIQEGDVEDIPLPAFKNSYIHRVKQDEPLVNIHDSTPLVNSDSNLMPPYQKEAAAEEGVGLNHSVGLSKSPNKEGNKLSPNLRVYVRRKEWGALNHEAYVQHSPLSCLNGKNLVSRKPFNEISKTQVYEGRDIHSSDPEGMIPNLHHPPHSSVPDDSVSKEYVGDEEAFQHGDG

SEQ ID NO: 136410 - protein, 321 aa, Glycine max
  Coding DNA Sequence Number=SeqID_19632
  Gene Ontology: Mol. function=DNA-directed RNA polymerase activity; Cellular component=chloroplast; Biological process=transcription
  Homolog annotation: Hit_ID=P69243; Match level="QueryCoverage=92%, HitCoverage=31%, E-value=1e-134, Identity=75%"; Hit description=DNA -directed RNA polymerase 3A, chloroplast precursor
  Pfam annotation: Domain name=RNA_pol; Domain location=43-320; Score =177.3; E_value=3.9e-50; Accession=PF00940.10; Description=DNA -dependent RNA polymerase
MKDEEGFYYPHNLDFRGRAYPMHPHLNHLGSDLCRGLLEFAEGRPLGKSGLRWLKIHLANLYAGGIEKQSYDGRLGFIEDHIHDIFDSADHPINGNRWWLTAEDPFQCLAACINLSEALRSSSPNSFISHLPIHQAAAVNLVAKEKPADVYTEIAVRVYDIMRQDSNKDPDTFPNALLAKVLIDQIDRKLVKQTVMTSVYGVTYIGAREQIKRRLGEKGFVTDDRLLYAASCYAAKVTLAALGEVFEAARGIMGWLGDCAKGGSETFLQVIACENQAVCWTTPLGLPVVQPYCKTERYQRERTSTDSGKAELEVTGKRGNC

SEQ ID NO: 136411 - protein, 50 aa, Glycine max
  Coding DNA Sequence Number=SeqID_19633
MVIESGMRTLLRWATWDGVLMPGLVEMGYLFCAIARSPPSTTYDGCPITQ

SEQ ID NO: 136412 - protein, 458 aa, Glycine max
  Coding DNA Sequence Number=SeqID_19634
  Gene Ontology: Mol. function=drug transporter activity; Cellular component=membrane; Biological process=multidrug transport
  Homolog annotation: Hit_ID=UPI000034F19D; Match level="QueryCoverage =78%, HitCoverage=74%, E-value=6e-88, Identity=70%"; Hit description =antiporter/ drug transporter
  Pfam annotation: Domain name=MVIN; Domain location=3-423; Score= -217.6; E_value=0.034; Accession=PF03023.5; Description=MviN-like protein
  Pfam annotation: Domain name=MatE; Domain location=185-342; Score =60.6; E_value=5.1e-15; Accession=PF01554.9; Description=MatE
  Pfam module annotation: Pfam domain module=MVIN::MatE; Domain location=3-423::185-342
METAYIGRLGTVELASAGVSISIFNIISKLFNIPLLSVATSFVAEDIAKSSSAADAKTKQQLSSVSTALLLALALGFFEALALYLGAGAFLHLIGVPTVCFHPLLYAFYFLYPLPSIGNFSAVFLFPLLMYYFRLGVTGAAISTVISQYIGTMLMIWCLNKRAELLPPKMGDLQFGSYIKSGGFLLGRTLAVLSTMTLGTSIAARHGPVAMAAHQICMQVWLAVSLLTDALAASGQALIASSVSRHEYKVVKEVTSFVLRIGLVMGICLTAILGASFGSLATIFTQDSEVLQVVKTLALFVSASQPFNALAYIFDGLHYGVSDFRYAAFSMMFVGAVSSAFLVFAPPLFGLQGVWLGLVLFMALRAAAGAVRLLSKNGPWWFLHRDLQIAEMLVEGVSKLVVFWRWKAWFKIMGSILRSDEKFIAEIEGWSRESLDGEYGCNTGCDILKRILSVGYYI

SEQ ID NO: 136413 - protein, 149 aa, Glycine max
  Coding DNA Sequence Number=SeqID_19635
  Gene Ontology: Mol. function=nucleic acid binding; Cellular component= intracellular; Biological process=regulation of transcription
  Homolog annotation: Hit_ID=O65499; Match level="QueryCoverage=82%, HitCoverage=73%, E-value=6e-18, Identity=36%"; Hit description =Putative zinc-finger protein
  Pfam annotation: Domain name=zf-C2H2; Domain location=26-48; Score =9.2; E_value=1.1; Accession=PF00096.16; Description=Zinc finger, C2H2 type
  Pfam annotation: Domain name=zf-C2H2; Domain location=97-119; Score =11.4; E_value=0.6; Accession=PF00096.16; Description=Zinc finger, C2H2 type
  Pfam module annotation: Pfam domain module=zf-C2H2::zf-C2H2; Domain location=26-48::97-119
MKRECGEASSCSRKKQKRLMEDAGARPCTECGKKFWSWKALFGHMRCHPERHWRGINPPANVVRRQQEQEQMSQEDHEVAASLLLLANSNVLESDGHKCSICLRVFSTGQALGGHKRCHWDSSSSKSLSVLDFDLNFPPPLTLDLRLGL

SEQ ID NO: 136414 - protein, 124 aa, Glycine max
  Coding DNA Sequence Number=SeqID_19636
MKRKKHHTEKSRIIGLLVVSFLRSRLLHRTLIIAISASLLLLFALFSLFAPSPVNEINLQTQNNDQVRSRFEVPAGGGRCRRDLWSSIHSRLFYGCSNAGVNFASKANPYHPISQPIYEFNFGL

SEQ ID NO: 136415 - protein, 95 aa, Glycine max
  Coding DNA Sequence Number=SeqID_19637
MELLNLPDCLCSKLFSSFDQEWNTHHKRPNILPPQFNMVEASNQIHETTSLVLLLVSVMMKEYLLLAAAAATSWFQGQPTPQEAESMALLFTRAL

SEQ ID NO: 136416 - protein, 441 aa, Glycine max
  Coding DNA Sequence Number=SeqID_19638
  Homolog annotation: Hit_ID=Q0GPD2; Match level="QueryCoverage=28%, HitCoverage=47%, E-value=1e-49, Identity=82%"; Hit description=BZIP transcription factor bZIP107
  Pfam annotation: Domain name=DUF630; Domain location=1-60; Score =115.9; E_value=1.2e-31; Accession=PF04783.3; Description=Protein of unknown function (DUF630)
MGCGSSKLEDLPAVALCRERCGFLDEAIHQRYALAAAHMAYINSLKAIGHSLHLFIQQDMDAPPSPSPSPSPSPPHKPSKHASSSHSDSAGSHLHFHSDSDSDHLPSLHHSPDPSSPLPHHLHMNYMKNKAAPSIVYEQRPLSPQTMYLGESSSSSSFYPYQYPPYPYPYDPYSAVGSSSPQLHAVSKPPPPPPSPPRSSTWDFLNFFDNSDDKYYPQTHYPATATPSRDSREVREEEGIPDLEDEDYHHEVVKQVHGDQKLVQPTMHEPPASSRHHDEDDDDDDDDDDDDDEVEYEVHVVDKKVVDGDNNDGNKAKEHAAFRTRRPGSRNPLEVAKEIQILFQRASDSGAQIAKILEVGKLPHNRKHAAYQASSKMLQVVAPSLSLVSSQPSTSKDAESASAANMDFNVDLTTGARNLSSTLQKLLLWEKKLFNEVKVSK

SEQ ID NO: 136417 - protein, 904 aa, Glycine max
  Coding DNA Sequence Number=SeqID_19639
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=99%, HitCoverage=100%, E-value=0.0, Identity=84%"; Hit description =Transcriptional factor B3; Auxin response factor; Aux/IAA_ARF _dimerisation
  Pfam annotation: Domain name=Auxin_resp; Domain location=253-336; Score=196.7; E_value=5.5e-56; Accession=PF06507.4; Description=Auxin response factor
  Pfam annotation: Domain name=B3; Domain location=126-231; Score =114.3; E_value=3.6e-31; Accession=PF02362.12; Description=B3 DNA binding domain
  Pfam module annotation: Pfam domain module=Auxin_resp::B3; Domain location=253-336::126-231
MKLSSPGFSPPPQEGEKRVLDSELWHACAGPLVSLPAVGSRVVYFPQGHSEQVAVSTNREVDGHIPNYPSLPPQLICQLHNLTMHADTETDEVYAQMTLQPLNPQEQKGAYLPAELGTPSKQPTNYFCKILTASDTSTHGGFSVPRRAAEKVFPPLDFSQQPPCQELIARDLHGNEWKFRHIFRGQPKRHLLTTGWSVFVSAKRLVAGDSVLFIWNEKNQLLLGIRRANRPQPVMPSSVLSSDSMHLGLLAAAAHAAATNSRFTIFYNPRASPSEFVIPLAKYVKAVYHTRVSVGMRFRMLFETEESSVRRYMGTITGISDLDSIRWPNSHWRSVKVGWDESTAGERQPRVSLWEIEPLTTFPMYPSPFPLRLKRPWPPGLPLFHGLKDDDFGINSSLMWLRDTDRGLPSLNFQGIGVSPWMQPRLDPSMVNYQSDMYQAMAAAALQDMWTSNPSKQHPTSSIQFQQPQNFPNQTSPLMQTQLLQQSPSQQAFPNSQENPHPSPSQSQAQTQTHFQQHLQHQHSFNNQNQHHLLPQQQQQPQQPQLQQQQVVDHQQISSVVSTMSQFVSAAQSQSPPMQAISSLGHQQSFSDSNGNPTTTAIVSPLHSILDSFPQDDTSHLLSLPRSTSWVPVQHSTAWPPSKRVVVDPLLSSGASQCVLPQVEQLGQPHSTMAQNGIALPAFPGRECTIEGSNDPQNHLLFGVNIEPSSLLMHNGMSSLKGVSSNSDSPTIPFQSSNYLNTTGPDSSLNPGMTHNIGETGFLQTPENGGQGNPSNKTFVKVYKSGSFGRSLDITKFTSYPELRSELARMFGLEGELEDPVRSGWQLVFVDQENDVLLLGDGPWPEFVNSVGYIKILSPQEVQQMGNNELELLNSVPIQRLSNGVCEDPRNLSTGITTVGSLNY

SEQ ID NO: 136418 - protein, 56 aa, Glycine max
  Coding DNA Sequence Number=SeqID_19640
MAKYTAALLLLVLLVVAILNGSDASRRRLPEKDDLVPKDHHVSAEIENLSIAPTNP

SEQ ID NO: 136419 - protein, 71 aa, Glycine max
  Coding DNA Sequence Number=SeqID_19641
MPNIVNVSTSISIAGVLLSEACALSVSHVLSEALSPLSGLGESEKHMCAQRVISSLSEAFVSSCAKRAQLA

SEQ ID NO: 136420 - protein, 146 aa, Glycine max
  Coding DNA Sequence Number=SeqID_19642
  Gene Ontology: Mol. function=nucleic acid binding
  Homolog annotation: Hit_ID=Q1RSN0; Match level="QueryCoverage=76%, HitCoverage=18%, E-value=2e-11, Identity=32%"; Hit description=Zinc finger, CCHC-type
MDDCKFLQTKFENFKKDHYVECMKLQAELSYFKDLFGKLNKGKSDLNHMLSVRKNTTDKTSLGYNKQTSFSKKNQFASSKGANPNKVCLKARDSMWYLDSGCFGHMMDNKSKLANFVSKDGGCVTFGDNNKGKIMGEGNIGNQHKT

SEQ ID NO: 136421 - protein, 120 aa, Glycine max
  Coding DNA Sequence Number=SeqID_19643
MSLFSVGGGQETSYPSKNIWHSSWDRGKFPLVIEVYGNNQKLDNQINIDGKSFRNPKFSRAIRSSPKEERKRNGCAEIETRSQPQGTAGGKRRHLSSIASIGGQHRSNSIKGNRVGTFLV

SEQ ID NO: 136422 - protein, 497 aa, Glycine max
  Coding DNA Sequence Number=SeqID_19644
  Gene Ontology: Mol. function=triacylglycerol lipase activity; Biological process=lipid metabolic process
  Homolog annotation: Hit_ID=Q9C8G6; Match level="QueryCoverage=81%, HitCoverage=78%, E-value=1e-144, Identity=61%"; Hit description =Lipase, putative
  Pfam annotation: Domain name=Lipase_3; Domain location=215-364; Score= 183.2; E_value=6.3e-52; Accession=PF01764.16; Description=Lipase (class 3)
MALSTVRHNHFLATHEPGLNRFNMVRAQHHHVLLDHPKTKTPNRATRLAESLSHVLHLHIDPTSHKNLDLLSVHEEKHSTPTMSPRENISQKWREIQGYHNWEDILDPLQPWLRREIVKYGEFAQATYDAFDYDSFSEYCGSCRYNQNKLFEKLGLTRNSYTVTRYIYAMSHIELPRWLERSHVADTWSKDSNWIGFVAVSDDDETRRIGRRDIVVAWRGTVAPCEWYEDFQRKLDPIGHGDAKVEHGFLSIYKSKSETTRYNKSSASDQVMKEVTKLVNFYKGKKGEEVSLTITGHSLGGALALINAYEVATTFLDLPVSVISFGAPRVGNIAFKDELHQMGVKLLRVVVKQDWVPKMPGLLFNEKLKMFDEITGLEWVYTHVGAELALDVHSSPYLKGGMNLSGFHSLETYLHLIDGYLSHETPFRSEARRDIALVNKSCDMLVDELRIPHCWYQLANKGLVCNAHGRWVKPKRDNDDIPSHASEVFNAGLGVVM

SEQ ID NO: 136423 - protein, 252 aa, Glycine max
  Coding DNA Sequence Number=SeqID_19645
  Gene Ontology: Mol. function=protein kinase activity; Biological process=protein amino acid phosphorylation
  Homolog annotation: Hit_ID=Q9FWF0; Match level="QueryCoverage=71%, HitCoverage=35%, E-value=1e-78, Identity=76%"; Hit description =Protein kinase-like protein
MCQAALPVRGERLFLGLECDFKGRQQCYSFSRLALHEALAEPGVTFKFAFTCSLKNLKLYDMIFMHCRKLEKGLKVRSHIMLGIPKHEEAPSTPQRPLSAMGEACSRMDLTAIHQILVATHYRDDEGTNELSFQEWTQQMRDMLEARKRGDHAFRDKDFRTAIDNYSQFIDVGTMVSPTVFARRSLCYLLCDQPDPALRDAMQAQCVYPDWPTAFYMQSVALAKLDMHKDAADMLNEAAALEEKRQRGARGS

SEQ ID NO: 136424 - protein, 691 aa, Glycine max
  Coding DNA Sequence Number=SeqID_19646
  Gene Ontology: Mol. function=galactosyltransferase activity; Cellular component=membrane; Biological process=protein amino acid glycosylation
  Homolog annotation: Hit_ID=Q1SGZ2; Match level="QueryCoverage=99%, HitCoverage=100%, E-value=0.0, Identity=77%"; Hit description =Glycosyl transferase, family 31; Arginase/agmatinase/formiminoglutama se; Concanavalin A-like lectin/glucanase
  Pfam annotation: Domain name=Gal-bind_lectin; Domain location=193 -411; Score=132.2; E_value=1.5e-36; Accession=PF00337.12; Description= Galactoside-binding lectin
  Pfam annotation: Domain name=Galactosyl_T; Domain location=457-641; Score=57.9; E_value=3.4e-14; Accession=PF01762.12; Description =Galactosyltransferase
  Pfam module annotation: Pfam domain module=Gal-bind_lectin::Galactosyl _T; Domain location=193-411::457-641
MKRTKSDPPNSRRFRLSHFLFGIGVLYLLFVSCKFPQFLRIVSTLSGDGSEDRLEGAAVGDSEDSDLSKSFVSSVYKDAFHRRLEDNRDQEGAPLRPNTEPKKEEERLPESPKQIPLRYGRITGKIMREYKRTNDLSVLERMADEAWILGLKAWKEVDKVDEKGSMKNSVLDGKPESCPSWVSMNGDELIKGDSLMFLPCGLAAGSSITVVGTPHHAHKEYVPQLAKMKRGGGLVLVSQFMVELQGLKSVDGEDPPKILHLNPRIRGDWSRQPVIEHNTCYRMHWGTSQRCDGLPSGDEEEMLVDGYRRCEKWLRNDIIDSKESKTTSWFKRFIGREQKPEMTWPFPLVEGRMFVLTLRAGVDGYHINIGGRHVTSFPYRTFSPSNLQGFTLEDATGLAIKGDVDVHSIYATSLPTSHPSFSPQRVLEMSETWKASPLPKHPIKLFIGVLSASNHFAERMAVRKTWMQSAAIKSSDVVARFFVALNPRAEVNAVLKKEAAYFGDIVILPFMDRYELVVLKTVGISEFGIQNVTAAYVMKCDDDTFIRVDTVLEEIEKVPQGKSLYMGNLNLRHRPLRNGKWAVTYEEWPEEVYPPYANGPAYVISSDIVTFIRSQHKDRKLRLFKMEDVSMGMWVERYNNTIAAVQYSHNWKFCQYGCMEGYFTAHYQSPRQMICLWDKLSRGRARCCNFR

SEQ ID NO: 136425 - protein, 309 aa, Glycine max
  Coding DNA Sequence Number=SeqID_19647
  Gene Ontology: Mol. function=protein kinase activity; Cellular component=chloroplast; Biological process=protein amino acid phosphorylation
  Homolog annotation: Hit_ID=Q10S67; Match level="QueryCoverage=97%, HitCoverage=62%, E-value=1e-115, Identity=66%"; Hit description =Protein kinase family protein, putative, expressed
  Pfam annotation: Domain name=Pkinase; Domain location=61-294; Score= -15.4; E_value=1.2e-07; Accession=PF00069.15; Description=Protein kinase domain
  Pfam annotation: Domain name=Pkinase_Tyr; Domain location=74-294; Score=-83.9; E_value=2.5e-07; Accession=PF07714.7; Description =Protein tyrosine kinase
  Pfam module annotation: Pfam domain module=Pkinase::Pkinase_Tyr; Domain location=61-294::74-294
MGCCQSSTLLRVGERETHPEKEKEKDHQRLSEAEKEGFDFSFSEFSLAELKAATNNFSSDYIVSESGEKAPNLVYKGRLQNHSRWIAVKKFSKSAWPDPKQFVEEASGVGKLRHPRLAILIGFCCDGDERLLVAEYMPNDTLAKHLFHWETQTIEWAMRLRVALYIAQALHYCSSEGRPLYHDLNAYRVLFDQEGDPRLSCFGFMKNSRDGRVTPESVIYSFGTVLLDLLSGKHIPPSQALDMIQGKNNMLLMDSHLEGKFSTEEATVVVNLASKCLQYEPRERPDTKDLVTTLAPLHTKPDVQTPSLT

SEQ ID NO: 136426 - protein, 385 aa, Glycine max
  Coding DNA Sequence Number=SeqID_19648
  Gene Ontology: Mol. function=zinc ion binding
  Homolog annotation: Hit_ID=Q6H6V3; Match level="QueryCoverage=92%, HitCoverage=72%, E-value=1e-77, Identity=48%"; Hit description=Zinc finger (C3HC4-type RING finger) protein-like
  Pfam annotation: Domain name=zf-C3HC4; Domain location=254-301; Score= 62.2; E_value=1.7e-15; Accession=PF00097.15; Description=Zinc finger, C3HC4 type (RING finger)
MENRGESADAELQLDADFVPVPAQTCTGNEKSNKASRIPQSRRPNLSSLQIPAWSLDIALSTFAKTDGPSVSRSSPGSTRGLPPRPNSAKVRSSMRGLLPQRSFKINACSQDIERTGLIVPNTPPSDAPLDKPSTSTSLSLNNRVISPSTKVSHSLPVTPFATSSAENEHGRHLGRDSDLSTMEVHQHMTRSFSVPVDGKATNLRVTDSRGLIRVISAKRHLETVGGKSTDGAFVPEIAIEDATEDIPEEQAVCRICLVELGEGGNTLKMECSCKGDLALAHQECAVKWFSIKGNRTCDVCKLDVQNLPVTLLKIYNPLTPARQASNVPQQSEIVYYRIWQDVPVLILVSMLAYFCFLEQLLLLVGNSESITSSTGSLAIFSVYR

SEQ ID NO: 136427 - protein, 113 aa, Glycine max
  Coding DNA Sequence Number=SeqID_19649
  Gene Ontology: Mol. function=zinc ion binding
  Homolog annotation: Hit_ID=Q1EPH4; Match level="QueryCoverage=69%, HitCoverage=28%, E-value=2e-13, Identity=44%"; Hit description=Zinc finger (C3HC4 type RING finger) family protein
MEYTVKSVSRSFVWAYACFQFATLILLAHLNFNAILSILLSTFTGFGIAISMNSLVMEFIGWRTSRQVQSSFVNVNWTEQQHREHVQEQGQEDGGQHQRQRQQEHHLPQHGNS

SEQ ID NO: 136428 - protein, 61 aa, Glycine max
  Coding DNA Sequence Number=SeqID_19650
MDLRNKVGGDKGRVRHEGEREGDGHEGGGGAATCKRLEQRAMVVLWRGGGGVAELMRRCEK

SEQ ID NO: 136429 - protein, 70 aa, Glycine max
  Coding DNA Sequence Number=SeqID_19651
MEENTTGLHSEALLIHVSRGLSIKKSLENFLQRRRKKRSLEKSRSAGQSGLLHFLNEEGLIANPPSPQLC

SEQ ID NO: 136430 - protein, 343 aa, Glycine max
  Coding DNA Sequence Number=SeqID_19652
  Homolog annotation: Hit_ID=Q1T3X5; Match level="QueryCoverage=44%, HitCoverage=63%, E-value=1e-64, Identity=75%"; Hit description=Zinc finger, RING-type
  Pfam annotation: Domain name=zf-C3HC4; Domain location=65-102; Score =13.0; E_value=0.0072; Accession=PF00097.15; Description=Zinc finger, C3HC4 type (RING finger)
MVDQMWLLMGGKQASGTFMRLLGSLEKLDICKKSHSSIDGISYGKKMMEGDGKLINIDLEREDECGICLEPCTKMVLPNCCHAMCIKCYRKWNTRSESCPFCRGSLRRVNSEDLWVLTCNEDVVDAETVSKEDLLRFYLYINSLPKDHPDALFLMALFHQGYFIGSTSVACPLSSIRSDRNKELGGTRDLINQYRLWPYYEFFCKKSLPVSISETHYLHNVVGDTKIRKGEGMELDQLCKNTDTSEKKACLCPFDLDVLSEAFHMRDMNPVHLSSGLPNAVPKLENQSRDHERKNKKVKDKGEKYRKQKHRLHRVNNGSCIENIRIRPHDPHPLLQLKNQRGK

SEQ ID NO: 136431 - protein, 83 aa, Glycine max
  Coding DNA Sequence Number=SeqID_19653
  Gene Ontology: Mol. function=choline-phosphate cytidylyltransferase activity; Cellular component=endoplasmic reticulum membrane; Biological process=biosynthetic process
  Homolog annotation: Hit_ID=Q42622; Match level="QueryCoverage=88%, HitCoverage=24%, E-value=1e-28, Identity=83%"; Hit description =CTP:phosphocholine cytidylyltransferase
VKSVGRFKETKRTEGISTSDVIMRIVKDYNQYVLRNLDRGYSRNELGEKRLRVNRRLKTLQEKVKEHQEKVGEKELRMSGKVL

SEQ ID NO: 136432 - protein, 83 aa, Glycine max
  Coding DNA Sequence Number=SeqID_19654
MNPFHDNHTYDLVKFPKSKKVEQMNVKIVFFHDDLEEENCMKQPDSFQVERKKDYLYRLSKYLLFANNQSALILRDHFTTSNK

SEQ ID NO: 136433 - protein, 572 aa, Glycine max
  Coding DNA Sequence Number=SeqID_19655
  Gene Ontology: Mol. function=two-component response regulator activity; Cellular component=nucleus; Biological process=two -component signal transduction system (phosphorelay)
  Homolog annotation: Hit_ID=Q1T3X9; Match level="QueryCoverage=93%, HitCoverage=91%, E-value=0.0, Identity=63%"; Hit description =Response regulator, RegA/PrrA/ActR type
  Pfam annotation: Domain name=Myb_DNA-binding; Domain location=194 -244; Score=44.4; E_value=3.9e-10; Accession=PF00249.21; Description =Myb-like DNA-binding domain
  Pfam annotation: Domain name=Response_reg; Domain location=26-121; Score=42.6; E_value=1.3e-09; Accession=PF00072.14; Description =Response regulator receiver domain
  Pfam module annotation: Pfam domain module=Myb_DNA-binding::Response _reg; Domain location=194-244::26-121
MPLETGITVSVRDLYLSSTQAVHEVGLDWTIQKPELNKLRLHALKKLRERKEAYDIVISDVNMPDMDGFKLLEQVGLEMDLPVIMMSVDGETSRVMKGVQHGACDYLLKPIRMKELRNIWQHVFRKRMHEARDFESHEGFDFEGIHLMRNGSDHSDDGNLFAVEETTSIKKRKDADNKHDDKEFGDHFPTKKARVVWSVDLHQKFVKAVNQIGFDKVGPKKILDLMNVPWLTRENVASHLQKYRLYLSRLQKENDQKSSSSGIKHSDSPSKDLGSFSFLNTANKQQNDIATDSFSYSDGTLLIQMDATSYEGDLKGIVSEPTTEKRRASTSEIPDPKVQKSSQKSLNKPFTSVESSEANHAVFDCTIPTEYSWSEFPKGPLKEEQKTPVQLEDSLCQLPLHGTQHHIQIDQSQSIASINSNPSITEEEVAAKLETKPLYAGYESDYVNPVSSIGSAVEAFRSQSKSLMVSDQSSEPTFTSNLSLKTQGFNLDCISDLDFYQRNLLLGGEVASAPLDEDLNFFLLQSECYNMNFGLQNIDMSEYYDPRLTAEVPSHFYDSADYSSVDQSLFIA

SEQ ID NO: 136434 - protein, 477 aa, Glycine max
  Coding DNA Sequence Number=SeqID_19656
  Gene Ontology: Mol. function=transferase activity; Biological process= alkaloid metabolic process
  Homolog annotation: Hit_ID=Q1T3Y9; Match level="QueryCoverage=90%, HitCoverage=97%, E-value=5e-65, Identity=33%"; Hit description =Transferase
  Pfam annotation: Domain name=Transferase; Domain location=2-431; Score=281.3; E_value=1.9e-81; Accession=PF02458.6; Description =Transferase family
MEFISRETIKPSNPTPPHLRIHPLSFIDHIVFRNYIPLLFFYNSPNHEQASTISKLKKSLSQVLSRYYPFAGKLRDQVSIDCNDQGVSFLVTRLRCNLSTILQNPTEESLNPLFPDELQWKPMSSSSSSSIIAIQINCFACGGIAMSVCMCHKVGDAATLSNFINDWATLNRQKELEQETAELLLLPFPVPGASLFPQENLPVFPEVLFVENDTVCRRFVFEASKIDSLKSTVSSHNVPNPTRVEVVSALIYNRAVSALGLISKTTSFRTAVNLRTRTVPPLPEKSVGNLVWFLFVLSPWETELHELVLKMKQGLTEFCETYAKKFGGEDKDMSFISECLKQAASVPEPQPGGSDDEESQIVTMFCCASWCRFPMYEADFGWGKPVWFTTSKCPVKNSIVLMDTRDGGGIEAIVNMEEQDMARFERDVELLKYASLNPAVGHVEIVAARDSTDKNKDSNALVFAWGCIAQCNVYMNN

SEQ ID NO: 136435 - protein, 102 aa, Glycine max
  Coding DNA Sequence Number=SeqID_19657
  Gene Ontology: Mol. function=binding; Biological process=thiamin biosynthetic process
  Homolog annotation: Hit_ID=Q9LIE7; Match level="QueryCoverage=75%, HitCoverage=9%, E-value=4e-20, Identity=57%"; Hit description =Selenium-binding protein-like
METEKRIAGYHVLISNIYAEEGEWEKVDRVRNQMKEKGLQKEMGCSWVEIAGHVNFFVSRDEKHPQSGEIYYILDKLTMGMKDAGYKPRNNSNLNRILESSD

SEQ ID NO: 136436 - protein, 490 aa, Glycine max
  Coding DNA Sequence Number=SeqID_19658
  Gene Ontology: Mol. function=coproporphyrinogen oxidase activity; Cellular component=chloroplast; Biological process=porphyrin biosynthetic process
  Homolog annotation: Hit_ID=P35055; Match level="QueryCoverage=92%, HitCoverage=100%, E-value=0.0, Identity=84%"; Hit description =Coproporphyrinogen III oxidase, chloroplast precursor
  Pfam annotation: Domain name=Coprogen_oxidas; Domain location=110 -490; Score=784.2; E_value=7.6e-233; Accession=PF01218.9; Description= Coproporphyrinogen III oxidase
  Subcellular localization annotation: CTP_CleavageSite=33; ConfidenceScore=5.22e-01
MEKVRPAKRWEKGRKTLSSPNFIFRSLFGNQIRSMMHCASIVSAPSYAFPFLSGSASTTPTAISLTKRSWKPPPSMAKGPVRATVSIEKETPEANRPETFLRGVDEAQSSTSVRARFEKMIREAQDTVCSALEAADGGAQFKEDVWSRPGGGGGISRVLQDGAVWEKAGVNVSVVYGVMPPDAYRAAKGVPTDQKPGPVPFFAAGISSVLHPKNPFAPTLHFNYRYFETDAPKVKLLLSADAPGAPRQWWFGGGTDLTPAYIFEEDVKHFHSERFWQMLKDSAIKIQKQACDKFEPTFYPRFKKWCDDYFYIKALIINKQETNGGKWITAMTVGNNEMMGMGRRYVMQGKQDDDYAVMIMVVVVHRGERRGLGGIFFDDLNDYDQEMLLSFATECANSVIPAYLPIIEKRKDLPFNDHQKAWQQLRRGRYVEFNLVYDRGTTFGLKTGGRIESILVSLPLTARWEYDHKPEEGSEEWKLLDACINPKEWI

SEQ ID NO: 136437 - protein, 638 aa, Glycine max
  Coding DNA Sequence Number=SeqID_19659
  Gene Ontology: Mol. function=hydrolase activity; Cellular component =nucleus; Biological process=metabolic process
  Homolog annotation: Hit_ID=Q9LIE7; Match level="QueryCoverage=96%, HitCoverage=78%, E-value=0.0, Identity=58%"; Hit description =Selenium-binding protein-like
  Pfam annotation: Domain name=PPR; Domain location=159-193; Score =15.7; E_value=0.1; Accession=PF01535.11; Description=PPR repeat
  Pfam annotation: Domain name=PPR; Domain location=259-293; Score =13.0; E_value=0.22; Accession=PF01535.11; Description=PPR repeat
  Pfam annotation: Domain name=PPR; Domain location=361-395; Score =37.6; E_value=4.4e-08; Accession=PF01535.11; Description=PPR repeat
  Pfam annotation: Domain name=PPR; Domain location=463-497; Score =30.4; E_value=6.5e-06; Accession=PF01535.11; Description=PPR repeat
  Pfam annotation: Domain name=PPR; Domain location=54-88; Score=24.3; E_value=0.00043; Accession=PF01535.11; Description=PPR repeat
  Pfam annotation: Domain name=PPR; Domain location=564-598; Score =54.0; E_value=5e-13; Accession=PF01535.11; Description=PPR repeat
  Pfam module annotation: Pfam domain module=PPR::PPR::PPR::PPR::PPR::PP R; Domain location=159-193::259-293::361-395::463-497::54-88::564-598
MASSTVVPVPPVPVEGGKPSRGISIRSRLSKLCQEGQPHLARHLLDTLPRASTAVWNTVIIGFICNHMPLEALQLYAEMKSTPCTPSDCYTFSSTLKACSLTQNLMTGKALHSHLLRSQSNSRIVYNSLLNMYSSCLPPQSQHDYVLKVFAVMRKRNVVAWNTLISWFVKTHRHLHALRAFATLIKTSITPSPVTFVNVFPAVPDPKTALMFYALLLKFGADYVNDVFAVSSAIVLFSDLGCLDHARMVFDRCSNKNTEVWNTMIGGYVQNNCPLQGVDVFVRALESEEAVCDEVTFLSVISAVSQLQQIKLAHQLHAFVLKNLAATPVIVVNAIMVMYSRCNFVDTSFKVFDNMSQRDAVSWNTIISSFVQNGLDEEALMLVCEMQKQKFPIDSVTMTALLSAASNMRSSYIGRQTHAYLIRHGIQFEGMESYLIDMYAKSRLIRTSELLFQQNCPSDRDLATWNAMIAGYTQNELSDKAILILREALVHKVIPNAVTLASILPACSSMGSTTFARQLHGFAIRHFLDENVFVGTALVDTYSKSGAISYAENVFIRTPERNSVTYTTMIMSYGQHGMGKEALALYDSMLRCGIKPDAVTFVAILSACSYSGLVEEDMLGRVGRVVEAYEFVQRLRED

SEQ ID NO: 136438 - protein, 241 aa, Glycine max
  Coding DNA Sequence Number=SeqID_19660
  Gene Ontology: Mol. function=binding; Cellular component=signal recognition particle, endoplasmic reticulum targeting; Biological process=photosynthesis
  Homolog annotation: Hit_ID=Q5N842; Match level="QueryCoverage=92%, HitCoverage=29%, E-value=2e-44, Identity=46%"; Hit description =Putative signal recognition particle 72
MAPKAKPAPSQPAPPPALEDLFTTLNRHIQASAYDNAVKLTDQILAIAPGDEDALRCKVVALIKNDRVEDALSAIHSSKKQLDDFHFLKAQKLRKKEPKICRQHTSNQTQACKLLLSHWKISEAYCLYRQNKLDEALESLKRQESNDETMLLECQILYRLGKMDACLDIYRKFQNSKIDNMEINSVAALVMAGRSSEVQGMLDSLRVKATSSFELAYNTACSLIARNKYSDAEQLLLSGRR

SEQ ID NO: 136439 - protein, 535 aa, Glycine max
  Coding DNA Sequence Number=SeqID_19661
  Gene Ontology: Mol. function=nucleoside-triphosphatase activity; Cellular component=membrane; Biological process=proteolysis
  Homolog annotation: Hit_ID=Q50JE6; Match level="QueryCoverage=80%, HitCoverage=74%, E-value=1e-112, Identity=48%"; Hit description =Werner helicase interacting protein 1
  Pfam annotation: Domain name=AAA; Domain location=140-321; Score =64.5; E_value=3.4e-16; Accession=PF00004.19; Description=ATPase family associated with various cellular activities (AAA)
  Pfam annotation: Domain name=AAA_2; Domain location=136-253; Score= -51.7; E_value=0.079; Accession=PF07724.4; Description=ATPase family associated with various
  Pfam annotation: Domain name=AAA_3; Domain location=140-279; Score= -18.5; E_value=0.034; Accession=PF07726.2; Description=ATPase family associated with various
  Pfam annotation: Domain name=AAA_5; Domain location=140-274; Score= -4.2; E_value=0.0037; Accession=PF07728.4; Description=ATPase family associated with various
  Pfam annotation: Domain name=Bac_DnaA; Domain location=117-318; Score= -131.7; E_value=0.084; Accession=PF00308.9; Description=Bacterial dnaA protein
  Pfam annotation: Domain name=Mg_chelatase; Domain location=113-263; Score=-138.2; E_value=0.0027; Accession=PF01078.11; Description =Magnesium chelatase, subunit ChlI
  Pfam annotation: Domain name=ResIII; Domain location=122-237; Score= -35.7; E_value=0.045; Accession=PF04851.6; Description=Type III restriction enzyme, res subunit
  Pfam annotation: Domain name=Sigma54_activat; Domain location=116 -269; Score=-180.5; E_value=0.017; Accession=PF00158.16; Description =Sigma-54 interaction domain
  Pfam annotation: Domain name=UBA; Domain location=1-38; Score=28.2; E_ value=3e-05; Accession=PF00627.21; Description=UBATS-N domain
  Pfam module annotation: Pfam domain module=AAA::AAA_2::AAA_3::AAA _5::Bac_DnaA::Mg_chelatase::ResIII::Sigma54_activat::UBA; Domain location=140-321::136-253::140-279::140-274::117-318::113-263::122 -237::116-269::1-38
MEMQQLLSMGFPDELAAQALAATGGKSTVKATEWILSHKPNSSTFQPKLDRFFHSQSQEHDEPSKRPKPSPSPSPSPAQPQHWPSFFFKIADKKHANTHIHEPLYERLRPRTLDDVVGQEHLLAPNSLLRSAIQRNRLPSILLWGPPGTGKTTIAKAIVNSTPSTNSYRFVSLSAVTSGVKDVRDAVDEARKLRLKSNQTTVLFVDEVHRFNKSQQDSFLPVIEDGSIVFLGATTENPSFHLITPLLSRCRVLTLNPLQPHHLALLLNRAVTHTDKGLMQSVGVHVDVSEEVVDFISNNCDGDARVALNALEIAAVTAAARLQQGMELDLHTNEECKDDVAAAAAVVVSVADAKEALQCKHVAYDKAGEEHYNVISALHKSMRGSDANAAIYWLARMLEGGEEPLYIARRLIRFASEDVGLADPLALNQAVSCYQACHFIGMPECNVILAQCVAYLALAPKSVAVYRAIGAAQKAVRESAGHNEGVPLHLRNAPTKLMKDIGYGKGYIYTPDNPTATQTYLPPSLLGHKFLDWPE

SEQ ID NO: 136440 - protein, 661 aa, Glycine max
  Coding DNA Sequence Number=SeqID_19662
  Gene Ontology: Mol. function=transmembrane receptor activity; Cellular component=integral to membrane; Biological process=defense response to bacterium
  Homolog annotation: Hit_ID=Q9XGQ5; Match level="QueryCoverage=97%, HitCoverage=97%, E-value=0.0, Identity=80%"; Hit description =Putative transmembrane 9 superfamily protein member 2
  Pfam annotation: Domain name=EMP70; Domain location=60-619; Score =856.8; E_value=1e-254; Accession=PF02990.7; Description=Endomembrane protein 70
MGVPTWRKPVIYWVCLFVIINAFVQISNAFYLPGSYMHTYSNGDPIYAKVNSLTSIETELPYSYYSLPYCKPLGKIKKSAENLGELLRGDQIHNSPYLFHMNVNQSIYLCITTALNENEVKLLKQRTRDLYQVNMILDNLPVMRFANQNGIKIQWTGFPVGYTPPDGSADYIINHLKFTVLVHEYEGNGVEIIGTGEEGMGVISEADKKKVSGYEIVGFQVTPCSVKRDPEVMTKLHMYDNIYSTNCPSELDKYQPIKEQERISFTYEVEFVKSDIRWPSRWDAYLKMEGSRVHWFSILNSLMVIFFLAGIVFVIFLRTVRRDLTRYEELDKEAQAQMNEELSGWKLVVGDVFREPDGSKLLCVMVGDGVQILGMAAVTIVFAALGFMSPASRGMLLTGMIILYLFLGIAAGYVSVRLWRTIKGTSEGWRSISWLSACFFPGIAFIILTGLNFLLWGSKSTGAIPISLYFELLFLWFCISVPLTLIGGFMGTKAQQIEYPVRTNQIPREIPARKYPSWLLVLGAGTLPFGTLFIELFFILSSIWLGRFYYVFGFLLVVLLLLVIVCAEVSVVLTYMHLCVEDWQWWWKSFFASGSVALYVFLYSINYLVFDLQSLSGPVSAILYLGYSLLMAIAIMLSTGTVGFLMSFYFVHYLFSSVKID

SEQ ID NO: 136441 - protein, 221 aa, Glycine max
  Coding DNA Sequence Number=SeqID_19663
  Gene Ontology: Mol. function=acyltransferase activity; Cellular component=oxoglutarate dehydrogenase complex; Biological process =metabolic process
  Homolog annotation: Hit_ID=Q8PQ85; Match level="QueryCoverage=87%, HitCoverage=40%, E-value=2e-62, Identity=62%"; Hit description =Dihydrolipoamide acyltransferase
  Pfam annotation: Domain name=Biotin_lipoyl; Domain location=5-78; Score=76.2; E_value=1e-19; Accession=PF00364.12; Description=Biotin -requiring enzyme
  Pfam annotation: Domain name=E3_binding; Domain location=159-195; Score=41.1; E_value=3.7e-09; Accession=PF02817.7; Description=e3 binding domain
  Pfam module annotation: Pfam domain module=Biotin_lipoyl::E3_binding; Domain location=5-78::159-195
MSQTKNFNLPDLGEGLPDATIVEWFVKEGDVIKLDEPLVSMETAKAVVEVPSPFSGKVLKLSGGAGDIIPTGSVLASFELDPNLPQRADGQDTGHSHGHAAPAAAPTPPPLPAAAAPVAVEEAKPAAAERDDAGTVVGAMQSSNAVHAEQALAVGGVKAVPAVRAMARKLGVDLSRVAATGTDGAVTMADVKQAAANGTAKLGAAPAPVAAAAYAAPAPAQ

SEQ ID NO: 136442 - protein, 120 aa, Glycine max
  Coding DNA Sequence Number=SeqID_19664
MKLHHLAAFHIQLAGVVVAQGFGATLVQQLQPGDGRPSSAPIVGAYPGKRRPFLVTDTYFDDLAGVEPERIGILAAVSPQKAGPHVSRPPPRAWLQPRSAQRSAGTSFPGGTAECGCRSQ

SEQ ID NO: 136443 - protein, 168 aa, Glycine max
  Coding DNA Sequence Number=SeqID_19665
  Homolog annotation: Hit_ID=Q9SJ31; Match level="QueryCoverage=65%, HitCoverage=96%, E-value=3e-32, Identity=63%"; Hit description =Expressed protein
  Subcellular localization annotation: CTP_CleavageSite=41; ConfidenceScore=5.59e-01
MAAKLTLSSPFSFKTSFLPKSPSFSLGLYSPRTNVTGVKVHAKLGGGDEQAKKGGKKKFITREEEPQQYWQTAGEREGENPMKTPLPYIIIFGMSTPFVILAIAFANGWIKPSPGEELPFHFYISVPYFKAFKWLLMYVQVQPSKLPMIKPGHLPFGNWSVSEADGII

SEQ ID NO: 136444 - protein, 225 aa, Glycine max
  Coding DNA Sequence Number=SeqID_19666
MKKILVSIKFLLCLSLLCVLFLSFPLLLQSLKPSLMQFFSYMVEKSYMFLLCNGLLLVLIAINSAPINASSPPTTERAAVAVHIEEKSSQLESKEPDIAVAAPIAGEETESPHKEEKILVRVEQDNVLSDTQEEEEEKEEEEEEEEEEEEEEEEEEEEEEKEEEEEEEGNVLVIIDEDKHDTEELNKKCEDFIKRMKATFSSNNLELRAVDSFYFDNQKLPVAVN

SEQ ID NO: 136445 - protein, 109 aa, Glycine max
  Coding DNA Sequence Number=SeqID_19667
MGLISGNQFGPLRNNENSNKLQPKARLWSPMHQIKNCILSFPSDEKPKVLEENNDLVEEEYKTNSSSDSSILLIKILFTIPFDYLTIEIIIEQKNIAESSNGVNGRPGF

SEQ ID NO: 136446 - protein, 328 aa, Glycine max
  Coding DNA Sequence Number=SeqID_19668
  Gene Ontology: Mol. function=nucleotide binding; Biological process =fatty acid biosynthetic process
  Homolog annotation: Hit_ID=Q7XYX5; Match level="QueryCoverage=58%, HitCoverage=69%, E-value=4e-53, Identity=57%"; Hit description=AKIN beta4
  Pfam annotation: Domain name=AMPKBI; Domain location=242-328; Score= -0.1; E_value=0.0058; Accession=PF04739.5; Description=5'-AMP -activated protein kinase, beta subunit, complex-interacting region
MGSNSRGKDGEGTSGVKKDEYEQDIKFLPPEVLYGNTNGFTDPLVVQLPPHGPGPYEPPPPLLIQPQYIHEGKERNLIKAIRNKLPIKVGCFSTFSRLLLPFNSDLWNWNGTSKVPVAAMQMQRPAAVAQSLPQNGYVESVIHERLKSVRITWNHAATDVAIAGSWDNWKTTEPLMRVDQNFVIVKTLPIGIYHYRFIVDGYLTHAPEFPSASDDSGYGYNILDLQDYIPEIVANFSDFEDPPSPPSSYDNTYLNEEEFSKPPPELPPQLPVAIRHEASSSASGSRFVPRPTHLELNHLYIHKTDRGKDDEALRFLSAIELASSKLPL

SEQ ID NO: 136447 - protein, 1011 aa, Glycine max
  Coding DNA Sequence Number=SeqID_19669
  Gene Ontology: Mol. function=binding; Cellular component =intracellular; Biological process=metabolic process
  Homolog annotation: Hit_ID=Q9FIB2; Match level="QueryCoverage=92%, HitCoverage=93%, E-value=0.0, Identity=55%"; Hit description =Selenium-binding protein-like
  Pfam annotation: Domain name=PPR; Domain location=106-140; Score =40.9; E_value=4.4e-09; Accession=PF01535.11; Description=PPR repeat
  Pfam annotation: Domain name=PPR; Domain location=210-244; Score =34.1; E_value=4.7e-07; Accession=PF01535.11; Description=PPR repeat
  Pfam annotation: Domain name=PPR; Domain location=317-350; Score =15.3; E_value=0.12; Accession=PF01535.11; Description=PPR repeat
  Pfam annotation: Domain name=PPR; Domain location=422-456; Score =33.7; E_value=6.3e-07; Accession=PF01535.11; Description=PPR repeat
  Pfam annotation: Domain name=PPR; Domain location=626-660; Score =33.8; E_value=6.1e-07; Accession=PF01535.11; Description=PPR repeat
  Pfam annotation: Domain name=PPR; Domain location=727-761; Score =48.4; E_value=2.4e-11; Accession=PF01535.11; Description=PPR repeat
  Pfam annotation: Domain name=PPR; Domain location=762-796; Score=8.8; E_value=0.68; Accession=PF01535.11; Description=PPR repeat
  Pfam annotation: Domain name=PPR; Domain location=798-832; Score=7.1; E_value=1.1; Accession=PF01535.11; Description=PPR repeat
  Pfam module annotation: Pfam domain module=PPR::PPR::PPR::PPR::PPR::PP R::PPR::PPR; Domain location=106-140::210-244::317-350::422-456::626 -660::727-761::762-796::798-832
MILCYRRLLHNASHARSTQLALSEQLLHHCNSSHHHLHFPPLNLDYNRYRDSCTVEDAHQLHLQIYKTGLTSDVFWCNTLVNIFVRAGNLVSAQKLFDEMPQKNLVSWSCLVSGYAQNGMPDEACMLFRGIISAGLLPNHYAIGSALRACQELGPNMLKLGMEIHGLISKSPYASDMVLSNVLMSMYSHCSASIDDARRVFEEIKMKTSASWNSIISVYCRRGDAISAFKLFSSMQREATELNCRPNEYTFCSLVTVACSLVDCGLTLLEQMLARIEKSSFVKDLYVGSALVSGFARYGLIDSAKMIFEQMDDRNAVTMNGLMVGLARQHQGEEAAKIFKEMKDLVEINASSYAVLLSAFTEFSNLKEGKRKGQEVHAYLIRNALVDVWILIGNALVNLYAKCNAIDNARSIFQLMPSKDTVSWNSIISGLDHNERFEEAVACFHTMRRNGMVPSKFSVISTLSSCASLGWIMLGQQIHGEGIKCGLDLDVSVSNALLTLYAETDCMEEYQKVFFLMPEYDQVSWNSFIGALATSEASVLQAIKYFLEMMQAGWKPNRVTFINILSAVSSLSLLELGRQIHALILKHSVADDNAIENTLLAFYGKCEQMEDCEIIFSRMSERRDEVSWNAMISGYIHNGILHKAMGLVWLMMQKGQRLDDFTLATVLSACASVATLERGMEVHACAIRACLEAEVVVGSALVDMYAKCGKIDYASRFFELMPVRNIYSWNSMISGYARHGHGGKALKLFTQMKQHGQLPDHVTFVGVLSACSHVGLVDEGFEHFKSMGEVYELAPRIEHFSCMVDLLGRAGDVKKLEEFIKTMPMNPNALIWRTILGACCRANSRNTELGRRAAKMLIELEPLNAVNYVLLSNMHAAGGKWEDVEEARLAMRNAEVKKEAGCSWVTMKDGVHVFVAGDQTHPEKEKIYDKLKEIMNKMRDLGYVPETKYALYDLELENKEELLSYHSEKLAIAFVLTRQSELPIRIIKNLRIQIDFTILMVAYVLVRIIGD

SEQ ID NO: 136448 - protein, 221 aa, Glycine max
  Coding DNA Sequence Number=SeqID_19670
  Gene Ontology: Mol. function=zinc ion binding
  Homolog annotation: Hit_ID=Q9C8E1; Match level="QueryCoverage=89%, HitCoverage=31%, E-value=3e-50, Identity=48%"; Hit description=RING zinc finger protein, putative
  Pfam annotation: Domain name=zf-C3HC4; Domain location=87-144; Score =32.4; E_value=1.5e-06; Accession=PF00097.15; Description=Zinc finger, C3HC4 type (RING finger)
MCSDEIGDRPRPLPKIDELKGAVDVTERKGDPSWDYDPEKGCWLWKKPPPESKKPVDIKSENGTTIRVKRKAENVSVKERLLKEFGCQICRKVMASPLTTPCAHNFCKACLEGAFSGQSFIRNRACGGGRTLRAQKNVMKCPSCSNDIADFLQNPQVNREMLAVIESLQRQAEENSEELSDKNDENLHDPTEVSKPSDSTDKVLEEIKDNELNQPHKRRKE

SEQ ID NO: 136449 - protein, 97 aa, Glycine max
  Coding DNA Sequence Number=SeqID_19671
MSVLELYIEKDVVGGSAFHSANSVRSCENNLSNNESEPPRNVSNLHEDEDEDNNDYLVSNSYVEDSLDEDDSVDGISDTDDEVADMVQPVTIVQPRE

SEQ ID NO: 136450 - protein, 102 aa, Glycine max
  Coding DNA Sequence Number=SeqID_19672
  Gene Ontology: Mol. function=kinase activity
  Homolog annotation: Hit_ID=Q9FGW9; Match level="QueryCoverage=81%, HitCoverage=17%, E-value=2e-21, Identity=58%"; Hit description =Similarity to kinase
DDTLFKLRKLLDDYMLEKQKSQAKAGQCEMELLNESGFSNSSMQPCKDAGNEQVEEDVDIVGGNDPPISNYPSLEIENDVTKRNSKCSSSSSSSSESGSSSS

SEQ ID NO: 136451 - protein, 55 aa, Glycine max
  Coding DNA Sequence Number=SeqID_19673
MVKKSTLMKSTAMLFGRTAVLISVHPWSSYYLLVYAHDGLIFTFQGLSYNPFVNP

SEQ ID NO: 136452 - protein, 469 aa, Glycine max
  Coding DNA Sequence Number=SeqID_19674
  Gene Ontology: Mol. function=protein kinase activity; Cellular component=integral to membrane; Biological process=protein amino acid phosphorylation
  Homolog annotation: Hit_ID=Q6K2A4; Match level="QueryCoverage=95%, HitCoverage=67%, E-value=1e-167, Identity=62%"; Hit description=ABC1 family protein-like
  Pfam annotation: Domain name=ABC1; Domain location=246-366; Score =193.4; E_value=5.4e-55; Accession=PF03109.7; Description=ABC1 family
MAMQGCYCHYTKLATQRRTLENLSFSGSISVNKLSKNERTRTCDPLSAGNNQFHRLLVKMRQTEMPASKYGTNGKAVRMVGTNELVKRKRMLENKVLNGSATSKVVRKNGITGLNKTVKSRRSLEELKVLATDEGFSWANENYSSWQRSIDVWSFVASLRIRIMLDNAKWTYFGGFTEAKQKSRRRKTASWLRKCVLQLGPTFIKLGQLSSTRSDLFPREFVDELAKLQDMVPAFSPKKARKFIESELGAPINILFEEFEDRPIAAASLGQVHRAILHNGEKVVIKVQRPGLKKLFDIDLKNLKLIAEYFQRSETFGGPLRDWIGIYEECKTILYQEIDYINEGKNADRFRRDFRNIKWVRIPLVYWDYTALKVLTMEYVPGIKIDQVDTLTSRGYDRLRISSRATEAYLIQILKTGFFHADPHPGNLAIDVDEAIIYYDFGMMGQIKSFTRERLLELFYAIYEKDSKK

SEQ ID NO: 136453 - protein, 163 aa, Glycine max
  Coding DNA Sequence Number=SeqID_19675
  Gene Ontology: Mol. function=protein kinase activity; Cellular component=integral to membrane; Biological process=protein amino acid phosphorylation
  Homolog annotation: Hit_ID=Q6K2A4; Match level="QueryCoverage=98%, HitCoverage=22%, E-value=4e-57, Identity=68%"; Hit description=ABC1 family protein-like
MEYVPGIKIDQVDTLTSRGYDRLRISSRATEAYLIQILKTGFFHADPHPGNLAIDVDEAIIYYDFGMMGQIKSFTRERLLELFYAIYEKDSKKVMQRLIDLGALQPTGDLSSVRRSVQFFLDHLLSQAPDQEQTLSAIGEDKLKVENYSKLSGESSPDFIIDY

SEQ ID NO: 136454 - protein, 325 aa, Glycine max
  Coding DNA Sequence Number=SeqID_19676
  Gene Ontology: Mol. function=DNA binding; Cellular component=nucleus; Biological process=regulation of transcription
  Homolog annotation: Hit_ID=Q1RY17; Match level="QueryCoverage=90%, HitCoverage=66%, E-value=3e-84, Identity=61%"; Hit description =Homeodomain-related
  Pfam annotation: Domain name=Myb_DNA-binding; Domain location=159 -209; Score=22.2; E_value=0.0019; Accession=PF00249.21; Description =Myb-like DNA-binding domain
MEGNFSMATTTTTGDVDFGDLSEGNLLESINFDDLFVGIDINGDVLPDLEMFHEFSVDVNTGEESSEMNSSADNSKVENDQNVMINTGPKKEEEEDKASCNSSGQDLGSIRGEEIVSKRDESVVVNPAPKDGGKGRKSSSAQSKNNNSSNNAQGKRKVKVDWTPELHRRFVQAVEQLGVDKAVPSRILEIMGIDCLTRHNIASHLQWPKVSKKYRSHRKHLLAREAEAASWSQRRQLYAGGGKREGNPWLAPIMGFPPMTTPMHHFRPLHVWGHPSMSLVHMWPKHLSNSPPLLWPLSPPAVPPQDPSFWQQLVSSLNLTNQSNL

SEQ ID NO: 136455 - protein, 161 aa, Glycine max
  Coding DNA Sequence Number=SeqID_19677
VKFGDMRGYRMVIRTIRQPGANETVDAQRLTSSSVPFVNQGQANSLTRGDLHRLLCLCRPNPRRYRMVILIFRQQGANEPVDAQRLTSSSARFVIQGQGVRWQAEIPYGRLHLSSTKANEFDGIRMMSFTLIVWRHSSPMTHEILLCWAGTIKFDCVWKRC

SEQ ID NO: 136456 - protein, 71 aa, Glycine max
  Coding DNA Sequence Number=SeqID_19678
  Gene Ontology: Mol. function=metal ion binding; Cellular component =mitochondrial intermembrane space protein transporter complex; Biological process=protein import into mitochondrial inner membrane
  Homolog annotation: Hit_ID=Q9XH47; Match level="QueryCoverage=90%, HitCoverage=92%, E-value=2e-22, Identity=66%"; Hit description=Small zinc finger-like protein
  Pfam annotation: Domain name=zf-Tim10_DDP; Domain location=14-67; Score=16.4; E_value=0.00012; Accession=PF02953.6; Description =Tim10DDP family zinc finger
MASNISPAAFDKEQIFGMAEKEMEYRVELFNKYKESELNMGENSCIDRCVSKYWHVTNLVGQLLGSGRSPM

SEQ ID NO: 136457 - protein, 267 aa, Glycine max
  Coding DNA Sequence Number=SeqID_19679
  Gene Ontology: Mol. function=caffeate O-methyltransferase activity; Biological process=lignin biosynthetic process
  Homolog annotation: Hit_ID=Q43609; Match level="QueryCoverage=93%, HitCoverage=96%, E-value=8e-63, Identity=62%"; Hit description =Caffeic acid 3-O-methyltransferase
  Pfam annotation: Domain name=Dimerisation; Domain location=37-82; Score=30.8; E_value=4.9e-06; Accession=PF08100.2; Description =Dimerisation domain
  Pfam annotation: Domain name=Methyltransf_2; Domain location=4-242; Score=243.0; E_value=6.5e-70; Accession=PF00891.8; Description=O -methyltransferase
  Pfam module annotation: Pfam domain module=Dimerisation::Methyltransf_ 2; Domain location=37-82::4-242
NNIEEAVMGGNQKQQVVSDEEAFLFGMELAGASAVSMVLKSALELGILETIAKAGPGAYLSPSHIATTYLHTPSINCLMGLSDISSITMKKILETYNGFEGVGSVVDVGGGTGAIINMVASKYPTTKCVNFDLPHVIKEAPAYTGVEHISGDMFVSVPKGDVIFMKWVCHDWNDEQCLKLLKNCYDSLPDDTGKVILAEGISPETPDSNLAARCEFQMDVIMLCHSPNGKERTEKEYKALAKGAGFHGFRIASCVLNTHVMEFLKKA

SEQ ID NO: 136458 - protein, 181 aa, Glycine max
  Coding DNA Sequence Number=SeqID_19680
  Gene Ontology: Cellular component=integral to membrane; Biological process=transport
  Homolog annotation: Hit_ID=Q6YZD2; Match level="QueryCoverage=97%, HitCoverage=66%, E-value=5e-59, Identity=64%"; Hit description =Coated vesicle membrane protein-like
  Pfam annotation: Domain name=EMP24_GP25L; Domain location=1-54; Score= 31.7; E_value=2.5e-06; Accession=PF01105.14; Description =emp24gp25Lp24 family
MKQKVKGPSGEQIQDFRDKTSEKFDFVAHKSGVHKFCFTNKSPYHETVDFDVHVGHFSYFEQHAKDEHFTPLLEQIGKLEEALYNIQFEQHWLEAQTDRQAIDTIPKETTLLRTLLPISLTMFTVHCSLFTVEDIDYVNDAMSRRAVHKAIFESAALIGASALQVYLLQRLFERKLGTSRV

SEQ ID NO: 136459 - protein, 94 aa, Glycine max
  Coding DNA Sequence Number=SeqID_19681
MEFIRFGVVRPTAIGAIVDLLALPLIENLGLLALPQIFKDTEKLMVDRVDPCVESLIDNVEVERHISMAVAKGGASRDHLILMKQIAGIIPSMK

SEQ ID NO: 136460 - protein, 95 aa, Glycine max
  Coding DNA Sequence Number=SeqID_19682
  Homolog annotation: Hit_ID=Q1SJM7; Match level="QueryCoverage=57%, HitCoverage=4%, E-value=5e-10, Identity=58%"; Hit description=Cyclic peptide transporter
MVHDQSAIIIGHECPYSKDNNPLKPPKKRERERERRKTKTNKNQNLIDVVDESAAYIVRKTTNIVHNFAGGKQHQRGAYAITNGPKETKNHEEPV

SEQ ID NO: 136461 - protein, 100 aa, Glycine max
  Coding DNA Sequence Number=SeqID_19683
  Gene Ontology: Mol. function=ATPase activity, coupled to transmembrane movement of substances; Cellular component=integral to membrane; Biological process=transport
  Homolog annotation: Hit_ID=Q1SJN0; Match level="QueryCoverage=64%, HitCoverage=20%, E-value=1e-17, Identity=51%"; Hit description=ABC transporter, transmembrane region
MALVGGSGSGKSTAISLLQRFYDPIEAEIFLDGVAIQEEVVEVAKASNAHNFISQLPQGYDTQHEVLHSHPPIYLLPRTQVQDHHRIQTQQHTGSELSHS

SEQ ID NO: 136462 - protein, 99 aa, Glycine max
  Coding DNA Sequence Number=SeqID_19684
MRNGRAPQSALQRCEPPLVPLSRIRMSLHFFEMAHRSWHRRAHYAYSRCELNNGRWSFRERERGFDNGSQHADDVHQGERARFEGERGLRYRAPERGLS

SEQ ID NO: 136463 - protein, 211 aa, Glycine max
  Coding DNA Sequence Number=SeqID_19685
  Gene Ontology: Mol. function=Rab GTPase activator activity; Cellular component=intracellular; Biological process=regulation of Rab GTPase activity
  Homolog annotation: Hit_ID=Q6Z973; Match level="QueryCoverage=98%, HitCoverage=55%, E-value=2e-86, Identity=71%"; Hit description =GTPase activator protein-like
  Pfam annotation: Domain name=TBC; Domain location=1-142; Score=46.0; E_value=6.3e-11; Accession=PF00566.9; Description=TBC domain
MDLPRTFPGHPWLDTPEGHAALRRVLVAYSFRDSDVGYCQGLNYVAALLLLVMKTEEDAFWMLAVLLENVLKWKFRIATHLEALEFDVSLVTTEWFLCLFSKSLPSETTLRVWDVIFYEGAKVIFNVALAIFKMKEDELVITHHVGEVINILQITTHHLFDPDDLLTVAFDKIGSMTTNTISKQRKKQEPEVMKELDQRIRRLNSLRMEDK

SEQ ID NO: 136464 - protein, 111 aa, Glycine max
  Coding DNA Sequence Number=SeqID_19686
MVGYTPSSFADLVFTGERIKVGLERGISDHPALINAKTGANEEDENEGETLAMTAIPTRSNFPSAQQCHYSANICPSHYPPSSHPERPSLNQPQSLPAAHLVPKHQPKGIL

SEQ ID NO: 136465 - protein, 48 aa, Glycine max
  Coding DNA Sequence Number=SeqID_19687
MTYYVALKLGMSKTLLESITGQYQSMKLLSRQSYSLVVIPQPNQRKGQ

SEQ ID NO: 136466 - protein, 132 aa, Glycine max
  Coding DNA Sequence Number=SeqID_19688
MATADALERETKKAQKEEHDELKAYLRSKRNLSQQLSETEGNMWAVIDECKEKLNLAATHEQRLEDEYAKISAESEARERVIDSWHQEATMWTDRFALTLNRSQELPRLLAKAKAMADTYSAPKKIHGLLSY

SEQ ID NO: 136467 - protein, 302 aa, Glycine max
  Coding DNA Sequence Number=SeqID_19689
  Gene Ontology: Biological process=cell adhesion
  Homolog annotation: Hit_ID=Q1SJM1; Match level="QueryCoverage=82%, HitCoverage=97%, E-value=1e-76, Identity=65%"; Hit description=Beta -Ig-H3/fasciclin
  Pfam annotation: Domain name=Fasciclin; Domain location=53-185; Score= 115.1; E_value=2.1e-31; Accession=PF02469.12; Description=Fasciclin domain
  Subcellular localization annotation: CTP_CleavageSite=33; ConfidenceScore=5.32e-01
MEFSMIFIVSNIMLLFSSAFAKTASPPSLSPTPAPAPAPDFVNLTELLSVAGPFHTFLGYLESTKVIDTFQNQANNTEEGITIFVPKDSAFNAIKKTTLSNLTSNQLKQVILFHALPHFYSLAEFTSLSQTSSTPTFAGGDYTLNFTDDSGTVHINSGWSKTRVSSAVHSTDPVAIYQVDKVLLPEAIFGTDIPPAPAPAPTPDIAPAADSPTEHSADSKHHLHHPLMMAPLLTSSSAMESGPTLSWQLLYSFTQAGTIPITVIAETEVYIKVFMNWMHLSQMQIGFGGWTFTVPVGLLARS

SEQ ID NO: 136468 - protein, 561 aa, Glycine max
  Coding DNA Sequence Number=SeqID_19690
  Gene Ontology: Mol. function=actin binding; Cellular component =cytoskeleton; Biological process=establishment and/or maintenance of cell polarity (sensu Fungi)
  Homolog annotation: Hit_ID=Q9FKI0; Match level="QueryCoverage=86%, HitCoverage=93%, E-value=0.0, Identity=60%"; Hit description=Fimbrin- like protein 2
  Pfam annotation: Domain name=CH; Domain location=123-239; Score=93.9; E_value=4.7e-25; Accession=PF00307.21; Description=Calponin homology (CH) domain
  Pfam annotation: Domain name=CH; Domain location=268-370; Score =104.7; E_value=2.8e-28; Accession=PF00307.21; Description=Calponin homology (CH) domain
  Pfam annotation: Domain name=CH; Domain location=394-499; Score=77.6; E_value=4e-20; Accession=PF00307.21; Description=Calponin homology (CH) domain
  Pfam module annotation: Pfam domain module=CH::CH::CH; Domain location=123-239::268-370::394-499
  Subcellular localization annotation: CTP_CleavageSite=27; ConfidenceScore=5.09e-01
MSSFVGVLVSDQWLQSQFTQVELRTLKSKYVSERTQSGRVTVGNLPPIFKKLKGFSELFTEDEIKDALAESYQNMDEEIDFESFLRAHLNLQSRAIAKDGGSKSSSSFLKAATTTVHHAINESEKASYVAHINNYLAEDKFMSQFLPIDPSTNALFDLAKDGVLLCKLINIAVPGTIDDRAINTKRVLNPWERNENHTLGLNSAKAIGCTVVNIGTQDLIEGRPHLVLGLISQVIKIQLLADLNLKKTPQLVELVEDDKDVEELISLAPDKLLLKWMNFHLKKAGYEKQVTNFSSDLKDGEAYAYLLNALAPEVAGPSALATSDPTERANMVLEQAEKLDCKRYLTPKDIVEGSPNLNLAFVAQIFQHRNGLTTVDSQKMSFAEMMTDDAETSREERCFRLWINSLGIATYVNNVFEDVRNGWVLLEVLDKVSPASVNWKLATKPPIKMPFRKVENCNQVIKIGKELNFSLVNVAGNDIVQGNKKLLLENASSVLLCHASPSHPVALRIVNFEQITHFSNLSLNSTYPYPPNFYFEVSNKGAISFFVVDTTKFKFQKEDKI

SEQ ID NO: 136469 - protein, 227 aa, Glycine max
  Coding DNA Sequence Number=SeqID_19691
  Gene Ontology: Mol. function=Rho GDP-dissociation inhibitor activity; Cellular component=cytoplasm; Biological process=negative regulation of cell adhesion
  Homolog annotation: Hit_ID=Q9SFC6; Match level="QueryCoverage=99%, HitCoverage=95%, E-value=3e-94, Identity=73%"; Hit description=Rho GDP-dissociation inhibitor 1
  Pfam annotation: Domain name=Rho_GDI; Domain location=23-226; Score =69.7; E_value=9.3e-18; Accession=PF02115.7; Description=RHO protein GDP dissociation inhibitor
MGFDENKETGEKSDHANEEHYKSEGEPLSRHVNESSIHATEDEEDEVGSKLQLGPQCTLKEHLEKDKDDESLRRWKEQLLGSVDVNNVAEILDPEVNITCLSIISPDRDDIVLSIPENGNPKGLWFTLKEGCHYRLKFTFHVSNNIVSGLKYTNTVWKTGVKVDSSKEMLGTFSPQAEPYTHEMPEETTPSGLFARGSYSARSKFLDDDNKCYLEINYTFDIRKEWA

SEQ ID NO: 136470 - protein, 186 aa, Glycine max
  Coding DNA Sequence Number=SeqID_19692
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=O64761; Match level="QueryCoverage=50%, HitCoverage=30%, E-value=2e-31, Identity=73%"; Hit description =Putative phosphatidylinositol-glycan synthase
  Pfam annotation: Domain name=GPI2; Domain location=16-183; Score =120.8; E_value=3.7e-33; Accession=PF06432.2; Description =Phosphatidylinositol N-acetylglucosamin
MNPSLVNNSSPTHPRWRKVAYGGMQPGYDDNHTDESFLEGMVMNASVVKRDMLKVMLDSVSISEYLCIVALVVLVWTCTLASTIDENSLLLIDVGLLVSVAASLLILHLFLHDYSESTVKAPGVLKNPALTSCISVNASVVASVFIASRLPSRLHVFAIMLFSLQEYKFEINGPWDEAKLCFDITD

SEQ ID NO: 136471 - protein, 38 aa, Glycine max
  Coding DNA Sequence Number=SeqID_19693
MRMLGTVTTRAILDVSATLTLSAVVTLSEYDGKLALSV

SEQ ID NO: 136472 - protein, 493 aa, Glycine max
  Coding DNA Sequence Number=SeqID_19694
  Gene Ontology: Mol. function=catalytic activity; Biological process =cellular metabolic process
  Homolog annotation: Hit_ID=Q9C8J3; Match level="QueryCoverage=80%, HitCoverage=45%, E-value=3e-52, Identity=34%"; Hit description =Cinnamyl alcohol dehydrogenase, putative; 82967-79323
  Subcellular localization annotation: CTP_CleavageSite=34; ConfidenceScore=5.52e-01
MATAASRRPRWRHHAPPPPTPRILHFPRRRPSSRRDLKSNTTNRLWALIDRERRARVPIVVLDNNNNSSEGERRRERVESRSQSPKGWALEEEKWKFQAEMLRAECNLLRMEKEIAVKKLERTRVQMETTLRSALHTLVSVSAPSLFPTPYSLIVFISTLTKRSYNMIKAVCDEGRIKICEGKNVDMVLDEEIHELTLKLQRLHRRSKVKDLGARKNRNFDKQVSVLQRRLEQIGGSSDEIYLREFQEMENISLSIKRSSIVDDNVVASGKLNVEILRRKMEGLSKGILLQRMEEEYNSLLSTASSSLASSGSNSKRLEYQDSSSVRVPHQEKLFCEGNPCSGHCKTVVRRIVEQVRTETEQWSQMQEMLGKVQEWKEKALSSESKTNELEAELSVLRGDLRKEQTAAKGIKCSPTPVDTQNELEKRIVVCSSKEKNKVTENSKHNDVSRKAHGGRGGDGLLVPKRSPLRDIGNSSLLITQNLSSFVINHKSL

SEQ ID NO: 136473 - protein, 156 aa, Glycine max
  Coding DNA Sequence Number=SeqID_19695
MVSLFWNSAMIRGRDEVYAAAMPLRATKRPPQLLMSAAYSLNFWDFQHFMVIIKPSSPSQVLGFDFQPKDPEDIYVALAALNGRAVPGTVLPRNKCWLVGYSKAEADAVEIAREFNKEWETNLRIGLHDCHDYTNTLVWQLTGEKDVLKRLRNIGS

SEQ ID NO: 136474 - protein, 900 aa, Glycine max
  Coding DNA Sequence Number=SeqID_19696
  Gene Ontology: Mol. function=porin activity; Cellular component =integral to membrane; Biological process=transport
  Homolog annotation: Hit_ID=Q1SJK9; Match level="QueryCoverage=99%, HitCoverage=100%, E-value=0.0, Identity=76%"; Hit description =Peptidase S59, nucleoporin
  Pfam annotation: Domain name=Nucleoporin2; Domain location=34-201; Score=103.5; E_value=6.2e-28; Accession=PF04096.4; Description =Nucleoporin autopeptidase
MECDVGGVSDSCILHTCKRRRVYKGCFHPSIDIMTETEASLPILNSSGYYTKPSLKELVARELVEPGYCSRVPDFTVGRFGYGYVRYLNETDVRGLRIDEIVKFHRHEIVVYSDENDKPAVGQGLNKAAEVVLVLDSEILKSKEGKEDVMVSKLKQITKRQKAQFISFDLVTGEWKFLVGHFSRFGFGDDDEEDIAMDDAEVYDVEKESPSNTNELELSHSLPSHLRLDPVKMREMRLLMFPDEEEVEDLSCKSSSGKQYVRPLQSSAQAINHRSTPPVARKTPFPLLEYKHGNFDSNSPGGILMVQQHKGMPLRTIKSQGFKLDLKHETPVSGNYAHNIVDAGLFMGKSFRVGWGPNGILVHSGAPVGSSGNHKLLSSVVNLEKVAFDNVVRDENKKVTEELIDHALVSPLNFHKGINHVMKEVEIGPCKLTLQKLEANRSTLSEISHHYCDLIERQLSVPGLSSTTRLGLTHQVMTWELIRVLFSDREQKGQVESLGADNEEDMMQDIKEICQDVDREALPLMRRAEFSYWLRESVSYHVQNQISSLNDSDYLQHIFVLLTGRQLDEAVQLAVSKGDVRLACLLSQAGGSTVNRSDIARQLDIWRNKGLDFSFIEKDRLRLYELLAGNIHDALHDVKIDWRRFLGLLMWYKLPPNTSLPIAFQTYKHFVDEGTAPYPVPLFIDEGTSEEAMFSAFSSTPDPLDYHMIWHQRAVLEAVGVINSNDLHILDMSFVSQLLCVGKCHWALYVVLHLPLREDYPYLHVNLIREILFQYCETWSSDESQQQFIEDLGIPTDWMHEALDSLESKNAACQDFVSQLNESLAVWGCRLPVDARVVYSRMAGEICDLLLSGVGEGATRDEQFNCFDTAFSAPIPEDQRSGHLQDAVYLFTSYLSEIAT

SEQ ID NO: 136475 - protein, 176 aa, Glycine max
  Coding DNA Sequence Number=SeqID_19697
  Gene Ontology: Mol. function=hydrolase activity, acting on glycosyl bonds; Cellular component=cellular_component; Biological process =carbohydrate metabolic process
  Homolog annotation: Hit_ID=O82019; Match level="QueryCoverage=99%, HitCoverage=52%, E-value=2e-53, Identity=62%"; Hit description =Polygalacturonase precursor
MDMKLNIPAINVLFLLLAISSTTQSVDINIKKFGGGADITQALTKAWEEACAATSASKIVIPGGSYKMEAVDLKGPCMAPIEIQFDGTLQAPADPNALDGADEWLKVQHVNFFTLSGKGVFDGQGATAWKQNDCGTNKNCKKRSKGAITSHLMVSTSVLQIPVSTLTGFTLEDQLM

SEQ ID NO: 136476 - protein, 93 aa, Glycine max
  Coding DNA Sequence Number=SeqID_19698
  Homolog annotation: Hit_ID=Q5D1M2; Match level="QueryCoverage=38%, HitCoverage=4%, E-value=8e-10, Identity=83%"; Hit description=Class III HD-Zip protein 5
MKFLPVVEILKYRPLWFRDCQAVDVLNVLPTTNSGTIELLYKAYSTHLFYVMPGVSTRHSMGLLMRDGAQVILPLAHTIEHEEVINWPVLIMQ

SEQ ID NO: 136477 - protein, 331 aa, Glycine max
  Coding DNA Sequence Number=SeqID_19699
  Gene Ontology: Mol. function=protein binding; Cellular component=cell division site; Biological process=embryonic development via the syncytial blastoderm
  Homolog annotation: Hit_ID=Q2A9T4; Match level="QueryCoverage=95%, HitCoverage=99%, E-value=7e-89, Identity=49%"; Hit description=MO25 protein-related
  Pfam annotation: Domain name=Mo25; Domain location=2-316; Score =258.1; E_value=1.8e-74; Accession=PF08569.1; Description=Mo25 protein family
MKKALFKPKPKTPVELVRHARELIIFLDSKTCTRESKREEKLSDLSKTVLEIRTVLYGNGELEPNAEACSQITREFFKDDTFRLFILYLSNLNLGARQDATHVIANLQRQRINSQLIASQYLEKNLDLVDMLIDGTVLDKWLMKVDLISYEKEGDIALSYGAVARECIRHQSVARHILESEHMKKFFDYIQLPNFEIASDAVATFKELLTRHKSTVAEFLSKNYDWILSAKTFYCACQFFKEYNSQLLESTSYFTRRYAIKLFVANQNKPPEIVSILVTNKHKLLQFLDNFNSDKADEHFQADKQQVINEIITLEQEDRPCTSLDNCEVPC

SEQ ID NO: 136478 - protein, 52 aa, Glycine max
  Coding DNA Sequence Number=SeqID_19700
MPYKLYMENLNLCMKESWSISYLGNRVMETGVSQMKRYGEKDGLIDGFTLNI

SEQ ID NO: 136479 - protein, 297 aa, Glycine max
  Coding DNA Sequence Number=SeqID_19701
  Gene Ontology: Mol. function=dopamine beta-monooxygenase activity; Biological process=histidine catabolic process
  Homolog annotation: Hit_ID=Q9SJ74; Match level="QueryCoverage=98%, HitCoverage=76%, E-value=1e-117, Identity=66%"; Hit description =Expressed protein
  Pfam annotation: Domain name=DUF568; Domain location=1-140; Score =175.5; E_value=1.3e-49; Accession=PF04526.4; Description=Protein of unknown function (DUF568)
MTGTRALIAFPDPNSGQIVLLSYILDPTVKLQKSPLLSRPLDIHLLSSTAAMYGGKMATVHNGAAIQIFGTVKLQTNKTKIHLVWNRGLYVQGYSPTIHPTTSTDLASIATFDVLSGSSAPQHTDLTTLRVIHGTVNAISWGILLPMGAITARYLRHIQALGPAWFYAHAGIQLFGFVLGTVGFVIGIRLGQLSPGVEYRLHRKLGMAVFCLGALQTLALLFRPNTRNKFRKYWKSYHHFGFEVMGASRSYAKLTYCLGLSTLIGLCIALEVNSWVVFCRKSKEDKMRREGLIGTSH

SEQ ID NO: 136480 - protein, 135 aa, Glycine max
  Coding DNA Sequence Number=SeqID_19702
  Homolog annotation: Hit_ID=Q9SJ74; Match level="QueryCoverage=53%, HitCoverage=18%, E-value=8e-24, Identity=69%"; Hit description =Expressed protein
MPHPTHPEGDMKLPKKTSSKVELWGWNVHAMEACWVGRFMHFSKVFVAVSTVQWDDNAMWGREHTRERKDKVYVRLVEMGQCDRVLKFVSSGGSRGQYSISNEILLCRSSAATPFDYSHCLHEIRRLMFAYCAWL

SEQ ID NO: 136481 - protein, 78 aa, Glycine max
  Coding DNA Sequence Number=SeqID_19703
MNLNFSSLGEDNPVKQVNCEFCTPLLLLNFGFKTQDVWFSRANWSACFEGSDIEIDYKGMLRLEFLSYCLGLWDLSEM

SEQ ID NO: 136482 - protein, 149 aa, Glycine max
  Coding DNA Sequence Number=SeqID_19704
  Homolog annotation: Hit_ID=Q6CQF3; Match level="QueryCoverage=37%, HitCoverage=59%, E-value=1e-07, Identity=72%"; Hit description =Kluyveromyces lactis strain NRRL Y-1140 chromosome D of strain NRRL Y- 1140 of Kluyveromyces lactis
LVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGTAQPEVGPAAGEHRTS

SEQ ID NO: 136483 - protein, 141 aa, Glycine max
  Coding DNA Sequence Number=SeqID_19705
  Gene Ontology: Mol. function=structural constituent of ribosome; Cellular component=ribonucleoprotein complex; Biological process =translation
  Homolog annotation: Hit_ID=Q2QD65; Match level="QueryCoverage=67%, HitCoverage=74%, E-value=2e-37, Identity=84%"; Hit description =Ribosomal protein S12
  Pfam annotation: Domain name=Ribosomal_S12; Domain location=15-140; Score=149.5; E_value=8.9e-42; Accession=PF00164.15; Description =Ribosomal protein S12
MGQILQDQTLWELRNDGRKEIKKKWDKRIDREKDFLFLLEDRDWIHICLSGSKGDLSVNFSTITPKKPNSALRKVARVRLTSGFEITAYIPGIGHNLQEHSVVLVRGGRVKDLPGVRYHIVRGTLDAVGVKDRQQGRTSAL

SEQ ID NO: 136484 - protein, 52 aa, Glycine max
  Coding DNA Sequence Number=SeqID_19706
MHMTQMQFTNTGARETVSFLDTTSRGSKVPQQGIKTEPMCDAYAKGATRECI

SEQ ID NO: 136485 - protein, 191 aa, Glycine max
  Coding DNA Sequence Number=SeqID_19707
  Gene Ontology: Mol. function=helicase activity; Cellular component =membrane; Biological process=viral genome replication
  Homolog annotation: Hit_ID=Q1SN45; Match level="QueryCoverage=97%, HitCoverage=11%, E-value=2e-55, Identity=56%"; Hit description=AAA ATPase
  Pfam annotation: Domain name=DUF889; Domain location=1-105; Score= -28.1; E_value=1.4e-09; Accession=PF05970.5; Description=Eukaryotic protein of unknown function (DUF889)
MEYLSSDSVDKSETNEDSYFQSITTKFLNSLNTSGLPTHSIKLKIGSPIMLLRNLDQNQGLCNGIRLVVTKMTKHVIAAEIISGKNIDLAVYIPRMSMSPSQSPWPFKLLKRQFPIMLSYAMAINKSQGLLLSMVGLYLPKPVFTHGQLYVALLRVNSTKGLKILIHDDEQKSMNSTTNVVFKEVFRNIKR

SEQ ID NO: 136486 - protein, 218 aa, Glycine max
  Coding DNA Sequence Number=SeqID_19708
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q874L9; Match level="QueryCoverage=88%, HitCoverage=33%, E-value=9e-45, Identity=43%"; Hit description=GUP1
  Pfam annotation: Domain name=MBOAT; Domain location=2-169; Score =55.3; E_value=2e-13; Accession=PF03062.9; Description=MBOAT family
MIDVPQNTNSVRNVTLNGFRWVLNFMWLKFLLIWRFFRFWSLINGIETPENMPKCINNCHNLEGFWKNWHASFNKWLVRYIYIPLGGSKKKLLNVWVVFTFVAIWHDLEWKLLSWAWLTCLFFIPELVLKSAAKAFQAQSSFGECIFRELSAVAGAVTITCLMVANLVGFVVGPTGINWLLSSFLNNNGLPVLGGMLMTFYVGTKIMFHIDEAKQRSP

SEQ ID NO: 136487 - protein, 65 aa, Glycine max
  Coding DNA Sequence Number=SeqID_19709
MGLNFEGMHKLNTDDSSRGNLGPSDFGGVIKDCLERHLFPSSCFNYKENSSLLELAVGITLSTLI

SEQ ID NO: 136488 - protein, 419 aa, Glycine max
  Coding DNA Sequence Number=SeqID_19710
  Gene Ontology: Mol. function=signal transducer activity; Cellular component=membrane; Biological process=response to light stimulus
  Homolog annotation: Hit_ID=Q9LUB9; Match level="QueryCoverage=99%, HitCoverage=63%, E-value=1e-125, Identity=55%"; Hit description =Similarity to bZIP transcription factor
  Pfam annotation: Domain name=BTB; Domain location=30-132; Score=4.1; E_value=0.0017; Accession=PF00651.21; Description=BTBPOZ domain
  Pfam annotation: Domain name=NPH3; Domain location=216-419; Score= -16.0; E_value=1.8e-09; Accession=PF03000.5; Description=NPH3 family
  Pfam module annotation: Pfam domain module=BTB::NPH3; Domain location= 30-132::216-419
MEVVSPKDYSVASSPYSSPNIGALLKIKVITWSQQTGLPVSVRVRVKDKIFSLHKFPLTSKSGYFKKRLNDASDVELPETFPGGPETFEMIAMFVYGSSTLIDPFNVVALRCAAEFLEMTEDHCSGNLCERFDLYLNQVVLQSWDDTLIALQRCQMLLPWSEDLLIVSRCIESLAFMACMEVLDPERRRDTPVVTVEELASQDWSCEIIKDDAVSQDLWMRDLIALPFGFFKRVIGSLRKQGMKEKYVSPIIVFYANKWVLSKKTRQFWESSCDKIGEGGMNSKASVILQGVVDLLPVGDKARKVIPVGFYFALLSRSLELGLTTESKAKLQDQITSLLHFSQVENFLLPESGAKLMSSSMELVTMESIISAYVASSSRVNQTPEASNYRVAELWDAYIFNIAADPDMGPKRFMELIER

SEQ ID NO: 136489 - protein, 130 aa, Glycine max
  Coding DNA Sequence Number=SeqID_19711
  Homolog annotation: Hit_ID=Q1T5K4; Match level="QueryCoverage=71%, HitCoverage=8%, E-value=1e-07, Identity=34%"; Hit description=RNA -directed DNA polymerase
MEERRGENGEFTSNLQEAKQFNNFIEGMMLVEPPFAGRMVNGFMPVRGFKDFVKERYNQGWPKGPVVQAWRSFVLKEKLNRLKAYIKVWSKENYDDLEGTCNECRARIESLDLKAEQQGLSEEDVLEKGV

SEQ ID NO: 136490 - protein, 500 aa, Glycine max
  Coding DNA Sequence Number=SeqID_19712
  Gene Ontology: Mol. function=molecular_function; Cellular component =nucleus; Biological process=nervous system development
  Homolog annotation: Hit_ID=Q656K0; Match level="QueryCoverage=93%, HitCoverage=90%, E-value=1e-154, Identity=61%"; Hit description =Putative ES2 protein
MLQSPGHSPLHISSPSPSISQESAQKPNDPPSSSCAKHPAVLDEDTYVEALEKIIERDYFPDISKLRDRLDWLEAIKTGDPVVIREAQLKILERRAGTAKVTNHNDTSRTTSHTPGSTFVRNFTPLDEFDGKPSQTPRAPAPEAKEGENNDGGVDTSLGLDQFMRRYTSEDNHSFSKILEKVNKKRKERFGYLNEDVQGIEDVKRDRITDGYGTSYQPPSTLEGWNYTAKNLLMYHPADRGEVPLTEEERAHRIKAATKEINRGNTRFHGKMMDSRPKDDGTVEVLYTPVGGATPAPMSLREGDKLKKYDLEDLRKTPNPFYLESRKKAENGYSFVKTPSPAPGVDESPFITWGEIEGTPLRLDLEDTPLDIGGSADGPHYKIPSAPARDSKAHSLSREAARKIRERSKMFHKPPLASPVRGGSASPSMRTLSPAAQKFVRNAFAKSSSSVDETLRASYRGSTPALATPRSVSRSVSRFGRDGSLASRSPSVREGSNPPL

SEQ ID NO: 136491 - protein, 535 aa, Glycine max
  Coding DNA Sequence Number=SeqID_19713
  Gene Ontology: Mol. function=sequence-specific DNA binding; Cellular component=nucleus; Biological process=regulation of transcription, DNA-dependent
  Homolog annotation: Hit_ID=Q9SI37; Match level="QueryCoverage=66%, HitCoverage=73%, E-value=2e-63, Identity=40%"; Hit description=WRKY transcription factor 1
  Pfam annotation: Domain name=WRKY; Domain location=113-171; Score =114.7; E_value=2.7e-31; Accession=PF03106.6; Description=WRKY DNA -binding domain
  Pfam annotation: Domain name=WRKY; Domain location=316-375; Score =142.2; E_value=1.4e-39; Accession=PF03106.6; Description=WRKY DNA -binding domain
  Pfam module annotation: Pfam domain module=WRKY::WRKY; Domain location=113-171::316-375
MVSTDKSADQNIPSDELQQRVSPDSDTTLSQGHDTKNDLSKPEEATSILSIVVKNEEGKDSDATACALESDQEGSTCSLPLGKPLQSPDTLSHEFPRLQSSQECPSIIREKVSKDGYNWRKYGQKHVKGNEFIRSYYKCTHPNCQAKKQLQQSNNGHITDSICIGQHNHPRPQLNSTVSVECVLPVVEQAPHKPSLANVEGEQYTLSVLLFLCLCRKDLNVFFDIIHEDKASVEHGCMPQQIKPLQSFPPAKVSPVNELKAAHLQLTKAKNQLTFTAKLIPSRKKDNSNADVARVDMSTRESRVVVVQTSSEVDLVNDGYRWRKYGQKLVKGNTNPRSYYRCSNPGCPVKKHVERASYDSKTVITTYEGQHDHEIPPGRTVTQNAATNTRTTATNGKAGTKSEGNTDDTGERSGLGLTSRLTEQQTGKSTTKSKAGDMVEFRVIRLSNEGPEIKLSEQQQQKDNSATKDDSVSNDVICHSSSGVLCRSNEQLKGEVKPISEGSKDCLKVVAVHDTPSTESEFNKQSAADAEPVQS

SEQ ID NO: 136492 - protein, 297 aa, Glycine max
  Coding DNA Sequence Number=SeqID_19714
  Gene Ontology: Mol. function=protein kinase activity; Cellular component=cytoplasm; Biological process=protein amino acid phosphorylation
  Homolog annotation: Hit_ID=Q1SS77; Match level="QueryCoverage=97%, HitCoverage=95%, E-value=1e-133, Identity=75%"; Hit description =Protein kinase
  Pfam annotation: Domain name=Pkinase; Domain location=26-284; Score =172.0; E_value=1.5e-48; Accession=PF00069.15; Description=Protein kinase domain
  Pfam annotation: Domain name=Pkinase_Tyr; Domain location=27-282; Score=33.4; E_value=1.6e-14; Accession=PF07714.7; Description =Protein tyrosine kinase
  Pfam module annotation: Pfam domain module=Pkinase::Pkinase_Tyr; Domain location=26-284::27-282
MPAEKSNSCDSEVEAFVEVDPTGRFGRYSDLLGCGAVKKVYSAFDQEEGIEVAWNQVRLRNFSEDPVLINRLHSEVELLRTLSNKYIIVCYSVWKDEERHNINFITEVCTSGNLRDYRKKHRHVSIKVFKKWSKQVLEGLEYLHTHDPCIIHRDLNCSNIFVNGNIGQVKIGDLGLAAIVGRNHAAHSILGTPEYMAPELYEEDYTEMVDIYSFGMCLLEMVTTEIPYSECDSVAKIYKKVTMGIKPEALSKVTDPEVKEFIEKCIAQPRARPSATDLLKDPFFYELNNDEESTPIN

SEQ ID NO: 136493 - protein, 133 aa, Glycine max
  Coding DNA Sequence Number=SeqID_19715
  Gene Ontology: Cellular component=nucleus; Biological process =regulation of transcription, DNA-dependent
  Homolog annotation: Hit_ID=Q9LDL7; Match level="QueryCoverage=85%, HitCoverage=29%, E-value=3e-24, Identity=47%"; Hit description =SCARECROW gene regulator-like
MQMVGNKLSKLAEDFKVLFEFDVVAIFACDVQLQNLRVQSRVALAVNFAFMLHQMPDESVIAESNTDIFEFFPRLPETLDYYYKAMFESIDVNVTPSVEQHCLARDIVNNIACEEWKVQNFRNVDQMGFQTHP

SEQ ID NO: 136494 - protein, 1234 aa, Glycine max
  Coding DNA Sequence Number=SeqID_19716
  Gene Ontology: Mol. function=transferase activity, transferring phosphorus-containing groups; Cellular component=membrane; Biological process=two-component signal transduction system (phosphorelay)
  Homolog annotation: Hit_ID=Q9C5U2; Match level="QueryCoverage=90%, HitCoverage=95%, E-value=0.0, Identity=59%"; Hit description =Histidine kinase
  Pfam annotation: Domain name=CHASE; Domain location=344-568; Score =301.0; E_value=2.2e-87; Accession=PF03924.4; Description=CHASE domain
  Pfam annotation: Domain name=HATPase_c; Domain location=741-909; Score=125.4; E_value=1.6e-34; Accession=PF02518.16; Description =Histidine kinase-, DNA gyrase B-, and HSP90-like ATPase
  Pfam annotation: Domain name=HisKA; Domain location=629-694; Score =84.8; E_value=2.7e-22; Accession=PF00512.15; Description=His Kinase A (phosphoacceptor) domain
  Pfam annotation: Domain name=Response_reg; Domain location=1085-1220; Score=102.9; E_value=9.2e-28; Accession=PF00072.14; Description =Response regulator receiver domain
  Pfam module annotation: Pfam domain module=CHASE::HATPase _c::HisKA::Response_reg; Domain location=344-568::741-909::629 -694::1085-1220
NLREDDGHCDIVPLLMLLLGVQYHKAPNFMCPEGWIAEKIFGTVTLVNLARMSVNRRLPASNGRLLSNMKSWKLNEPLNGSNSPRTWSVWFILSFNSKYLVSKENEAICEERERALLQRYNVSRKQIHALASLFSGSDQKTVVVAEMNMNSNKVVLFVLCLTKFIMQILSNCIDERRLQMLLSSGMVSTPQLICPENQELQKVHTCVADTVEPIEQCPVLNDCVQTRLELSFPLKSYVSLASHSALPTDLVSYLHRGKNIVQSWELRVSAIRNQKQKLVQGHPAAQQKCLKHFPRGPSRGAGREETLANMCDERARMLQDQFNVSMNHVHALAILVSTFHHGKHPSAIDQKIFGEYTESTAFERPLTSGVAYALKVLHSDRMHFEKQHGWTIKKMETENEALVQDCIPENLDPAPIQDEYAPVIFAQETVSHIVSIDMMSGKEDRENILRARASGKGVLTSPFKLLKSNHLGVVLTFAVYNTNLPLDATLEQRIEATVGYLGASYDVPSLVDKLLHQLASKQTIVVNVYDTTNASAPITMYGTDVADTGLLYISSLDFGDPLRKHEMHCSFKQRPPLPWTAINASVGVFVITLLLGHIFYAAINRIAKVEDDYRQMRELKVRAEAADVAKSQFLATVSHEIRTPMNGVLGMLQMLMDTELDENQMDCAQTAHKSGKDLISVISEVLDQAKIEAGKLELEAVAFDPRAILDEILSLFSEKSNEKGIELAVYASNQVPKVVIGDPKRFRQIITNLVGNSLKFTHDKGHVFVSVHLANEVKNPLHIMDAVLREGLNLNQDISNRTYDTLSGFPVCNRWKSWANFKQLSGINEPEIIQLLVIVEDTGIGIPTDAQSRIFTPFMQADSSTSRTYGGTGIGLSISKCLVDLMGGEIGFVSEPGIGSTFSFTGTFRKGESTSLDAMQQNNHFGSEFQGLRTLVVDSRKIRAEVTRYHLQRLGMSVDVTYSLNSACSCLSNVCNKSMSTQLAMILIDKDAWDKECHILYTIKKRRQNGIKGDPMNLPKIFLLATHLSSNEQDGLKSVGIIDDILMKPLWLSSLIQCYRVSLGTENKRVNRKKVSKLGNLLIDKQILVVDDNAVNRRVAKGVLQKYGAKVTAVESGRAALKMLKLPHNFDACFMDLQMPEMDGFEATRQIRCLESEVNEKIACGQASAEMFGSISYWHIPILAMTADSTQSSNEECIKCGMDDYVSKPFEEEKLYMAMARFFKGQDGKGMTDL

SEQ ID NO: 136495 - protein, 622 aa, Glycine max
  Coding DNA Sequence Number=SeqID_19717
  Homolog annotation: Hit_ID=Q1RT73; Match level="QueryCoverage=96%, HitCoverage=97%, E-value=0.0, Identity=66%"; Hit description=IMP dehydrogenase/GMP reductase
MACNCKSPLTSYQSSAWIPLKKMELNDSRHAISKDLDYDAKRLSLIRQIDFAWAVEKDEEKKKQKSSRETSTTWQWQDLVENLQLAHQELSVIIDLINIVEANDAVTVASMTRPKLLPNEALSDRAVSAAIKLQCYRHVGKYFKQSAKAFEQQVAREARFYGALIRLQQNWKVKRQRQAAIVPGNEGFTFDLFDNSYDQAAIIRSLSMSTVRVNHDAAGMLAINVSPDLCHSLQLGFVGVQTDDTRRKSNENKSQFSGEHNLGETGEESLSDEECVKKAHSLLREVHEAIFNEQPYPCIYKEAVSGFEPMTNRSPRHNFTAAPGLALLSNSICYEIDIQQIFLEHIFGKGGEKPISVGNRLSGVQEKDGSSLLGHFLKSLAHRIFSTKVLAELENVVCKVPYLQLISNPTWHSRAWSWTLYMEVPQSILRGSQTKTSDYYEKNDGKRQFWTKLVVNDDCINVKAEGSPNVAGLFKGKFEETHSINKYNCNLADLPVIIMQQINKLITAIEIMQVASQIINRLYQEAMVVGIKANRDFLCLSFELEQGETLGLVASVVDPENSEGCISWWLVMEDSFAEEQKLHMSITDGASEYRKFLGHLSLDLLYTTLIDLVGLCSGGGGQ

SEQ ID NO: 136496 - protein, 367 aa, Glycine max
  Coding DNA Sequence Number=SeqID_19718
  Gene Ontology: Mol. function=ligase activity; Cellular component =nucleus; Biological process=regulation of transcription
  Homolog annotation: Hit_ID=Q9SCP4; Match level="QueryCoverage=94%, HitCoverage=79%, E-value=1e-135, Identity=42%"; Hit description =Nodulin / glutamate-ammonia ligase-like protein
  Pfam annotation: Domain name=PPR; Domain location=100-134; Score =29.4; E_value=1.3e-05; Accession=PF01535.11; Description=PPR repeat
  Pfam annotation: Domain name=PPR; Domain location=136-170; Score =30.3; E_value=6.7e-06; Accession=PF01535.11; Description=PPR repeat
  Pfam annotation: Domain name=PPR; Domain location=171-205; Score =32.6; E_value=1.4e-06; Accession=PF01535.11; Description=PPR repeat
  Pfam annotation: Domain name=PPR; Domain location=206-240; Score =39.6; E_value=1.1e-08; Accession=PF01535.11; Description=PPR repeat
  Pfam annotation: Domain name=PPR; Domain location=241-275; Score =23.3; E_value=0.00086; Accession=PF01535.11; Description=PPR repeat
  Pfam annotation: Domain name=PPR; Domain location=276-310; Score =34.4; E_value=3.8e-07; Accession=PF01535.11; Description=PPR repeat
  Pfam annotation: Domain name=PPR; Domain location=29-63; Score=14.5; E_value=0.14; Accession=PF01535.11; Description=PPR repeat
  Pfam annotation: Domain name=PPR; Domain location=311-345; Score=4.0; E_value=2.5; Accession=PF01535.11; Description=PPR repeat
  Pfam annotation: Domain name=PPR; Domain location=65-99; Score=25.5; E_value=0.00019; Accession=PF01535.11; Description=PPR repeat
  Pfam module annotation: Pfam domain module=PPR::PPR::PPR::PPR::PPR::PP R::PPR::PPR::PPR; Domain location=100-134::136-170::171-205::206 -240::241-275::276-310::29-63::311-345::65-99
MMLGKCRQPEEASLLFEIMLSEGLKPTVDVYTALVSAYGQSGLLDQAFSTVEDMKSVVDCEPDVYTYSILIRCCAKFRRFDLIEHVLAEMSYLGIKCNCVTYNSIIDGYGKASMFEQMDDALNDMIENGNSHPDVFTLNSFVGAYGNAGQIDKMEKWYDEFQLMGIKPDITTFNTMIKSYGKAGMYEKMKTVMDFMEKRFFTPTIVTYNTVIEVFGKAGEIEKMDQHFLKMKHLGVKPNSITYCSLVSAYSKVGCIDKVDSIMRHVENSDVVLDTPFFNCIISAYGQAGNLKKMGELFLAMRERKCEPDNITFACMIQSYNTQGMTEAVQNLENMMISAKSSLGMLCYLFFDAFSMFSMFRPSYCAW

SEQ ID NO: 136497 - protein, 47 aa, Glycine max
  Coding DNA Sequence Number=SeqID_19719
MRCLVMMPRRASSNINITQWDKEGNDNEIVNTSTIDDISKNDGFQAL

SEQ ID NO: 136498 - protein, 278 aa, Glycine max
  Coding DNA Sequence Number=SeqID_19720
  Gene Ontology: Mol. function=unfolded protein binding; Cellular component=mitochondrion; Biological process=protein folding
  Homolog annotation: Hit_ID=Q9S7E7; Match level="QueryCoverage=88%, HitCoverage=31%, E-value=2e-82, Identity=64%"; Hit description =Putative heat-shock protein
  Pfam annotation: Domain name=HATPase_c; Domain location=117-278; Score=40.7; E_value=5e-09; Accession=PF02518.16; Description =Histidine kinase-, DNA gyrase B-, and HSP90-like ATPase
  Subcellular localization annotation: CTP_CleavageSite=35; ConfidenceScore=5.05e-01
MMQRLSSATTTTTTRSALLRYGGGALRRDVLAPISSSHLAAKSQAGENDTKAARWFSIMSSDRSTFDSSNLKRDLFFGKRYESTAAESSSSAAAERYEYQAEVSRLMDLIVNSLYSNKEVFLRELISNASDALDKLRFLSVTEPGLLKEAVDFDIRIQADKDNGIISITDTGIGMTRQELVDCLGTIAQSGTAKFLKALKDSKDAGGDNNLIGQFGVGFYSAFLVSDRVVVSTKSPKSDKQYVWEGEANASSYTISEETDPEKLIPRGTRLTLYLKAC

SEQ ID NO: 136499 - protein, 259 aa, Glycine max
  Coding DNA Sequence Number=SeqID_19721
MAVEVCSEISSTGISPRISFSHDLKNTEDASVRVEDPHRGSDLCLLDSSSDFVFCITNGLAQQLSSADELFSNGKIIPTEIKRVSNEPSQSQLATTEKIQKKRLKEFLSASSDEAENEEEKPSSKYFWQFKRSSSLNFDTTRGNGLIRSLQFLSRSNSTGSAPNPKQTELPRETHKQRLQKQSSVSSRRSSSSSSSSSTYYFYSSSQKPSLKKNGGSSGNGVRISPVLNLPQAYIPKATARFFGFGSLFCNGKSKRNKK

SEQ ID NO: 136500 - protein, 105 aa, Glycine max
  Coding DNA Sequence Number=SeqID_19722
  Gene Ontology: Mol. function=RNA-directed DNA polymerase activity; Biological process=RNA-dependent DNA replication
  Homolog annotation: Hit_ID=Q2HS45; Match level="QueryCoverage=79%, HitCoverage=12%, E-value=5e-13, Identity=45%"; Hit description=RNA -directed DNA polymerase
MEPLPVVTLKWAVTQSNTLREDNDCMAAHFTAKGLKVVLFHMHSNKSPGPNGLNPTFFKRFRHLLGPKVHKVASSWLQQSTFLLQLNSTTIVLIPKCPNRDHEKF

SEQ ID NO: 136501 - protein, 144 aa, Glycine max
  Coding DNA Sequence Number=SeqID_19723
MKGKKISSFGTQTRITGRECTFVMKNSHSEQEAEPRREAIIIFKGMRCLAMFTLSRPRRKVKTVNFNLSHPSRTSSIIPKSHINYGYIECPPALSLVVALWALDVVGNGRWIHSFMVLIMALNWMVYKARTSLIDRFLEHGFNV

SEQ ID NO: 136502 - protein, 63 aa, Glycine max
  Coding DNA Sequence Number=SeqID_19724
MSYGGLIWKNNKNDNQIGLSERGAEGAAAMVGTGLPIYSVLKGCKIQQTIKSCFLEAGTMIIQ

SEQ ID NO: 136503 - protein, 1171 aa, Glycine max
  Coding DNA Sequence Number=SeqID_19725
  Gene Ontology: Mol. function=transporter activity; Cellular component= integral to membrane; Biological process=RNA transport
  Homolog annotation: Hit_ID=Q2UY13; Match level="QueryCoverage=97%, HitCoverage=86%, E-value=0.0, Identity=79%"; Hit description =Nucleoporin
  Pfam annotation: Domain name=Nup133; Domain location=647-1171; Score=- 167.1; E_value=0.008; Accession=PF04044.5; Description=Nup133 nucleoporin
  Pfam annotation: Domain name=Nup133_N; Domain location=74-542; Score =82.9; E_value=9.9e-22; Accession=PF08801.1; Description=Nup133 N terminal like
  Pfam module annotation: Pfam domain module=Nup133::Nup133_N; Domain location=647-1171::74-542
  Subcellular localization annotation: CTP_CleavageSite=63; ConfidenceScore=5.46e-01
MFSCGTKKSNVRSRRLQGRDSTVVDSPVTPARTSFHDNGVPNRPTTGTPAPWAPRLSVLARVPQVNRSGKGDDTDPTKPVFVGEFPQVVRDEQNILLHKRIPAEDHACGGIDKSTSLAWIICGNRVYLWSYLSPASSVKCVVLKIPLNDADVGRNDAGSWLLRVVNCDATSVGTNKIAKQCNSAAVVLCNCRTRAVIYWPDIYSQSHAPVTSLVSSDELEAVMIPDGKASFHRQRRQSKLGSSLSGLHTFNSMIASADPSCKFVCVALACSSSGELWQFQCTPTGIHRRKVYENFPLQQGESGQIVSNIGYPRSLTWCFPHHSIQESNWQFLVLTDHEIQCFRVEFGSDIPISRLWSQAIVGTDAEVGIKKDLAGQKRIWPLDMQVDDHGKVITILVATFCNDRISSSSYTQYSLLTMQYKSGLGLETTNDRVLEKKAPIEVIMPKARVEDEDFLFSMRLRIGGKPSGSAVIISGDGTTTVSHYYRNSTQLYQFDLPYDAGKVLDASILPSADDYEEGAWVVLTEKAGIWAIPEKAVILGGVEPPERSLSRKGSSNERSAQEEIRNLTFAGNFAPRRASSEAWNAGDKQRTVLSGIARRTALDEESEALLNNLFNDFLSSGQIDRSLEKLETSGSFERDGETNVFVRMSKSIIDTLAKHWTTTRGAEILAMAVVSTQLLEKQQKHQKFLHFLALSKCHEELCSKQRLALQIILEHGEKLSAMIQLRELQNLISQNRSTNVDSSNSSLDIQMSGAIWDMIQLVGERARRNTVLLMDRDNAEVFYSKVSDLEDLFFCLDAELEYVIRPEHPLGIQIQRACELSTACVTIIRTCFNYKNENRLWYPPPEGLTPWYCQPVVRTGIWSVASVLLHLLNEISGLDKTAKLDLYNHLEALAEVLFEAYSGAVTAKNECGEEHKGLLNEYWERRDSLLESLYQKVKDFEDTHKDSIEGAGEQNEEAIMKVTSHLLSIAKRHGCYKVMWTICCDVNDSELLRNIMSFQRKIVQTNVNQHESLGPNGGFSYYVFMKLHESRQFSQLLRLGEEFPEELSIFLREHPDLLWLHDLFLHQFSSASETLHALALSQNLLSTSVAEEEGEQEYMKMKLKLTDRKNLLFLSKIAAFAAGNDAGTQVKVDRIEADLKILKLQGLKLESTNLQRLKMNKKTYMSANLRD

SEQ ID NO: 136504 - protein, 232 aa, Glycine max
  Coding DNA Sequence Number=SeqID_19726
  Gene Ontology: Mol. function=RNA-directed DNA polymerase activity; Biological process=RNA-dependent DNA replication
MELWRMKVPPKFKQLIWGILRNCLPSRSRLRDKRVLCPLPCIAPLILDIINSVHEEDLCNKFATGLWCIWRQQNDKFWRNQVQPTQITIQQAFQHLEEWKDARQQQSQSHVMQILDNQCEWKKPSFGYLKCNVDATIFNQDQQFGNGMCIRDHNGQFIQAKTWFQGVSDPTIAEACGLYQAMEWLKESYNNNIISELDNKFVVDDFNHNNKDLSYLASILRLVFDVIDDDMV

SEQ ID NO: 136505 - protein, 303 aa, Glycine max
  Coding DNA Sequence Number=SeqID_19727
MNCEIGKESIQKGPPSEGATVNSNTLSAGVESFSLGSGVATHIKSSGSDILAQDFQVVEQDDKLNEGNTGITLCKNILIQEGSNLLDKTKKIGIVSTSADTRTRLGAHKHFVDLDDAQIALLAEAIAAYPQLGMLVRSSRENEFHKLCNEAVQLGFERSWVDEMRQRVVARDPAWTMHKHELDSMATITTKKNLVSVIIENTSKIKEIFYLEGFPINGQPNIERNWSKSLRTIKKMKISQILNPKQLKFHLATLCDNWEYLLLIPISHLLPELEHQILNQNSRPVHLLLLTLYKTAQQTDEKV

SEQ ID NO: 136506 - protein, 191 aa, Glycine max
  Coding DNA Sequence Number=SeqID_19728
  Gene Ontology: Mol. function=diaminohydroxyphosphoribosylaminopyrimidi ne deaminase activity; Biological process=riboflavin biosynthetic process
  Homolog annotation: Hit_ID=Q1S453; Match level="QueryCoverage=35%, HitCoverage=5%, E-value=2e-14, Identity=56%"; Hit description =CMP/dCMP deaminase, zinc-binding; Bacterial bifunctional deaminase- reductase, C-terminal
KKKDEEHGAEQSRDNVVVIIAAVGLHVEVRGGATTEFVNDVDDLDLHSVGALGIKVAFNDDFVKGGEDDITEVGMGESRMFGTAIRCLAKKPKPKMGPVILKTPPEQRQTITRTLFDIIKEHGPITVANTWERVQEVGLKDLTSKNHMKIVLKWMRERQKIRLLCNHVGAHKQFLYTTWFTKPVTPPKNSS

SEQ ID NO: 136507 - protein, 371 aa, Glycine max
  Coding DNA Sequence Number=SeqID_19729
  Gene Ontology: Mol. function=RNA-directed DNA polymerase activity; Biological process=RNA-dependent DNA replication
  Homolog annotation: Hit_ID=Q1SLA3; Match level="QueryCoverage=39%, HitCoverage=14%, E-value=7e-41, Identity=48%"; Hit description=RNA -directed DNA polymerase
MELDGSVRVCMLPQILFVEGGLWMHLSFLTSTITGPWLVMGDFNETILPSDQRGGIFNHQRAIELLQKLDRGMANLDWQMAFPEGYVEVLCRMHSDHNPLLLRCGGLTPARGQRPSHDVAWIMHDQYATVEEKSWNDEKGRPIQVLTKVKENFLIFNKEVFGSIVKKKGPLKLALEPANSSFQVTPCSWIEDDDGLSLTRPVTKDEDAFSTGYFDPVLSETLMALIPKMDNPDGHLSYALCNFFIIPSYSRQINWISEGNIALPKSIGALGTRKARDMNVAFLGKVMGITRFGMKTGRARVFFAIRWIMSILLDHVVMDENNVGPELEVDNQRRNPGHVANDPQDVGCRRSTRVKFTSSKLRGFEAEMGYK

SEQ ID NO: 136508 - protein, 165 aa, Glycine max
  Coding DNA Sequence Number=SeqID_19730
MGERALVQRPVRSSTSQAEVSPESGQHEDNRKGWSAEKNPAAKCRKKEQPRWQQQTMRANQKQTLEASIPDNVESDLQGNWMVVSRKKRSNNQGNQEVGASLHQTFTPIEQLITNVAKAAKHIIPRSQSQVTRYDELVTVPRKNISDPPESSNVQAMELEANQNQ

SEQ ID NO: 136509 - protein, 525 aa, Glycine max
  Coding DNA Sequence Number=SeqID_19731
MNAQNFENIGLSPLDFVYSICNMIESDEVSTSSGTNELPSSQINEKSENDFIGNIPGSEAQAAATSTNSEPNKRPTPSPLDNCQRETHSHELVDGQSTSQSYFTDQQRPLGKTESAIGIPQHEQNPAPENTSPFQMNLEDPSTSKSKPPSPQVNDNNQFVLGSITETVREHKQFESRVTVFETGECPELERENKRTSNLQKLEQKLSPISSPNMIESIDEIETTIIGKVPTSVKLAIPTSVLEVRSPSLTCMTTRQHKIHLHFLDKESSNEAGFPDQHALGESMNIEETGKESIQEGHPLEGATVKTLSTGVGSISLGSGVVTLTDISSRDILAQDFQIQEIMPCQEIQIQEGLNLMDKQEGTGIISNNSIEVSPDIRTRLGAYKHFVDLDDTQVALLEEAVKKYPHLWNTCEMCSERFQALMLKSLAEILLFLRNETAVSITPQRKNEFHRLCNVAVQLGFERSWVDEMHQRVVARDPELDNARAAIRKLLKRRDHLTQELRDIQNELKILDDFLDAQTKCFDF

SEQ ID NO: 136510 - protein, 692 aa, Glycine max
  Coding DNA Sequence Number=SeqID_19732
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=59%, E-value=0.0, Identity=48%"; Hit description=Chromo
  Pfam annotation: Domain name=rve; Domain location=503-659; Score =102.3; E_value=1.4e-27; Accession=PF00665.16; Description=Integrase core domain
  Pfam annotation: Domain name=zf-H2C2; Domain location=471-512; Score =14.3; E_value=0.0046; Accession=PF09337.1; Description=His(2)-Cys(2) zinc finger
  Pfam module annotation: Pfam domain module=rve::zf-H2C2; Domain location=503-659::471-512
MRFKGSINGIIIQVLLDSGSSNNFLQPRLASCLKLPIEPVPNFHVLVGNGNFLIAEGLVSKLDVLIQGHALQLSAYLLLVTGADLVLGAAWLVTLSPHISDYNTLTLKFYLDKQFVTLHGEKSTTASPAQFNHLRRMYRTNAIAELFALQPEIPVYPQDDWLDIPRYMEPELAILIHTYKQVFVVPKGLPPNRSQNHAIPLMHGTGPVKVRPYRYPHSQKLHIEKMILDMALNAITVKDSFPIPTVDELLDELHGANYFSKLDLSAPATFQCLMNDVFKGVLSNYCFSINSMLGFLNVHLACKLLTIWVIQFQDLGRFIRGYASLATPLTNMLKKDNSQWSNEALTAFDSLKAAMTQAFVLALPDFNKPFTLETDASGLGIGAVLSQDNHPISFFSKKLTPSLQKKSTYTREFYAFTEAIAKFRHYLLGHKFYDFTIEYKPGKDNIPADSLSRLVIPDDLSLKQQIVHECHNSLVGGHAGYTRTLARVTAQFHWQGMHKFIKDYVQTCLVCQRDFITGLPLSHGYTVIMVVVDRLSKYAHFSDLKANYSSKVVAETFMNTMVKLHGFPKTIVSDRDKVFTSQFWQQLFKLSGTSLNMSTAYHPQSDGPSEAVNKCLEMYLRCFTFDSPKEWYKLLPWAEYWYNTAYHTSIGMTPFRVVYGRKPPQLLRYTPNLQDSASVQDQLMLRDATLAK

SEQ ID NO: 136511 - protein, 1111 aa, Glycine max
  Coding DNA Sequence Number=SeqID_19733
  Gene Ontology: Mol. function=protein binding; Cellular component =membrane; Biological process=defense response
  Homolog annotation: Hit_ID=Q1SPY2; Match level="QueryCoverage=100%, HitCoverage=65%, E-value=0.0, Identity=47%"; Hit description=Disease resistance protein; AAA ATPase; Zinc finger, C2H2-type
  Pfam annotation: Domain name=LRR_1; Domain location=1017-1039; Score =4.0; E_value=52; Accession=PF00560.23; Description=Leucine Rich Repeat
  Pfam annotation: Domain name=LRR_1; Domain location=618-646; Score =0.8; E_value=2e+02; Accession=PF00560.23; Description=Leucine Rich Repeat
  Pfam annotation: Domain name=LRR_1; Domain location=810-833; Score =10.0; E_value=3.8; Accession=PF00560.23; Description=Leucine Rich Repeat
  Pfam annotation: Domain name=LRR_1; Domain location=842-866; Score =5.2; E_value=30; Accession=PF00560.23; Description=Leucine Rich Repeat
  Pfam annotation: Domain name=LRR_1; Domain location=868-891; Score =3.7; E_value=59; Accession=PF00560.23; Description=Leucine Rich Repeat
  Pfam annotation: Domain name=LRR_1; Domain location=946-970; Score =6.2; E_value=20; Accession=PF00560.23; Description=Leucine Rich Repeat
  Pfam annotation: Domain name=LRR_1; Domain location=972-996; Score =1.4; E_value=1.5e+02; Accession=PF00560.23; Description=Leucine Rich Repeat
  Pfam annotation: Domain name=NACHT; Domain location=174-326; Score= -19.5; E_value=0.0019; Accession=PF05729.3; Description=NACHT domain
  Pfam annotation: Domain name=NB-ARC; Domain location=135-439; Score =216.0; E_value=8.7e-62; Accession=PF00931.13; Description=NB-ARC domain
  Pfam module annotation: Pfam domain module=LRR_1::LRR_1::LRR_1::LRR _1::LRR_1::LRR_1::LRR_1::NACHT::NB-ARC; Domain location=1017 -1039::618-646::810-833::842-866::868-891::946-970::972-996::174 -326::135-439
MECLYGFASSISRDLVCGAINQLRYPCYFNNLIEELEKEEGNLIVTRNDVQKFVAHANNQTRTTAEVVNHWLQDAENDIDNVNQLLKEARTKKSCCFGHSPNWIWRYCVGKKLANKTRDLEKRIQRGRPYIQIERNTTLPSSTLDILSEKCMNFDSRESSYEKLMEALKDNEVAMIGLYGMGGCGKTTLGMEVTKIAKAEDLFDKVLFVPVSSTVDVPRIQEKIASSMGYGFPENEKGERERAQRLCMRLTQENKLLVILDDVWEKLDFGAIGIPFFEHHKGCKVLITTRSEAVCTSMDCQRMIHLPILTSEEAWALFQEKALITEGTPDTVKHLARLISNECKGLPVAIAAVASTLKGKAEVEWRVALGRLKSSKPMNIEKGLQDPYKCLQLSYDNLDSEEAKSLFLLCSVFPEDYEIPTELLTRCAIGLGVVGEVRSYEEARSEVIAAKIKLMSSCLLLNAFHERVKMHDFHRNVAHLIAKNEDKVIKCELEKDATLEQISVRYLWCVKFPNDLDCSSLEFLCIKTKLEISDQIFRRMENLRVMYLDNGGWHKLPLSTMTFKTLKNLRCLILSNWVLSDISFISDMKKLECLALSDCYLPSFLELQNDGVVAQLTNLKSLMLYKCDMETNNFDVVRRIPRLEELCIINRQQEWDVYNENTIKFSNTFSVPQELQWYTIKLGSLRQDDEDDDANFISHKRTLLLSCFHISNKAIKDLAKKAKVLSIANTQGGAKNIIPDIFQLEKGDIHELNKLEICNSKEIECLVDTSNHLSEVGILFSELLKLKICKMDQLRVLWHGCIPPSGPFEKLEKLNLSNCAQLTSFFTHAIVQSHVQSTIFQNLQEVIISGCRELKYVFSANTVRGLPQLKVLKIKDCNQLDQIVEDIVPSTPDMNYPLAHQDQKQELDEIIQDEQHQQFLNPHFEPNQLEIFPESTAIPGSFTLSSLTTLELRSCPTLGSLFTASTAKTLTSLEELIIEDCDGLKHILTRERGHKNQKENLVEDDREFQSDISMFLGLKRLSIEGCDLQHILSVSFVGYQAKLEDIRNKETHNNFEHLQRKNIQIGQVRLKLKKLELYDLPQMTYIWVASKSSLFLQYLKTLDIEECAKLE

SEQ ID NO: 136512 - protein, 165 aa, Glycine max
  Coding DNA Sequence Number=SeqID_19734
MKHQLASNGFVPRWEYPLPEWSSDRHGLGLGTKAEHRRAVSGIAGSGYVGICHMPDWFRRVGLLTAARLVALGSSEDDGPGDVVTPAKGDCSSDGEGSQLWQCWADSTQPYPIFYYKSATHSGENTQHKTPAPSSDERQQHDPVKATHMTPHPHAANSTMNDGDE

SEQ ID NO: 136513 - protein, 189 aa, Glycine max
  Coding DNA Sequence Number=SeqID_19735
  Homolog annotation: Hit_ID=Q6ASS1; Match level="QueryCoverage=63%, HitCoverage=26%, E-value=4e-33, Identity=55%"; Hit description =Unknow protein
MTIVATNKVMFCNHSAVDWCYCHAGDIERGLQTFENHLRLDRPVASELFVTLAEGAMIGYTEKGMQMAQDVLVRMNERNIFVNNKLGSELLFVAAGEKTGGYTTANYIWDMMRARGITPSFPAVEAYYQGLKKLPKPCDLSDAAAAMALNLAMVFRFRLLHEIKFPPIRTQYLEVDFLCDGDPAQSASE

SEQ ID NO: 136514 - protein, 61 aa, Glycine max
  Coding DNA Sequence Number=SeqID_19736
MKNKARVRVGLAVKLFNKNRRKFHRLRMCVMNYNFHHDNYKIATKPLFKAVPVITVVETMS

SEQ ID NO: 136515 - protein, 377 aa, Glycine max
  Coding DNA Sequence Number=SeqID_19737
  Gene Ontology: Mol. function=DNA binding; Biological process=DNA integration
  Homolog annotation: Hit_ID=Q0KIN0; Match level="QueryCoverage=40%, HitCoverage=8%, E-value=3e-48, Identity=64%"; Hit description =Integrase core domain containing protein
  Pfam annotation: Domain name=rve; Domain location=109-260; Score =49.5; E_value=1.1e-11; Accession=PF00665.16; Description=Integrase core domain
MDMQSYLGPVVPSYDAVSEQLLRLSTLHAFGSSSAPAGDSSALVSHSSNHGGETKVVVVNDVPDIAIIATFMVILKPTVTTRLAIKRNRRIRETIGAGHESGGLYQLSSSMVCVSAISIELAHQHLGHPSLNKMYLDFLNEKTFLCVFHFQDFTLEIQNQFDVSIKILHSDNACKYLSSQFCSFLTLKGILHETSYAHTPQQNGVAKGKNRHLVETACTLILHYNVPHHFWGDALLTACYLISRMPSSVLGNQVPYSILYPKEPLYIVPLRVLGCTCYVHDLTPACYLISRMPSSVLGNQVPYSILYPKEPLYIVPQRVFGCTCYVHDLTLGSCLVAKGYTHIFGLDYGTTTTLWPKSHLCISFLLWLPFNIDLCTS

SEQ ID NO: 136516 - protein, 116 aa, Glycine max
  Coding DNA Sequence Number=SeqID_19738
  Gene Ontology: Mol. function=oxidoreductase activity, acting on the CH-CH group of donors, iron-sulfur protein as acceptor; Cellular component=chloroplast; Biological process=phytochromobilin biosynthetic process
  Homolog annotation: Hit_ID=Q588D6; Match level="QueryCoverage=64%, HitCoverage=32%, E-value=4e-18, Identity=45%"; Hit description =Phytochromobilin synthase
MKDLNPVHDIINQYEYKEKYFKSLIPLGLKYAELFPWGGKPQVWLELICKAVKETDESQIFHNLEAQHRYLTWRAEKPIINMIGDLAISKLIFVPGIIGLGFFNSPRIFTHLASIG

SEQ ID NO: 136517 - protein, 560 aa, Glycine max
  Coding DNA Sequence Number=SeqID_19739
MAKDLWTHFKKWGDVREIFIPNHKNQGGRRYDFARFKGVPDEHELERKLVKLVIDGLKLYVNLPKYGRRNMGIEDHRANMRTRPEGHSNEARIECRKPTQVRLPHRTYAEVTTTNTTNAGQRKQPRPAQIGQTHSQSSIQLQVDWEKKKWLKEAWVGRLKKLSAFDSIEEDIPWELGVNVVSKYIGDDMVLLLGLSDSKAEAMINSEAQSLFHSIQKWNPNMRPGYKLVWAQCWGVPLQVWDIDNIRRIVAAVGELVEVDDEVEELRRLDRARVLLRTQWKPLIHHTVDATINGEAYQIVIVEEGEAYGGMRNQWARKHTYTSEDIDSDDINDDSVHAGMSANHDFLHPRNGINGEGWPDDAHNHCGSLPAGPTPVECPLGIDQRTMAPLLRIQIAKRPEEFQQPSAGYASTDVDPEITVAEASMRDSQKKKLNRSRGLLSGAESIEEEMFGEPDQGQKEDDIGSCHKQAQHRGEQCTQREVPLSVDTLPPAAIGSPEANGTMKNPEEEDIQEAESQWELAKSMGVHTELDQAAIINRITEMENRDKQEAAEMGKRQSAP

SEQ ID NO: 136518 - protein, 76 aa, Glycine max
  Coding DNA Sequence Number=SeqID_19740
MGHLSSRATNSKQTEPVDMQCSTICLLQWPIFMILAAKITAPAVMASCGSMAFGQQGAATYHISGVSFVKIFWYAM

SEQ ID NO: 136519 - protein, 36 aa, Glycine max
  Coding DNA Sequence Number=SeqID_19741
MQDMAQALHVGKHLHGCSPDRRSVEGMMKLIEEIPE

SEQ ID NO: 136520 - protein, 144 aa, Glycine max
  Coding DNA Sequence Number=SeqID_19742
  Homolog annotation: Hit_ID=Q6ASS1; Match level="QueryCoverage=62%, HitCoverage=19%, E-value=1e-33, Identity=73%"; Hit description =Unknow protein
  Pfam annotation: Domain name=PPR; Domain location=60-94; Score=4.6; E_ value=2.1; Accession=PF01535.11; Description=PPR repeat
  Pfam annotation: Domain name=PPR; Domain location=95-129; Score=13.0; E_value=0.21; Accession=PF01535.11; Description=PPR repeat
  Pfam module annotation: Pfam domain module=PPR::PPR; Domain location =60-94::95-129
MEKNKDEEDNSKNCRRWREQLARKEYRKDKLRPLNRVSGLRFFSVSTEEYSKRNYANNVAEYNTVLGSLTAQRRNFLLRDVYDDMMLDGVKPTRDTFHSLVVGTMKGARMQDAFYFVEQMKIMGLLPDGWGGMMLLLGINEWNA

SEQ ID NO: 136521 - protein, 451 aa, Glycine max
  Coding DNA Sequence Number=SeqID_19743
  Gene Ontology: Mol. function=transcription factor activity; Cellular component=nucleus; Biological process=regulation of transcription, DNA-dependent
  Homolog annotation: Hit_ID=Q9FKH1; Match level="QueryCoverage=85%, HitCoverage=92%, E-value=3e-80, Identity=42%"; Hit description =Transcriptional regulator STERILE APETALA
  Subcellular localization annotation: CTP_CleavageSite=50; ConfidenceScore=5.90e-01
PPHFTHTLMSSTSSSSSSSSSTSSSTPYDAVAPDIPGPSTRRTTRSGQFEASSSSSQRQRAMNEVLPEPFLEALATQLALDAANYNGRLSAASALAILFQLEYMYWHRTARNFSTGRHRFFDPPVFDPSDHHLLQNLLCRCLALSDTHLACGFVDGTVRLFDLETRAHVTTFLSLHGHLFGPFSRSVSGIVIFNSNIAFARLDGDIYVDNVNGPGPGPSQARRAVEGDVVNNGVLVGFAGTGRWWVGLFAGIAGRAFQIWDARSEERVFVGGSLTDPETVMGWHMLTELVEAVGRVRVTEREYVVACTGSRLVCFSFRNPEVLLRDVGSTTGFVVSSLDASQEAYVVVERNGVGTVRRVSTLERLSRFRLNRLLWVQGLWACMNLGYALTYSPSPSPSLRVWDIEQAIGRLCVTLGLRAGELNSFVANDRHVAISSNDNNINLLDFGVQDP

SEQ ID NO: 136522 - protein, 120 aa, Glycine max
  Coding DNA Sequence Number=SeqID_19744
MKVEGLLSITSSQDLRLSLQSLQDSILLHQNHHNNEHILFAGIRSKNMVAWNSNNNNIASNDICGGGGGGKFVFNAPSTLIGLATVASMMLMKTSTNLDHPNADELQICNYIRLQFGGGR

SEQ ID NO: 136523 - protein, 94 aa, Glycine max
  Coding DNA Sequence Number=SeqID_19745
HLLRQRPSSPTTTISCPLRLVPFEAAADKGPWLLLVVFIVVYIVLFKEDKLVPGVYVGLIDEADLRAVSERLSGTACCHPSSVVCHPVPHYQFR

SEQ ID NO: 136524 - protein, 402 aa, Glycine max
  Coding DNA Sequence Number=SeqID_19746
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=69%, HitCoverage=38%, E-value=1e-75, Identity=50%"; Hit description =Receptor protein kinase like protein
  Pfam annotation: Domain name=Pkinase; Domain location=223-402; Score =4.0; E_value=8.5e-09; Accession=PF00069.15; Description=Protein kinase domain
  Pfam annotation: Domain name=Pkinase_Tyr; Domain location=236-396; Score=-49.3; E_value=1.9e-09; Accession=PF07714.7; Description =Protein tyrosine kinase
  Pfam module annotation: Pfam domain module=Pkinase::Pkinase_Tyr; Domain location=223-402::236-396
MSGDTLLIQEALGEKVGKFIQCVACFLGRLVIAFIKGWLLTLVLLSCIPPLVISGSMMSFTFAKLPSHGQAAYSEAATVVERTIDSIRQVASFTGESQAIAQYNQSLTKAYRTAVQDGVVAGRIIDSAKILAWSFSDSNFSIGDALVTENLPSFVHHKKWFPGAQAFAVGVTSIVFVLIIGFGYVAFFVLRRRKTQEEVEDWELEYWPHRIGFHEIDAATTGFSEENVVVVGGTRKVYKGVLHGVEVAVKRIPQEREEGMRQFLAEVSSLGRMKHRNLVGLRGWCKKEKGNLILVYDFMRNGSLDKWIFECEEGMMLTWEERIQVLKNVATGILYLHEGWEVKVLHRDIQANNVLLHKDMNARLGDFGLARMHDHQGQVVSTTRVIGTLGYIAPEVIQRGTT

SEQ ID NO: 136525 - protein, 520 aa, Glycine max
  Coding DNA Sequence Number=SeqID_19747
  Gene Ontology: Mol. function=protein serine/threonine kinase activity; Cellular component=integral to membrane; Biological process=protein amino acid phosphorylation
  Homolog annotation: Hit_ID=Q9LY50; Match level="QueryCoverage=54%, HitCoverage=38%, E-value=3e-76, Identity=53%"; Hit description =Receptor kinase-like protein
  Pfam annotation: Domain name=Pkinase; Domain location=237-500; Score =61.1; E_value=3.5e-15; Accession=PF00069.15; Description=Protein kinase domain
  Pfam annotation: Domain name=Pkinase_Tyr; Domain location=237-500; Score=35.4; E_value=1.2e-14; Accession=PF07714.7; Description =Protein tyrosine kinase
  Pfam module annotation: Pfam domain module=Pkinase::Pkinase_Tyr; Domain location=237-500::237-500
MVEDVDEEKEKEEKKKKKIKEVSHECSLVNKHKPIWMRKPEEMTKEEYSAIMNSSSISLIRSMTKEEYSAIMNSSSISLIRSMTKEEYSAKATTCKLMEGIREPQTYLIQFTEPKGSKCNLLECDRQVTNRVGTEAKTRLVNATENSDLERRKPKKLASKVDSAIRSESETWSNLGASHLHSFASVVDWAIRSSRTVSNLGTSPVPSFASAEDNNAMRVVPARLFTWAELVAATNNFSIHNQIGAGCFSVVYRGKLVDGREVAIKTGGTWPKRESKLTLLSGLHHKNLIRLVGFCETNYERLSVYEYMKNGSLYDRLHDKGSSVLNSWKMRIKIALDASRGIEYLHNYADSFIIHGDIKSSNILLDATWTARVSDFGWKFMRNRRRIIENTDPEYVIRGALSAESDVHGLGVVLFELLTGKRPTFVYGEDGGTLLSRKHLVDFAVTAISNGFLEKILDQRAGQPDVNETEAVKLVADTAIRYVNLKLKDRPTMADIVVRLERALAIFEYDSIFRALVSNC

SEQ ID NO: 136526 - protein, 205 aa, Glycine max
  Coding DNA Sequence Number=SeqID_19748
  Gene Ontology: Mol. function=monooxygenase activity; Cellular component=membrane; Biological process=electron transport
  Homolog annotation: Hit_ID=Q1S498; Match level="QueryCoverage=100%, HitCoverage=39%, E-value=1e-67, Identity=63%"; Hit description =Cytochrome P450
MASMMTESTNQMIDRWIAQINSGNPKIDVEREVVETAGEIIAKTSFGMKGKNAKEVSEKLRALQMTLFKTTRYVGVPFGKCFNVKKTLEAKKLGKEIDKLLLSVITSRMKSIKRQTQEDLLGLLLQGNNNHQDDGKLGKTFTTRDLLDECKTFFFAGHETTALAISWTLFLLAMHEDWQIQLRDEIREVVGDKELDINTLAGLRK

SEQ ID NO: 136527 - protein, 48 aa, Glycine max
  Coding DNA Sequence Number=SeqID_19749
MGTTDIGLVYHGDTSSALVGYLDFDYAVDLDARRTMTSFYGGWVFELP

SEQ ID NO: 136528 - protein, 82 aa, Glycine max
  Coding DNA Sequence Number=SeqID_19750
MVGSGMTTHIQDELITSESRVLPSQAKAVEDEAQDVFQDKRRGEKEFGVGFLAVARYPKWVVNIVPVPKKDGKMRCAWTIKI

SEQ ID NO: 136529 - protein, 176 aa, Glycine max
  Coding DNA Sequence Number=SeqID_19751
  Homolog annotation: Hit_ID=Q2PMM5; Match level="QueryCoverage=98%, HitCoverage=7%, E-value=1e-99, Identity=100%"; Hit description =Protein ycf2
MVERKNPYLTRLLTIPMNSIGPKNDTLEESSESSNINRLIVPLLYLPKGKKISESYFLDPKESTRVLPITKKYIMPESNWGSRWWRNWIGKKSDSSCKISNETIAGIEISFKEKDIKYLEFLFVYYMDDPIRKDHDWEFFDRLSPRKRRNIINLNSGQLFEILVKDWIYYLMFAFS

SEQ ID NO: 136530 - protein, 134 aa, Glycine max
  Coding DNA Sequence Number=SeqID_19752
MEDSHCAFYVKTVVNPSGEEHVGHILLTMRLVSVEKVVDDEAQVLFPTSEIQSLYDIYEKPVELLWDGKKFGLPNADASFFLTYFDVNEIISVYGFLEPQSVHNAKDRRAECRQYIETWVKESQEEVYLGAYLN

SEQ ID NO: 136531 - protein, 87 aa, Glycine max
  Coding DNA Sequence Number=SeqID_19753
MTLRSLFLVYAVEPALGPAPDHAELVECGPSAASDERRGVYSEDVIAPEPSPQPEPEPSAPVPDLHIPQDSSTSTLALDLNEHAQDD

SEQ ID NO: 136532 - protein, 79 aa, Glycine max
  Coding DNA Sequence Number=SeqID_19754
MLSFWGIWVERSEILNIHYSDSVRQCTAMIYSALLAFCHFLHSAIDSTAKMQGGFEDLSHLGLGGHSSSTLALVFESMR

SEQ ID NO: 136533 - protein, 54 aa, Glycine max
  Coding DNA Sequence Number=SeqID_19755
MGDAEKIGEGAESEATRAFLNEDAEKIGEGAKSKARTASTKECMQNRVIYRCKN

SEQ ID NO: 136534 - protein, 134 aa, Glycine max
  Coding DNA Sequence Number=SeqID_19756
  Gene Ontology: Mol. function=solute:hydrogen antiporter activity; Cellular component=integral to membrane; Biological process =regulation of pH
  Homolog annotation: Hit_ID=Q5Z8T1; Match level="QueryCoverage=60%, HitCoverage=19%, E-value=4e-21, Identity=52%"; Hit description =Putative Potassium-efflux system protein
MDNVYIISNPKSKYPVLQLDLRFTYCSYLLVETVAQFGVIFLLFALGLELSTRKLRVVQAVAILGGLLQIFLSMSLCGITASRLFAMRRYRGGMLYAVLPLHMQRGCFRIRTHDQQVTKAQLYRCTRARPHFYK

SEQ ID NO: 136535 - protein, 95 aa, Glycine max
  Coding DNA Sequence Number=SeqID_19757
MACFDDDLQSPSLVVHQAKIHCALSDDSGSKRTHWAGRASITKRGFSALSVKKESGRAYESKQHAKREINSLSESFVSCQTQRNIGAKPKSTYSR

SEQ ID NO: 136536 - protein, 311 aa, Glycine max
  Coding DNA Sequence Number=SeqID_19758
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=70%, E-value=1e-148, Identity=78%"; Hit description =Photosystem II P680 chlorophyll A apoprotein
  Pfam annotation: Domain name=PSII; Domain location=1-311; Score =404.8; E_value=1.3e-118; Accession=PF00421.9; Description =Photosystem II protein
MALYELAVFDPSDPVLDPMWRQGMFVIPFMTRLGITNSWGGWNITGGTITNPGIWSYEGVAGAHIVFSGLCFLAAIWHWGWLVFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFMGMELLGPMFLFEGQNLNIVWNK

SEQ ID NO: 136537 - protein, 58 aa, Glycine max
  Coding DNA Sequence Number=SeqID_19759
MWVQAIGLFAQATCAPDFGLPRPFNQRLLVLHVGGERSELSRIGCWTNGLSYLKKKGG

SEQ ID NO: 136538 - protein, 137 aa, Glycine max
  Coding DNA Sequence Number=SeqID_19760
  Subcellular localization annotation: CTP_CleavageSite=28; ConfidenceScore=5.06e-01
MVGKDLRSTGNPMMCKFKTSTPSHHMACLSNYTPPNVAYTLNENLNNSTPILIESQQPQTDHAHVSRPMEETHEIPHHDLADFEPWLEYATEGQAVGGIPLAKHFGGPSVSPTAFKNPHDYGRNGKVGSSRGKAQGH

SEQ ID NO: 136539 - protein, 454 aa, Glycine max
  Coding DNA Sequence Number=SeqID_19761
  Gene Ontology: Mol. function=nucleic acid binding; Biological process= DNA integration
  Homolog annotation: Hit_ID=Q1S7C5; Match level="QueryCoverage=80%, HitCoverage=39%, E-value=1e-57, Identity=45%"; Hit description =Integrase, catalytic region
  Pfam annotation: Domain name=rve; Domain location=156-311; Score =24.4; E_value=5.5e-05; Accession=PF00665.16; Description=Integrase core domain
MQIEEVEALLAHEMRLEKSQKKLASETVSLNLTEASSSTLQQQSSSFAKAHVASESVNLNYNLNFGFHGFGRASDCYHPYDQNYQLQVPANFQGFQTSSNPWNQFLAAQQHYGSYQPNNFPNFADPWGMMPRKLQFPQQFQQSHSQEQAQNPPGALITNSGVLGSCPTTSSTWFPDSGASYHATADQNNIHQLSSFECPDQIFIGNRQGKVGPDGLYQFPSLHLQPQSKLPLNKFLTDLGIIHRLACPHTHHQNGVVERKHCHIVELGLTLLSHASMPLEFWDHDFVTAVYLINRLPTASLNFSVPYTVLFGQPPSYQQHLKAFGCACFAFLRPYNSHKLEFRSHECLFLGYSNHKGYKCLSPSGKSTNIVSEPVTQPVANDSIPELPSSTASASDSSSSYESASHYPIPHNSPPMQTRAKSESKSVKQAFQDPNCQAAVVATIAAKNSVCSSY

SEQ ID NO: 136540 - protein, 63 aa, Glycine max
  Coding DNA Sequence Number=SeqID_19762
MQCTQDSWCLNPDQLGSHIEEEYSDKLEDEEKQGGAGGGGLDSAIVGPSSSAYHIRNRERERN

SEQ ID NO: 136541 - protein, 157 aa, Glycine max
  Coding DNA Sequence Number=SeqID_19763
MGHGAYLKSGYYQIHMKEGISVDCGSNDFQDYFDDGKESRVKQVPKNQESKSFKNQVSKNQDSRIIKFQDSIKFQESRFKNNQDQDSRLKIQESREDSIKISTKKKFFKTLSSTRIFHKIFYQRVLLSSNQLPEGNNQLPVANIIFKTDLQNCNRLP

SEQ ID NO: 136542 - protein, 70 aa, Glycine max
  Coding DNA Sequence Number=SeqID_19764
MATSPPEERPKRTPHVPMKCIVWHVKEREGSTRRRETSKRAHRGQWVARKVTVADKGQKNATTNKVHWGQ

SEQ ID NO: 136543 - protein, 192 aa, Glycine max
  Coding DNA Sequence Number=SeqID_19765
  Gene Ontology: Mol. function=pepsin A activity; Biological process =proteolysis
MVLRVSLILVLLVLHCSCTVQSIFGHHNHNDLNKNGSSLAAVKFPDHAHFNAVSSSTETGCSFSKSEKFEPSVATMTSNGDTDGEEGEAFVAAKQHKQSVKLNLRHHSVSKDSEPKRSVADSTVRDLKRIQTLHRRVIEKKNQNTISRLEKAPEQSKKSYKLAAAAAAPAAPPEYFSGQLVATLESGVSLGS

SEQ ID NO: 136544 - protein, 185 aa, Glycine max
  Coding DNA Sequence Number=SeqID_19766
  Homolog annotation: Hit_ID=Q1S9A7; Match level="QueryCoverage=39%, HitCoverage=32%, E-value=8e-16, Identity=48%"; Hit description =Peptidase S8 and S53, subtilisin, kexin, sedolisin; Zinc finger, CCHC- type
MEIINKIQIHGDKIEDVKVIEKILRSMTSKFNYVVCSIEESKNLDQLSIDELQGSLLVREHKLIEQDNEVQALKASTNYNATTQNQLADRGGGKGGRGNRDACSKREGQGNRGRANPPSEDVISSVLSVPNLTKSKFTYSRLASLRKLKGPRAFKTLKLAEIKEGVQKVRMGGSSRDTKREAKRA

SEQ ID NO: 136545 - protein, 135 aa, Glycine max
  Coding DNA Sequence Number=SeqID_19767
  Gene Ontology: Mol. function=DNA binding; Biological process=DNA integration
MASRRRLVDPSEKVMEFKYNNQVWTLVVPPKRVKPIGCKWVFKKKTGMDGETSYVLGIRIYRDRSLRLFGLSQVHILTKCLGTSVCMIPIRDSCLPHGIYLSKGQYATTSNEREHMSKISYASTIGSIMYAMMCT

SEQ ID NO: 136546 - protein, 175 aa, Glycine max
  Coding DNA Sequence Number=SeqID_19768
  Homolog annotation: Hit_ID=Q1RWN2; Match level="QueryCoverage=48%, HitCoverage=6%, E-value=1e-17, Identity=52%"; Hit description =Peptidase S8 and S53, subtilisin, kexin, sedolisin; Integrase, catalytic region; Zinc finger, CCHC-type
MAERSGVMMSIHCHGGEIKKERKGGWGDEGRGEGREKEKRTWCRGRGRGKKREKNAWGEEIGVEERGKGRERNCGIGGGERFSWKRKKEMLKMSSRGSKEYWQIVENGVAEPATSTILTYQQKIELDGQRLKDLKAKNYLFQAIDRSILETILCKDTSKHIWDSMKKKYQGTTRA

SEQ ID NO: 136547 - protein, 99 aa, Glycine max
  Coding DNA Sequence Number=SeqID_19769
  Gene Ontology: Mol. function=catalytic activity; Biological process =metabolic process
  Subcellular localization annotation: CTP_CleavageSite=56; ConfidenceScore=5.27e-01
MGSRRRTGTWQRTPPHPTTAFNTAQGMAQAFRAGEYFRRMMVLRVPLRPHPIDAPRAQTVFLEEDDHRHEERVASSRMRFRKLSGGREDEGYKGNTRTF

SEQ ID NO: 136548 - protein, 124 aa, Glycine max
  Coding DNA Sequence Number=SeqID_19770
MPALKIMLSDYFSISNGRYHPELLRRYPILKDLEANKIDVIEFQSIPKLVRGNICDNYGFEFPLKAKLLSDENKTCSCPNQVNKNLFTYRYGLRALNFEYASVCLQDRYGLRALNFEYVSVCLQ

SEQ ID NO: 136549 - protein, 102 aa, Glycine max
  Coding DNA Sequence Number=SeqID_19771
MARVCEIEFRATYPNFMKIQHFGFLRENKKLQCKGFSSKLRHDSEIPNGENARNWVANVVLKFHDDPTVNESEIIVFPRQVLWTAGKRKGFERRRGKTKMRG

SEQ ID NO: 136550 - protein, 63 aa, Glycine max
  Coding DNA Sequence Number=SeqID_19772
MEGGEKSQPIPPPPPPPHPPIQKSMENPHSRATTYTVWPLQSIFGKALLFKLCSAPKMPSTPL

SEQ ID NO: 136551 - protein, 58 aa, Glycine max
  Coding DNA Sequence Number=SeqID_19773
MGDQATSMLLDLSDSEGLLSEAGSLSERFPNPLSKLYASLSGCHSLSGFVTLNKSSIT

SEQ ID NO: 136552 - protein, 103 aa, Glycine max
  Coding DNA Sequence Number=SeqID_19774
  Gene Ontology: Mol. function=drug transporter activity; Cellular component=membrane; Biological process=multidrug transport
  Homolog annotation: Hit_ID=Q1T5H1; Match level="QueryCoverage=62%, HitCoverage=12%, E-value=2e-18, Identity=73%"; Hit description=Multi antimicrobial extrusion protein MatE
MIPIKTHHFSSDLSKPKKVGCFKHFSVDLSRLYEIHYPMDENRSSNEPNKWKMPLFVFFKDARNVFKLDALSREILGIALPSALAVSADPIASLIDTAFIGRL

SEQ ID NO: 136553 - protein, 94 aa, Glycine max
  Coding DNA Sequence Number=SeqID_19775
  Gene Ontology: Mol. function=DNA binding
  Homolog annotation: Hit_ID=Q9LTA2; Match level="QueryCoverage=95%, HitCoverage=33%, E-value=5e-14, Identity=48%"; Hit description =Similarity to AT-hook DNA-binding protein
PVIRRVVDRRYNHKHHANDEEPPDDESIDNLPLRSRKVQGECVQDHRQRIMVEEGGGHGEDIEAVMESDCGDSGTGGSERRLTESDIGDCSKNG

SEQ ID NO: 136554 - protein, 195 aa, Glycine max
  Coding DNA Sequence Number=SeqID_19776
  Gene Ontology: Mol. function=drug transporter activity; Cellular component=membrane; Biological process=multidrug transport
  Homolog annotation: Hit_ID=Q1T5H1; Match level="QueryCoverage=85%, HitCoverage=39%, E-value=9e-61, Identity=63%"; Hit description=Multi antimicrobial extrusion protein MatE
  Pfam annotation: Domain name=MatE; Domain location=1-121; Score=-4.1; E_value=0.0031; Accession=PF01554.9; Description=MatE
  Subcellular localization annotation: CTP_CleavageSite=27; ConfidenceScore=5.31e-01
ANTICKFSSVTSSKKSKDKVGKKKRLIASASTALLFGTILGLIQAAVLIFATKPLLGVMGVKRDSPMLKPAESYLRLRSFGAPAVLLSLAMQGIFRGFKDTTTPLYVIVSGYALNVILDPIFIFTLKLGIKGAAIAHVLSQRIVDAKATSLAARLGSIPMAAFQTCLQVWMTSSLLADGLAVAVQEMLDSNFYFQ

SEQ ID NO: 136555 - protein, 59 aa, Glycine max
  Coding DNA Sequence Number=SeqID_19777
  Homolog annotation: Hit_ID=Q9LQ55; Match level="QueryCoverage=76%, HitCoverage=5%, E-value=4e-13, Identity=73%"; Hit description =Dynamin-2B
MGLLQKKTMVYHVLVDLVSSSANATPGLGRYPPFKREIMAIVSSSLEAFKNESKKWWLH

SEQ ID NO: 136556 - protein, 96 aa, Glycine max
  Coding DNA Sequence Number=SeqID_19778
  Gene Ontology: Mol. function=structural constituent of ribosome; Cellular component=ribonucleoprotein complex; Biological process =translation
  Homolog annotation: Hit_ID=P49210; Match level="QueryCoverage=48%, HitCoverage=24%, E-value=5e-14, Identity=74%"; Hit description=60S ribosomal protein L9
MRKPKDALSVKTGAKREEIPNFNILLVVANPSVDWKVSIHEPHLVTISLGEAGDQILDVAQQGLEDLLAVLGVSGRSFIERWRLEAIEGSTAWWEE

SEQ ID NO: 136557 - protein, 158 aa, Glycine max
  Coding DNA Sequence Number=SeqID_19779
MTDHGTRKTTTDRLEEAIVRLTNSHTSINDRYNDLSGKVDSILEHLRLLDSGNHTSTVPANPPNHPHNAVKIDIPRFDGRDPLGWIFKITQLFQYQNTPEEERIIVASLYLDSAALSWYQWMFNNGLITPWNGFLQALESRFAPTFYEDPKGALFKLT

SEQ ID NO: 136558 - protein, 328 aa, Glycine max
  Coding DNA Sequence Number=SeqID_19780
  Gene Ontology: Mol. function=RNA-directed DNA polymerase activity; Cellular component=chromatin; Biological process=chromatin assembly or disassembly
  Pfam annotation: Domain name=RVP_2; Domain location=124-238; Score= -37.8; E_value=0.00088; Accession=PF08284.2; Description=Retroviral aspartyl protease
MALQPISLLQATALAKLQEEKLRDRATPVPRSFPHPEPSSTSNPNISAKPKSPFVQRTPAEMAFRREKGLCYNCDEKWNAGHRCKGKSTIPDSVDHEVEDERGAIVIENHEFQGDANCSHISLHALAGLPSSETFRIYGSIKNSKLTILVDSGSTHNFLQPRIAQFLHLPAQYTHPLQVMVGNGTMLTSDQVCPETQVIIQGNPFVISFHLLPISGGDAVLGIDWLRRLGPVTTDYTESIINPIKASHSDGLNFRVLSIAHHHPKPARPTPLFTPHPICGAPTSSVWSSLPTTITASASTTGGTSHYLEAIHNSDKCQTLLISTFSEE

SEQ ID NO: 136559 - protein, 154 aa, Glycine max
  Coding DNA Sequence Number=SeqID_19781
  Homolog annotation: Hit_ID=Q6CQE5; Match level="QueryCoverage=29%, HitCoverage=41%, E-value=1e-09, Identity=68%"; Hit description =Protein TAR1
  Subcellular localization annotation: CTP_CleavageSite=51; ConfidenceScore=5.05e-01
MTTDISALASMKNVAKCDTWSSSVADRAQVPWKGAPERVRTPSCPDPVAPRGAVGESGCLGMQPQSGGKFRPRLNTGERPIANKYREGYINSRLLLNPWLSQGMDPIASMHVRDAVGKGGAVNCGRRKKMQNEYGRKKGKIHPLFEKGKTPYRN

SEQ ID NO: 136560 - protein, 84 aa, Glycine max
  Coding DNA Sequence Number=SeqID_19782
MAMAQVRPVVRDAVGKGGAVNCGRRKKMQNEYGLRAGLAVAMGEEDSGGINGEGCAWTVLLTLHATQKREREKAKTKGERRMKS

SEQ ID NO: 136561 - protein, 690 aa, Glycine max
  Coding DNA Sequence Number=SeqID_19783
  Gene Ontology: Mol. function=RNA-directed DNA polymerase activity; Cellular component=chromatin; Biological process=chromatin assembly or disassembly
  Pfam annotation: Domain name=RnaseH; Domain location=199-320; Score= -27.8; E_value=0.022; Accession=PF00075.14; Description=RNase H
  Pfam annotation: Domain name=rve; Domain location=364-500; Score =12.0; E_value=0.00059; Accession=PF00665.16; Description=Integrase core domain
  Pfam module annotation: Pfam domain module=RnaseH::rve; Domain location=199-320::364-500
MDYRALNSVTVRDRFPIPTIDELLDELGCASWFSKLNLRQGFHQILMEKHNGHFEYLVMPFGLCNALSTFQSAMNQLLQPFLRRFATVFFDDILIYNNSLSSYILHLETIFRTLQQGEFFLKRSKCLFAQESIEYLGHIVSGKGGSTASSSRTMLPLHPLLQKLLCKDAFSWTQESQVAFDQLKAAMTNARVLALPNFSEPFVIETDASGTAIGAVLMQNGHPLAYFSKNLGPRLLHASTYIRELHAIVAAIRRWRQYLLGRPFTILTDHKSIRELMTQVIQTPEQHYYLSKLPGYDYSIQYKSGVTNVVADALSRAPATDGELLILSVPQLDFLHDIKHSLKTNLEFQQLMKLIQDDPTSHPDYTLCDGLILFKGRIWLNKGNPSIPSLLLEHHATPLVVVDRYSKGIHLGALPTGFTAFKVAALFMEIICNLHRFPKSIVSDRDPIFTEVINRVLEQYLRCFVHDQPASWFPYLALVEWSYNTSRHSSSGLTPFEVTYGKPPPTIVDYITGATKNEAIHAVLDERQALHSKLQQRLKKAQEVMTKYTDTKREDVTFDVGQWVYVKLRPGRQTSIAGQRHPKLSKRFFGSFQITERIGHVAYCLKLPLESQIHLGEPPEDTTWESWTELCETYHLEDKVDFREGGSVSSTIQAQPPPLIPPPSSPPIATARPARTRKTPPHLHDYYTNT

SEQ ID NO: 136562 - protein, 137 aa, Glycine max
  Coding DNA Sequence Number=SeqID_19784
MAPNFRGRWAREVSCQRWKRAINCSSTRSSALENKFALVMFGTKRMGTGRWQRQSPKNVPELQKQVVRISVTSIKAHQNVERRVTSRERPEKTSEKEKGPSEKRKQVAGISATTRKVHWGHGGGRFSLFPQPGTDTM

SEQ ID NO: 136563 - protein, 98 aa, Glycine max
  Coding DNA Sequence Number=SeqID_19785
MVMVIISIAMTTIKLSMVVAMVVTIALEVVVEGHWWWWQCKCDTNDGGGNASGGGNDKNDYGGGNYDRGGISGGDSDNNGGCDTLYPTHICTNNKRNN

SEQ ID NO: 136564 - protein, 44 aa, Glycine max
  Coding DNA Sequence Number=SeqID_19786
MPLTGGGTYKTKDSSTQGSSLDMQRVTSLSSPQVWTSVVLCQVW

SEQ ID NO: 136565 - protein, 78 aa, Glycine max
  Coding DNA Sequence Number=SeqID_19787
MLIIHENGGELGRALQKSTVMEHILCSDGDFIQAFARRGLNLAPFKKLNYGQFGMEANSMADSFAKTGLSLKSRILNN

SEQ ID NO: 136566 - protein, 68 aa, Glycine max
  Coding DNA Sequence Number=SeqID_19788
MRGGGCTAARPGELLASSRSSLARPSELSFLVGPGAEKCPKSDPFALILSILHISFRNITNPYRLHDN

SEQ ID NO: 136567 - protein, 112 aa, Glycine max
  Coding DNA Sequence Number=SeqID_19789
MRGGGCTAACPGGLSSLFCLNRKERRVYGKGFTGSRKYLQSIRLRQERGLRTIGRIELAYGRIEVKAARFLDLAQFLTKLHKISSTSSDMDNRSKEQLCACKVYVAGHLALG

SEQ ID NO: 136568 - protein, 202 aa, Glycine max
  Coding DNA Sequence Number=SeqID_19790
MVCVENADMTDRLLVGSFTFKCHIMHYILCRVLLPHSTNLAQASEEDLILLWALQTGCQIDWAHLVHYHMHKTLQANAHVPYPHLVTLILQHFNIPLVNEPFIKVKCSFAIGVVAVASFGYRKDLDGQRIRKQDLPPNAPDERTPSPPPRDHFSSLLNDVLNELWDLRAFVGDRFDSMDSCITRLEDDMSFIRSCFDPPIDS

SEQ ID NO: 136569 - protein, 74 aa, Glycine max
  Coding DNA Sequence Number=SeqID_19791
MSSKARVAPFSCLARVSEYPLSKLGALITGREKRLTERADDTLSAKMLLRFSQLAKRAECLALRMILAKRTSLT

SEQ ID NO: 136570 - protein, 160 aa, Glycine max
  Coding DNA Sequence Number=SeqID_19792
  Gene Ontology: Mol. function=DNA binding; Biological process=DNA integration
MPSTLPGDADVPHTPPNNLHSLSSPWSFAISKTTLGNYGQLGGKIHLEAPHLQTYEDFLTRLGIKHLVTFVEHPQTNEQVEAANRVILKALQTILDGLKKEELYNILWAYHYTPQTVTNETPYRLTYDTDTMILVKFREPSTTRLLFKQQQNEEKYEGGT

SEQ ID NO: 136571 - protein, 64 aa, Glycine max
  Coding DNA Sequence Number=SeqID_19793
MLATGNRLLPSDQRCERWEQGWSRKGHSRSKLRWPSPSSEASKGPPSAFSTNPRPGSHNLAAIA

SEQ ID NO: 136572 - protein, 594 aa, Glycine max
  Coding DNA Sequence Number=SeqID_19794
  Pfam annotation: Domain name=IncA; Domain location=208-488; Score= -18.9; E_value=0.097; Accession=PF04156.5; Description=IncA protein
MSSFLPDSAIGLSGGECHCASAPGLGCHSTLNRFSVYSAGALECGSFLAPPKQLGDGTLSLASYSTSSLTPLGSSRQGSVDPYGEGIMGDFAWRPLVKQVGPVGGTVPPSTVALSVGEGGQPTNEVGSIVVATEVTHSTPSSVLAKRKRDDATRPSGRKKSKAPMSLCVLRQAIRLGPTVGRRTTTQDIPLAHLTIEASVAATATSATSAPSPHVAVVQEVSPIVVKVVAPATQADSVMVSSSIVAAPLLIVDVMTIGALTVLPPSSSALVVLPAIILAAMVSPFSSSHPRVSLDHLCTSSDTDSLWSVTYKPRQKTPVGFVSAFNRNLSGERTAAPRGSLKDGILGGGGRQAIRTNRQLSSKVGGALAKLLRTQLDGDDLFRHCKDFQVENMDLDGRVESMVAEKDELAKRVAELEARLRESESRLEESELRAAKEWETNTELEEELILYKKEAIEKHQKGFQKAIRKRLMRKRRLLMKGRVLQSKAMTLSFFLPDCEDLCLTYPWLKVFPNQCGDRSLDLLNSSFDGYKESTPPMVMRSKCGFDLIKSLSNNGVAGHFAELRPLAVIVVVVGGPWALVPRVNLGFCRCEYQG

SEQ ID NO: 136573 - protein, 66 aa, Glycine max
  Coding DNA Sequence Number=SeqID_19795
MFEYEFQTWCSNFMTIQRLTSSKSSFYQDRFRLHQGWSLGLSSLGSGTCLSWILSSPQSCVEAYQG

SEQ ID NO: 136574 - protein, 188 aa, Glycine max
  Coding DNA Sequence Number=SeqID_19796
MTDKDTLQQLQNRITEMEQRHEEKLTKLNANHDQLEARVRRPQGDEQSAHILPETQGESYPRCIGDTIDNLSLSYMQRPSAQTVCRHSFVDRIMETDIPLGWKPLNLEWYDGTTNLDEHLDAFLTQANLYTNDNAILCFVLPTSFKGVALTWYDGLPPRSIDSIDTLIERFSAQYAISRSLLDRVASE

SEQ ID NO: 136575 - protein, 147 aa, Glycine max
  Coding DNA Sequence Number=SeqID_19797
SSALLLSASWFLFYSSGCPLGLAPAWLLSDLLTNWAKYPTYISFVWGSWMGTSRLNAFSRIMDSSSACHGLAKAAEIITKDDDKGDDKKLKGQSKNEFKMFKIESRTLQDSRGKLNSRIKNQDSRDQGSRLKIQESRKGYSRIKKKA

SEQ ID NO: 136576 - protein, 188 aa, Glycine max
  Coding DNA Sequence Number=SeqID_19798
  Gene Ontology: Mol. function=binding; Cellular component =intracellular; Biological process=RNA processing
  Homolog annotation: Hit_ID=O64858; Match level="QueryCoverage=96%, HitCoverage=32%, E-value=5e-42, Identity=46%"; Hit description =Expressed protein
  Pfam annotation: Domain name=DUF946; Domain location=2-188; Score= -203.1; E_value=2.6e-12; Accession=PF06101.2; Description=Plant protein of unknown function (DUF946)
  Subcellular localization annotation: CTP_CleavageSite=32; ConfidenceScore=5.25e-01
FSIFEPSGVPKGFSMLGSYSQPNNKPLSGYVLVAKDVSTNTSNPSLKQPLDYTLVWNSASLEIDQDGPIYVWLPIAPNGYKAVGHVVTTTPTKPSLEKIMCVRLDLTDQCETNSFIWDSDNFNFLDVRPSNRGIQAPGVRVGTFVAQNASLNSPSIACLRNTNAIPKYMPNLPQIKAILQVYSPVMSL

SEQ ID NO: 136577 - protein, 183 aa, Glycine max
  Coding DNA Sequence Number=SeqID_19799
  Subcellular localization annotation: CTP_CleavageSite=46; ConfidenceScore=5.31e-01
MASSSSLLLLELKFRAPQITPKRRRSLSRFCSQNSRYNVALRTRIRAFKEEGAVIDRVNDVKWSGNGVAASEYGANGSVNGYANGVSGVRESENANGSLVKYVNDNGNGNGVAAEVVEDSAEASKRMEDGRKKRETNTALIPWPSAFDAPSNYTIHLFLSLSSTSSSNKVMMSSSGNSGCIGW

SEQ ID NO: 136578 - protein, 108 aa, Glycine max
  Coding DNA Sequence Number=SeqID_19800
MEEVRAVHLVEFNGRARMMQSYPARVLDRRLQEDWARAAKEGLGVLMNPRLSSSFPRKLLKELKDPAFIEAPQATSIKGRAMSEWLGFNGKTRKSLGFNWKNKEEARA

SEQ ID NO: 136579 - protein, 189 aa, Glycine max
  Coding DNA Sequence Number=SeqID_19801
  Gene Ontology: Mol. function=transcription factor activity; Biological process=regulation of transcription, DNA-dependent
  Homolog annotation: Hit_ID=Q710F0; Match level="QueryCoverage=58%, HitCoverage=19%, E-value=3e-14, Identity=35%"; Hit description=CDT1a protein
  Pfam annotation: Domain name=CDT1; Domain location=20-134; Score =11.6; E_value=9.8e-07; Accession=PF08839.1; Description=DNA replication factor CDT1 like
MEQNACKELSKIASDFKCEKVLETVDESIVCPTPQKNEEPLTVKSREGQTNLPEKKFSHAHLAQMKYILPKSVCIDRVLVHDKKSLCMVPDMKITLKFEVVEDCSGESADLALRRYFKSKLIDFFDMHPEDMPTQKSTSSYKPGKRVLDFSLMEDNDGLGIEVDKLESIRALHGSIRYMIRSLKGLLKK

SEQ ID NO: 136580 - protein, 124 aa, Glycine max
  Coding DNA Sequence Number=SeqID_19802
  Gene Ontology: Mol. function=DNA binding; Cellular component=beta -galactosidase complex; Biological process=DNA integration
  Homolog annotation: Hit_ID=Q1SD84; Match level="QueryCoverage=88%, HitCoverage=11%, E-value=3e-32, Identity=44%"; Hit description =Integrase, catalytic region
MEVVCSKRGIVVSQQKYILDLLEETGMSGCRPVDTPIDPNGKLWEKGSLHVDVGRYQRYLKSNPGKGMFFKKNSDLEKSKKQGVVAKSNAEAKFRAMAQGICEGLWIYRVLEELEMEIELPLKL

SEQ ID NO: 136581 - protein, 74 aa, Glycine max
  Coding DNA Sequence Number=SeqID_19803
PFAKCTPCAKRISVHALSYESHALSFSLIAKRQLIRGQAQFLMAIIEVHDAKRQSWQLSEIHCGNMSAKRVPLS

SEQ ID NO: 136582 - protein, 163 aa, Glycine max
  Coding DNA Sequence Number=SeqID_19804
  Gene Ontology: Mol. function=oxidoreductase activity; Cellular component=membrane; Biological process=metabolic process
  Homolog annotation: Hit_ID=P0AFP4; Match level="QueryCoverage=99%, HitCoverage=60%, E-value=4e-66, Identity=73%"; Hit description =Hypothetical oxidoreductase ybbO
MPQFRQNRFRRQAKACGDTGVAHGLIAFALLHVFGKPGGNRARLNQADAHAAGAYFHAQRIAPRLQRPFTGGISAAARRGNQAEHRAGVDNPPVAAILQRRQQAQRQLVGAEKVGGELLLQLLTRHAGQRTVLAEAAVIEQPVQAVIGEGQHAIGGGIHTGRI

SEQ ID NO: 136583 - protein, 53 aa, Glycine max
  Coding DNA Sequence Number=SeqID_19805
MEWSMLACWDNSITIVNYKQTRLLQETFKVKQTKIASILIQGQANKIKKKIRP

SEQ ID NO: 136584 - protein, 89 aa, Glycine max
  Coding DNA Sequence Number=SeqID_19806
MLHALWDCPHSKEVQIGMGVNSRRILTGNKWSIQHVCQLIRSIVTELEVYCTSRQPVTTEALNAPKNHFVKLNVDMILGYLIMLWVEEV

SEQ ID NO: 136585 - protein, 383 aa, Glycine max
  Coding DNA Sequence Number=SeqID_19807
  Pfam annotation: Domain name=BRO1; Domain location=32-379; Score= -119.3; E_value=3e-05; Accession=PF03097.8; Description=BRO1-like domain
MMLHFVQPSKLKTKKMVFEDVYASCDSTTLEHLKELSSKRKAIEDSINECNFVTEAIAKEMSGGLESRFEQDIHKIENYLPFLEILIPYADATSTINQIQISQWNAALKIRWSSALTTSSFFKIKGPKFFQINNLRFELGMTLFLCGGILRERALEVLSTDLVQSATIFRQAAGIYHHLAQEVLPHLEPELPPEKPPEALAAVSSIMSLICLAEAQAVTIRKAEEKGTSSSLLAKLHHGVTLFLEEAIGIFHTVVTQCKDISSRLSEFMYFCKCLHELKGQQYLAESLKACGQIGAAIGVLSSVLNKVKKKIPGEDPWKSIYQKQIQDASEVLRKFVHENDFVWHEKIPSIYELPLPEGTKIVTFIPYSPKRWERQLSFKGLV

SEQ ID NO: 136586 - protein, 176 aa, Glycine max
  Coding DNA Sequence Number=SeqID_19808
  Gene Ontology: Mol. function=RNA-directed DNA polymerase activity; Biological process=RNA-dependent DNA replication
  Homolog annotation: Hit_ID=Q2HS45; Match level="QueryCoverage=93%, HitCoverage=49%, E-value=8e-25, Identity=55%"; Hit description=RNA -directed DNA polymerase
MPPYGGMLWLEQGSLPSSLSEMNIVLIPKCDNLLSMKELRSISLCNITYKILSKALANPLKPFLSRCIDEEQSTLVEGRVILDNVMVANELMHYLRFKARGIKDLSTLNKRVEAQGVVEGLGNKYLALPSLVGRSRKFMFGYIKDRVWKVEKDPILERQVFIKTKKRDHDKVYVIA

SEQ ID NO: 136587 - protein, 863 aa, Glycine max
  Coding DNA Sequence Number=SeqID_19809
  Gene Ontology: Mol. function=RNA-directed DNA polymerase activity; Cellular component=chromatin; Biological process=chromatin assembly or disassembly
  Pfam annotation: Domain name=RVP_2; Domain location=139-259; Score= -52.2; E_value=0.012; Accession=PF08284.2; Description=Retroviral aspartyl protease
  Pfam annotation: Domain name=RnaseH; Domain location=483-601; Score= -27.7; E_value=0.022; Accession=PF00075.14; Description=RNase H
  Pfam annotation: Domain name=rve; Domain location=703-861; Score =29.4; E_value=1.3e-05; Accession=PF00665.16; Description=Integrase core domain
  Pfam annotation: Domain name=zf-H2C2; Domain location=644-685; Score =14.4; E_value=0.0044; Accession=PF09337.1; Description=His(2)-Cys(2) zinc finger
  Pfam module annotation: Pfam domain module=RVP_2::RVT_1::RnaseH::rve:: zf-H2C2; Domain location=139-259::244-409::483-601::703-861::644-685
MVAQYLADFEDLANRIIGLPAPFLLSYFISGLNADIHCEVQAHQPLTLVQVAGLARLQEEKFVDARQNPHPPPLRPRHQPSPLPHPITPHVSSPPIRPVSTPSLLPPPPRQPGPSVKRFSLEEIASRRERGLCFNCEEKYHRGHRCASRVAPETLRFMGVIADHQIILLVDGGSTHNFIQFQLVSQLGLPTRTTMPLRVMVGNGQQLECNSLCEAVTVTIQATSFVVDLHVLPIAGANVVLEVQWLKSLGPVLTYYNTLCMKFFHAALNALTIKDRFLIPTVEELLDELGGTSFFSKLDLLQGYNQIRMYSGDIPKTAFRTHHDHYEFRVMPFGLCNAPSSFQATMNVVFRPYLRRFIIVFFDDNLVYSAFMADHLTHLEATFQVEYLGHVVLSQGVQPVASKVDVVLHWPTPQSSRAVRSFLGLAGFYRRFIKGYATIAAPLVKLTTLDHFQWTEQAQIAFDELKRALSSAPVLALPDFDIPFIVETDASGIGMGVVLSQKGHPIAFFSKPFHPHLLTASTYVRELFAITTAVKKWRQYLLGHRFIIITDHMSLKELLTQMIQTPEQHTYLARLMGYDYQIIHRSGAQNQAADALSRIPDLASSSYLTLSVPCPTFLEELRRQLESSSTYGFSMIPTLLTEYHSTPTGGHMGIAKTLARLSENFSWPGIRQDVTDFVTNCLPYQQTKYETKKIAGLLCPLPVPQRPWEDLSLDFILGLPLYHGNSVILVVVDRFSKGIHLGMLPAAHTAHVVASLFIEIVGKIYGLPRSLVSDRDPLFLSHFWRELFQLSGTQLRMSSAYHPQSDGQTEVEWCHNTSWNVATRSTPYEITFGCKPFNFPDYIAGSSNLDAVDDMLKDREETF

SEQ ID NO: 136588 - protein, 81 aa, Glycine max
  Coding DNA Sequence Number=SeqID_19810
MSEGFQGSVLKDIERRGKEEEEGRENEADALPNHDCNQLLHRSSFGVLRSSSDLMNYVGLNFSSHLRIRRNKGNTLVDPKK

SEQ ID NO: 136589 - protein, 149 aa, Glycine max
  Coding DNA Sequence Number=SeqID_19811
  Gene Ontology: Mol. function=RNA-directed DNA polymerase activity; Biological process=RNA-dependent DNA replication
  Homolog annotation: Hit_ID=Q1T5K4; Match level="QueryCoverage=95%, HitCoverage=19%, E-value=1e-18, Identity=30%"; Hit description=RNA -directed DNA polymerase
MNELELKGEEVPLNEEELVSWRTQQEEFWRIVMHKESLRHQKAKVKWLNEGDCTSKYFHLMVNWKRRNNLLRGLHMEAFGDEEVREAVWECGSSKNLGLDSFKFKFIKESLCFMKHDILNFLQDIHVNVVIARGCNASFIILIPKVVDP

SEQ ID NO: 136590 - protein, 241 aa, Glycine max
  Coding DNA Sequence Number=SeqID_19812
MASRVLLGTLFFKKNYLLFFLDFSLPSIISVHALGIVSKCGITLAIINVSLAQDTKLNEEKSTPEPSNVLVNTTTETTNAEVEDELSLSLTLPNPSPQSLGSEISEAISSCPGFGNNYKDCSRSEWPILDCLKRMKIAIGSTRGRAYLHDGLRKGDLQRGRRKRWRMVQKRESSIQGENEKVSGCGIGDKRRRRRRRTRRIKKGSSFYTTYQDTTMSMTTNTTECDDRHRVRDDDSDNTCG

SEQ ID NO: 136591 - protein, 124 aa, Glycine max
  Coding DNA Sequence Number=SeqID_19813
MVSLNKWKYQHSTDEDSLLESDVSLDMRSFQEKFDEEVRLENINVLVAKGRNQGKGLNGDGNGDGVGEDQSVLYPMSVRWLKGDNGDEKCQILLDEDGKEVRLNEKGGLDGDVMKSELVSEEGK

SEQ ID NO: 136592 - protein, 145 aa, Glycine max
  Coding DNA Sequence Number=SeqID_19814
  Pfam annotation: Domain name=Chromo; Domain location=4-59; Score =17.7; E_value=0.0081; Accession=PF00385.14; Description='chromo' (CHRromatin Organisation MOdifier
MVKELVDRDEALRPLRQKNGIVVPYWLIKWQGKLVEEATWEDAVTIKNQFPGVSLEDKLVAEGEGNVRFHKLPSPVQLSHETWDLATGKTILIAKEQGAFRVVLLGAQEDPRPESKVTIKPTSKVRHLGYLSNMASPQTTWESSV

SEQ ID NO: 136593 - protein, 191 aa, Glycine max
  Coding DNA Sequence Number=SeqID_19815
  Gene Ontology: Mol. function=hydrolase activity
  Homolog annotation: Hit_ID=Q2QLI3; Match level="QueryCoverage=70%, HitCoverage=41%, E-value=5e-43, Identity=61%"; Hit description =Expressed protein
MAEKEGISITYYGLRNTVQFKNSTQRKFLSWSKHKIWVTYLEPGESSDIETNYGSKISVKATAGPVLGPPWQRPENGYIVTSPQGQLSLYYEPHCVYNQSFTEKERADIVITPVIKQLLPNFTLVSGQEDAVKLAKLLQAKFIVPMKNGDLDSKGLLASLISGEGTVESFKDLCSGFENRMNVSLSPMLIA

SEQ ID NO: 136594 - protein, 91 aa, Glycine max
  Coding DNA Sequence Number=SeqID_19816
MTNEEHRMKNDVEVDYSHDSRAGYFSLKPFGGPGKLEASLGEPGSRKLPSMNLLPLSFAPLTKTLNDLSFCTVTNVEQLTSASEDQKINEC

SEQ ID NO: 136595 - protein, 197 aa, Glycine max
  Coding DNA Sequence Number=SeqID_19817
  Homolog annotation: Hit_ID=Q2QLI3; Match level="QueryCoverage=49%, HitCoverage=29%, E-value=1e-27, Identity=59%"; Hit description =Expressed protein
  Subcellular localization annotation: CTP_CleavageSite=56; ConfidenceScore=5.95e-01
MATLQCNCNSLALNKPSYSRRRRRQFLQPLFSSTRFVSSNSICTSSSATTSRWGCAVSAVVSEENAVGSSFSAADVFKLTYLEGNSWIWNVGGINILVDPILVGNLDFGIPWLYDAAKKVLQKFQLSDLPEINCLLITQSLDDHCHLKTLKPFSQKFPDIRVIATPNAKGLLDPLFRNWFKLFQMRASTAMSNIYCT

SEQ ID NO: 136596 - protein, 1475 aa, Glycine max
  Coding DNA Sequence Number=SeqID_19818
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=91%, E-value=0.0, Identity=37%"; Hit description=Chromo
  Pfam annotation: Domain name=Chromo; Domain location=1323-1377; Score= 51.3; E_value=3.2e-12; Accession=PF00385.14; Description='chromo' (CHRromatin Organisation MOdifier
  Pfam annotation: Domain name=RVP_2; Domain location=379-512; Score= -26.5; E_value=0.00012; Accession=PF08284.2; Description=Retroviral aspartyl protease
  Pfam annotation: Domain name=rve; Domain location=1074-1234; Score =78.1; E_value=2.7e-20; Accession=PF00665.16; Description=Integrase core domain
  Pfam module annotation: Pfam domain module=Chromo::RVP_2::RVT _1::Retrotrans_gag::rve; Domain location=1323-1377::379-512::625 -794::126-201::1074-1234
MKAKVTTLESEVSEVRTTLMEVQNTVKENHATLIALLEKCFGKSVQQDEGESGGKQKTPEGKGSPENEGSSGNSSGGSGGAVLSEFRHAVKKVELPMFNGKDPAGWISRAEIYFRIQETTPKVKIRLAQLENEGLTWEGLKEALLGRYGGHGEGDVYEQLTELRQGGTVDEYITEFEYLIAQIPKLPDKQFLGYFLHGLKPEIRGKVRSLATMGEMNRSKLLQVTKAMEREVKGSGSNFYRGPKSGNGSHRPNSYGSSKPGSDWVMVKGREVEATGGARSNANGPNADKPAHSDRRRTGPRDRGFTHLSYQELMDRKQKGLCFKCKGPYHPNHQCPDKQLRILVVDDDAGAEQEANILAVEVDESEEEEGGEMCILNLNHIAFENHQTVKFQGQIQGVPVLVMVDSGAMHNFISQKLVHKMEWPIEETPMMNIKLGDGCYKSSRGVCCGMELGIGSFTISPKLHLFELGGIDVVLGMEWLKKLGDMIVNWRQQTMSFWSDKRWVSLQGIDGQEKKLVALQSILSKPKLNDQEVLWGLKTQERSEVQCLTKHQQVELDHLLVQFEDVFKEPSGLPPRRNKEHAINLVEGHGAVNVRPYRYPHHHKNEIERQVQEMLTAGIIRHSTSSFSSPVILVKKKDSTWRMCVDYRALNKVTIPDKFPIPVIEELLDELHGANFFSKLDLKSGYHQVRVKDSDVCKTAFRTHEGHYEFLVMPFGLMNAPSTFQSLMNEVFRSLLRKCVLVFFDDILIYSRGWENHMKHLETVLKMLAQHSLVANKKKCQFVQKSVEYLGHVISEAGVAVDPNKVKSVIQWPVPKNVKGVRGFLGLTGYYIKFIRDYGKVARPLTELTKKDNFKWGVESQQAFEELKRRLTTAPVLALPDFTKQFVIESDASGGGIGAILMQDKRPIAYFSKALGRRNLTKSAYEKEMMAIQRIVTAEQQNWAAKLLGYDFEIVYKQGRLNKGADALSRMYERTELNTITSYAQWDQKQQVTMEIQKDEKLQSIIKALQQDPKAKPGYVYKQGVLMYNGRIATNVYWMGMKGTIQEYVRSCDICQRQKYMATAPGGLLQPLPIPEQIWDDISMDFITGLPKSRGYEAILVVVDRLSKYSHFIPLKHPYTARSIADVFCKEIVKLHGVPVSIVSDRDPVFVSGFWKELFRMQGTQLKMSSAYHPESDGQTEVVNRWLQGEVRIEAVQRDLIDRDEALRQLRSQLLRAQERMKRQADKKRIDKSFVVGEWVFVKLRAHRQQSVVTRINAKLAARYYGPYPILERIGAVAYKLKLPTGSKVHPVFHVSLLKKAIGEYHEEEALSELLSDEQTEIFEPEAVLGTRKIKQQGEEIKQVLIQWKGKTTDEATWEDVIMMKSQFPTFNLEDKVLIEEGGVDRGHAVDSVPHEELAHHETTGPRTWLVYSRRVLEEFFPLRLEYYERRKHKGFTPMPRKCKSAEPQVAGANEDQEDDNNTTELEKKLYKEVK

SEQ ID NO: 136597 - protein, 186 aa, Glycine max
  Coding DNA Sequence Number=SeqID_19819
MTFLPNRFMNECGRSKADQSLYGLLEPQSIQNAKERRQQCQQYIETWVKESQRQLYLGAYLHQARWQLFVLHPRENTVVWFCSLRKKPDINIKGAINSAMKTITSSFEGMSNQGAPRWVEPKSNVQSGGFECGYYVMHWMWCIVTAGLKDDWHKWFSDGSPLDVEAITTVRQKWATYFLTFRKSSC

SEQ ID NO: 136598 - protein, 434 aa, Glycine max
  Coding DNA Sequence Number=SeqID_19820
  Gene Ontology: Mol. function=protein serine/threonine kinase activity; Cellular component=membrane; Biological process=protein amino acid phosphorylation
  Homolog annotation: Hit_ID=Q9LRY1; Match level="QueryCoverage=85%, HitCoverage=91%, E-value=1e-132, Identity=66%"; Hit description =Receptor protein kinase-like protein
  Pfam annotation: Domain name=APH; Domain location=92-270; Score= -10.7; E_value=0.033; Accession=PF01636.13; Description =Phosphotransferase enzyme family
  Pfam annotation: Domain name=Pkinase; Domain location=89-363; Score =159.6; E_value=8.2e-45; Accession=PF00069.15; Description=Protein kinase domain
  Pfam annotation: Domain name=Pkinase_Tyr; Domain location=89-363; Score=146.3; E_value=8.2e-41; Accession=PF07714.7; Description =Protein tyrosine kinase
  Pfam module annotation: Pfam domain module=APH::Pkinase::Pkinase_Tyr; Domain location=92-270::89-363::89-363
MSCFSCFLPNEKKVAKKPNNRKRIQQPAIHSPKESAQPVQPRPDNHFNKAKATPQTEPKINKEANKDNGNNIAAQTFTFRELAAVTKNFRQECLIGEGGFGRVYKGRLEKTNQEVAVKQLDRNGLQGNREFLVEVLMLSLLHHQNLVNLIGYCADGDQRLLVYEYMPLGALEDHLLDLQPQQKPLDWFIRMKIALDAAKGLEYLHDKANPPVIYRDLKSSNILLDKEFNAKLSDFGLAKLGPTGDKSHVSSRVMGTYGYCAPEYQRTGQLTVKSDVYSFGVVLLELITGRRAIDNTRPTREQNLVSWAYPVFKDPHRYPELADPHLQGNFPMRSLHQAVAVAAMCLNEEPSVRPLVSDIVTALTFLGTAPGSQDLTGIAPVDMSSSPQEANNSAPLNLLDDDIFMDRQRAVAEAIEWGTNTRSKAPLRDSPTSL

SEQ ID NO: 136599 - protein, 57 aa, Glycine max
  Coding DNA Sequence Number=SeqID_19821
  Gene Ontology: Mol. function=DNA binding; Cellular component=nucleus; Biological process=regulation of transcription, DNA-dependent
  Homolog annotation: Hit_ID=Q9LSI7; Match level="QueryCoverage=56%, HitCoverage=10%, E-value=3e-09, Identity=75%"; Hit description =Transcription factor-like protein
MVGGLIGRCVSNISRIRNEFGAMIKGSRGVEGVVGLGGLTIPDLILKTTTSQPKKKI

SEQ ID NO: 136600 - protein, 150 aa, Glycine max
  Coding DNA Sequence Number=SeqID_19822
MAISNMHPQFKEKLVAQEYGDLYQLASKTNRMEQFIHKKKVLKRKLKSYEVNLTHVQGKGIARDGKKALKEGHFKLANRGVVKTEMDVDPFPKLDINMVSYEEPANKGKKMKQAWKPKIIGIQKTKGSIKRTSVFEKIVVTSFSNRNMGT

SEQ ID NO: 136601 - protein, 89 aa, Glycine max
  Coding DNA Sequence Number=SeqID_19823
VLLLRHVATVKDSNIVDTLPLAYCHLIECCIPANKDFLTIIVQVKNCLSEWGRVIPFYEKERLACISVNVRAMAVHQNGSKLDDKTTHK

SEQ ID NO: 136602 - protein, 77 aa, Glycine max
  Coding DNA Sequence Number=SeqID_19824
MVTTRNGNDSKGGANHFDGGANNDNPLLQQLLKAVEDLKNKNEAQQNLNEETQQQNIEAKTRRREEKERHLAAVIEA

SEQ ID NO: 136603 - protein, 136 aa, Glycine max
  Coding DNA Sequence Number=SeqID_19825
MTEARQKGVRKHSKKLRKLTDCATTPPFGFRLITEFHAHDDSRLYYFFFLHNTKQNTNNNKNNNNIIYTFGKGINRENNKGHIFQSRGSALHNEEHIGEWRIALEGPHYAIMKNGSKLIGGGCMNENVIHGAPKTG

SEQ ID NO: 136604 - protein, 45 aa, Glycine max
  Coding DNA Sequence Number=SeqID_19826
MDTSEPYTRAMRGIVHEPQVNLGVMMKDNDWYLKALHWGNEGHRA

SEQ ID NO: 136605 - protein, 79 aa, Glycine max
  Coding DNA Sequence Number=SeqID_19827
  Subcellular localization annotation: CTP_CleavageSite=35; ConfidenceScore=5.03e-01
MVTRTFCQPGSNEPVDAQRLTLSPTPFVVVTREVRVFALVVRKHSSPTTHEILLYWAETIGCNGEGKCCGRPTLSFSKH

SEQ ID NO: 136606 - protein, 222 aa, Glycine max
  Coding DNA Sequence Number=SeqID_19828
  Homolog annotation: Hit_ID=Q47522; Match level="QueryCoverage=28%, HitCoverage=83%, E-value=6e-22, Identity=75%"; Hit description=LacZ protein
VPPVQLLTGWCVTAKAPPDISAGKCSGHAARRVPFAIQAAQLLGRAIGAGLFAITPAGERGMCCKAIKLGNARVFPVTTLNSIGIPRRLRITTWKPAPSRRDAICALKESPAMRGFSFSARADLEGTPPRRAASKLASPTPNARRSARAWPGSPSIKLIDTVDLEGGPVGKPVVPAALMNRPTRGERRFAYWALAECILAYYVGTDEGVSEVLHVAEKKGCT

SEQ ID NO: 136607 - protein, 376 aa, Glycine max
  Coding DNA Sequence Number=SeqID_19829
MAKERGLPLKDKVMLWISVLESSKSRGLQYSPSIEADIHLLGARVRTKGSNAKTIANPLGEEHVANVMPTMGLYMQRDHMAHLVALGKIYEGGSTIHNVPYADDVKPVELLWDGTKFGIPNEETSFFLRYSNVNEIISGDKCLNMAILQVWMIAMKTLKTTVNGKTDQVTPQWIEVKSHVESGGYKCDYYVMHWMRNIVNGRLKNDWSMLKKLGANNIEVVIGCGVRFDHGFGVVKVILEQNCDTHKNFDDMCADIRLALSYLNNADQCGFDSSKDHPFDGSKPVHFSQHTLWKPMNNFVVDPCGEVNDVEILSIKGTTQQSQRDLSQLIGCLPILQDWEIIVASEKLAECQETIVNLGKQLKALVAPKDASTKIN

SEQ ID NO: 136608 - protein, 229 aa, Glycine max
  Coding DNA Sequence Number=SeqID_19830
  Gene Ontology: Mol. function=transferase activity
  Homolog annotation: Hit_ID=Q1S920; Match level="QueryCoverage=73%, HitCoverage=34%, E-value=1e-38, Identity=52%"; Hit description =Prenyltransferase and squalene oxidase repeat, putative
MEKDVHEKLQRMLLSVGFCASKLTPMPRLISMMGNSMAFMDPKLHSFLQMRMGYGKVLIHNNSQLASTYCAISILKIFGCELSNLDSETIVTSMRNLQQPDGSFIPIHTGGQTDLSGMDKEMTKDYILRCQVCEASASTRDGIRELSEDCTIFWTYMFVENSYNGGFGLVPGAKSHAPKIWKSLSHFILSYWEQATKKEVYFTCSRRQKLLEGQSIAASKRHSDNQCLS

SEQ ID NO: 136609 - protein, 240 aa, Glycine max
  Coding DNA Sequence Number=SeqID_19831
MHAKKNVDDSEIGTLLNIQGKTKDGLKYHQDLLDMVYESSCIRYHKVNEYFCPQHVTQCQQKRKNKVIDPRQLDDLENEATIVLSQLEMYFPLSFFDIMVHLNLLGFLKLVMTEHEENKPDKCFMSKIRVIQDCQWFYKEDPVGHLNTPKVPSAFGWSFKGKFDVPKALNAKKKDPSVKYDDLDPQTWEEFAASRKTPNWQGIRKKAQEIQKYNDCKHILSRRGYDLLEKKLMEEKMKKI

SEQ ID NO: 136610 - protein, 166 aa, Glycine max
  Coding DNA Sequence Number=SeqID_19832
  Gene Ontology: Mol. function=nucleic acid binding; Cellular component= intracellular
  Homolog annotation: Hit_ID=Q1SHX5; Match level="QueryCoverage=21%, HitCoverage=10%, E-value=4e-11, Identity=80%"; Hit description=Zinc finger, C2H2-type
MQAHHPFSYISSCPGNSTSSAFLEPHHHHHEAVVDEASISLSLGPPGQQHQQPNNPNKAVTSSIPHHHYQQNPTTTTSSDDHHRQRGGVTVALHIGLPSTTPTTSPNSVTTTTTTTSKSPDLHLASAAPNIQGQYWIPSPAQILIGPTQFSCTVCNKMFNRFNNMQ

SEQ ID NO: 136611 - protein, 143 aa, Glycine max
  Coding DNA Sequence Number=SeqID_19833
  Gene Ontology: Mol. function=nucleic acid binding; Cellular component= intracellular; Biological process=chromatin modification
  Homolog annotation: Hit_ID=Q69JB8; Match level="QueryCoverage=70%, HitCoverage=26%, E-value=1e-52, Identity=83%"; Hit description =Putative WIP1 protein
  Pfam annotation: Domain name=zf-C2H2; Domain location=44-66; Score =19.4; E_value=0.013; Accession=PF00096.16; Description=Zinc finger, C2H2 type
MLRLPCYFCAEVCKNNIEHPRSRPLKDFRTLQTHYKRKHGAKPFGCRKCGKPFAVRGDWRTHEKNCGKLWFCICGSDFKHKRSLKDHVRAFGDGHAPHTVESCGRVGEDGLLLLGDDDDDELEVEEDDEEEDYNSNDLAFGFN

SEQ ID NO: 136612 - protein, 105 aa, Glycine max
  Coding DNA Sequence Number=SeqID_19834
MILCWELQDCIERRRRREKCDGEEMKGWWRREEGNKEKDGLGSLETTNGRACMMTIVVLEWQLQISNLALRLSIGSQDQDSCGHGDHDYARKSDVHARKSNFSSM

SEQ ID NO: 136613 - protein, 88 aa, Glycine max
  Coding DNA Sequence Number=SeqID_19835
MWAHLDSIKLLNLFPTMLIYDTTYKTNKLKGFFVKDNVLPQVIVSDKNLAFTNALETLFSSSTNLLFMFHIRKNVSAKCKLLVDKGED

SEQ ID NO: 136614 - protein, 109 aa, Glycine max
  Coding DNA Sequence Number=SeqID_19836
MEERKSDDVVHGDSSSSLRSSEPGSVKSKAWLFLRECDEATVSFYDDDDGEPKRVKAKVCFEDRVDLNRDMAQAIRLVRATIEDLSTIDVAEALLSSKPPSTISPSRAP

SEQ ID NO: 136615 - protein, 83 aa, Glycine max
  Coding DNA Sequence Number=SeqID_19837
MAKSDDNVRSQVRILVKERKEEWVPAGTDEERVWRCIDAKSISLTSDIILKFPTVRMLKNELRTWFRNITMIQRLASARLSFY

SEQ ID NO: 136616 - protein, 124 aa, Glycine max
  Coding DNA Sequence Number=SeqID_19838
MAFPCKLTFQCLLSQEMAPRKLPTKRSRKDTTGEGSSVAPQADMDFDRLRFWSAEHQQRFETIKGWSFLRERRVQLRDDEFPDFQGEIARRHWAPLVRSMAKFDLEILIEFYANAWPTEEGVRE

SEQ ID NO: 136617 - protein, 166 aa, Glycine max
  Coding DNA Sequence Number=SeqID_19839
  Homolog annotation: Hit_ID=Q1SRN1; Match level="QueryCoverage=41%, HitCoverage=4%, E-value=6e-21, Identity=71%"; Hit description =Integrase, catalytic region
  Pfam annotation: Domain name=zf-C2HC_plant; Domain location=19-74; Score=63.7; E_value=6.1e-16; Accession=PF07567.3; Description =Protein of unknown function, DUF1544
MSGIGTDTASSNPPSKRIDIGWKHCTAVRENVTNEICCNYCHKIMKGGITREKHHLIEKSRNVAPCLVCPKEVSDEIRATENSDYLSTVALSHNPVLHSHTKHMELDIFFVREKVLNRSLVVTDVPAQDQIADVLTKPLSRTRFVYLRAKFKLLIFINNPEFVGGV

SEQ ID NO: 136618 - protein, 136 aa, Glycine max
  Coding DNA Sequence Number=SeqID_19840
MGWFPYAPFGPASRCRTGVANITLSWKTNPALKVIRGPQCIPIFTCFIFCGQTRALDQNMLDWCGNWANTFVELKLKHFFENNKPVECICHGQHILAAAGVPKLFVGLHFPDNYFELLGYKGVIGKTEQVGEITFI

SEQ ID NO: 136619 - protein, 139 aa, Glycine max
  Coding DNA Sequence Number=SeqID_19841
  Gene Ontology: Mol. function=methionyl aminopeptidase activity; Cellular component=chloroplast; Biological process=proteolysis
  Homolog annotation: Hit_ID=Q9FV52; Match level="QueryCoverage=87%, HitCoverage=26%, E-value=4e-36, Identity=61%"; Hit description =Methionine aminopeptidase 1B, chloroplast precursor
MDRLKEIRVFAFLLKHYLSEHAEKYGYGVVERFVGHGVGTVFHSEPIIIHNRNEKAGRMVEGQTFTIGKCIVSLYQESEVITVTLSLTYYCEPILSMGSIDSITWPDNWTTLTADGSPAAQFEHTILITKTGAEILTTC

SEQ ID NO: 136620 - protein, 44 aa, Glycine max
  Coding DNA Sequence Number=SeqID_19842
MVKYRAKSKIEMNRGAREWVRVDARPVISRSSSHVRFRTIKKHY

SEQ ID NO: 136621 - protein, 85 aa, Glycine max
  Coding DNA Sequence Number=SeqID_19843
MDEEQWRYDTIMYEKVDMSVENEEDVGVKVEHVDCSDTFNTSQLAKRVVSIGLRRRIWLEYALAVENVDARLSCVRSQFWEENDG

SEQ ID NO: 136622 - protein, 192 aa, Glycine max
  Coding DNA Sequence Number=SeqID_19844
  Gene Ontology: Mol. function=chitin binding; Cellular component =extracellular region; Biological process=chitin metabolic process
  Homolog annotation: Hit_ID=UPI00006A17C9; Match level="QueryCoverage =85%, HitCoverage=100%, E-value=5e-17, Identity=30%"; Hit description= UPI00006A17C9 related cluster
  Subcellular localization annotation: CTP_CleavageSite=45; ConfidenceScore=5.63e-01
MWMCSPLKARACIPLKARTCSPLKARSCNSTKVRACCPLKGRMCSPSMVRTCSLLNARTCSPLNVRACSPLKVGACSPMKARACSPLKVWMCSPLKVRTCSPLTARTCSPSMVRTCSKTHGCIFQERNMHGVATSIYLRKMGKEGGGCHPARPGDLNSPKRVRLLPPEGTAFCWKILEGPSGPDCYLLPPVY

SEQ ID NO: 136623 - protein, 185 aa, Glycine max
  Coding DNA Sequence Number=SeqID_19845
  Gene Ontology: Mol. function=CDP-diacylglycerol diphosphatase activity; Cellular component=integral to membrane; Biological process=phospholipid biosynthetic process
  Homolog annotation: Hit_ID=Q8ZA34; Match level="QueryCoverage=55%, HitCoverage=40%, E-value=2e-24, Identity=50%"; Hit description=CDP -diacylglycerol pyrophosphatase
  Pfam annotation: Domain name=CDH; Domain location=3-185; Score=38.0; E_value=3.8e-09; Accession=PF02611.6; Description=CDP-diacylglycerol pyrophosphatase
MQARRRSVTLLIIAFILLIAGLIAGAVHLHKNADALWQIVSEKCVPDMTQRGNPAPCQQVNLVQGYVTLKDLNGPLQYLLMPIAKITGMESPILLEPTTPNLFAAAWQQRRLLAQKRGAPVDDRVLSLAINAQYGPGYAGTEAECAVADGNAAAAYLADSHAEHRRTGAAERVYPAGRGGAACAR

SEQ ID NO: 136624 - protein, 125 aa, Glycine max
  Coding DNA Sequence Number=SeqID_19846
MSGFTRDSPQISASPHQLDLAPYASEPYNAQWNAPGLLRDKHTLRSSRILGEMEVDEPWLGLWLPLNYQVDMGARIAFVDNWAVGKEKVCYWLSNDIVGLVGNLAVSEWQSQHGLLPHSHPLHLP

SEQ ID NO: 136625 - protein, 71 aa, Glycine max
  Coding DNA Sequence Number=SeqID_19847
MGRRKGSNNRPTTISSRENQRSSRIAQIHRSINDKDDGSVEDPIQADEMSHSVHRDNIMQPLEEMPVEDHV

SEQ ID NO: 136626 - protein, 63 aa, Glycine max
  Coding DNA Sequence Number=SeqID_19848
MASALMMLIFHTSYCMEIFFMRKNTCTWGHVTRFGTSLRLRLITTGGGGELPVHDKVTSTLGA

SEQ ID NO: 136627 - protein, 192 aa, Glycine max
  Coding DNA Sequence Number=SeqID_19849
  Subcellular localization annotation: CTP_CleavageSite=41; ConfidenceScore=5.18e-01
MTFLGDTSSQTIVNSRLTFIFPNDSVIHNKCGVYFKSSTPVPMRVPNMCDFSTLKSRIHNILQLNDNQFVDEIHYRRPLEDTDNMDVNTMLMSNDRFSCVGPIELLCTVGRTPDEILNLLERSMTPTHDAVLYYNGRWNMPRQNNFVGYAFTGKNPQKFDISKGCTIDELKDLIKQLAPKGNPPHGIHESQL

SEQ ID NO: 136628 - protein, 102 aa, Glycine max
  Coding DNA Sequence Number=SeqID_19850
MQALEEEILSTKERREEKSEMDGIFGVMTLRGEGVLLGVHFFSALPPLPKLPRLDDFCVLLVVRGRRRRSRERAEESSSARSRGRTFFRRRDLSTTEKRSFT

SEQ ID NO: 136629 - protein, 62 aa, Glycine max
  Coding DNA Sequence Number=SeqID_19851
MTSKVDLPLGGVVDGASMKISKNHFQQPNPTGYPIITNEVGDEVFIYLLKVDIISKIGHVGE

SEQ ID NO: 136630 - protein, 146 aa, Glycine max
  Coding DNA Sequence Number=SeqID_19852
  Gene Ontology: Mol. function=transferase activity; Cellular component= cytoplasm; Biological process=auxin mediated signaling pathway
  Homolog annotation: Hit_ID=Q5CCP3; Match level="QueryCoverage=93%, HitCoverage=71%, E-value=2e-37, Identity=53%"; Hit description =Glutathione S-transferase GST 18
  Pfam annotation: Domain name=GST_N; Domain location=2-56; Score=30.0; E_value=8.5e-06; Accession=PF02798.10; Description=Glutathione S -transferase, N-terminal domain
MGEVKLLGVWPSGFVYRIIWALALKGYNPVYKKVPVLVLEGKPIAESMVILEYIEETWPQPHLLPQDMYERVVARFWVSFAEEKVTRAFFLSFFVSVGEEFQKARKEVRGVLKVLEETIGDKKYFGGEEIGLLDIKFGWLVLFSLC

SEQ ID NO: 136631 - protein, 181 aa, Glycine max
  Coding DNA Sequence Number=SeqID_19853
  Homolog annotation: Hit_ID=Q1T1F7; Match level="QueryCoverage=61%, HitCoverage=23%, E-value=2e-09, Identity=33%"; Hit description=IMP dehydrogenase/GMP reductase
MPICVRPMKFERMKSVTEFARRRPTASARRQRVPVIVAHDESVLPAPDVEADVFPDDPMALTDVEDTGADIPTDSGTQATEDEPEGFSGGPSDPSVLTQYANHVACSVWTGEECPELKLSSHGRKVYSLGRSVPAIEGLVVGTGLSPLIACSVDTGDRGYLFSFVEQWHRETSSFHLPVGE

SEQ ID NO: 136632 - protein, 70 aa, Glycine max
  Coding DNA Sequence Number=SeqID_19854
MVWVNWNGGGTRKIHGVIVGTVRNGKRALKKGHAHPTRKFLPPTWLHLIRPCQVPLCLISQVHPSIFSPK

SEQ ID NO: 136633 - protein, 108 aa, Glycine max
  Coding DNA Sequence Number=SeqID_19855
MAKSDDSVRCAYFGRRKEGRVQMKRGCGGEMWWSSKTESVGVEDGVSLDLDALNGIEKEEGIVAESSNGGDLAARNGSLRMAIGFAFKVLDSPIRTAQSTPSEAMTSN

SEQ ID NO: 136634 - protein, 70 aa, Glycine max
  Coding DNA Sequence Number=SeqID_19856
MSIVPSSRHERLHVEESGVPYLQVVQLQTGKGSAQTLSVAVKRTRERRKVFNAGNCRDFGSSKGGQQDIL

SEQ ID NO: 136635 - protein, 87 aa, Glycine max
  Coding DNA Sequence Number=SeqID_19857
MCKILKITAKGSLLRHFLAPGPTRKLKSEETSSPRQARLLQEEESRLPGRAEIAWHEGLKERGPEVKKEEERREKKKKEERKKLKCH

SEQ ID NO: 136636 - protein, 55 aa, Glycine max
  Coding DNA Sequence Number=SeqID_19858
MKAKTSNIKIYGKEGLISSLGTKRNGDARKKYNSRGDKEAVFDMGSLKAPRKDEF

SEQ ID NO: 136637 - protein, 148 aa, Glycine max
  Coding DNA Sequence Number=SeqID_19859
MVSNPSREQKKAKTSKRKQDECSRAALNHLDTWFKDKSKKNDYKMIYIVKDFSQQGFNFPNLLEAHGLSKLVQMKVTFYPELVKVFYTYARADLKEVVGLDMGGVRKFNEMLEEFLGSWWTDCRRQNGGLPHYLHSHSKAKQSCSCNR

SEQ ID NO: 136638 - protein, 70 aa, Glycine max
  Coding DNA Sequence Number=SeqID_19860
MAELSRMKRDHPKTRGDLEIHSVLVGLGSVLVIHRARALTAARSYSMHGSDDILIARASRFGLRGRSVLI

SEQ ID NO: 136639 - protein, 142 aa, Glycine max
  Coding DNA Sequence Number=SeqID_19861
  Gene Ontology: Mol. function=iron-sulfur cluster binding; Cellular component=mitochondrion; Biological process=biotin biosynthetic process
  Homolog annotation: Hit_ID=Q0AE72; Match level="QueryCoverage=74%, HitCoverage=31%, E-value=3e-38, Identity=66%"; Hit description =Biotin synthase
MEQQTSAAVCGSEMQTSVINLDGLKPSVSCHPTVERWRVADIMALFELPFNDLLHQAHTVHREHFDPNAVQVSTLLSIKTGGCSEDCGYCPQAARYHTEVENEPLMQLDEVLAAAQAAKDSGASRFCMGAAWRGPKQRDLEP

SEQ ID NO: 136640 - protein, 403 aa, Glycine max
  Coding DNA Sequence Number=SeqID_19862
  Gene Ontology: Mol. function=binding
  Homolog annotation: Hit_ID=Q2CS14; Match level="QueryCoverage=55%, HitCoverage=55%, E-value=7e-10, Identity=28%"; Hit description=TPR repeat
  Pfam annotation: Domain name=TPR_1; Domain location=121-154; Score =3.9; E_value=1.8; Accession=PF00515.18; Description=Tetratricopeptide repeat
  Pfam annotation: Domain name=TPR_1; Domain location=189-222; Score =17.4; E_value=0.045; Accession=PF00515.18; Description =Tetratricopeptide repeat
  Pfam annotation: Domain name=TPR_1; Domain location=87-120; Score =12.2; E_value=0.19; Accession=PF00515.18; Description=Tetratricopepti de repeat
  Pfam annotation: Domain name=TPR_2; Domain location=121-154; Score =10.7; E_value=1.9; Accession=PF07719.7; Description=Tetratricopeptide repeat
  Pfam annotation: Domain name=TPR_2; Domain location=189-222; Score =24.1; E_value=0.00051; Accession=PF07719.7; Description =Tetratricopeptide repeat
  Pfam annotation: Domain name=TPR_2; Domain location=87-120; Score =19.1; E_value=0.016; Accession=PF07719.7; Description=Tetratricopepti de repeat
  Pfam annotation: Domain name=TPR_4; Domain location=189-214; Score =23.7; E_value=0.00064; Accession=PF07721.5; Description =Tetratricopeptide repeat
  Pfam annotation: Domain name=TPR_4; Domain location=223-248; Score =6.7; E_value=6; Accession=PF07721.5; Description=Tetratricopeptide repeat
  Pfam annotation: Domain name=TPR_4; Domain location=87-112; Score =7.4; E_value=4.9; Accession=PF07721.5; Description=Tetratricopeptide repeat
  Pfam module annotation: Pfam domain module=TPR_1::TPR_1::TPR_1::TPR _2::TPR_2::TPR_2::TPR_4::TPR_4::TPR_4; Domain location=121-154::189 -222::87-120::121-154::189-222::87-120::189-214::223-248::87-112
EPEDEAVAIPAPAISNVNAAPAKAVLAPQIEGEFSIKPAETTAANPVVSVIEPPLEAANTAKQVKSNQEEPGVRGVVNKQVRPDQEVNLLIQRAVDHEQKGRLNEALVTLRQAINSYPQSEDARQLLAAYLFESKQDSEAVAVLQTGIKQYPGQIGLSKSLAKWQLSHGQPEPVLQTLKPVANLLIQDAESQWMLAMAYQQTGQHAAALPHFERATVLRPGVAQWMVAYAISLQAAGQSAQALQQLQLAYNMPLSERLSEFVSQRIRQLGGTVPVRANTSAVTRFAPAFFNTLATACILAPVVMTSSTTTTLSMHLLCQFQRVIEAALPDAVRMHGHGHENMWLFLSGESWQVVEQASCQQVAKRKLLMIPHNVPETLGSAHCGQRGAVYQGNNATQWAQRIE

SEQ ID NO: 136641 - protein, 110 aa, Glycine max
  Coding DNA Sequence Number=SeqID_19863
  Gene Ontology: Mol. function=nucleoside-triphosphatase activity; Cellular component=membrane; Biological process=amino acid transport
  Homolog annotation: Hit_ID=Q26V64; Match level="QueryCoverage=92%, HitCoverage=27%, E-value=5e-20, Identity=52%"; Hit description=ATPas
MSFPSSAASPARQEQAVPEGAAKEPMVTFEGVTKTFGGTGGKPGFAALAGIDYAVPKGSITGIIGRSGAGKSTLIRLANGLEKPSTGRVIVDGVDVAALDEKSLRTLRRS

SEQ ID NO: 136642 - protein, 176 aa, Glycine max
  Coding DNA Sequence Number=SeqID_19864
  Homolog annotation: Hit_ID=Q9JKS4-3; Match level="QueryCoverage=44%, HitCoverage=12%, E-value=3e-11, Identity=45%"; Hit description =Isoform 3 of Q9JKS4
GLHTLAFRGLHALAFRGLHALAFEGLHALAFRGLHTLTFRGLHALAFRGLHALAFKWHHVLNFIGLHALAFRGLRVLTFIHGPPPDLGGGPTVRAQPEEEAIAQLLFILGKDFTRTAAKRRVRIMRTKMTTLTQIWMTDRAHKTPSGPGEVQTGPWGFQLWLRASVSPTGCPSPPA

SEQ ID NO: 136643 - protein, 215 aa, Glycine max
  Coding DNA Sequence Number=SeqID_19865
  Subcellular localization annotation: CTP_CleavageSite=66; ConfidenceScore=5.19e-01
MEKILKNEYHPLSEASTHLASKRNLEGNLPCKHVLSALSARSASRFSPSRLNARLALSQSSLTRAKCENGAKCDVEVRKPFLKPGITELKESLKSANTKEHIRVKESSFEILGRFELPCRLNARLALSQSSLTRAKCENGAKCDVEVRKPFLKPGITELKESLKSANTKEQIRVKESSFEILGRFVSFLAIMRFLEVEETSPLLCKKTISLNSSS

SEQ ID NO: 136644 - protein, 163 aa, Glycine max
  Coding DNA Sequence Number=SeqID_19866
MENIRVKLQNIFREDPTVNEGWEAFLPRNLDDPSVTFSGTRKSWARGSEAPSSSAPFTSAFLSPPAVPVHLGPSTQSLDLLMSMLQSLHQGQLLVMQSLQNMVQQRPIMSLEEFSQKVAWPGVQPSPLEGGEASIAQEPQPDQEDDTSEDSEATPPPSEPFIF

SEQ ID NO: 136645 - protein, 46 aa, Glycine max
  Coding DNA Sequence Number=SeqID_19867
DPPQEERSLRIEIEEELKNITEGDPPKQKRSQGNEKKTEDDNITQG

SEQ ID NO: 136646 - protein, 232 aa, Glycine max
  Coding DNA Sequence Number=SeqID_19868
MGSNQTPFLKKRFYQVKIKRLEVTSLLELRQLTGQLQRQAFRKAYRKCLGSRTQGLDWLLKLKATREEKAEALEERKEVQALKAELKKVQAVKEKFKSIAVKVRKEYDELKDVNTAATEALERETKRARKEEHGRNKFRRALWGSNKELKLRKEKRDQSRVDDMVFELKACLKSTRSLSQQLSEMEGNVMAIIAKKGSKGKGDRFIAPRGDDVDGSICPYLEQKSGSSSTAS

SEQ ID NO: 136647 - protein, 173 aa, Glycine max
  Coding DNA Sequence Number=SeqID_19869
DGIIYCEVHNVSIVIDQSLFFSLTKLPNQGVPFEGTLVDDWKFDYSIHDARHMAHLIRYRMHKALRTNAPLPYPHLVTLFLHHFKIPLEDEPFVQVKRSFAISAGAIISFGYRKDDDGQWVRKQNLPQPIPDECTLSPPPQRVDSSSLLNDVLSELHSVRAFVGDRFDAMDTR

SEQ ID NO: 136648 - protein, 134 aa, Glycine max
  Coding DNA Sequence Number=SeqID_19870
  Subcellular localization annotation: CTP_CleavageSite=69; ConfidenceScore=5.90e-01
AHQTQGPPLVSLVAPKACQTQGSSFVSLIGSSNPRFTLGSSNSRSALGESRFSKGSSNPRSTLGSLNPRSALGESRFSKGSLNPRSVLYESHRLVKPMVHPWNTRNLGSTLGTYSYKNPRHALGKLTPLELRRA

SEQ ID NO: 136649 - protein, 117 aa, Glycine max
  Coding DNA Sequence Number=SeqID_19871
MVLEMSDETHCRSNGGSILQNIVPYPLKASNDRGDNGDPALWLRRAWGYALTSPPPLLHAPPMKGCALLRRREMPPPVRCESVNLFKEDDLLLEVSWQVSYKEELLMEMTSRSTRGC

SEQ ID NO: 136650 - protein, 146 aa, Glycine max
  Coding DNA Sequence Number=SeqID_19872
  Gene Ontology: Mol. function=nucleic acid binding; Cellular component= mitochondrion; Biological process=DNA integration
MSQPLGFQNSNTTLYVVSALQYLSITRPELSYSVNKASDVDDRRSTSGAAVYFCPNLISWWSHKQQVVAKSSIEAEYCSLAQITTEISWIQTLLTELKVPFNTPIIFCDNQSAVAIAHNQVLHARTKHTELDVFFVREKVLTKQLT

SEQ ID NO: 136651 - protein, 79 aa, Glycine max
  Coding DNA Sequence Number=SeqID_19873
TTFVHAWGFDKLATLLLVKATTIDTGQSPSTLDNLFHLQTNLELGGLMYRLGSIKYTWQALWHSDTQVSRDPGAWKSCL

SEQ ID NO: 136652 - protein, 247 aa, Glycine max
  Coding DNA Sequence Number=SeqID_19874
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9FLD7; Match level="QueryCoverage=86%, HitCoverage=48%, E-value=4e-74, Identity=64%"; Hit description =Glycosylation enzyme-like protein
  Pfam annotation: Domain name=Branch; Domain location=64-247; Score =252.9; E_value=6.7e-73; Accession=PF02485.11; Description=Core-2I -Branching enzyme
  Subcellular localization annotation: CTP_CleavageSite=69; ConfidenceScore=5.19e-01
MTLLLGLTKICSLFLLFLATLTSPEGTPILPFYRSITAASYSVFVESKLRPLPVVSSLPPPPSLAYLVSGSKGDSAAVTRVLLALYHPNNRYVVHLDLESSPEERSDLVRFVEGHALFKRFGNVRVIKKANLVTYRGPTMVANTLHAAAILLRELGDWDWFINLSASDYPLVTQDDLLHMFSYLPRDLNFIDHTSDIGWKDHQRARPIIVDPGLYMNKKQDVFWITQRRSRPTTFKLFTGEDPFLVC

SEQ ID NO: 136653 - protein, 88 aa, Glycine max
  Coding DNA Sequence Number=SeqID_19875
MENFTKQSLRMAPNSLGGGCINENAIHGAPKKGREWRNALSNQYAWLQTRGRRMHERKRNSWGSKKGVENGELHYAITMHGSKLEGGG

SEQ ID NO: 136654 - protein, 368 aa, Glycine max
  Coding DNA Sequence Number=SeqID_19876
  Gene Ontology: Mol. function=nucleoside-triphosphatase activity; Cellular component=membrane; Biological process=transport
  Homolog annotation: Hit_ID=Q8D191; Match level="QueryCoverage=98%, HitCoverage=72%, E-value=1e-129, Identity=63%"; Hit description =Putative ATP-binding protein of ABC transport system
  Pfam annotation: Domain name=ABC_tran; Domain location=192-368; Score= 47.4; E_value=1.1e-11; Accession=PF00005.17; Description=ABC transporter
  Pfam annotation: Domain name=ABC_tran; Domain location=3-130; Score =41.6; E_value=3.5e-11; Accession=PF00005.17; Description=ABC transporter
  Pfam module annotation: Pfam domain module=ABC_tran::ABC_tran; Domain location=192-368::3-130
SVAVSNLSVAENIAFEHNLNGLLGWHRQARLRDTARGIIDELKFDLDLNEKVAALSIAQRQQVAICRALVADARLVIMDEPTASLTRTEVNQLLRTVRYLKDKNICVVFVSHRLDEVLEISDRVTVIRDGRKMGCWPAREMTPHHLTELMTGLKLDYQLKAPTRNADRAILEVEKLTRAGQYHDVNFKLYAGEVLGLCGLLGSGRTELALSLFGMTKPDSGKIWLDSKPVRFRGHEDAIKAGIGYVSEDRLTLGLVQQQSVADNMVLPILDKLQNRFHLIDEYRKNKLILQWIQQLGVRVADPNLAISTLSGGNQQKIVLAKWVLTQPRILILDSPTVGVDVGAKASIYQLIHELAKEGLSIVLISDE

SEQ ID NO: 136655 - protein, 169 aa, Glycine max
  Coding DNA Sequence Number=SeqID_19877
  Gene Ontology: Mol. function=nucleoside-triphosphatase activity; Cellular component=membrane; Biological process=protein complex assembly
  Homolog annotation: Hit_ID=Q5P2E4; Match level="QueryCoverage=74%, HitCoverage=35%, E-value=1e-33, Identity=53%"; Hit description =Putative cytochrome aa3 oxidase assembly protein, related to CtaA
MQALLGMWTVTLLLKPVIVTLHLLGGMTTLAVLSWIAFRHTCKADIALPAGQQYWLRLALLIWIAQVLLGGWTSSNYAALACTDFPTCHSLWWPAMDMGDAFHITRALGVSRDGGQLHLDALTAIQWDTIAAPNFQNAGVGIAGNCALPDCGGDRQPFIAAAIGVGGVA

SEQ ID NO: 136656 - protein, 255 aa, Glycine max
  Coding DNA Sequence Number=SeqID_19878
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=6e-34, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLAFRGLHVLHFRGLHVLAFRRLHALAFRGLHTLTFRGLHVLTFRGLHVLTFRGLHALAFRGLHVLTFRGLHVLAFRGLHVLHFRGLRVLPFRGLCALTFRGLHALTFRGLHVLAFRGMHAFTFRGLHVLAIKGLHALTFRGLHILPFRGLQRATRPPLQRTNVLAIRGLHVLAFRGLHVLTFRGLHALTFRGLHVLAFKGLHALAFIGLHALTFKGLHVLAFRGRHFLDFRRLHAPSPLEGYASSLSVGSTSAP

SEQ ID NO: 136657 - protein, 45 aa, Glycine max
  Coding DNA Sequence Number=SeqID_19879
ARVKSCPGMHSSCVIASSYGCARIVGPPPGSGGGLRADKRKLLAP

SEQ ID NO: 136658 - protein, 115 aa, Glycine max
  Coding DNA Sequence Number=SeqID_19880
MGPRTFWLPPWGQPVTYTNEDSLHPYLNAPTKNRLTTSSGSFTKEYATCTLGKMNGDTSDKSRLVAIDYFINSWAKRISTAKRSFNALSAKENLAEHQHQSCTLSVRSGFFVMAG

SEQ ID NO: 136659 - protein, 456 aa, Glycine max
  Coding DNA Sequence Number=SeqID_19881
  Gene Ontology: Mol. function=ATPase activity, coupled to transmembrane movement of substances; Cellular component=integral to membrane; Biological process=transport
  Homolog annotation: Hit_ID=Q2HRY7; Match level="QueryCoverage=86%, HitCoverage=86%, E-value=1e-169, Identity=59%"; Hit description =Cyclic peptide transporter
  Pfam annotation: Domain name=ABC_tran; Domain location=215-410; Score= 125.3; E_value=1.7e-34; Accession=PF00005.17; Description=ABC transporter
  Subcellular localization annotation: CTP_CleavageSite=49; ConfidenceScore=5.33e-01
MGLVISWRLSIVMIAVQPIIIACFYTRRVLLKSMSNKSVKAQQQSSNIASEAVSNLRTVTAFSSQDRILKMLEEAQQGPSQENIRQSCFAGIGLGCSQGLASCIWALNFWYGGKLISCGYISIKTFLESFMVLVSTGRIIADAGSMTTDLARGADVVGDIFGIIDRRTKIEPDDPNGYMLERLIGQIELHDVHFAYPARPNVAIFENFSMKIEAGKSTALVGQSGSGKSTIIGLIERFYDPLKGMVTIDGMNIKLYNLKSLRKHIALVSQEPTLFGGTIRENIAYGRCERVDESEIIEAAQAANAHDFIASLKEGYETWCGEKGVQLSGGQKQRIAIARAILKNPKVLLLDEATSALDGQSEKVVQDTLMRGRWWRLEPIRPCWPKDHVELITPWQLKEVDQKEKELSNRGDGVDSCGSSDDGVSVALMVVVVLVVVVTAVATQKAIVNCWESVVF

SEQ ID NO: 136660 - protein, 287 aa, Glycine max
  Coding DNA Sequence Number=SeqID_19882
  Gene Ontology: Mol. function=acyltransferase activity; Cellular component=integral to membrane; Biological process=metabolic process
  Homolog annotation: Hit_ID=Q47J22; Match level="QueryCoverage=96%, HitCoverage=39%, E-value=9e-87, Identity=56%"; Hit description=AMP -dependent synthetase and ligase:Phospholipid/glycerol acyltransferase
  Pfam annotation: Domain name=AMP-binding; Domain location=1-236; Score=-34.1; E_value=3.7e-06; Accession=PF00501.18; Description=AMP -binding enzyme
MLDFSPSDKFMMALPLFHAFGFTGALLPLLNGIPLLLFPSPLQYKLIPEVIYDKGCTVFFSTSTFLSNYAKYAHPYDFYKLRVVFAGAEKLNEEVRKIYHEKFGIRILEGYGTTECAPVLAANTPMANRNGSVGQFFPGIQYKLTPVPGIEKGGLLHVKGDNIMQGYYLFDNPGVLVAPQDGWYETGDVVEVDAEGFIHIKGRVKRFAKVAGEMVSLEVVEKIASTAAPDQQPAATTVADASRGESIVLFTTDSKLKREDLQIVAKNLGSPEMPSPGKLLSSNRFQY

SEQ ID NO: 136661 - protein, 75 aa, Glycine max
  Coding DNA Sequence Number=SeqID_19883
MPLVRLSSLNITLGSFEQFRLSPSVTTTCHTSSLNESSLILYDENHRSSNNGRAGIHLGQTIYASQGFQMQGIQF

SEQ ID NO: 136662 - protein, 51 aa, Glycine max
  Coding DNA Sequence Number=SeqID_19884
MSPQSRLTESWIPPRVDLVDPVSKDEVEDLEEETSIEEDPSIDEEDPVAYR

SEQ ID NO: 136663 - protein, 211 aa, Glycine max
  Coding DNA Sequence Number=SeqID_19885
MWLRVLNNLRFWDSWFMIPNAFLHIQAQRKYMKVGLYEAHGSWLIWKHMEVHGAYLDGGRANLLNDRCSSRKLPRSTTASYLGNLLNEEEEEAQRRRASNEEEDTGRRTRKKKQEEEPGRRSRKKKQEGDPKEEEAEAQKRGGRERGVNCSGLCHFCDAQLENRWHTIVGCSYTIEVWREAGLWEFLQSIILSWNELVWQDRHVQQNHVVY

SEQ ID NO: 136664 - protein, 76 aa, Glycine max
  Coding DNA Sequence Number=SeqID_19886
  Subcellular localization annotation: CTP_CleavageSite=65; ConfidenceScore=5.32e-01
MVGLVSGHGGRGANMKKGNPSQPIIRQQGWKTLGVIASKQCRRRSTSTKGGMPPRRHRYMTQQCEAATGATEAPRQ

SEQ ID NO: 136665 - protein, 105 aa, Glycine max
  Coding DNA Sequence Number=SeqID_19887
MKEEEEEKEKTKSRLYRIAIVDHFPTSFLLLALYPVQPSVVMVVDTEASPECLAWGHQKKCALQWYIPDKPQNRSECGLEELHVFPPWVERHGHEYDRVEVFDSQ

SEQ ID NO: 136666 - protein, 396 aa, Glycine max
  Coding DNA Sequence Number=SeqID_19888
MDQCSLTATSEEQYVNIEIPEQLIRGWQQQGYTHLHYGAIRLVLSLHGRRGLPVTARVSLLDSNYIHYENVVIRTVLTTLYAGSVVLTIFLNYNVNLRDPTLPQRMKVQIQNHVVNLSMPTSHDSALFILTNNQEETPSIVQIPRNISRKELQELIPLQWVTGYEKLRENTKHVSTSQATFRRSIDGLVTTTFKKPDEANNNNSSEVFHSLMIKPKVKEDSRMSIFAVKADGSVIYSDKVNRHFIWDVAPEMCDSDCSCDDHDGDTDENTDDDDDDEDKWKPEPRPCKPPPPPQRRSDPKNGPWTGIKKKYPEDPLWKEKRMVEILGWNHPSLKIPEAPIPCMMFASTTSYDQEFPSLDRKADPVTKVSTKPYIIPTEVGPEGKLKSPSQAEEVLN

SEQ ID NO: 136667 - protein, 57 aa, Glycine max
  Coding DNA Sequence Number=SeqID_19889
MSCGIGVVGTTSLPCLQRLTWVEVLAELENPRIDEGSVVENLRMRCFCMLKRCRRYT

SEQ ID NO: 136668 - protein, 697 aa, Glycine max
  Coding DNA Sequence Number=SeqID_19890
  Gene Ontology: Mol. function=RNA-directed DNA polymerase activity; Cellular component=nucleus; Biological process=RNA-dependent DNA replication
  Pfam annotation: Domain name=Exo_endo_phos; Domain location=7-183; Score=-5.7; E_value=0.028; Accession=PF03372.13; Description =EndonucleaseExonucleasephosphatase family
  Pfam module annotation: Pfam domain module=Exo_endo_phos::RVT_1; Domain location=7-183::441-678
MWGNQLIDWIALPSSGLSGGLLMMWKKGLWVVKSNFSGHGFIGVCVEFKSKLFFFVNVYAPCNTAGRRLLWETLYNLKYGSSAGEWCLVGDFNAVSNREARTGRSENWGYIDMVDFNAFVNEMNLIDPPLHGNKFTYFCSDGIAASRLDRFLVSDGIMNLRQVKGQRVGKRDISDHRPIWLECSNLNWAPKPFRFNNCWLEHDGFKSFIVEEWKKIQITGRKAYVIKEKLKIIRESLKKWNKEVFGWLDLNIENIVADMNELDRGIEEGCNLNVVVKKKEANALFWQQLMMKESLLKQKSRLRWIKEGDSNTKFFHSCLQDRRRKNQILSLQVEGRCVDQVGEVKMEVRRFFEEGFKEASFSRPVLGGIEFQTLGSEENSFLVAPFSEEEIKDVVWSCDGNKCPGPDGFNLRFIKECWEFVKDDIVEFLQEFHITGVLPKAITASFLALIPKVNNPQNLKEYRPICLIGCLYKILSKVLASRLKKVIAKLISPCQSAFISGRQILDGVLMINEVVDLAKRRKDECLLFKVDFEKAYDSVSWSFLTYMLNKMGFDKKWIGWIQACVFSSSMSVLVNGSPTDEFTAHKGLRQGDPLSPFLFLIVAQGLSGLVQKASQVGNFDGYQVADGLNLSLLQFADDTILLGKGSWKNLWSIKTIFRSFELVSGLRVNFHKILGCSGWCQPAAKIDLETGGGFYEG

SEQ ID NO: 136669 - protein, 65 aa, Glycine max
  Coding DNA Sequence Number=SeqID_19891
MAYMMVAAVAAVLQSGVLGRTRQAKLQWMKVCKMYGKFCNQMGEGITSDFVSFNGRHRLMNFTYS

SEQ ID NO: 136670 - protein, 315 aa, Glycine max
  Coding DNA Sequence Number=SeqID_19892
  Gene Ontology: Mol. function=RNA-directed DNA polymerase activity; Biological process=RNA-dependent DNA replication
MGSNQAHAFKKRCSSSQGQVWKKECALWNPYRMRARAKEMSQIEEVQEQMKADMEAMKERMTIIMEAMMSMRRMMEVREAHDAPQDHNLDDFKPHLGYATKGQALGGVPLPNTLGGAQYRPQPQPFHFVVGKVPPDMVEREKSDHIEERLRAIEGGENYVFADMAELCLVPDVVIPLKFKMQDFDKYKGTTCLKNHLKMYCRKMGAYAKDERLLMHFFQESLTWATVTWCTNLEPFRVHSWKDLMVAFIRQYQYISDMAPDRMQLQNMCKKVHESFKEYAQRWRDLAAQAAFPMMEREMITKIIDTLPMFYYEKM

SEQ ID NO: 136671 - protein, 90 aa, Glycine max
  Coding DNA Sequence Number=SeqID_19893
  Homolog annotation: Hit_ID=Q1SYZ5; Match level="QueryCoverage=74%, HitCoverage=40%, E-value=6e-14, Identity=52%"; Hit description =Uncharacterized plant-specific domain
  Pfam annotation: Domain name=DUF623; Domain location=7-66; Score =77.2; E_value=5.2e-20; Accession=PF04844.4; Description=Protein of unknown function, DUF623
VAIEKDSSNPYHDFRHSMLQMIFEKEIESEDDLQDLLQCFLQLNAQCHHHVIVKAFNEICKEAFPHKVSTTPAVSEPSPSHRSPLIVQKS

SEQ ID NO: 136672 - protein, 71 aa, Glycine max
  Coding DNA Sequence Number=SeqID_19894
MCGSHHQRLFVENVRKTKNGYAKLENKGLGVVYAWGSFQPLYKMTYVTNDQLKFTLQKKRDSPMIEGDEDT

SEQ ID NO: 136673 - protein, 78 aa, Glycine max
  Coding DNA Sequence Number=SeqID_19895
MERRIRKKRKTRLRRYQIATVINFYIVLRSVFFVCHSTLGCDTLPLIFKKQRTPLMKKIQGIQAPYGATSCGIKSIFV

SEQ ID NO: 136674 - protein, 464 aa, Glycine max
  Coding DNA Sequence Number=SeqID_19896
  Gene Ontology: Mol. function=transcription factor activity; Cellular component=transcription factor complex; Biological process =regulation of progression through cell cycle
  Homolog annotation: Hit_ID=Q9FNS0; Match level="QueryCoverage=68%, HitCoverage=70%, E-value=1e-123, Identity=72%"; Hit description =Transcription factor
  Pfam annotation: Domain name=E2F_TDP; Domain location=145-210; Score =116.3; E_value=8.8e-32; Accession=PF02319.11; Description =Transcription factor E2Fdimerisation partner (TDP)
MQLKRKSEAADFEADSGDRMTPGFTEAANSPFQTPVSGKTGKGGKSFRLTKGNRLGTQTPGSNIGSPSGNNLTPAGPCRYDSSLEAQPGPALLPSVTSILHIEGHPKMFNLWLIQRITVAVSGKDLMSEADPVLPAHSFIVFFAANGGCRGLLTKKFINLIKQAEDGILDLNKAADTLEVQKRRIYDITNVLEGIGLIEKKLKNRIQWKGLDVSRPGEADDSFPSLQAEVENLTMKERQLDEQIREMQERLRDLSEDENNDKLLFVTEEDIKNLPCFQNETLIAIKAPHGTTLEVPDPDEAVDYPQRRYRIVLRSTMGPIDLYLVSQFEEKFEEINGVDVAPKLPSSPDGTKHQSTVVPEDRGKDIEVQGQEAPGPSSDFTTSQDFVSGIMKIVPSDVASEADYWLLSDADVSITDMWRTEPGVEWNELEPLQEDYCMTRENTATPSHPSNVDEVSSAPKSTGG

SEQ ID NO: 136675 - protein, 59 aa, Glycine max
  Coding DNA Sequence Number=SeqID_19897
MAFGGPKARPGELRLSHEVTGSPRQAGYLTWKSFGGLGKLGASLETEDVESYEAQRQGH

SEQ ID NO: 136676 - protein, 88 aa, Glycine max
  Coding DNA Sequence Number=SeqID_19898
MALVGGKAVVVSGGDEGRFHRGERELAFHGVHDLVRRFRGAGAGGGSARGRHAPGGDRRRRGSEGWGREFGGIGRGNGGDLIVWRVGK

SEQ ID NO: 136677 - protein, 244 aa, Glycine max
  Coding DNA Sequence Number=SeqID_19899
  Gene Ontology: Cellular component=chloroplast thylakoid membrane
  Homolog annotation: Hit_ID=Q9XIN6; Match level="QueryCoverage=76%, HitCoverage=96%, E-value=4e-53, Identity=59%"; Hit description =Expressed protein
  Pfam annotation: Domain name=DUF1279; Domain location=141-244; Score =155.8; E_value=1.1e-43; Accession=PF06916.3; Description=Protein of unknown function (DUF1279)
MNKEEFCHYEFMTSSATNNRGVATLTCKIAVLIIHHTTSSSIVRYKIREGPAMTTSLLLPSPSCASILSKGTNRICTRASFHTLKSHVKKGFRVRALKEKTEEIESPSQQSSPEEVTKKYGLEAGLWQIFSSKEEGKDNSEQQKSKGDQAKELLAKYGGAYLATSITLSLISFALCYALISAGIDVQSLLQKVGISTDATGEKVGTFALAYAAHKAASPIRFPPTVALTPILAGWIGKKVEKDK

SEQ ID NO: 136678 - protein, 109 aa, Glycine max
  Coding DNA Sequence Number=SeqID_19900
HRGQVVFSHTADIGFCSVIAAEIWAILTGEDSGVQYCGGRRQRHTRYALLIRKAPPPHRQTPVEKNARGRSRAEQHNSTTTTPPTMVKKQLTSPAPTVHSRSRNRAEEE

SEQ ID NO: 136679 - protein, 285 aa, Glycine max
  Coding DNA Sequence Number=SeqID_19901
  Gene Ontology: Mol. function=RNA-directed DNA polymerase activity; Cellular component=extracellular region; Biological process=RNA -dependent DNA replication
  Homolog annotation: Hit_ID=Q1SLB1; Match level="QueryCoverage=96%, HitCoverage=56%, E-value=1e-43, Identity=32%"; Hit description=RNA -directed DNA polymerase
NEVVDDARRWKKACLILKVDFAKAYDCVCWEFLLYMTRRIRFTEKWISWIKVCPESTSISVLVNGSHYEEFHPGRGLRQGDPIAPFLFLIVAKGMSGFTKEALRMTCILVNFYKSSFEGVRMNTFVLHRYASILNCYPMVLSFVYLGIPIEENPRRESVLEEGRRKIDWIKWEDICKPRELSGLGIENVIQFNSALLGKWRWRLLREHGSSWGLVLKSKYGDIFGTPIKRVSNFDSIWWSDLVKVCGENEGGSWFDNNICWKDNIVGIVGSWEDGRWVWNLVWKE

SEQ ID NO: 136680 - protein, 670 aa, Glycine max
  Coding DNA Sequence Number=SeqID_19902
  Gene Ontology: Mol. function=exonuclease activity; Cellular component= intracellular; Biological process=regulation of transcription, DNA -dependent
  Homolog annotation: Hit_ID=Q6K2K4; Match level="QueryCoverage=49%, HitCoverage=44%, E-value=6e-53, Identity=36%"; Hit description =Putative 5'-3' exoribonuclease
  Pfam annotation: Domain name=XRN_N; Domain location=1-150; Score =104.6; E_value=2.9e-28; Accession=PF03159.8; Description=XRN 5'-3' exonuclease N-terminus
MNQQRSRRFRAAKDNEIQEAEEERLRRQFGMKRKQVLPKQQSDVSDSNIITPGTEFMHELSKALKSYISSRITSNSLWKDIMVILSDANVSGEGEHKIMSYIRKQLSLEGYNPNTSLIWLTFEFEMQDVDLIMLAMATHEPHFSILREDVPIQRQHSKDAAKPFKGAIDLLMTVYKKEFNKLGGYLVDMSMSRIGEKNAAFLKLSRLEKFMLAVGAYEEKIFKKRSEIREKYLRRFIRDSEDAKQDEENATCYSDLDEENTSDCTLLIKSVLVNNVSATHAEYQIEQNTKDLKDELKICIREKCDLFQSGNFLTDKVQKYTEGLVWVLQYYFSSVASWTWFYPFHYGPFASDLKGMGQENEAIRNSVKADSLFVRSASELAEKFGSLSLDTNPPCKLETISDGIGGNISLCDEFIEKPCLDICDNKKEDRVLCVYYELPAGSNHIPRLLSDVKLPEKTIFEIDIMETELWHEPQKYDSRFERVQNQDKWRSENTSNTSRFPPNASNQHARSFVYKDAGVGLGSGRGKRIDAMANESVPNNIRTQHFVDNFRQLRISESNNHFPRPGGGSSQSRPHNIGHINQSRNAPYHQGSQYNNGYMNQPRNAPYHQGSQYNNGYMNQSKNAPNHQGSNYLTVSNVGPGQGRGASSNSSLRPQWSGGNSYQVKDQNLW

SEQ ID NO: 136681 - protein, 449 aa, Glycine max
  Coding DNA Sequence Number=SeqID_19903
MDYVELTIEVFAGHRKKKHKGLSRNARKKQFNDCCLFKRKKFYLGQVPKPRYSYKAKKITPSDEKMSGKAGEVVLVTGTNDVSPYDKEFLLFNLDNKERWEEIGRCRAEPVANKIEKRHTKASPLQTQDKRNIGVMTIKRRKEGGSRDSARTSDGEYPGKEHVIVANIHRLGNKDKSQKGTMHATSEGAIKDCIVKEEVQFACIQEAKMGNVFKSLWGDGNIDWRESPAVNSAGRLLCMWSQDVLEVIDPFIGDGGEESVMGSTFELESQVNEAMWCLAGDFNSMRKSGYVLKEKLKLLKRGLKKWNSQSFGNLQHHSKELLAMINLLDVKDEEVGLSTEEIKRRRICLGEYHKVAKRHESLAYQKSRTKWIKEGDENMKFFHNKINWRKRKDGIKGLEVDRVWVEEPKIVKKKQLGDENNISLCSTFMEKEIKEAIWECSGDKSPGPN

SEQ ID NO: 136682 - protein, 667 aa, Glycine max
  Coding DNA Sequence Number=SeqID_19904
  Gene Ontology: Mol. function=voltage-gated potassium channel activity; Cellular component=integral to membrane; Biological process=potassium ion transport
  Homolog annotation: Hit_ID=Q9SL29; Match level="QueryCoverage=99%, HitCoverage=99%, E-value=0.0, Identity=71%"; Hit description =Putative cyclic nucleotide-gated ion channel 15
  Pfam annotation: Domain name=IQ; Domain location=607-627; Score=16.4; E_value=0.1; Accession=PF00612.17; Description=IQ calmodulin-binding motif
  Pfam annotation: Domain name=Ion_trans; Domain location=113-387; Score=44.8; E_value=3e-10; Accession=PF00520.21; Description=Ion transport protein
  Pfam annotation: Domain name=cNMP_binding; Domain location=488-588; Score=36.9; E_value=6.9e-08; Accession=PF00027.19; Description =Cyclic nucleotide-binding domain
  Pfam module annotation: Pfam domain module=IQ::Ion_trans::cNMP _binding; Domain location=607-627::113-387::488-588
MTFANSRSASFEDDPELAKFPSTNGDNGVKIKFHIDGTQIPEPSSNMAQKKVTGKFLKARMLSRVFSEDYDRVNRRVLDPRGQTIHRWNKIFLVACLASLFVDPLFFYLPVVRDEVCIDIGITIEVILTLILMKFRTAFVAPSSRVFGRGELVVGYYKIAFRYLRKGFWLDFVAALPLPQVLIWIVIPALRGSTMANTKNVLRFFIIFQYIPRLVLIFPLSSQIVKATGVVTETAWAGAAYNLMLYMLASHILGACWYLLSIERQEACWRSVCDLEKSFCQYGFFDCHRVKDALRVSWFMASNITNLCSPNANDDFYQFGIYADAVTSKVTSSAFFNKYFFCLWWGLRNLSSLGQGLLTSTHVGEIMVAIVVATLGLVLFALLIGNMQTYLQSTTVRLEEWRVKRTDTEQWMHHRQLPPELRETVRKYDQYKWLATRGVDEEALLKGLPVDLRRDIKRHLCLDLVRGVPLFDQMDERMLDAICERLKPALCTEGTFLVREGDPVNEMLFIIRGHLDSYTTNGGRAGFFNSCRIGPGDFCGEELLTWALDPRPSVILPSSTRTVKSISEVEAFALIAEDLKFVASQFRRLHSKQLRHKFRFYSHHWRTWAACFIQAAWRRHKKRKQVAELRARAINVNIAEPETPTRTDSGLVSSLQKPAEPDFSVDE

SEQ ID NO: 136683 - protein, 254 aa, Glycine max
  Coding DNA Sequence Number=SeqID_19905
  Gene Ontology: Mol. function=protein serine/threonine kinase activity; Cellular component=membrane; Biological process=protein amino acid phosphorylation
  Homolog annotation: Hit_ID=Q6Z8Z3; Match level="QueryCoverage=55%, HitCoverage=25%, E-value=1e-45, Identity=63%"; Hit description =Putative receptor protein kinase PERK1
  Pfam annotation: Domain name=Pkinase; Domain location=98-254; Score= -68.7; E_value=0.00018; Accession=PF00069.15; Description=Protein kinase domain
  Pfam annotation: Domain name=Pkinase_Tyr; Domain location=100-246; Score=-104.6; E_value=4.7e-06; Accession=PF07714.7; Description =Protein tyrosine kinase
  Pfam module annotation: Pfam domain module=Pkinase::Pkinase_Tyr; Domain location=98-254::100-246
MEFDGLMLNQLRTGFSKKNITSYYEGFSLQHSFIDDGITLNLVETKWLFLRSRNYQEATRFKETNFEQDVLYAMSTEGTKDAFRRPLCCLGAKEKPFMEILLLIALGGSSYVYRGWLKDGSDVAVKRLKDQRGPEADYQFFTEIELLSRLHHCHLVPLVGYCSELKGKNVQRLLVFEYMTNGNLRDRLDGVLGQKMDWSTRVTIALGAARGFEYLHEAAAPRILYRDVKSTNILLDENWQAKVRVFVFLNGSNF

SEQ ID NO: 136684 - protein, 84 aa, Glycine max
  Coding DNA Sequence Number=SeqID_19906
  Subcellular localization annotation: CTP_CleavageSite=50; ConfidenceScore=5.01e-01
MGIAFGFFVGISISSVHLTKISLLSSPVGNSFDVPVADSEIDRFSDEVKRSSAVIDESSGTKNLETLGSIRLPKKSKAGGFIGC

SEQ ID NO: 136685 - protein, 120 aa, Glycine max
  Coding DNA Sequence Number=SeqID_19907
MAGSEWHMLVLTYPKAIILVSASTVESMKNIGTSKIGLLTIANEMENLEVNPDEDAYDLASHNRIDNVRARTVERERVFHELITNSAFQSGQLTLCLEYTSNIDLKVLDRPAMHQLKGLG

SEQ ID NO: 136686 - protein, 174 aa, Glycine max
  Coding DNA Sequence Number=SeqID_19908
  Subcellular localization annotation: CTP_CleavageSite=24; ConfidenceScore=5.55e-01
MASPPASPPPPPSLSPPPPPPPPLSDAIASPPTVKRTRKVPVVHVDPATGKADGPHRKKLRTYLGIVARDKVAVTYENWKEVPIAQKDFIWEDIQCQPTLRQKGDARLVGVSSKKGKCAESPPTFIRGKRRKNRKGCGLRTLSLKGSGVAFTHGEGCFPCSYVFLNCDKEIRPT

SEQ ID NO: 136687 - protein, 95 aa, Glycine max
  Coding DNA Sequence Number=SeqID_19909
MAPEGRKEYKTNTSTTESVHKTCTIGRWIHTSTLPITFKSFKIRLVSIGYAKLKLGPFTSASGSDLKGYCSRGQNIRPQYKYITNITFLAFANST

SEQ ID NO: 136688 - protein, 232 aa, Glycine max
  Coding DNA Sequence Number=SeqID_19910
  Homolog annotation: Hit_ID=Q93ZR2; Match level="QueryCoverage=85%, HitCoverage=52%, E-value=2e-93, Identity=85%"; Hit description =Putative storage protein
  Pfam annotation: Domain name=DUF707; Domain location=10-232; Score =242.2; E_value=1.1e-69; Accession=PF05212.3; Description=Protein of unknown function (DUF707)
MSPTHALHVHICQRCALFSIVYLCSSYSCMRPLHDLKKKPKYLVTFTVGYEQRHNINAAVKKFSDDFAILLFHYDGRTSEWDQFEWSRSAIHVSARKQTKWWYAKRFLHPDIVSAYEYIFIWDEDLGVEHFNADKYIHLVKKYGLEISQPGLEPNNGLTWEMTKRRGDKEVHMVTEEKPGWCSDPHLPPCAAYALSLPPCNYTDELSKYLLVERSSAWMGIGLCSQKMCRGQ

SEQ ID NO: 136689 - protein, 682 aa, Glycine max
  Coding DNA Sequence Number=SeqID_19911
  Gene Ontology: Mol. function=ATPase activity, coupled to transmembrane movement of substances; Cellular component=integral to membrane; Biological process=transport
  Homolog annotation: Hit_ID=Q2HRY7; Match level="QueryCoverage=99%, HitCoverage=99%, E-value=0.0, Identity=45%"; Hit description=Cyclic peptide transporter
  Pfam annotation: Domain name=ABC_membrane; Domain location=28-310; Score=127.2; E_value=4.6e-35; Accession=PF00664.13; Description=ABC transporter transmembrane region
  Pfam annotation: Domain name=ABC_tran; Domain location=385-569; Score= 209.3; E_value=9.1e-60; Accession=PF00005.17; Description=ABC transporter
  Pfam annotation: Domain name=SMC_N; Domain location=374-573; Score= -135.2; E_value=0.1; Accession=PF02463.9; Description=RecFRecNSMC N terminal domain
  Pfam module annotation: Pfam domain module=ABC_membrane::ABC _tran::SMC_N; Domain location=28-310::385-569::374-573
MVSMERKTKNENGSIGFGSIFMHADGKDLLLMVLGTIGAVGEGLATPLVLYISSRMMNNIGSSSNMDGNTFIHNINKNAVAWLYLAGASFAVCFLEGYCWTRTSERQAAKMRCSYLKAVLRQDVAYFDLQVTSTSDIITSVSGDSIVIQDVLSEKVPNFLMNISLFVGSYIAAFAMLWRLAIVGFPFVVLLVIPGLIYGKTLIGLSSKIREEYNQAGTVAEQTISSIRTVFSFVGESKTMNAFSNALQGTVKLGLKQGLTKGLAIGSNGVVFGIWSFMCYYGSRLVIYHDAKGGTVFAVGAAIAVGGLALGAGLSNMKYFSEAVAVAERIKEVIKRVPKIDSDNKDGQTLEKFYGEVEFDRVEFAYPSRPESAILKGLSLKVPAGKRVALVGESGSGKSTVIALLQRFYDPVGGEVLLDGMGIQKLQVKWVRSQMGLVSQEPALFATSIKENILFGKEDATEDQVVEAAKAAHAHNFISLLPHGYHTQVGERGIQMSGGQKQRIAIARAIIKKPRILLLDEATSALDSESERLVQEALDNAAAGCTAIIIAHRLSTIQNADLIAVVGGGKIIEMGSHDELIQNDTGAYASTFRLQQQMDKEKVEESTEKTVTPRIILSTTDTENVGPNLIGPTIFSNHDDDVGEGKKVAAPSVRRLMALSVPEWKHAVLGCLNAMVFGAVQP

SEQ ID NO: 136690 - protein, 270 aa, Glycine max
  Coding DNA Sequence Number=SeqID_19912
  Pfam annotation: Domain name=zf-CCHC; Domain location=37-54; Score =21.6; E_value=0.00027; Accession=PF00098.13; Description=Zinc knuckle
QGQGILGVTSSKPKDDKGKTIEKQPLKASMQEKTSSMKCFKCLGRGHITSQCPTKKTMIMRGQDIYSSQDEVTTSPSSSESEEAKVEESSEEIYPQEEGQPIMVKEECKETLVSIATPLGLEFIPQVKELLDEGVEEKSPEFQEPRDLRSNPFQGGGNDAILPHKGIGQKTTPIQTSFEALNFVLLLSLSLHSSSPTSSSYPWLPMVWCLLSTLLLLHSAAIKIQEAKDSIDEEDPRPTNSNGATSVRVRMKEKCVKIGEKTECQNEIRL

SEQ ID NO: 136691 - protein, 181 aa, Glycine max
  Coding DNA Sequence Number=SeqID_19913
  Gene Ontology: Mol. function=nucleic acid binding; Biological process= DNA integration
MKLCFYREKGHNKSDCEEFKAWLENKQKSRGDLDNISSSLVVENFVAKRSKVEENSFMWHKRLGHISRQKVEGLTKTYILPSLGFDDLEKFEALEKFKFEAIEKELGKVIKIVRFVHGRKYYGKYGSTKHHMGSFALYFQDIGIVPQYTMFGTPEQKAVAKRHNRTLKDMMRNIMSRCNLS

SEQ ID NO: 136692 - protein, 287 aa, Glycine max
  Coding DNA Sequence Number=SeqID_19914
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=81%, HitCoverage=15%, E-value=2e-29, Identity=51%"; Hit description=Chromo
MADNTRMKELTGDVKRILEMMENRNKEYAARFETLETTLEMTLKDKTRDPGSISLAMNNHPFKVVPWYQMMTRENSFKTWIAFMRALETEFGPSPCECPRSQLFKLTQIGSVQSYYVQFTALANRVQGITQEALLDCFVGRLKPNIRMDVIAQSPTSLLRTVSLAKLYEEKYTPKLKPFSSSFSSKTQTSNTNSNLNINQNSPQSLKSTSLPPLLPTPYTKPINVKKMTSAEMQLRRERGLSFTCDDKFSPSHRCPNKQHFVLQWEEEDDPALQLDPPDEVETAGDP

SEQ ID NO: 136693 - protein, 181 aa, Glycine max
  Coding DNA Sequence Number=SeqID_19915
MENDKERVGWKRKGSTSNHNQNYAQAVRQGDGTKKHKWKAKGVNQVGKHEELWWGQDIHTHGEIQEWLDEVYLVGGIGNLKLNYIGDLTVLIFDIKDVERIRFNGSIHLVRIIEEGLWDSGSYICRQKGWKNSSDGELSKRSVYGWDFSSLIDECYDNCGEDGVKLQGDGGGKGGRHDGNL

SEQ ID NO: 136694 - protein, 91 aa, Glycine max
  Coding DNA Sequence Number=SeqID_19916
MWTDRFALTLNRSQELPPLLAKAKAMADTYSAPEEIHGLLSYLRIKSLPHFIPSMHCMLVSSFVTGSRKVHITFLIVHIGHCAPKCASKKR

SEQ ID NO: 136695 - protein, 124 aa, Glycine max
  Coding DNA Sequence Number=SeqID_19917
VPYGYPHLLSSRDGESDDMRGYLMVIRTFCQPEESEPVDMQRLTSSSAPFVNQGDESDDMRGYLMVIRTFCHPEASEPVDIQRLTSSSAPFVNQGDGKSDDMRGYLKVIRIFCHPEMASPMTWG

SEQ ID NO: 136696 - protein, 68 aa, Glycine max
  Coding DNA Sequence Number=SeqID_19918
MADRSGVTFHEDISNAVVLEIRIGLWWEFLIPLGVILAILDPLLIAISKSGPAVIGGKSIVLKPPTQL

SEQ ID NO: 136697 - protein, 63 aa, Glycine max
  Coding DNA Sequence Number=SeqID_19919
MTQMRKMVRRMRRTKAAVAPRMRRRRLRRWEEWAKWRIIMEMYALLMLYNVQQSTTCNPGGVD

SEQ ID NO: 136698 - protein, 181 aa, Glycine max
  Coding DNA Sequence Number=SeqID_19920
MESLICTMIVQTTRGIGVVLLTVIGVLQAEIWGIMYGLQMAAEAEREHLHVATNSLQDTNAEHDISNNTQGSSEGVEHQTNSVGDIHRTHIDEPENACKKQVESPNNNIEAEDVKEISHVVYKETGKASKVEVKDVKLNHPKEVQVNSVSKGSNAAKTKKKSMLPTSKASPISTPKSSKPA

SEQ ID NO: 136699 - protein, 282 aa, Glycine max
  Coding DNA Sequence Number=SeqID_19921
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=100%, E-value=8e-27, Identity=26%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=38; ConfidenceScore=5.33e-01
MAIHPRLQRTSRPPLQRAARPRLQRTTRPHLQRAACPHLQKVVGPLLQRASRPHLKRTTCPRLQMVARLHAFAFRGLHVLTIRGLRILPFRGLYALTFRGLNVLHFKGLHALPFRGLHVLLFRGLCALSFRGVHVLAFRWLHALAFKGLHVVAFRGLHALAFIGLHVLAFRGLHALVFRGLHALAFRGLHVLPFRGLHFFSYRGHYALSFKGLHVAAIRGIHAFAFRGLYVLTFRGLHALTLRGLHGLTFRGLHALTFRGLQVLPFIGQHPHAFRGLHADRG

SEQ ID NO: 136700 - protein, 544 aa, Glycine max
  Coding DNA Sequence Number=SeqID_19922
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q9LTN0; Match level="QueryCoverage=92%, HitCoverage=90%, E-value=1e-168, Identity=55%"; Hit description =Arabidopsis thaliana genomic DNA, chromosome 3, P1 clone: MTC11
  Pfam annotation: Domain name=Cellulase; Domain location=37-356; Score= 17.5; E_value=2.3e-08; Accession=PF00150.8; Description=Cellulase (glycosyl hydrolase family 5
MIPLITVRVIVLLLLGVTLQITKPVVVKGFPLHTSERWIVDESGKRVKLACVNWVSHLDAVVAEGLSQQPLDEISKRIKTMGFNCVRLTWPLFLVTNDSIASLTLRNSFQNLGLIQSLNGVQAINPSIIDLPLIKAYQAVVKSLGENDVMVILDNHVSQPGWCCSNLDGNGFFGDQYFDPDLWIMGLTKMATIFKGVTNVVAMSLRNELRGPRQNVNVWYRYMPKGAEAVHAANPDVLVILSGLNFDTNLSFIRNEAVKLSFNGKLVFEVHWYSFSDGQAWTLGNPNQVCGQVTENVMRRAGFLLDQGWPLFVSEFGVDLRGTSVNDNRYLNCFMALVAQLDLDWALWTLGGNYYIRQGDVGMEEYFGILNSDWIQVRNTSFLQRISAIQLPFKGPGLSEAKPYKVIFHPLTGLCILRNSPVEPLMRLGPCSNSDAWEYTDQKILSIKGTYFCLQAEEEGKQAKLGNACSGSNSRWEMISDSKMHLSTQTNNASGVCLDVDTNNIIVTNICQCLSKDNTCDPATQWFKLVDSTRKSRHYLRIPS

SEQ ID NO: 136701 - protein, 76 aa, Glycine max
  Coding DNA Sequence Number=SeqID_19923
MEILPLYKKIVGLQGCVYKIDSLYGGSLKLEDKDFPSYLSSLSKRLFLTLRSGFTLLSWMIGMKAHTLIYTTPPPQ

SEQ ID NO: 136702 - protein, 529 aa, Glycine max
  Coding DNA Sequence Number=SeqID_19924
  Gene Ontology: Mol. function=hydrolase activity, hydrolyzing O -glycosyl compounds; Cellular component=extracellular region; Biological process=protein amino acid phosphorylation
  Homolog annotation: Hit_ID=Q9SWX8; Match level="QueryCoverage=93%, HitCoverage=67%, E-value=1e-124, Identity=47%"; Hit description =Receptor-like kinase CHRK1
  Pfam annotation: Domain name=Glyco_hydro_18; Domain location=25-352; Score=267.6; E_value=2.5e-77; Accession=PF00704.18; Description =Glycosyl hydrolases family 18
  Pfam annotation: Domain name=Pkinase_Tyr; Domain location=416-526; Score=-129.3; E_value=0.00016; Accession=PF07714.7; Description =Protein tyrosine kinase
  Pfam module annotation: Pfam domain module=Glyco_hydro_18::Pkinase _Tyr; Domain location=25-352::416-526
MVSRITIALVLFEFLLCQEFEPLKAQTWLQAGYWYSGSGFPVSDINSALYTHLICAFAELNSSTYELYVSPEDEQSFSSFTTTVKQKNPSITTLLSIAGGNGNDTVLSLMVSKDSSRKYFIQSSIRIARLYGFQGLDLSWVPETISDMNNMGRLFEEWRAAAKSEAANDSTQVLILTAAVHFRPGLDSASYPVESIQNNLNWVHILTYDYHMPQLANFTAAHAALYDPSSSVNTDNGIKEWIGSGVTASKLVLGLPFYGYAWNLRNPEDNAIGASATGPAIGKSGAMNYKDIKAYIQRYGGHVKYNATYVVNYFSNGSTWIGYDDVEVVKMKVSYARENKLLGYAVWQVPYDDNWVLSSAAGILIYYLRRRFPKSTAVILSTLNNVNKDASRLFHSNAPDLQVFSFSDIEQATNRFSIENKVGQGGYGPVYKGILSNRQEVAVKKLSKASTQGFEEFKNEVMLTARLQHVNLVRLLGFYIDGEQQMLVYEYMPNKSLDSYLFGQKSSHFYILHLVNMQYDLNFRTLKSE

SEQ ID NO: 136703 - protein, 281 aa, Glycine max
  Coding DNA Sequence Number=SeqID_19925
  Gene Ontology: Mol. function=peptidase activity; Cellular component =integral to membrane; Biological process=aromatic compound metabolic process
  Homolog annotation: Hit_ID=Q84SE0; Match level="QueryCoverage=95%, HitCoverage=74%, E-value=9e-87, Identity=54%"; Hit description =Putative TPA: Cgi67 serine protease
  Pfam annotation: Domain name=Abhydrolase_2; Domain location=56-247; Score=-81.3; E_value=0.1; Accession=PF02230.7; Description =PhospholipaseCarboxylesterase
MGNVTGSVAARLAFFPPEPATYRVSREQDGRVVVSGAGLSEDRDLVAHVLETKGGNRIVATFWKHTFARFTLLYSHGNAADLGQMHDLFLELRAHLRVNIMSYDYAGYGASTGKPSEFNTYYDIEAVYDCLKSEYGIKQEDLILYGQSVGSGPTIHLATKLPNLRGVVLHSGILSGIRVLYPVKVTFWFDIFKGTNDEIVDWSHGKRLWELSKEKYDPLWVKGGGHCNLEAFPEYIKHLRKFLNAMEKLSITGETNKQPTHDPSDTEEEHKHNKCLRFGLR

SEQ ID NO: 136704 - protein, 436 aa, Glycine max
  Coding DNA Sequence Number=SeqID_19926
  Homolog annotation: Hit_ID=Q9AVU3; Match level="QueryCoverage=18%, HitCoverage=27%, E-value=5e-31, Identity=74%"; Hit description=GATA -1 zinc finger protein
  Pfam annotation: Domain name=GATA; Domain location=350-385; Score =70.7; E_value=4.7e-18; Accession=PF00320.17; Description=GATA zinc finger
MAIVLEQDIANMKDSWFFDNNFNGLSDEIFDDVINFFDFPLEDVEANGVEEDWDAQLKCLEDPRVDVYTASSAGLCAKTQNEKPQLGMKFSASENWTIGVKSGRYRGYRFSFCGGSLNSPLKVCCQCHLLILGNNRKNCYISSDTDPKCPGDAANLYEVLCLYSPKVSRDARQREEEGRKLGANLFPLPFRLQKLPLLGNGISPIKQLGKATGPVYGKTITHQNVTSNGKDLHQFQTYTYSPVSVFESSSSSSVENSNFDRPVIPVKRARSKRQRPSSFSPLFSIPFILNSPAMQNHQRIAAADSDFGTNVAGNLSNKLKKQKKKDSSLLSDDVEMMRSSSPESGSPRKCMHCEVTKTPQWREGPVGPKTLCNACGVRYRSGRLFPEYRPAASPTFVASLHSNCHKKVVEMRSRAIQEPVRGSMLASSNLHGNAVG

SEQ ID NO: 136705 - protein, 176 aa, Glycine max
  Coding DNA Sequence Number=SeqID_19927
  Gene Ontology: Mol. function=monooxygenase activity
  Homolog annotation: Hit_ID=Q8UAE4; Match level="QueryCoverage=83%, HitCoverage=51%, E-value=1e-67, Identity=72%"; Hit description =Alkanesulfonate monooxygenase
MKQQGGLVWGGPPMFKPRQSIPQQRQQAVALPFDFLEIGRVGKHEMGDAQRAHVALTVQIQQAALADSYGLKVVVPAYATVCGHLGNFRFRIAPSLGRGFAYQRGDPQAELQRRQIAAELFTEVPEPLDPFAHAGERFSPEKLHIGLGCGNLLGCFGSAAEIEFGMRSAFACGDTW

SEQ ID NO: 136706 - protein, 1003 aa, Glycine max
  Coding DNA Sequence Number=SeqID_19928
  Gene Ontology: Mol. function=protein serine/threonine kinase activity; Biological process=protein amino acid phosphorylation
  Homolog annotation: Hit_ID=Q2HSJ8; Match level="QueryCoverage=98%, HitCoverage=93%, E-value=0.0, Identity=53%"; Hit description=Protein kinase
  Pfam annotation: Domain name=Pkinase; Domain location=1-207; Score =161.9; E_value=1.7e-45; Accession=PF00069.15; Description=Protein kinase domain
  Pfam annotation: Domain name=Pkinase_Tyr; Domain location=1-207; Score=-14.7; E_value=1.4e-11; Accession=PF07714.7; Description =Protein tyrosine kinase
  Pfam module annotation: Pfam domain module=Pkinase::Pkinase_Tyr; Domain location=1-207::1-207
MALIARIQHPYIVEFKEAWVEKGCYVCIVTGYCEGGDMAELMKKLNGAYFPEEKLCKWFTQLLLAVDYLHSNYVLHRDLKCSNIFLTKDQDVRLGDFGLAKTLKADDLASSVVGTPNYMCPELLADIPYGFKSDIWSLGCCIYEMAAHRPAFKAFDMAGLISKVNRSSIGPLPPCYSPSLKTLIKGMLRKNPEHRPTASEVLKHPYLQPYVDQYRPSFSPPTTCSPVKPISAVNDHRKNMAESQNSNSSSSDKDTLMSNEKNIATAGPKCDNEATEMDQTSIDDDGSDEESGSCNVNAKTAEQEVVEPSHNKHHSNVESKQPKTIRNIMMALKEGKVREATSPMRGNRIKPSGLSTQKISTETLSKLPKPTFIAPSMKPNLESHAALARASPDPAKRMMGSHYPKHQILMTEASPKVKARHDFTPPSALVKQVEGDGVSPRPRQRTPPSLLRRPSFSGRMRLAGIDVPNAANDTGKLGTNKIVQEPQMSPCQLANGNVPHISRQVTTREPQKAFERSSKGLQTDSSNSASSSVSIQGCELADDATTFIDMREQMLPNHEKVNHIVGVESCPDRSQPTTCAHCKMVEKVPKETCEVSTNFQNTISSNEKVSSSLTLDHHHVEDSKVTLASEGGLVINKTTTSTTTSNCDDRSVEPSAGATKEIKDFQDISKEMPLTKSPKEIKDFQDISKEMPLTKSPKQAPPSSGEKSVHVEVSPVSEPDIVSQPTLGCKPPGDDKFTVRERLSPVAETVPVVTTTKSSSQKVLQEKGTLLQNPAQERPDTGHLPPAFDDVIHVIRHSSYRVGSEQPVKESVEMGVQNVDVGKFINVVRDDLEMRNITSPLTPLKSSSCSDAASLKSNISDQPETKNSNTPPILKSSSLFDASSMKSSISDYPGLKKQDVSNPPPLVSEPDSAEASKCNTPVNEEKLPVAKETLDVKSFRQRAEALEELLELSAELLQQNRLEELQVVLKPFGKDKVSPRETAIWLAKSLKGMMSEESGGRSS

SEQ ID NO: 136707 - protein, 88 aa, Glycine max
  Coding DNA Sequence Number=SeqID_19929
  Homolog annotation: Hit_ID=Q1T6A8; Match level="QueryCoverage=42%, HitCoverage=5%, E-value=2e-09, Identity=81%"; Hit description =Transketolase, C-terminal-like
MEKGDTKELRWLVLRFFWQEGEVNEEKGVVEEIGIKFITRQGQLLATNRGKAIGIDQFRASAPAGKIYKEFGITKEVVIVAAKELSYI

SEQ ID NO: 136708 - protein, 670 aa, Glycine max
  Coding DNA Sequence Number=SeqID_19930
  Gene Ontology: Mol. function=protein dimerization activity; Cellular component=nucleus; Biological process=regulation of transcription, DNA-dependent
  Homolog annotation: Hit_ID=Q9SKN5; Match level="QueryCoverage=99%, HitCoverage=99%, E-value=0.0, Identity=55%"; Hit description=Auxin response factor 10
  Pfam annotation: Domain name=Auxin_resp; Domain location=262-345; Score=166.2; E_value=8.2e-47; Accession=PF06507.4; Description=Auxin response factor
  Pfam annotation: Domain name=B3; Domain location=109-214; Score =113.3; E_value=6.9e-31; Accession=PF02362.12; Description=B3 DNA binding domain
  Pfam module annotation: Pfam domain module=Auxin_resp::B3; Domain location=262-345::109-214
MKETDKSLDPQLWHACAGGMVQMPPVNSKVFYFPQGHAEHAQSNVDFGAARIPIPPLILCRVAAVKFLADPETDEVFARLRLVPLRNSELDYEDSDANGEAEGSEKPASFAKTLTQSDANNGGGFSVPRYCAETIFPRLDYSAEPPVQTVIARDVHGEVWKFRHIYRGTPRRHLLTTGWSSFVNQKKLVAGDSIVFLRAENGDLCVGIRRAKRGGVGGPEGPCGWSSYGSGGLGLGPYGAFSGFMREESGRAKVSGESVREAVTLAASNQAFEVVYYPRANTPEFCIRTSAVRGAMRIQWCSGMRFKMPFETEDSSRISWFMGTIASVQVLDPIRWPNSPWRLLQVSWDEPDLLHNVKRVSPWLVELVSNVPIIHLAAFSPPRKKLRFPLDVQFPIPSFSGNPFGSSSSSSPFCCLSDNAPAGIQGARHSQIGISLSDLHLNNKLQLGLLPTKVHQLNLHAGISNAKSKESLSSLLSMGNSNMTLEKSDHVKRHHFLLFGQPILTEQQISRSSSDVATDDENKEKKKKGFLSDSQSSVSPGNLSSTAEFSWQLGSDTSHCKVFMESEDVGRTLDLSCLSSYQELYMRLANMFGIERSDMLSHVLYCDSSGALKQIGEEPFSEFMKTAKRLTILTDSNNKDSRRVWITGTRNAEHGLDAASNKTGPLSIFA

SEQ ID NO: 136709 - protein, 803 aa, Glycine max
  Coding DNA Sequence Number=SeqID_19931
  Gene Ontology: Mol. function=superoxide dismutase activity; Biological process=regulation of phosphoprotein phosphatase activity
  Homolog annotation: Hit_ID=UPI000059FD71; Match level="QueryCoverage =49%, HitCoverage=48%, E-value=7e-48, Identity=29%"; Hit description =PREDICTED: similar to CG10289-PA isoform 1
  Pfam annotation: Domain name=SAPS; Domain location=81-443; Score =503.6; E_value=2.2e-148; Accession=PF04499.6; Description=SIT4 phosphatase-associated protein
LRDQVQVEQLLRYIIEEPPEDAENKRAFKFPFIACEIFTCEIDVILKTLVDDEELMNLLFSFLEPNRSHSTLLAGYFSKVVVCLMIRKTVPLMNYVQAHQNVFRQLVDLIGITSIMEVLVRLVGADDHMYHNFIDVMQWLAESNLLEMIVDKLSPSSPPEVHANAAETLCTITRNPSSSLAIKLSSPSFVAKILNYALEDSQSKSSLVNSISVCVSLLDPKRSAISSPLFHSFRSQHMYEPPIPVNPDTIGAMLPKLSELHMLLNVSSDEKVLPTTYGELRPPLGKHRLKIVEFIAVLLKTGNEVAENEMVNSGTIQRVIDLFFEYPYNNSLHHHVESIILSCLESKTDAIVEHLLRECDLIGRFLQADKRSILSSDINLPTVTAAGKQAPRAGNIGHITRIVNKLVHLAHNRNLILTCLQENSEWNEWQALVLQERNVVENVHRWACGRPTALQDRMRDSDDDDLHDRDYDVAALANNLSQAFRYKIYGNEDNEEERGNLDRDDEDVYFDDDSAQVVISSLRLSDDQGSSLFTNSNWFAFQDDRIGGATGGTSSEMMDAINLNGAANGGNSSDDEVVVGEDEELDESKNNLNGTSSSSTNLNGITGSDSMNGDTLNFESKKASASHDMGFFRFEASDNEELFGDRPLPDWVGWGEPSDMQDAGSSKNPFIDHDDSSGSNLSTTKPQIGSPNPSPPSNGESVPSNRSPTKDSIDGGVDLNQRAVAVPSLFEEDVEFVGVELEGTEKAMEQALKEGIVGEAGPLKRNMVSKVPEKESTDEGGPGIKEFNDANYWRVDQEVAVLE

SEQ ID NO: 136710 - protein, 1011 aa, Glycine max
  Coding DNA Sequence Number=SeqID_19932
  Gene Ontology: Mol. function=RNA-directed DNA polymerase activity; Biological process=RNA-dependent DNA replication
MIEVVLNEDDTIGDSKKLVAAQTGFTFRNGYEYGKDNIRSARVSRELTEEEKDLVDRSTKKIKGVAHGFSGDSLLGDVWVKLLGRKIRFKVLENRLKQMWDKAKAQMEGPWLIYDHYLVVREWSPNFHPSSKAIEKVAVWAVRVDRNTLTQERGKYARLCAEANRIMDRGKIGIMKGSNIQMATQVAIVTHSQGPWTVVKKPRHQRKGKEREFQFTGNHVEKGGQGGSHAASRSRFVSLHEDEGDHAVVMEGDHEVEVRGKEYEKGGVLHPTRPPDTHGVIDAKESPLNLLLFELKRSNRGWRKWRYCKQYLNANNPDIMIILDTHLESSKLLKTVYFLGFDGSEAVERQGFAGGIILTWKKDKELWGLDLLEKDLYSMGIKEFLKDFLDHHPLTISLHADYNGPGIKPFRFECAWLTHPSFMDVTSNVHIRKRKLLARIGGIRKEINPDLNGFLKEIGTQGTTMDTPYSFPFIELEDLTMLAAPLQHEEIKKALFDMKPWKTPGLDGFPEIMEVNATNICLIPKVEQLEFVSQFCPISMCNVVYNVLTKTLVNHLKALIPELITPQQTGFIPSRSIHDNIVVAQEMMHSMRRMQGKVGYIIIKVDLSKAYDKICWSFVAKILKEVELPQNMMDVIMSCISSVKTNVLWNGQRSDMFSFHRGLRQGDPLLPYLFVLFMDKLSHIFSKWALETYEDGVEIQTTFYGRRITLAKSVVQSLPVYSMMTNVVPGDQQDKRRVHAVGWSTMSKVCRGMAMCNMKAMNKACLMKLGWQLRTKGSGLWCQALANLWSDLEEGEFWVIGQRDTVNVWRTKWDGRWDSDFIRMLMPEVIAQRIFAIMPPSAQADSDKRLWPRFNFFMADTKGWISMNLTMSIDGSGGSNWMGLWAHVCYYLWFWRNQQGWTKLNTDESVQGPQIVAACGGLIRDEKGCWISELWGVYEGLCLARKIGLVAMEVNIDSQAVMDSLSGKTNNCVDALARNAISMNEDFLVFQQPPSFVKELLLAYSAGVVTP

SEQ ID NO: 136711 - protein, 107 aa, Glycine max
  Coding DNA Sequence Number=SeqID_19933
  Homolog annotation: Hit_ID=Q652L2; Match level="QueryCoverage=37%, HitCoverage=4%, E-value=3e-11, Identity=82%"; Hit description =Putative HIRA
MGMRKHKLLIEDILPSMASNRKVHRLLNEFMDLVSEYEIAPVTEDIAANDQQKNQKYPEDAALNSKDNPQVAKVQTKITPALADEVTEHALVTYHANQDTQTNEGGS

SEQ ID NO: 136712 - protein, 60 aa, Glycine max
  Coding DNA Sequence Number=SeqID_19934
MNENIAYVCITFDILHAFDITSYHDEQQRIVECVFPLDEQHEENFEYSLYLLVVNNLSQV

SEQ ID NO: 136713 - protein, 50 aa, Glycine max
  Coding DNA Sequence Number=SeqID_19935
MAGSFKRTTELVEAILDKENFTLEELLDEEEVIQECKALNSRLINLCVSV

SEQ ID NO: 136714 - protein, 273 aa, Glycine max
  Coding DNA Sequence Number=SeqID_19936
  Gene Ontology: Mol. function=double-stranded RNA binding; Cellular component=intracellular
  Homolog annotation: Hit_ID=Q1SNX2; Match level="QueryCoverage=82%, HitCoverage=57%, E-value=7e-63, Identity=60%"; Hit description =Double-stranded RNA binding
MAEYEWTIIFLPVAKETASSSTEPENNDEVEQITIARALLNYRLKEKMTMSNPNAPLPFHERFQIQNPRPISSQPPPATSSKILPLICQKTAPRSKPSLATTTTNESPGSRHPQAAVAVTSDNSNLPQQSCSLECRATRPLKFPAAGAAPYVPIRQMRPSCQRIAPPVTIRTVVPAFAAPPASVPHPVIRAPPVRVAPPVTIRQAVPLYAAPKQQKDLPTANASGQQDKLPVKIQEMDKITGIQQFSDSIFKEAEPQTDNLEPILCQRLKWTA

SEQ ID NO: 136715 - protein, 308 aa, Glycine max
  Coding DNA Sequence Number=SeqID_19937
  Homolog annotation: Hit_ID=Q9ZRV9; Match level="QueryCoverage=32%, HitCoverage=13%, E-value=3e-15, Identity=52%"; Hit description=Beta -galactosidase
  Pfam annotation: Domain name=FBD; Domain location=69-117; Score=24.9; E_value=0.00029; Accession=PF08387.1; Description=FBD
MYLLHTDFNEVEIIEELIPEFYNLTSNEFGYLEHTNDWLEVLKVIKHCPKLQNLAINQVESRPDADRREWQYPLYVPKCIPSHLKTCRINNYGGHETEFEFARYIMTRSGLDSRLWLQEKIAQKDKDRVELSLLIYASPKQYDNMWRNSCMVEVHSCISFRMDNGSFKVGLTIPLTWSLLLTQVWNNLTLSVFILRRRCKIENEYGPESRGAAGRAYVNWASTASMAVGLGTGMPWVMCKENDAPHLEIFYSMRSKKERKGWMTIKIDFEKAYEDLVRDTLHDVGIPENIWVHESFMECQGFGRFYSL

SEQ ID NO: 136716 - protein, 139 aa, Glycine max
  Coding DNA Sequence Number=SeqID_19938
  Subcellular localization annotation: CTP_CleavageSite=49; ConfidenceScore=5.06e-01
MTLLLSNILPSDQPLRKYRDRAHKTPSGPGGAQQGSGVSNSGYRPLSVLQGARSPQQGIVPTRHPVDPKEPNRALGFPALVTGLSVSTTGCSFPPARGSAHKTPSGPGGAQQGPRVSSSGYGPLSILQGARPPSKFMSS

SEQ ID NO: 136717 - protein, 51 aa, Glycine max
  Coding DNA Sequence Number=SeqID_19939
MESKTWSKGDLRLENQGIPGCSPRRANLHFFFGGRNKYSFLQVDARLLEPP

SEQ ID NO: 136718 - protein, 59 aa, Glycine max
  Coding DNA Sequence Number=SeqID_19940
MGLRKRDREWRIALSNHYAWLQTRGWRMHEQKRNSCGSERRGRERRIALSNHYAWLQTR

SEQ ID NO: 136719 - protein, 391 aa, Glycine max
  Coding DNA Sequence Number=SeqID_19941
  Gene Ontology: Mol. function=transporter activity; Cellular component= 1-2nm peptidoglycan-based cell wall; Biological process=transport
  Homolog annotation: Hit_ID=Q6CZR8; Match level="QueryCoverage=29%, HitCoverage=47%, E-value=2e-34, Identity=59%"; Hit description =Octopine transport system permease protein
DLINGRVDAVMASHTNQNAYVKKHADAVNSTGYGFEGGVLGQGSAIAIRKNNPELKNALDQALVSMIKDGTLKQLSEKWLGRRAAGRRHRHGNGLAVCVAAGRDARQPAVLDADWWRPLAAASCQRLHHAVSRRAGAAGDLPGPFDVNGFVAGAIAIGLISGAYQSSVFRGAFYAIPAGTLEAATVTGVGAGIGDRAGGNHEPDFHRVEFHPDAVFLLQRRRAHAGGAAARTAADAQPGGIVPAGRRNTGAAAEFAASASPWQLRYAFLCLAVPRLPAVRESVLWPLLREPYWCGLIALILNDAAYTAEILRGGLNAVSVQSLEAAKVCGMSRFTTLRRITLPLAVRQALPAYSNEIISMIKSTSLVSTISLMEMTGIADSIVSETFRALE

SEQ ID NO: 136720 - protein, 58 aa, Glycine max
  Coding DNA Sequence Number=SeqID_19942
MHVVHRSESRFNNESNDVEYGNFYISDDVGTDVVSCVFYIIFQKATMLNMGTSTSVVT

SEQ ID NO: 136721 - protein, 65 aa, Glycine max
  Coding DNA Sequence Number=SeqID_19943
  Gene Ontology: Mol. function=sequence-specific DNA binding; Cellular component=nucleus; Biological process=regulation of transcription, DNA-dependent
  Homolog annotation: Hit_ID=Q6J3Q5; Match level="QueryCoverage=66%, HitCoverage=11%, E-value=6e-11, Identity=68%"; Hit description=Male -specific transcription factor M88B7.2
  Pfam annotation: Domain name=CCT; Domain location=35-63; Score=28.7; E_value=2e-05; Accession=PF06203.4; Description=CCT motif
MLLGAVSLFKRIFVKGEEEYPAKCSLPQRAASLNRFRQKRKERCFDKKVRYSVRQEVALSNNNGN

SEQ ID NO: 136722 - protein, 141 aa, Glycine max
  Coding DNA Sequence Number=SeqID_19944
  Subcellular localization annotation: CTP_CleavageSite=52; ConfidenceScore=5.49e-01
MDMPPSKDTPTQQPPPPTLVAPKATCVMANVSKRPALKKQQQKPSSIAQRLRALNENESEDDRPLVFRKRKVAPPLDETYVPQVKKVKQTQHAPPPLTQPCTRIEVLPPPTWKRLDVNLSRSGSFDTGYGGLDDATSGEGR

SEQ ID NO: 136723 - protein, 114 aa, Glycine max
  Coding DNA Sequence Number=SeqID_19945
  Homolog annotation: Hit_ID=Q84VJ1; Match level="QueryCoverage=61%, HitCoverage=21%, E-value=4e-33, Identity=88%"; Hit description =Biostress-resistance-related protein
MGYTKELSPFSLDKPVYSKEPHFLLFLCSWSQLLETLPLPNIKWICPTAPTQPISIFGGFPSTAWFDVGDISEDAPDDLEGLDASAAHVANLLSTEPADRRKENYPGLIFGSSK

SEQ ID NO: 136724 - protein, 126 aa, Glycine max
  Coding DNA Sequence Number=SeqID_19946
MVGYMPSSFADLVFTGERIEVGLRRGKFDFPALMKPGANGENKKEGKKHVVAFVPTWPNFSLAHQYQYSANISPSHYLASQERPIINKGHPQIDHKIHPMHLQDQIPPLIPIKTPTREGIFQKISL

SEQ ID NO: 136725 - protein, 272 aa, Glycine max
  Coding DNA Sequence Number=SeqID_19947
  Gene Ontology: Cellular component=membrane; Biological process =transport
  Homolog annotation: Hit_ID=Q1SNX4; Match level="QueryCoverage=98%, HitCoverage=81%, E-value=1e-105, Identity=75%"; Hit description =Yeast 73.5kDa hypothetical-related protein
  Pfam annotation: Domain name=DUF254; Domain location=1-270; Score= -164.7; E_value=0.00079; Accession=PF03164.5; Description=SAND family protein
MLQQCYDTSLLLESSYISSCLYLSTSCICNQASCRTSEAFSPVCLPRYNGLAFLYAYIHFFDDDTYLMLLTTSSDAFYHLKDCRIRIETVLLKSNVLSEVQRSLLDGGMHVEDVPPLPSSGSSPHLSQHRLPSDSPEREPNCHIGGVAGLWHFIYRSIYLDQYISSEFSSPINTPKQQKSNITCLRCYRLYRAYQKLFASMHDKGIGPHKTQFRRDENYVLLCWVTQDFELYAAFDPLADKALAIKTCNRVCQWVKDVENEIFLLGASPFSW

SEQ ID NO: 136726 - protein, 79 aa, Glycine max
  Coding DNA Sequence Number=SeqID_19948
MSFSVTQGRALPVALFEPLFGFMDLAVSTPKMSLTGLVWFWFLHLFLNGHRLKPFLMNPSLVDVVVEETSLLHPTLPPP

SEQ ID NO: 136727 - protein, 113 aa, Glycine max
  Coding DNA Sequence Number=SeqID_19949
AVHVSSIFEFGAEFHDCLSADPQDNPPYSTFVGSTMNIGSFAKYKKKEEVETRVVITERAGRTKSVSYLCFPLISDERLKQHSSLGRAELAWASYVATTPPGAVLRIPDAPGE

SEQ ID NO: 136728 - protein, 201 aa, Glycine max
  Coding DNA Sequence Number=SeqID_19950
  Homolog annotation: Hit_ID=Q680T1; Match level="QueryCoverage=35%, HitCoverage=11%, E-value=7e-30, Identity=87%"; Hit description=MRNA, complete cds, clone: RAFL22-37-F09
  Subcellular localization annotation: CTP_CleavageSite=39; ConfidenceScore=5.39e-01
MAVRGGMHPGRMYSDSTPPKQAKHQRPATQISLSLSSLSSQSKNCTSSIPNHHRSSNNNPTDPPPDPPPTPPAPLVAVTPPKGAVAAPPQASPRSMTSSTTKFKRSPSTIPNLNLPLTPPGFPENDTPMRYGDEHKLAGFSATLQAIISFVENGGDHVKLVRAGKHQVVFLVKGPIYLVCISCTEEPYESLRGQLELIYGQ

SEQ ID NO: 136729 - protein, 131 aa, Glycine max
  Coding DNA Sequence Number=SeqID_19951
MPWDERRVSLRVTRRIGAGSRKENRGGPVEMLEEEDTYLQLYNLIPVQFPNLFRSGVIHRGVATISFTPLILTHSNFNATTLQYLQPSPISPHDPSPTITTIVRVTIANNTLPHTCLSKLIKGNNPFLSLR

SEQ ID NO: 136730 - protein, 92 aa, Glycine max
  Coding DNA Sequence Number=SeqID_19952
MVLRVKYNNQIWLQLRRDEKEKGDGAMVIQVRRMWIYLLGLVYVSSQAIWTNNFIIHWKMKEGNYKQRNSKRSRISGIPEGMHDQLVNEKNL

SEQ ID NO: 136731 - protein, 99 aa, Glycine max
  Coding DNA Sequence Number=SeqID_19953
MTVMVVAIDTMATMTAMVRIPMNLIPSIRGLGNLPLRVPYEEIETRGEEGTQVQRREGEKEFERKKLLEFLLCPLQVSYSFYSGGPMLNHLRLAVIAKP

SEQ ID NO: 136732 - protein, 54 aa, Glycine max
  Coding DNA Sequence Number=SeqID_19954
MSELKCVDHMPSMSMQSLEEKEHGIRIMTGNVSCHLAKKLTLCMIDLSLAPILS

SEQ ID NO: 136733 - protein, 123 aa, Glycine max
  Coding DNA Sequence Number=SeqID_19955
  Homolog annotation: Hit_ID=Q9SKM9; Match level="QueryCoverage=42%, HitCoverage=46%, E-value=2e-11, Identity=57%"; Hit description =Expressed protein
  Subcellular localization annotation: CTP_CleavageSite=56; ConfidenceScore=5.19e-01
MSKEQPLPLESGPYHYKKPVQPTHNTKSRRQNKLNMNPIGFSLLSLVSLALVSIVTAQERAPHGLVYENPEAFSPSAYNFLHPNERKPETKDPCAASKCSPMPLAAQVEATEIHESKASTPQG

SEQ ID NO: 136734 - protein, 60 aa, Glycine max
  Coding DNA Sequence Number=SeqID_19956
ALCTDLPGSLALAFGHDHTSYGVYVMGVECIDLVRWPRRGEHLWAPRLITYGRGAVTCTP

SEQ ID NO: 136735 - protein, 577 aa, Glycine max
  Coding DNA Sequence Number=SeqID_19957
  Gene Ontology: Mol. function=sequence-specific DNA binding; Cellular component=nucleus; Biological process=regulation of transcription, DNA-dependent
  Homolog annotation: Hit_ID=Q9SJJ3; Match level="QueryCoverage=40%, HitCoverage=37%, E-value=3e-38, Identity=43%"; Hit description =Putative homeodomain transcription factor
  Pfam annotation: Domain name=POX; Domain location=351-484; Score =54.1; E_value=4.5e-13; Accession=PF07526.2; Description=Associated with HOX
MSNLRPESHVAQQIRREKLRIQNSYQPSHEFPNNLEQLSLHPGFNNLDLVQVRNVRNANMLDELAVYSSEMPNFSTSSSAARNALEYHQEQGAAAEPSNRLLLMNQYGSFPHSMSAIHSSHKQQCELRNLGNWRNSTPHQGSDWFVNYASNANSFLSAELNNNVSAYNELMDVHCSNASGEISGREMHKQGVLHHNSPPSSPLYQNALQDIVKSASFSAHTRQDMASLMQQNEHSIWVGNASEAELQQPSYESQPNHELRFGWTNRTIACDSLPQSLSLSLSSNAQPKPSVSHLEQGSASDDPQCLKHMKSIVSRDCGKSVQDQVEIPSKSTTTITYRSVGPLGPFTGYATILKSSRFLKSAQQLLDEICCLSDAKFGKSYDVSKRVSPEVSASTSADTVTGVAAKGSNSGSSSTTLYNVSKENRADPGVGSSFGLSSRSDYQHKKAKLLYMQEESVAGLGSATPYIPMALKSVSKHFSTSTCSNKADTTTMARVRCGSSMDQSFFLKNKCVKGTTELLDEPPQQHVWRPQRGLPERAVAILKAWLFEHFLHPYPTDTDKHMLASQTGLSRNQGVHS

SEQ ID NO: 136736 - protein, 186 aa, Glycine max
  Coding DNA Sequence Number=SeqID_19958
  Gene Ontology: Mol. function=transcription regulator activity; Cellular component=nucleus; Biological process=negative regulation of gene expression, epigenetic
  Homolog annotation: Hit_ID=Q9LXN4; Match level="QueryCoverage=81%, HitCoverage=12%, E-value=2e-39, Identity=56%"; Hit description=WD repeat domain protein
  Pfam annotation: Domain name=Hira; Domain location=1-109; Score= -47.8; E_value=0.0019; Accession=PF07569.2; Description=TUP1-like enhancer of split
MSLKCWLRVADDCFPASNFASSWSMGSIQSGELAALQVDVRKYLARKPGWTRLTDDGVQTRAHLEAQLASALALESSKEYRQCLLSYVHFLARLVHGSVHHRKLNLTELENSSLQEKQMNLDYENSESFLGPPTGMAGEASSDSKSAWDPFVLLAMVELHTIIAETFPTLGVCLDEGDKGNGKGKE

SEQ ID NO: 136737 - protein, 475 aa, Glycine max
  Coding DNA Sequence Number=SeqID_19959
  Gene Ontology: Mol. function=protein serine/threonine kinase activity; Cellular component=membrane; Biological process=protein amino acid phosphorylation
  Homolog annotation: Hit_ID=Q8RYK7; Match level="QueryCoverage=63%, HitCoverage=83%, E-value=9e-60, Identity=43%"; Hit description =Putative disease resistance protein kinase
  Pfam annotation: Domain name=Pkinase; Domain location=185-446; Score =53.8; E_value=5.8e-13; Accession=PF00069.15; Description=Protein kinase domain
  Pfam annotation: Domain name=Pkinase_Tyr; Domain location=185-446; Score=33.7; E_value=1.5e-14; Accession=PF07714.7; Description =Protein tyrosine kinase
  Pfam module annotation: Pfam domain module=Pkinase::Pkinase_Tyr; Domain location=185-446::185-446
MGAKAAPTHTDSTSILQQINLQIIRHLLTAAEALFTFKGSLGGPQQLGCSIVKYPCQMQWPCLDCYKLKDPGGITAKIDGNNDVPTLTPLQETQVRKPGGTRAAAIFGIVVAALVVIVILVTVYICLMRVKRFMRQTSEVASSMPSPTVEIGRVNNAHVNAFSPHYTHNTRQLTILEVEQATRNFSHSNIIGEGGFGFVYKGLLQDGSIVAIKRRLFVLTQDFVLKVKQIAHIHHNHLVKLIGYYEDSYQQLLVYEYLPNGNVGSHLYDSEGLPIGRLDLWRRISIASGASKGVEHLHSLVPPLIHTNFRTSNVLLDENYTAKVSDYGFCNSKTQVDNVGSSSNVDCFLDPELSFPQNYTEKSDVYSFGVFLLELICGCEAQNKSMSNPDENIVFQAKNSVDLDKFVDITLGEQEKHGARRVMKLALLCVDVTSRRPSMAQIVHELEQIQREIAPMYSQFNEEIGAVTLGSELFQ

SEQ ID NO: 136738 - protein, 63 aa, Glycine max
  Coding DNA Sequence Number=SeqID_19960
MTEQRIQHRGGDRDGVQEAEAEYTALSLCIRRKERISLNTYMYTLFRRFFLLALRLSPLPHYL

SEQ ID NO: 136739 - protein, 78 aa, Glycine max
  Coding DNA Sequence Number=SeqID_19961
MYDIIMFGEVDMNEQNEDEAGVNEEHIDCSNWTQSVAYEIEFVAVIMRSDINAEILAIGNVGVLLSFMGNQWLEANDG

SEQ ID NO: 136740 - protein, 103 aa, Glycine max
  Coding DNA Sequence Number=SeqID_19962
MVKLRMNSHTLSMKIVKHTYTRFRVQSETDTYTIKIRETEAETILNNDFCRVVFDDCLVMLLYCVGLFKYKEGVVVDCIVCSLELTCESLSLPWPLVTHGQKV

SEQ ID NO: 136741 - protein, 299 aa, Glycine max
  Coding DNA Sequence Number=SeqID_19963
  Gene Ontology: Mol. function=transcription factor activity; Biological process=regulation of transcription, DNA-dependent
  Homolog annotation: Hit_ID=Q1I8I6; Match level="QueryCoverage=99%, HitCoverage=100%, E-value=4e-88, Identity=56%"; Hit description =Putative transcriptional regulator, LysR family
  Pfam annotation: Domain name=HTH_1; Domain location=11-70; Score =63.0; E_value=9.9e-16; Accession=PF00126.17; Description=Bacterial regulatory helix-turn-helix protein, lysR family
  Pfam annotation: Domain name=LysR_substrate; Domain location=90-295; Score=124.6; E_value=2.8e-34; Accession=PF03466.10; Description=LysR substrate binding domain
  Pfam module annotation: Pfam domain module=HTH_1::LysR_substrate; Domain location=11-70::90-295
MNQGFQALPSLNALRVFEAVTRHLNFRLAAEELGVTQGAVAQHIRGLEASLGLKLFDRLPRTLALTAAGAGYAVHIRQAFELIDEATRTLRPEPDRLTLSVTPTFASRWMLPRLPAFTAAWPDIDMRVLASERLVQFHHEGVDLAVRYGRPPFGSGLEAMLLFSQTVLAVVSPALLAQHGDAAQPENCLRYPLLHDGHHLWPAFLAFMFPGQSLQHQHHLRFNQTALALEAALSGQGIALTSPHFVQNDLASGRLVPAWHREMPVDAGWYLVAPRRPREQATVSAVRAWLLSQAEQSKD

SEQ ID NO: 136742 - protein, 234 aa, Glycine max
  Coding DNA Sequence Number=SeqID_19964
  Gene Ontology: Mol. function=oxidoreductase activity; Cellular component=membrane; Biological process=metabolic process
  Homolog annotation: Hit_ID=Q8YGC4; Match level="QueryCoverage=99%, HitCoverage=97%, E-value=2e-92, Identity=71%"; Hit description=SHORT- CHAIN DEHYDROGENASE
  Pfam annotation: Domain name=KR; Domain location=6-183; Score=-94.1; E_value=0.066; Accession=PF08659.1; Description=KR domain
  Pfam annotation: Domain name=adh_short; Domain location=5-166; Score =19.6; E_value=2.8e-07; Accession=PF00106.15; Description=short chain dehydrogenase
  Pfam module annotation: Pfam domain module=KR::adh_short; Domain location=6-183::5-166
MTVEKVAVIVAGGSGMGAAAAEKLASEGFRVAILSSSGKGEALANRLGGLGITGSNQSVDDLQHLIDATLARWGRIDVLVNSAGHGPRAPILELSDDAWQQGMETYFLNVVRAVRLVTPIMQQQGGGSIINISSAWTFEPTDMFPTSAVFRAGLASFSKIFADTYAAENIRINNVLPGWIDSLPKTDERRDSVPMQRYGTAAEVAATIAFLASPGAAYITGQNIRVDGGVTRSV

SEQ ID NO: 136743 - protein, 395 aa, Glycine max
  Coding DNA Sequence Number=SeqID_19965
  Gene Ontology: Mol. function=protein dimerization activity; Cellular component=endoplasmic reticulum; Biological process=proteolysis
  Homolog annotation: Hit_ID=Q2RH29; Match level="QueryCoverage=97%, HitCoverage=98%, E-value=4e-71, Identity=38%"; Hit description =Peptidase M20D, amidohydrolase
  Pfam annotation: Domain name=M20_dimer; Domain location=187-293; Score=32.1; E_value=2e-06; Accession=PF07687.4; Description =Peptidase dimerisation domain
  Pfam annotation: Domain name=Peptidase_M20; Domain location=81-392; Score=179.5; E_value=8.3e-51; Accession=PF01546.18; Description =Peptidase family M20M25M40
  Pfam module annotation: Pfam domain module=M20_dimer::Peptidase_M20; Domain location=187-293::81-392
MTDHKILLARDISARSESMQAHLIAIRRDIHAHPELGFDTVRTAAIVEKELLRLGLTPQTGVGRTGVMVDITGAQPGKTVLLRADMDALPIHEQTGLPFSSIWPGKMHACGHDIHTATLLGVTAILADLRSQLHGTVRLIFQPAEETPESGAQAMIAAGAADGIDVAITLHNKPELAAGEIALTRGASTASSDEFDVVIHGKSTHAARPHMGTDPIIAAASLVTQLQTIVSRELDPANSAVLTIGHIHGGTTHNIISDSCLIQGTIRAKSPQARAHMEDAFRRICAGVALSLNTRIEVNYQRGVPPLMNDDALIDALEPILSHQFGKPVVAKPSSSFGAEDFSLFTERVPGCQIHIGSGAPGRDDHLHNSDYQPDERSIHAGTQALARIAIDLLS

SEQ ID NO: 136744 - protein, 236 aa, Glycine max
  Coding DNA Sequence Number=SeqID_19966
  Gene Ontology: Mol. function=oxidoreductase activity; Cellular component=cytoplasm; Biological process=metabolic process
  Homolog annotation: Hit_ID=UPI00006DC0E6; Match level="QueryCoverage =98%, HitCoverage=94%, E-value=2e-82, Identity=65%"; Hit description =COG4221: Short-chain alcohol dehydrogenase of unknown specificity
  Pfam annotation: Domain name=Epimerase; Domain location=9-233; Score=- 46.9; E_value=0.0043; Accession=PF01370.11; Description=NAD dependent epimerasedehydratase family
  Pfam annotation: Domain name=KR; Domain location=8-189; Score=-5.6; E_ value=5.1e-07; Accession=PF08659.1; Description=KR domain
  Pfam annotation: Domain name=NAD_binding_4; Domain location=11-220; Score=-86.8; E_value=0.0052; Accession=PF07993.2; Description=Male sterility protein
  Pfam annotation: Domain name=adh_short; Domain location=7-174; Score =137.1; E_value=4.8e-38; Accession=PF00106.15; Description=short chain dehydrogenase
  Pfam module annotation: Pfam domain module=Epimerase::KR::NAD_binding_ 4::adh_short; Domain location=9-233::8-189::11-220::7-174
MAHSNAKVIILTGASSGIGEAIARLLASQGHKLVLGARRTDRLAILCDELRASGAQLDYLATDVTQRADTQQLADFARDKYGRVDVMINNAGVMPLSPLSSLKVDEWDRMLDVNVRGVLYGIAAVLPVMESQQSGHIINIASIGALAVSPTAAVYCATKFAVRAISDGLRQESRQLRVTVINPGVVESELADTITDETARVAMQSYRQIALKPEAIAQAVSWAINQPGEVDVNEIT

SEQ ID NO: 136745 - protein, 318 aa, Glycine max
  Coding DNA Sequence Number=SeqID_19967
  Gene Ontology: Mol. function=sequence-specific DNA binding; Cellular component=intracellular; Biological process=regulation of transcription, DNA-dependent
  Homolog annotation: Hit_ID=Q1H3T0; Match level="QueryCoverage=91%, HitCoverage=89%, E-value=1e-99, Identity=60%"; Hit description =Transcriptional regulator, AraC family
  Pfam annotation: Domain name=AraC_N; Domain location=52-186; Score =136.9; E_value=5.5e-38; Accession=PF06719.3; Description=AraC-type transcriptional regulator N
  Pfam annotation: Domain name=HTH_AraC; Domain location=201-247; Score= 29.4; E_value=1.3e-05; Accession=PF00165.13; Description=Bacterial regulatory helix-turn-helix proteins, araC family
  Pfam annotation: Domain name=HTH_AraC; Domain location=253-297; Score= 23.8; E_value=0.00062; Accession=PF00165.13; Description=Bacterial regulatory helix-turn-helix proteins, araC family
  Pfam module annotation: Pfam domain module=AraC_N::HTH_AraC::HTH _AraC; Domain location=52-186::201-247::253-297
MVSSCWLTRLLWKTPAKANRPDCGASLPDSLVTVQTCALLRQLAPQEGYTASLLDGVRFMRADRQWARTPVLYEPSIIIICQGSKRAFLADKMYRYDAQHYLVLSVPLPFSAETEATSAEPLLGLAIRLDAATLARLVTQVAAADIPLAETPASIISTPVNETLADSTLSLLQALSDPLEAQGGAVRAALTYQGHFGRIARALQRIHADWQQPLDVPHLASEAGMSVPRFHLHFKSVTQTSPIQYLKSLRLHQARLMMIRDNLTAAGAAARVGYESDSQFNREFKRMFGRTPADEARVMKRAFALLPPEQLSARLQAH

SEQ ID NO: 136746 - protein, 653 aa, Glycine max
  Coding DNA Sequence Number=SeqID_19968
  Gene Ontology: Mol. function=metal ion transporter activity; Cellular component=membrane; Biological process=metal ion transport
  Homolog annotation: Hit_ID=Q8XS16; Match level="QueryCoverage=49%, HitCoverage=98%, E-value=2e-90, Identity=50%"; Hit description =Probable magnesium and cobalt transport transmembrane protein
  Pfam annotation: Domain name=Acetyltransf_1; Domain location=251-318; Score=20.9; E_value=0.0047; Accession=PF00583.14; Description =Acetyltransferase (GNAT) family
  Pfam annotation: Domain name=AzlD; Domain location=105-192; Score =15.3; E_value=0.00089; Accession=PF05437.3; Description=Branched -chain amino acid transport protein (AzlD)
  Pfam annotation: Domain name=CorA; Domain location=361-649; Score =147.9; E_value=2.6e-41; Accession=PF01544.9; Description=CorA-like Mg2+ transporter protein
  Pfam module annotation: Pfam domain module=Acetyltransf _1::AzlD::CorA; Domain location=251-318::105-192::361-649
PGYFMGTSSAVWHCGERPAEAGAASGGLLGLRTGYFCHLAAHGDCRCGDWTLYSRCVGDWPGCGVSGHPDRADFPGAAPASHAHSGHPRGTAVRAGDAFCACRYAGTYAIRFAGYRLGSRMHMSERMRNMLSDAATVLLLAVAVTTALFEGTDFAGVARLTGVLFAVFLAWRRAPLILVIIGAASAVSSTGVKMTPRLAHIDETPALWRIRNLAIRHGCREVYSAEIIAAWTPDELPHAYYDAVKNNPFYVIDDAKHGVAATGFLDLQSGSVEAIFTLPACHGKGYASAIMHAIIAEARRRAFSHLTLAATPNASGFAAMIRDSEYNKDNAKMVINCVVYRHGKREEHVEIDQISEVLKEEKSFVWLGLYQPDPAFMQTLQEEFILHELAIEDALVAHQRPKIEQYGESVFIVVKTAHMEDRQRISFGETHFFLGKNFLITVRHGSVEGYKAIRAKAEKNHAMLCQGPGYALYCILDFIVDNYSKITESLSERIADLEDGMFTTRFDSVTLENVYHLRRQLLSLRNAAMPVTEICPQLVRFHEDIIPKNLRAYLRDVQDHAHHVMIDAEDMRETLASAMQVNLALVSVQQSEVNKKLAGWGAILIVPTIIFSMYGMNFSDMPELHSHFGYPAALAVTLVICLVMWWRLSKRAG

SEQ ID NO: 136747 - protein, 302 aa, Glycine max
  Coding DNA Sequence Number=SeqID_19969
  Homolog annotation: Hit_ID=Q6W139; Match level="QueryCoverage=32%, HitCoverage=23%, E-value=2e-18, Identity=59%"; Hit description =Transporter
  Pfam annotation: Domain name=BPD_transp_1; Domain location=65-283; Score=-17.7; E_value=0.053; Accession=PF00528.12; Description =Binding-protein-dependent transport s
MTLSRWVGLVLLAVLLAYAFVLPLIQHGDPLQQDLLQMLQTPNRSHLLGFDHLGRDMLTRLSAALRLSLGLAALCVISALIAGVFTGVLSALYGGWPERLLSIVGDMCLALPGLLLVLLLAAIAPDAPQMLWLGISLVLWVEFFRVTRATLRPIVQAPAGPDDDRTAAVCVGSAVAADAAGSRTVFTVDQPQSADEKGAMMKGLQITGLSVATATETLVEPVDVRLQPGQPLTLLGETGSGKSLLAQAIMGILPPSLQASGYSAAASAVGQYAGFAAAGAVAVARSDHGDSATGGGRASLRA

SEQ ID NO: 136748 - protein, 388 aa, Glycine max
  Coding DNA Sequence Number=SeqID_19970
  Gene Ontology: Mol. function=pyridoxal phosphate binding; Cellular component=cytosol; Biological process=amino acid biosynthetic process
  Homolog annotation: Hit_ID=Q12C09; Match level="QueryCoverage=97%, HitCoverage=85%, E-value=1e-139, Identity=62%"; Hit description =Aminotransferase class-III
  Pfam annotation: Domain name=Aminotran_3; Domain location=1-313; Score=265.5; E_value=1.1e-76; Accession=PF00202.11; Description =Aminotransferase class-III
MHRQIDQLAYAHTSFFTSDTVEQLAEQLTRTAPGDLNYAYFVSGGSEAVETALKLARQYFVEIGQPARTRFIARKQSYHGNTLGALAVGGNEWRRRQFAPLLIDVIRVSACNEYRDRRADETQQQYTQRLLSELEQAIIDAGPETIIGFCAETVVGATSGATPPTPGYLQGVRRLCDQYGILFIADEVMCGMGRTGTLHAFEQDGVVPDLVTIAKGLGGGYQPIGAVLASEKIVSALQAGSGLFQHGHTYICHATAAAAALAVQQVIERDHLLEAVQQQGAYLHKALRDVLGELPHVGDTRGRGLFAGVELVRDKATKTPFDPAMKLHAAIKANCMARGLLVYPMGGTLDGQYGDHILIAPPFIVTPQQLDFVVDTLNTVIREETGKL

SEQ ID NO: 136749 - protein, 191 aa, Glycine max
  Coding DNA Sequence Number=SeqID_19971
  Gene Ontology: Mol. function=alpha-glucan, water dikinase activity; Cellular component=chloroplast; Biological process=carbohydrate metabolic process
  Homolog annotation: Hit_ID=Q9STV0; Match level="QueryCoverage=92%, HitCoverage=68%, E-value=1e-50, Identity=64%"; Hit description=Alpha- glucan water dikinase 2 precursor
  Pfam annotation: Domain name=PPDK_N; Domain location=57-191; Score= -164.1; E_value=0.026; Accession=PF01326.9; Description=Pyruvate phosphate dikinase, PEPpyruvate
MCHPNILKRYEASVRFNIATELTDRCKTEGELGLIGILVWMRFMACSHLTWNKNFTIVKGLGETLVGAYPGRATTFIMKKTNLKYPVVTSYPSKLMRLYSKKSIIFRSDSNAEDLEGFAGAGLFDSVIMDKVEKVVLDYSKDPIIADKPFQTSLFSRIAKAGKILEDLYGCPQDIEGVVKDGTIFVVQARP

SEQ ID NO: 136750 - protein, 626 aa, Glycine max
  Coding DNA Sequence Number=SeqID_19972
  Homolog annotation: Hit_ID=Q6IMT1; Match level="QueryCoverage=94%, HitCoverage=19%, E-value=1e-149, Identity=74%"; Hit description=SAB
MMLGVAAFHQNLWFFPPFVRSGGIKVQGLKRELVIAQISRKAASASLRTALQKAAQLRLTEKEKNKSPSYAMRISLQINRVAWSMLVDGKSFAEAEINDMIYDFDRDYKDVGIARFTTKYFVVRNCLPNVKSDMLLSAWNPPSEWGKYFYMTTSTISQKCSSCFHHQKVVKYSFLPPHPLLSIRPWSLSQMQFGSASFQSQILQSLTRKVMLRVDARQGAPKDGNSPLELFEIEIYPLKIHLTETMYRMMWEYFFPEEEQDSQRRQEVWKVSTTAGARRVKKGSSVLEASASNSHTTKESEASSKSGISAMLFPTSSQPPAHVDSAQASKTQNVKANPGNGATPELRRTSSFDRTWEETVAESVANELVLQSFSSSKNGQFGSTEQQDEAAKNKSKDSKGVKGGRSSHEEKKVAKSHEEKRSRPRKMMEFHNIKISQVELLVTYEGQRFVVNDLKLLMDQFHRTEFTGTWRRLFSRVKKHIIWGVLKSVTGMQGRKFNRPTGAGVPEIDLILSDNEGQAGKSDQYPPSWPKRPSDGAGDGFVTSIRGLFSTQRRKAKAFVLRTMRGEAENDFQGDWSESDMDFSPFARQLTITRAKKLIRRHTKKFRSRGQKGLFVTFMLLLLLFF

SEQ ID NO: 136751 - protein, 384 aa, Glycine max
  Coding DNA Sequence Number=SeqID_19973
  Gene Ontology: Mol. function=RNA binding
  Homolog annotation: Hit_ID=Q1RT02; Match level="QueryCoverage=98%, HitCoverage=81%, E-value=2e-80, Identity=45%"; Hit description =Cyclin-like F-box
  Pfam annotation: Domain name=F-box; Domain location=16-63; Score =38.9; E_value=1.7e-08; Accession=PF00646.23; Description=F-box domain
MKRRKRSHSEGRNEEDRLSDLPECVLLHILTFLNAKHAVRTCVLSTRWKDLWKRLPTLILHSSDFWTFKGFTKFVSRLLSLRDASLALLKLDFERHGCIEPQLLKRIVKYAVSHNVRQLGISVKCDIRDVPQCVFSCQTLTSLKLSVCPRGYIYGSTLFPKSLNLTALTTLHLQHFTFCKGDDDDDDMAEPFYACRRLCDLTIDYCTVKDARILCISSATLVSLTMRSDQSGDFYKIVLSTPNLCAFAFTGAPYQQLLGSNLSSLERVSIDAEIWSTSLESPLILLSWLLELANVKSLTVSASTLQVLFLIPELLKIKLPCLGNLKSLKVELKPLSPIFSMRLKAAKSWKAALKPSPPPMPDGIVDFLLQNSPSAKVDMIDFAR

SEQ ID NO: 136752 - protein, 131 aa, Glycine max
  Coding DNA Sequence Number=SeqID_19974
  Gene Ontology: Mol. function=sequence-specific DNA binding; Cellular component=nucleus; Biological process=regulation of transcription, DNA-dependent
  Homolog annotation: Hit_ID=Q9LRH6; Match level="QueryCoverage=88%, HitCoverage=38%, E-value=2e-33, Identity=59%"; Hit description=GATA transcription factor 26
  Pfam annotation: Domain name=GATA; Domain location=48-85; Score=58.5; E_value=2.2e-14; Accession=PF00320.17; Description=GATA zinc finger
MHIPYLIFKCRMHRNKGQFTSSKNQDGTNSWGSDQESGQDAVQSETLCTHCGISSKSTPMMRRGPSGPRSLCNACGLFWANRGTLRDLSKRNQEHSLAPPEQVDEGSNNNDFDCRSGIPAQHNNLVNDNKA

SEQ ID NO: 136753 - protein, 173 aa, Glycine max
  Coding DNA Sequence Number=SeqID_19975
  Homolog annotation: Hit_ID=Q9STV0; Match level="QueryCoverage=62%, HitCoverage=8%, E-value=7e-07, Identity=29%"; Hit description=Alpha -glucan water dikinase 2 precursor
MAPSGSSNNAMASPRVLHFDLIEGMQLAGLEKKHNANRVETREKEKGKRKQNYDIALRELPSHLPKGITLTKSRNSYLTGRIKPVNDNRDQLRSGMHYSYLRKYNIEDWLQKHSEGHAKGAISTAALIENFIGGTDVLSKQIYHVHNYEIMNVDKGQEVEILVASGNMGYLEV

SEQ ID NO: 136754 - protein, 186 aa, Glycine max
  Coding DNA Sequence Number=SeqID_19976
  Gene Ontology: Mol. function=transcription regulator activity; Cellular component=intracellular; Biological process=regulation of transcription, DNA-dependent
  Homolog annotation: Hit_ID=P0ACM5; Match level="QueryCoverage=89%, HitCoverage=66%, E-value=3e-57, Identity=65%"; Hit description =Putative HTH-type transcriptional regulator yegW
  Pfam annotation: Domain name=GntR; Domain location=23-86; Score=61.8; E_value=2.2e-15; Accession=PF00392.11; Description=Bacterial regulatory proteins, gntR f
  Pfam annotation: Domain name=HTH_11; Domain location=36-83; Score= -0.4; E_value=0.1; Accession=PF08279.2; Description=HTH domain
  Pfam annotation: Domain name=UTRA; Domain location=106-185; Score= -2.3; E_value=0.0051; Accession=PF07702.3; Description=UTRA domain
  Pfam module annotation: Pfam domain module=GntR::HTH_11::UTRA; Domain location=23-86::36-83::106-185
MTDHNALLARLTTTLATESRTPLYKRFASAIKDAVRDGTLVHEEILPGEREFSQSLNISRITVRKAMDELEKEGVVFRSRGYGTQICSQFEYSLKEPKGLSQQAVLRGKTPDTVWINKSKIACSAEIAEKLGLSTGSDVYLLKRIRYVDRQAVSVEESWVPARYIADADEIGISLYDYFHRQQILP

SEQ ID NO: 136755 - protein, 465 aa, Glycine max
  Coding DNA Sequence Number=SeqID_19977
  Gene Ontology: Mol. function=N-acetyltransferase activity; Biological process=metabolic process
  Homolog annotation: Hit_ID=Q12KI7; Match level="QueryCoverage=27%, HitCoverage=87%, E-value=5e-33, Identity=55%"; Hit description=GCN5 -related N-acetyltransferase
  Pfam annotation: Domain name=Acetyltransf_1; Domain location=179-248; Score=6.1; E_value=0.35; Accession=PF00583.14; Description =Acetyltransferase (GNAT) family
  Pfam annotation: Domain name=Acetyltransf_1; Domain location=300-369; Score=55.1; E_value=2.3e-13; Accession=PF00583.14; Description =Acetyltransferase (GNAT) family
  Pfam annotation: Domain name=Glyoxalase; Domain location=16-177; Score=2.6; E_value=0.077; Accession=PF00903.15; Description =GlyoxalaseBleomycin resistance proteinDioxygenase superfamily
  Pfam module annotation: Pfam domain module=Acetyltransf _1::Acetyltransf_1::Glyoxalase; Domain location=179-248::300-369::16 -177
EAINGDRMQMKDIDVGFTHVAFMVRDLEKSMDFYRRYAGMKVIHTREPDVPAARKADDVSDTPLGKFGHLGIACASREEIDRKTAMAVAEGVLRKAPEEAGEPRYAPRPVYFNSPARRQRRTYGTDVADLYSTPGVAQADNVARYQSWEEFTWHDAEKLYAQQDALPFNSNNTWFQLAVAHQEDDRLIGDIGIHFFDEGRHAELGMTFDAGYQKQGFALEAMSAIVTLLFTQFAKHRLTAVVDTRGVVTISEVSKEEYHLLIQVWEDAVRATHHFLNEQDILRLRQLILENYFDAVVLRKVSDENHDIVGFIGVQDENIEMLFVSPAHHKKGVGARLVHYAIRYLSAKKVDVNEQNTAALGFYQHLGFQVTGRSSVDALRIAAVIPAGKRTPPLIPPQRACGVRISVCGSHLMAERPHQSHVILRVATLDDDPAQTPVSYIWCSHTVPWLTERDDVPQYQQDKET

SEQ ID NO: 136756 - protein, 479 aa, Glycine max
  Coding DNA Sequence Number=SeqID_19978
  Homolog annotation: Hit_ID=Q6IMT1; Match level="QueryCoverage=99%, HitCoverage=18%, E-value=1e-146, Identity=57%"; Hit description=SAB
MELERARSVYQEYMEENRPVTNVALFDMQNAKFVQRSGGLKDIAVCSLFSATDITVRWEPDVHLSLVELVLQLKLLVHNSKLQEHGNEHMVDVSHVQDANWKKEVTIESGHLEKPKKKESIFAVDVEMLSISAGLGDGVDAMVQVQSIFSENARIGVLLEGLMLSFNGARIFKSSRMQISRIPSVSASTSDTKGHAVTTWDWVVQGLDFHICMPYRLQLRAIDDVIEDMLRGLKLIIAAKTSLIFPVKKESSKVKKPSTVQFGCIKFCIRKLTADIEEEPIQGWLDEHYQLLKKEAAELAARLNFLDEFISKAKQGSKSTDTVSSSQERKFSFNNVEVDVKDSSTIESMREDIYKRSFRSYYQACQNLVLSEGSGACVEDFQAGFRPSTSRTSLLSISALDLDVSLKKIDGGDFGMIEVLKKLDPVCLENDIPFSRLYGSNILLNTGSLVVQLRDYSFPLFSGSSGKCEGCLVLAQQQR

SEQ ID NO: 136757 - protein, 882 aa, Glycine max
  Coding DNA Sequence Number=SeqID_19979
  Homolog annotation: Hit_ID=Q6IMT1; Match level="QueryCoverage=99%, HitCoverage=33%, E-value=0.0, Identity=65%"; Hit description=SAB
MYQDVYVGRWRKVRMLRSASGTTPPLKTYSDLPIHFQKGEVSYGVGYEPAFADISYAFTVALRRANLSVRNPGPLILPPKKERSLPWWDDMRNYIHGKISLLFSESKWNVLASTDPYEKVDKLQIVTNSMDLHQSDGRVLVSAKDFKILLSSLESLANRHGFKIPTGVSGAFLEAPVFTLEVTMDWDCESGDPMNHYLFALPVEGKPRDKVFDPFRSTSLSLWWNFSLRPFPPPSQKQSSSSITRRDIEGDATAFDPSHISHNVSPVSPTFNFGAHDLAWILKFWSLNYIPPHKLRSFSRWPRFGIPRVARSGNLSLDKVMTEFMLRLDATPACIKNMPLDDDDPARGLTFAMTKLKYELCYSRGKQKYTFESKRDILDLVYQGLDLHMIKAFLNKKECASVAKVVNMILKSSQSLSMDKVSCKKGYMTEKNCDDGFLLSSDYFTIRRQSPKADPARLLAWQEAGRRTIEMAYVRSEYDNGSETDDHMRSDPSDDEGYNVVVADDCQSVFVYGLKLLWTIGNRDAVWAWVGGLSKAFEPPKPSPSQQYAQRKLLEEKKLRDGADFHQDDVSKCPPTGKISKSPSLQQLSTPGSVSSSPNSVKVDNLPSVKKENMDGSGGTRRLMVNVIEPQFNLHSEDANGRFLLAAVSGRVLARSFHSILHVGYEMIEQVLATKDVQINEYQPEMTWKRMEFSVMLEDVQAHVAPTDVDPGAGLQWLPKILKSSPKILRTGALLERVFMPCDMYFRYTRHKGGTPELKVKPLKELKFNCDDITATMTSRQFQVMLDVLTNLLFARLPKPRKSSLSFPVEDDEDVEEEADEVVPDGVEEVELAKINLEKREREQRLLLDDIRKLSLWCDPSMDPHQEKESDLWMISGGRSLL

SEQ ID NO: 136758 - protein, 224 aa, Glycine max
  Coding DNA Sequence Number=SeqID_19980
  Homolog annotation: Hit_ID=Q6IMT1; Match level="QueryCoverage=92%, HitCoverage=7%, E-value=7e-54, Identity=51%"; Hit description=SAB
VSFNLPKLDVSFVHREHGLSVENNIMGIQLKSTKSRSTEDLGESTRLDFQLEFSEIHLLREAGSSILEILKLDLISFVYIPIQMLPLHQPISPVRAETEVKLGGTQCNIIMSRLKPWLFLHSSKKKKMVLQEEASVVARPQSTDGKTVMWTCNVSAPEMTIVLFNMAGSPVYHHDADDTWVRYSEEASLSIGKNPNLTLVRDNVKIEYISGGQSSPYELALELS

SEQ ID NO: 136759 - protein, 220 aa, Glycine max
  Coding DNA Sequence Number=SeqID_19981
  Homolog annotation: Hit_ID=Q6IMT1; Match level="QueryCoverage=85%, HitCoverage=7%, E-value=3e-54, Identity=55%"; Hit description=SAB
MTNYDYILWCNQLQPVIEVHGLSHFLVAPIIPPWFQGCSQSSHLFANNISNMGTTVHTELGELNLHLADEYQECLKESVFGVESNCGSIMHIAKVNLDWGKKDVELSEEDGPRCRLGLSIDVTGMGVYITFKLVESLVSTAISFQALLKSLSASKKKSTHSQGRLTKSSGKGTHFLKFNLERCSVHVWGETGLENTIVPDPKRVNYGSQGGRVMLNVSAD

SEQ ID NO: 136760 - protein, 247 aa, Glycine max
  Coding DNA Sequence Number=SeqID_19982
  Homolog annotation: Hit_ID=Q6IMT1; Match level="QueryCoverage=47%, HitCoverage=4%, E-value=3e-34, Identity=63%"; Hit description=SAB
GAIESVSVGEIKLSLRQSLVKLGVGFISRDPKLQVLICDLEVVMRPSNKSPGKKKTRKSRASGRGKWMIVGNIARYLSVCVTDLVLKTPKFTVEIKELNVDISKDGGSNSSGQASITALERSSAPFICEMFSVSFVVMLVEEEEVDVSQMIYKLSGMNPYSWNTMEAGHGEATNPVLLKVQEAIQNNTPMPLSDWASIPVGSTNLEELIQTFECKFLTAIDGGNIAQQWQCPTSETANQHNAVLSPV

SEQ ID NO: 136761 - protein, 90 aa, Glycine max
  Coding DNA Sequence Number=SeqID_19983
MEAFGSLAGNVKEEKVHENENVDVFAPACWAASNHTCLAAQLCPATMDTLDTALHASWVHIRVQRESDMGHAVEVPCPCFLAYEWPTTPK

SEQ ID NO: 136762 - protein, 529 aa, Glycine max
  Coding DNA Sequence Number=SeqID_19984
  Homolog annotation: Hit_ID=Q5N7Y0; Match level="QueryCoverage=44%, HitCoverage=71%, E-value=2e-40, Identity=39%"; Hit description =Leucine zipper factor-like
MNTSHNVIESSKNPKRKLTGEAAISERGKPLEHEHGSVARLHRRECDKNHGEKGRTLEKGKKVAMNVLEEEKEEGFGEKVGDVIGCNAGAGEACVGKRAPRVTVCATIYNSEPITWLRSKTKGRFFQRYMAAPHTPARPPSLASLTAIVNHGCRRSSRSCSSQSQEPGPGLKSQFVGGFGAFEGSDPREDGGDAAASAGRGGTRSIGGGGGGPGRAEAPKLAALLKEMKEGLDTVRRKIQSLTATAKGLSIEDHPVVRSVVEIRLFLEKIRPIDKKQQYQIQKLIQASENATRSDIQNKEPVASNKSEDVSKYRPNPDMLVSKVDLTLQDGNEYYQPVKFAPTSMDLERSSKYERNALRREKEILKQAKQSDYIRTLMNDMEEKPEEIRDFEGASREVDRYIAKMDERARQEEELFTRVPLTKQERKREKYLKKSRNGLQGLTESFYDEIKTLPFGDKTGEQGTNNFDFFAEETLKEEKLGFELKGGNACYLQNRPLHAVGGSNTRFNGKECKTYRVGIGAFLRVDCRF

SEQ ID NO: 136763 - protein, 283 aa, Glycine max
  Coding DNA Sequence Number=SeqID_19985
  Gene Ontology: Mol. function=protein dimerization activity; Biological process=DNA integration
  Homolog annotation: Hit_ID=Q2R1C3; Match level="QueryCoverage=98%, HitCoverage=61%, E-value=7e-55, Identity=49%"; Hit description=HAT family dimerisation domain containing protein
  Pfam annotation: Domain name=DUF659; Domain location=36-196; Score =45.0; E_value=5.3e-11; Accession=PF04937.6; Description=Protein of unknown function (DUF 659)
MFFSSRLPFHLARNPYYREAFSYATNTSNLSGHKPPSYNKLRTTLLTTERSHVENLMQPIRNSWNQKGVTIVSDGRSDPQRRPLINFMVVTESEPMFLKAVNCSGDIKDKDFIAQHMKDAIMKVGSSNVVQIVTDAVLCKTIGMIIENEFPTIYWTPYVVHTSNLALKNICAAKDSEKNNVLGSHTQIVDNANLIKKFTMGHFEIINETSQFGVANFFGGREDFHDVDSLRDRGKLDAKSWWLVHGAHALTLQKISLKLLRQPSSSSCRERNWSTYNFIHSLK

SEQ ID NO: 136764 - protein, 186 aa, Glycine max
  Coding DNA Sequence Number=SeqID_19986
MVWECLEGEAMVRRPELPGGGSSGENEWHEDSEGEGNYFHKSEFGVTVGRGSIYRERDGSVVENTCGKLSELKVTSSSSTFAVLSFVFLGGATCQLNVHVSTGPGVNSADPGVGVFIGGAATLGGFGGVVSSGGGGDCRIGGGGGGGKDKVGLVLKLGFGNVCCGGGGGEGASIPKLDPEQRAPSQ

SEQ ID NO: 136765 - protein, 170 aa, Glycine max
  Coding DNA Sequence Number=SeqID_19987
  Homolog annotation: Hit_ID=Q2QQ06; Match level="QueryCoverage=50%, HitCoverage=25%, E-value=9e-28, Identity=72%"; Hit description =Expressed protein
  Pfam annotation: Domain name=CRT-like; Domain location=35-143; Score=- 51.3; E_value=0.013; Accession=PF08627.1; Description=CRT-like
  Subcellular localization annotation: CTP_CleavageSite=30; ConfidenceScore=5.86e-01
MSFAVALCSTSSFFPSGFAIRNPKQLQPFVSMSLSSKLPLHFSGNARFNRNHPTMFKIRASNSNSSSSSKLVLFSSTIVVTTAVANRVLYKLALVPMKEYPFFLAQFITFGYVVIYFSILYFRYRARIVTDEMLAIPKLRFVAIGFLEALGLVSGMSAAAYKLSEKLEKL

SEQ ID NO: 136766 - protein, 77 aa, Glycine max
  Coding DNA Sequence Number=SeqID_19988
MVLVVFVSLRLTSVEYGQFTSGQRRHRIQWIKEFRTLLRELRIESPDRSLHDHIIEALGKLTVEQGIPYVTKKVMRN

SEQ ID NO: 136767 - protein, 100 aa, Glycine max
  Coding DNA Sequence Number=SeqID_19989
MEANAVAVVATRVVAKVNLMPPSDLNQMNHPTSDMVGKDLGSTSGPHYVQIQNKHAFTPYGLPSNYTPPNVAYTPNENVITPLQYSLRAINLNLIRHMSL

SEQ ID NO: 136768 - protein, 200 aa, Glycine max
  Coding DNA Sequence Number=SeqID_19990
  Gene Ontology: Mol. function=nucleic acid binding; Cellular component= intracellular
MAAPKVNEKLLEDLEVMGFPKARATRALHYSGSLIYHIDKLVDMKIMCTVQGNTSLEDAINWIIDHENDIDIDEMPLVDVDIDIESTESFPITEEMRMKAQSLRVQERKRKEEEEKRLEREREKGLRFLLRHKIGLGNNCHNYIICHDQERIQAGKRLLEAKRIAEENERKRNLALKKAEKEEEKRAREKVLKKLEQDKV

SEQ ID NO: 136769 - protein, 223 aa, Glycine max
  Coding DNA Sequence Number=SeqID_19991
  Homolog annotation: Hit_ID=Q1T1H9; Match level="QueryCoverage=29%, HitCoverage=28%, E-value=8e-21, Identity=75%"; Hit description=SAM (And some other nucleotide) binding motif
MWFNVDDSNGLPELGKNYSYIIIARPLLYGYRDVSVDERASDFVAKAVDLAARELIAIASPRQGLICVAFCLLLGYSKGINLELLALPDDGVPKLLLDIGCGSGIRGETISENGHHWIGLDISATMLRSRNSSWSYGWGHQYIYYSGYATPYRARSPPTYWGPVISEEICAVFPGPLAKPGTRLGADPFCNRGGWPSWLSKVAGEAINGLTPRRADTFEQIDK

SEQ ID NO: 136770 - protein, 88 aa, Glycine max
  Coding DNA Sequence Number=SeqID_19992
MESFKYNDCEMNRKGIEHLHIECPFGVGKRERVRSWTLLGSVPKEYSKKAAIKSVKLSSINKSKDGIEGRMEDSRVVRSRGEKRKAPV

SEQ ID NO: 136771 - protein, 78 aa, Glycine max
  Coding DNA Sequence Number=SeqID_19993
MKYSIETFTIHLVSKGKIINRWESACRKPIFNLAHTGIHSKRQKATQIKPCLGDAIAINSLAAKSTAFATKSEAYIDA

SEQ ID NO: 136772 - protein, 58 aa, Glycine max
  Coding DNA Sequence Number=SeqID_19994
MVSRVAGTCFPRTWSWAVDNVNTIIAPTLVGKLGLAKGYLALSNFYVAFCDDEQDPTQ

SEQ ID NO: 136773 - protein, 146 aa, Glycine max
  Coding DNA Sequence Number=SeqID_19995
  Gene Ontology: Mol. function=helicase activity
  Homolog annotation: Hit_ID=Q9ZQR0; Match level="QueryCoverage=69%, HitCoverage=8%, E-value=1e-26, Identity=51%"; Hit description =Putative helicase
MHLLLFLHPDNKYPSSTDIDKIISAEIPSHQEDPELYRLVENHMIHGPCGILQSNSPCMKEGKCSRLYPKQFQPQTLLDSNGYPVYRRRNNGHSNTENGVIIDTFLPVKLLGEYLLFQSTAESLLLRDCIFIFQISTIFFMKIMMI

SEQ ID NO: 136774 - protein, 158 aa, Glycine max
  Coding DNA Sequence Number=SeqID_19996
  Homolog annotation: Hit_ID=UPI0000E69101; Match level="QueryCoverage =82%, HitCoverage=91%, E-value=1e-15, Identity=40%"; Hit description =conserved hypothetical protein
MTLAALGATYACEWLDWAPRPALPDPHERPPVPLRYQSLAAVPVHRHPRHPHHAGLPADRCRTAPATMEPQLRRLLHILGRDYYVWDRAGAIDFLKPGRGIVRTSFRIDDALLDELRAEAASGEKVLRWFSNDVIDESGEVVAQVRKQVYLRLKPHAR

SEQ ID NO: 136775 - protein, 273 aa, Glycine max
  Coding DNA Sequence Number=SeqID_19997
  Gene Ontology: Mol. function=ATP binding; Cellular component=membrane
  Homolog annotation: Hit_ID=Q3BN41; Match level="QueryCoverage=65%, HitCoverage=40%, E-value=8e-68, Identity=78%"; Hit description=ABC transporter permease
MTIALRSGVVFRDIRDISCFRKTSVRSVGAWGAANQRGGRDSRVFPFVTVCRHAAEYATCAASRTLHARWAEASIAADFRRSVADAQSIAGKCSGFAQRRGDRQTCRAQRREQAADQADAQRPFQTRPQQFRRHMELEHHCAEVAADGGHAVAIEQQPCHRTAEQATQQRQQHRLQHHRGHHRQAPEADRAHGGDLARTRGHGRIHGVERAEHRTDRHDRADYLAEDVDQLGQPTALLAVVDTGGFHVQLQAWISGDGGLETARSRPCHRCAR

SEQ ID NO: 136776 - protein, 96 aa, Glycine max
  Coding DNA Sequence Number=SeqID_19998
  Gene Ontology: Cellular component=endoplasmic reticulum; Biological process=ER to Golgi vesicle-mediated transport
  Homolog annotation: Hit_ID=Q8VXX9; Match level="QueryCoverage=76%, HitCoverage=61%, E-value=9e-14, Identity=60%"; Hit description=Bet1 -like protein At4g14600
MESEKNMEWTSNRKIDGFHFPFQCLPIRTKAPPSTAMPPLIDPEGLSTRPVASSDEIQLHIDPGIDFDDEITGLRGQVAEEIGSEVKFQRDFLEQV

SEQ ID NO: 136777 - protein, 529 aa, Glycine max
  Coding DNA Sequence Number=SeqID_19999
  Gene Ontology: Mol. function=protein serine/threonine kinase activity; Cellular component=flagellin-based flagellum; Biological process=protein amino acid phosphorylation
  Homolog annotation: Hit_ID=Q6YXH1; Match level="QueryCoverage=81%, HitCoverage=81%, E-value=1e-113, Identity=51%"; Hit description =Putative calcium-dependent protein kinase
  Pfam annotation: Domain name=APH; Domain location=111-288; Score=0.0; E_value=0.0055; Accession=PF01636.13; Description=Phosphotransferase enzyme family
  Pfam annotation: Domain name=Kdo; Domain location=102-275; Score= -78.9; E_value=0.022; Accession=PF06293.4; Description=Lipopolysacchar ide kinase (Kdo)
  Pfam annotation: Domain name=Pkinase; Domain location=109-415; Score =258.1; E_value=1.9e-74; Accession=PF00069.15; Description=Protein kinase domain
  Pfam annotation: Domain name=Pkinase_Tyr; Domain location=109-413; Score=-1.1; E_value=2.1e-12; Accession=PF07714.7; Description =Protein tyrosine kinase
  Pfam annotation: Domain name=RIO1; Domain location=122-268; Score= -87.9; E_value=0.017; Accession=PF01163.12; Description=RIO1 family
  Pfam module annotation: Pfam domain module=APH::Kdo::Pkinase::Pkinase_ Tyr::RIO1; Domain location=111-288::102-275::109-415::109-413::122-268
MRKKRKGSKTDGSADLAVILAPNHGSASSNLKSHYSLEDCCRLKKRCCKEEDADTEPATSFTRRLAGIATAPPCGTSSLITPGRGLKRKIGCIDVATQMGRKKKIEDDYVSGETIGQGKFGSVWLCRSKVSGAEYACKTLKKGEETVHREVEIMQHLSGHSGVVTLQAVYEEAECFHLVMELCSGGRLIDGMVKDGLYSEQRVANVLKEVMLVIKYCHDMGVVHRDIKPENILLTASGKIKLADFGLAMRISEDLAQIVSHEVDEVGAKSLSRRRESSGVVGLCREEDDRGENGTALIGAVQMRICFCVKVSKNLTGLAGSPAYVAPEVLLGRYSEKVDIWSAGVLLHALLVGSLPFQGDSLEAVFEAIKTVKLDFQNGMWKSISKPAQDLIGRMLTRDISARISAEEVLRHPWILFYTANTLKMLPIKTKLKNQIGATCQQLVAVREPRLGGNRIDNYSLSEGSSSESCYSDDQDECVLIDVLASAISHVRISEPKRSRADTTYTTILTILAGIIEFTFLSTLHSGQK

SEQ ID NO: 136778 - protein, 88 aa, Glycine max
  Coding DNA Sequence Number=SeqID_20000
  Homolog annotation: Hit_ID=Q9AX74; Match level="QueryCoverage=53%, HitCoverage=16%, E-value=2e-11, Identity=62%"; Hit description =Putative integral membrane Yip1 family protein
MISAFEGGLGQCMSVVTLEIFRWMVVGVVGFMLATFVALNLREHIMSRGQRWVYIVASIFLLQLVVVVALKVKCDYQIKLSFNSLMAI

SEQ ID NO: 136779 - protein, 142 aa, Glycine max
  Coding DNA Sequence Number=SeqID_20001
MMFMNNWSTSLGYGSLYGFLEPQSIHNAKDMHQECQYYIETWVKESQRQMAHWQLLVLCPEDNIVVWLCSLRKKPDVNIKATVNIAMKTLTATLEGKPDQPVPRWVEPKWFSYGTTLDSVAMTTLHKKWATYFLQVKNMKFR

SEQ ID NO: 136780 - protein, 55 aa, Glycine max
  Coding DNA Sequence Number=SeqID_20002
MRCNNWTQPWPMGSKIYPEVHENPRAFFSSSSPILLEPIAHGSSGWSLPREDCII

SEQ ID NO: 136781 - protein, 133 aa, Glycine max
  Coding DNA Sequence Number=SeqID_20003
  Gene Ontology: Mol. function=transferase activity
  Homolog annotation: Hit_ID=Q9FT21; Match level="QueryCoverage=98%, HitCoverage=94%, E-value=7e-14, Identity=57%"; Hit description =Putative glutathione S-transferase T3
FWGSPFVLRVKWVLELKGIQYQYVEDLGNKSAMLLQYNPVHKKLPALVHDAVMATFSKGGEEQKKAAQEARENLILLLEIVGVNLINEELMAKLDAWFDNFLELPVINECMSPRDKLLNHNKAFHKLLTSSST

SEQ ID NO: 136782 - protein, 108 aa, Glycine max
  Coding DNA Sequence Number=SeqID_20004
MSVYWENWKEKKLVMIWFFDEDDDLNWLDVAEATGAGEPLKNTRSQTQINKAAAAPAPTNEKGKKVMEMEEENEDEGEEEYNSNASESDGFQEDNDLNLEEDEDSDSN

SEQ ID NO: 136783 - protein, 172 aa, Glycine max
  Coding DNA Sequence Number=SeqID_20005
  Gene Ontology: Mol. function=structural constituent of ribosome; Cellular component=intracellular; Biological process=translation
MDPKIDFYMLLDKVIDEELEDNTDKELIWLILQNQQQNREEGQDRLSNNYFSPNSIYTDTQSQKRFHMQMHLFLQVVEALNNHDEYSQMMVNATRRNDLSPLQKCTAAICILTYGSPTDSVDEYIWIAETTIMECLQIFVLGICAIFGDEYLRRPNDEDTRRLLQMGVTCDF

SEQ ID NO: 136784 - protein, 99 aa, Glycine max
  Coding DNA Sequence Number=SeqID_20006
MAILPLPQPSVGLYKLHLILLYYDESVIERTRALVEAATNDHVQTLVDYLIPKPWIFFINGLICFLKFDGSGMEKEKDDWRRHFKEKMSLEEAHHHRKP

SEQ ID NO: 136785 - protein, 116 aa, Glycine max
  Coding DNA Sequence Number=SeqID_20007
  Subcellular localization annotation: CTP_CleavageSite=36; ConfidenceScore=5.49e-01
MDSSGSHSDTSRGSFDATQICNPPTTIKRSNGGTVVVSIAKTMTWRNCGGRKVERASVQPRFITYPSHDHDGKAEWCRHREVLRWNEGGADFDATDIYNKSESQPRRQGKVVVAPW

SEQ ID NO: 136786 - protein, 429 aa, Glycine max
  Coding DNA Sequence Number=SeqID_20008
  Gene Ontology: Mol. function=phospholipid binding; Cellular component= coated pit; Biological process=endocytosis
  Homolog annotation: Hit_ID=Q7X9S1; Match level="QueryCoverage=54%, HitCoverage=66%, E-value=4e-43, Identity=43%"; Hit description=Fiber protein Fb19
  Pfam annotation: Domain name=ANTH; Domain location=31-280; Score= -50.9; E_value=4.7e-05; Accession=PF07651.6; Description=ANTH domain
  Pfam annotation: Domain name=ENTH; Domain location=31-161; Score= -30.0; E_value=0.013; Accession=PF01417.11; Description=ENTH domain
  Pfam module annotation: Pfam domain module=ANTH::ENTH; Domain location=31-280::31-161
  Subcellular localization annotation: CTP_CleavageSite=56; ConfidenceScore=5.24e-01
MAQQKRLRGLAQNLKDKASVIAAALSTKRHLSSVRVHVLRATTHALAAPPSEETISAVLAVGHGGSHRHPRACIDTLMDRLHTTRSATVALKCLYTLHNVVVKGPFVLKDQLSCYPSYGGHNFLNLSTFRDVSDLESLELSSWVRWYAAVLEQTLTVSRILGYYLNDSCESQEKKKTLVVSNASNADLLYKLEVLVGFVEQISHVPDSLHLQRNELVYEVVRLVGENYRSVQGEIFLRVEELGERIMEDFDVGELNELVGYLGRLEESREKLLLLFVNRRKNNGFWELVEKTKGKGVAKKKEIEGKWLAVVVSGNAAELTRSTNPFLDPGQQLSPVPRLSFATEEIGVFLLRRNCYPRFNRNNSVRLRTSSQRSSLPSNPKSNRPPHAAPVNVFAWRIYTMKNIISLHSLLHARRHRHCPWIYWPCQHH

SEQ ID NO: 136787 - protein, 57 aa, Glycine max
  Coding DNA Sequence Number=SeqID_20009
MGWVTSKKPKVMEMRRGQEMEVAGEGVGDDGDGEHGEAALTVSEDALLGLVENNAML

SEQ ID NO: 136788 - protein, 197 aa, Glycine max
  Coding DNA Sequence Number=SeqID_20010
  Subcellular localization annotation: CTP_CleavageSite=28; ConfidenceScore=5.26e-01
MSPSYSSPPPPPPTHYPYYSPPPPPPPDCNMTKPKLPPPPPPPPPPNCNMSQPLPPIPYKYNCSCPPNTTYNPAPPPNTTYNPAPPPYTIIKYEYNNKAIIAVSVSLGGFLVAFLLLAVFFLARPKPKPQPQPQPEPEPEPCDDQDPPQPPPTHQYAPVDQQPPPTVTTSYQVIEIQEAADVAAASYHDHGGHHNYG

SEQ ID NO: 136789 - protein, 171 aa, Glycine max
  Coding DNA Sequence Number=SeqID_20011
  Gene Ontology: Mol. function=drug transporter activity; Cellular component=membrane; Biological process=multidrug transport
  Homolog annotation: Hit_ID=Q9FR32; Match level="QueryCoverage=95%, HitCoverage=40%, E-value=1e-34, Identity=46%"; Hit description =Ripening regulated protein DDTFR18
MASALETLCGQAYCAGHHRMLGVYLQRSWVVPVFHSDVAGVHFCHARVEVNRETHCGGGTGGFSGALVDPFHLSFPFQFTLQRFLQCQLKTGIIAWVSGWLLMRNGIVGTALSIGFSWWLSVLGMLGYPLFGGCPRSWTGFSAEAFIGLWEFFKPSLASGVMLALVFFLPL

SEQ ID NO: 136790 - protein, 126 aa, Glycine max
  Coding DNA Sequence Number=SeqID_20012
  Homolog annotation: Hit_ID=UPI000044A741; Match level="QueryCoverage =58%, HitCoverage=18%, E-value=1e-09, Identity=53%"; Hit description =PREDICTED: similar to Ac1147, partial
RLSGYSVTNETQPANSYVEIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 136791 - protein, 287 aa, Glycine max
  Coding DNA Sequence Number=SeqID_20013
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=99%, HitCoverage=84%, E-value=1e-155, Identity=95%"; Hit description =Photosystem II D2 protein (Photosystem Q(A) protein)
  Pfam annotation: Domain name=Photo_RC; Domain location=29-286; Score =321.2; E_value=1.8e-93; Accession=PF00124.9; Description =Photosynthetic reaction centre protei
MTIALGKFTKDENDLFDIMDDWLRRDRFVFVGWSGLLLFPCAYFALGGWFTGTTFVTSWYTHGLASSYLEGCNFLTAAVSTPANSLAHSLLLLWGPEAQGDFTRWCQLGGLWTFVALHGAFALIGFMLRQFELARSVQLRPYNAIAFSGPIAVFVSVFLIYPLGQSGWFFAPSFGVAAIFRFILFFQGFHNWTLNPFHMMGVAGVLGAALLCAIHGATVENTLFEDGDGANTFRAFNPTQAEETYSMVTANRFWSQIFGVAFSNKRCNWFMDECSWGSRFGPEPTCL

SEQ ID NO: 136792 - protein, 285 aa, Glycine max
  Coding DNA Sequence Number=SeqID_20014
  Homolog annotation: Hit_ID=Q1SJY4; Match level="QueryCoverage=27%, HitCoverage=16%, E-value=4e-08, Identity=36%"; Hit description=Zinc finger, CCHC-type
EIWDSLSINYEGTEDVRLRIVITLTKHYGSFTMKDREYVDDMFGRLRVLLNNMEALGDMYTKAQVNMKVLENFPKKPRHMKLKGPQLKKRRYSQDKKNKIIMITWDDSYNENSCISNYEQANICLMVDTDNKAKTNVNFYDKYEHSKVRCIQKKKQMSKGTNNVGPKKIWVPKSQIVLVGDILGRKKEGDIGKGEISGLGKIGIPSVVSIDNVLYVKGDQVPKEVVLEVVKDASEAKQHQVKIAERVETTLETSCEIFYTTFAKREAELEPAMMYEQIVEEEKSS

SEQ ID NO: 136793 - protein, 135 aa, Glycine max
  Coding DNA Sequence Number=SeqID_20015
  Gene Ontology: Mol. function=carbon-sulfur lyase activity; Cellular component=vacuole
  Homolog annotation: Hit_ID=Q9FE98; Match level="QueryCoverage=47%, HitCoverage=14%, E-value=1e-12, Identity=47%"; Hit description =Alliinase, putative; 28821-30567
  Pfam annotation: Domain name=EGF_alliinase; Domain location=59-116; Score=117.0; E_value=5.2e-32; Accession=PF04863.4; Description =Alliinase EGF-like domain
MATSLQKSRSATKKLLEDFTKKRRLESPKEQVQSPMKLKFIIVLCASISTFVCMGEWEPTWSTRAAEEAEAVAAIPCSGHGRAYLDGLILKDMNKSRCECNSCYAGSDCSQFLSDCPANADGEVDIILFNGSHRD

SEQ ID NO: 136794 - protein, 103 aa, Glycine max
  Coding DNA Sequence Number=SeqID_20016
  Gene Ontology: Mol. function=carbon-sulfur lyase activity; Cellular component=vacuole
  Homolog annotation: Hit_ID=Q76BK3; Match level="QueryCoverage=94%, HitCoverage=21%, E-value=4e-26, Identity=54%"; Hit description =Alliinase-like
  Pfam annotation: Domain name=Alliinase_C; Domain location=1-103; Score=-171.6; E_value=4.9e-05; Accession=PF04864.4; Description =Allinase, C-terminal domain
GDPYFMEPFWMQHAASSAILVSGWHRMSYSYSDGSVISQLLVEYIKKVHGIVGNAITEGKYIVFGSGSTQLLNAAVYALSPDPSMSPAKVVATAPYYPVSSIN

SEQ ID NO: 136795 - protein, 147 aa, Glycine max
  Coding DNA Sequence Number=SeqID_20017
MSSSMICLTSVSTTIPVNGIIYLKTAKPKKKKALCEEWCNCVPNSVHSKTNKLNQNVKNTYTHDGITSSQCKEAIANSNLGELVTGDGGKAEDRWVGEKRVVVAEKIAKEEKGGGVDMVEMKEGCVMRDFHDLHTVVHFKRVFAGSL

SEQ ID NO: 136796 - protein, 251 aa, Glycine max
  Coding DNA Sequence Number=SeqID_20018
  Gene Ontology: Mol. function=carbon-sulfur lyase activity; Cellular component=vacuole
  Homolog annotation: Hit_ID=Q9FE98; Match level="QueryCoverage=96%, HitCoverage=53%, E-value=3e-76, Identity=55%"; Hit description =Alliinase, putative; 28821-30567
  Pfam annotation: Domain name=Alliinase_C; Domain location=1-240; Score=302.1; E_value=1.1e-87; Accession=PF04864.4; Description =Allinase, C-terminal domain
DFSYEGDTSLWKNNTNSSFRFIEFVTSPNNPDGKLNKGILKGSDVKTIYDRAYYWPHFTAIPSPADDDLMLFSISKLTGHAGSRFGWAIIKDEAVYQKMMIYLRLSAMGVSRDVQLRVLKLLDVATEGDGKEIFQFTYSTMRDRWIRLKQIIYKSKRFSLQKLSPQYCTFFKRVRDPSPAYAWLKCERQQDMNCYETLKAAGIIGRKGSNFSADERYVRLSLIKSQDDFEILTNKLRSLVAKEWESNPASI

SEQ ID NO: 136797 - protein, 56 aa, Glycine max
  Coding DNA Sequence Number=SeqID_20019
MGRNKVGPFDPRCNADFIAAAIYNNCWIERSKSILLQGFGEVAMVGEWVATTTMWS

SEQ ID NO: 136798 - protein, 122 aa, Glycine max
  Coding DNA Sequence Number=SeqID_20020
MEDDEKTPLVGEIEEVDASPVEEEGTSEREKRVRTKVPEAEIHLYRQGKGPVAVFKSALGGWEQDQLEIREDILEKYGMKSVFAFNPTAGGRGVPVRFNPRNGRSILTYRDGAVVLSYLILV

SEQ ID NO: 136799 - protein, 242 aa, Glycine max
  Coding DNA Sequence Number=SeqID_20021
  Gene Ontology: Mol. function=GPI anchor binding; Cellular component =anchored to membrane; Biological process=cell adhesion
  Homolog annotation: Hit_ID=Q2PGX7; Match level="QueryCoverage=72%, HitCoverage=49%, E-value=2e-45, Identity=50%"; Hit description =Putative fasciclin-like arabinogalactan protein
MVWRLQSPFLLLHFAVIDLQEANDSIDKEDPRPTSCTRSYINFDAKKLYQITNGTALATTTYQATGNAHGSAGFVNIIDLHEKKVKFDIENNVGTLSSTFVKSVEEILYNISVIQISKVLPSTVIEAPAPIPTQQNLTNIMSKHECKVSADALSSQPNMLNTFNDNLDGGLTIFFPLDNAFKAFLPKFENLTKSSKNTLVTDGTNKNDFTVQNDNEDVTLKMKLTTLKITDTLIDKQPPVML

SEQ ID NO: 136800 - protein, 462 aa, Glycine max
  Coding DNA Sequence Number=SeqID_20022
  Gene Ontology: Mol. function=protein serine/threonine kinase activity; Cellular component=mitochondrion; Biological process =protein amino acid phosphorylation
  Homolog annotation: Hit_ID=Q1RSC2; Match level="QueryCoverage=99%, HitCoverage=92%, E-value=1e-168, Identity=42%"; Hit description =Pentatricopeptide repeat
  Pfam annotation: Domain name=PPR; Domain location=11-45; Score=27.9; E_value=3.6e-05; Accession=PF01535.11; Description=PPR repeat
  Pfam annotation: Domain name=PPR; Domain location=116-150; Score =46.9; E_value=7e-11; Accession=PF01535.11; Description=PPR repeat
  Pfam annotation: Domain name=PPR; Domain location=151-185; Score =43.3; E_value=8.4e-10; Accession=PF01535.11; Description=PPR repeat
  Pfam annotation: Domain name=PPR; Domain location=186-220; Score =46.6; E_value=8.1e-11; Accession=PF01535.11; Description=PPR repeat
  Pfam annotation: Domain name=PPR; Domain location=221-255; Score =40.1; E_value=7.5e-09; Accession=PF01535.11; Description=PPR repeat
  Pfam annotation: Domain name=PPR; Domain location=256-290; Score =44.6; E_value=3.3e-10; Accession=PF01535.11; Description=PPR repeat
  Pfam annotation: Domain name=PPR; Domain location=291-325; Score =46.8; E_value=7.4e-11; Accession=PF01535.11; Description=PPR repeat
  Pfam annotation: Domain name=PPR; Domain location=326-360; Score =41.0; E_value=4.2e-09; Accession=PF01535.11; Description=PPR repeat
  Pfam annotation: Domain name=PPR; Domain location=361-395; Score =39.6; E_value=1.1e-08; Accession=PF01535.11; Description=PPR repeat
  Pfam annotation: Domain name=PPR; Domain location=396-430; Score =47.4; E_value=4.9e-11; Accession=PF01535.11; Description=PPR repeat
  Pfam annotation: Domain name=PPR; Domain location=46-80; Score=21.1; E_value=0.0039; Accession=PF01535.11; Description=PPR repeat
  Pfam annotation: Domain name=PPR; Domain location=81-115; Score=32.2; E_value=1.8e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=11-45::116-150::151 -185::186-220::221-255::256-290::291-325::326-360::361-395::396 -430::46-80::81-115
MEVKGIKPNLVTLSILINCFCHLGQMAFSFSVLGKILKLGYQPDTITLNTLLRGLCLKGEVKKSLHFHDKVVAQGFQMNQVSYGTLLDGLCKIGETRCAIKLLRMIEDRSTRPDVVMYNIIIDGLCKDKLVDEACDFYSEMNARGIFPNVITYNTLICGFCLAGQLMGAFILLNEMILKNINPDVYTYNTLIDALCKEGKVKETKKLLAVMTKEGVKPDVVSYNTLMDGYCLIGEVHNAKQIFHTLIQRGVNPDVYSYSTMINGLCKCKMVDEAMNLLRGMLHKNMVPNTVTYNSLIDGLCKSGRITSALDLMKEMHHKGQPADVVTYNSLLDGLRKSQNLDKATALFMKMKKWGIQPNKYTYTALIDGLCKGGRLKNAQKLFQHLLVKGCCIDVWTYNVMISGLCKEDMFDEALAMKSKMEDNGCIPNAVTFDIIIRSLFEKDENDKAEKLLHEMIAKGLL

SEQ ID NO: 136801 - protein, 92 aa, Glycine max
  Coding DNA Sequence Number=SeqID_20023
  Gene Ontology: Mol. function=carbon-sulfur lyase activity; Cellular component=vacuole
  Homolog annotation: Hit_ID=Q9FE98; Match level="QueryCoverage=67%, HitCoverage=13%, E-value=5e-13, Identity=51%"; Hit description =Alliinase, putative; 28821-30567
  Pfam annotation: Domain name=EGF_alliinase; Domain location=30-86; Score=128.2; E_value=2.3e-35; Accession=PF04863.4; Description =Alliinase EGF-like domain
MAATMQNIDFVHGREIAQQKELPKRGEWEPTWSSRAAEEAEAVAAIPCSGHGRVYLDGLILKGHEPVCECNPCYGGSDCSKLLSDCAANAAG

SEQ ID NO: 136802 - protein, 84 aa, Glycine max
  Coding DNA Sequence Number=SeqID_20024
MDDPSSPKKTSLFSSFPSLLFTYSTQVDLRAKCERKIEREVRFESWWWRLAMWWPMARLVVTLEKREQEETTMKARACGKSSLL

SEQ ID NO: 136803 - protein, 237 aa, Glycine max
  Coding DNA Sequence Number=SeqID_20025
  Gene Ontology: Mol. function=isomerase activity; Cellular component =cytoplasm; Biological process=negative regulation of transcription
  Homolog annotation: Hit_ID=Q10PT6; Match level="QueryCoverage=98%, HitCoverage=81%, E-value=6e-70, Identity=50%"; Hit description=MA3 domain-containing protein, putative, expressed
  Pfam annotation: Domain name=MA3; Domain location=35-146; Score =122.8; E_value=9.4e-34; Accession=PF02847.7; Description=MA3 domain
MSKAASEGWLCVSSLKSLSEEPEKNTIEDGAAKSFKVKTQSIIQEYFLSGDILEVNSCLEQANSKNCAALNAIFVKKLITLAMDRKNREKEMASVLLSSLCFPADDVVSGFVMLIESADDTALDNPVVVEDLAMFLARAVVDEVLAPQHLEEIGTQCLGPGSVGSKVLRMTKSLLKARLAGERILRCWGGGGSSRSGWAFEDVKDMIGKLLEEYESGGEIREACRCMKELGMPFFHH

SEQ ID NO: 136804 - protein, 265 aa, Glycine max
  Coding DNA Sequence Number=SeqID_20026
  Gene Ontology: Mol. function=isomerase activity; Cellular component =cytoplasm; Biological process=negative regulation of transcription
  Homolog annotation: Hit_ID=Q6YPF2; Match level="QueryCoverage=98%, HitCoverage=98%, E-value=8e-47, Identity=37%"; Hit description =Putative MA3 domain-containing protein
  Pfam annotation: Domain name=MA3; Domain location=135-246; Score =137.8; E_value=3e-38; Accession=PF02847.7; Description=MA3 domain
  Subcellular localization annotation: CTP_CleavageSite=74; ConfidenceScore=5.00e-01
MDFGEGYVSNEHRELHQSATESADPLSVSPLQLSPKSSRSPNSPRSPKSPRTPQSPRSPTGQGKCSNLSPRNHRQSYFQKDGRPKKGGSGGKGTWGGLLDTDDTNVLDPNDPNYDSSEEFDHSNEKKPTTDLENYKKKATIIVEEYFSTDGVIATMNEVKELGKPQYGYYFVKKLVSMSMDRHDKEKEMAAILLSALYSDVVDPSQVYKGFSKLVESADDLIVDIPDTVEILALFIARAVVDDILPPAFLKKQMAYLPKDSKGVE

SEQ ID NO: 136805 - protein, 1193 aa, Glycine max
  Coding DNA Sequence Number=SeqID_20027
  Gene Ontology: Mol. function=transmembrane receptor activity; Cellular component=membrane; Biological process=defense response
  Homolog annotation: Hit_ID=Q1S494; Match level="QueryCoverage=96%, HitCoverage=69%, E-value=1e-179, Identity=43%"; Hit description=TIR
  Pfam annotation: Domain name=LRR_1; Domain location=559-584; Score =9.2; E_value=5.4; Accession=PF00560.23; Description=Leucine Rich Repeat
  Pfam annotation: Domain name=LRR_1; Domain location=637-659; Score =0.2; E_value=2.6e+02; Accession=PF00560.23; Description=Leucine Rich Repeat
  Pfam annotation: Domain name=LRR_1; Domain location=661-682; Score =0.4; E_value=2.4e+02; Accession=PF00560.23; Description=Leucine Rich Repeat
  Pfam annotation: Domain name=LRR_1; Domain location=684-706; Score =9.8; E_value=4.3; Accession=PF00560.23; Description=Leucine Rich Repeat
  Pfam annotation: Domain name=LRR_1; Domain location=708-729; Score =8.2; E_value=8.4; Accession=PF00560.23; Description=Leucine Rich Repeat
  Pfam annotation: Domain name=LRR_1; Domain location=731-753; Score =7.2; E_value=13; Accession=PF00560.23; Description=Leucine Rich Repeat
  Pfam annotation: Domain name=NACHT; Domain location=213-367; Score= -19.6; E_value=0.0019; Accession=PF05729.3; Description=NACHT domain
  Pfam annotation: Domain name=NB-ARC; Domain location=177-469; Score =134.6; E_value=2.6e-37; Accession=PF00931.13; Description=NB-ARC domain
  Pfam annotation: Domain name=TIR; Domain location=17-151; Score =154.1; E_value=3.6e-43; Accession=PF01582.10; Description=TIR domain
  Pfam module annotation: Pfam domain module=LRR_1::LRR_1::LRR_1::LRR _1::LRR_1::LRR_1::NACHT::NB-ARC::TIR; Domain location=559-584::637 -659::661-682::684-706::708-729::731-753::213-367::177-469::17-151
AEPSSSSFADKWNFYDVFLSFRGKDTRQNFTGHLYNSLFKNGILTFIDDKGLRRGEEITPALLNAIKNSRIAIIVFSEDYASSTYCLDELVTILESFKEEEGRSIYPIFYYVDPSQVRHQTGTYSDALAKHEERFQYDIDKVQQWRQALYQAANLSGWHFHGSQPEYKFILKIVKEISEKIDCVPLHVADKPIGLEYAVLAVKSLFGLESDVSMIGIYGIGGIGKTTIARAVYNMSFSKFEGICFLPDIREKAINKHGLVELQEMLLSETLKEKDIKVGHVNKGIQIIKQRLQQKKVLLILDDVDKLEQLKVLAGQYDWFGSGSIIIITTRDKHLLATHEVVKLYEVKPLNDEKSLELFDWHAFKNNKTDPSYVTISNRAVSYACGLPLALEVIGSDLFGKSLNECNSALDKYERIPHEKIHEIFKVSYDGLEENEKGIFLDIACFLNTFKVSYVTQMLHAHGFHPEDGLRVLVDKSLVKIDASGFVRMHDLIRDTGIEIVRQESTVEPGRRSRLWFKEDIVHVLEENTGTDKIEFIKLEGYNNIQVQWNGKAFQKMKNLRILIIENTTFSTGPEHLPNSLRFLDWSCYPSPSLPSDFNPKRVEILKMPESCLKIFQPHKACCKVLTHLPSLREVPLVTFLCLDYCSNLVKIDCSIGFLDKLLTLSAKGCSKLKILAHCIMLTSLEILDLGDCLCLEGFPEVLVKMEKIREICLDNTAIGTLPFSIGNLVGLELLSLEQCKRLIQLPGSIFTLPKVEVIFGFRHWRYLFFEENQDGKELSLEVFPKAILVCHLDPRHYHHLDLYYLYMSPNNVIQVCSPNLYMLCDFDLLFQKLALGVEKDWFRRCRKWSMNFSFRKKFPKIAHEWNEAEILFELKCPAPSSVEAMWAHNISMEIIDWTLIGVYNQGNIKDDIKFKMPMSTFLLPNREPPSLPDQPEVYRKIVKEVSEKIDCIPLHVADNAIGLEYSVQEVKSLLGLESDEVNMIRIYGISGIGKTTIACVVYNLIFSHFEGVWFLPDIREKTINKHGLVQLQEMLPSEILKEKYIKDNHCHHKRDKHLLATHGVINLYEHAFKNNKVDPCYVNISNREALDVHGLPLALEAIGSHGIFLDISNIFKTKEVGYVTRMLHAHDFHAEDGLRVLVDRSLIKIDASGGLFFHGCRQKNWRHRCSAIADGEKYAELEGAATGTGETC

SEQ ID NO: 136806 - protein, 69 aa, Glycine max
  Coding DNA Sequence Number=SeqID_20028
MGDQLLHYFMRLELIGGMLPQHSGTLQLSVLLAICNGKTPMSSVLLAAFMEEQTPPKKFKNRPSFVISF

SEQ ID NO: 136807 - protein, 86 aa, Glycine max
  Coding DNA Sequence Number=SeqID_20029
MNPITQSEKEGKEQDNCIQIEKGEIVEGIKKIPRTDIVPYCSQRWLVQRWLEYLATMFGNVQVERQSSGQLAWQPASMPRADRSYS

SEQ ID NO: 136808 - protein, 143 aa, Glycine max
  Coding DNA Sequence Number=SeqID_20030
  Homolog annotation: Hit_ID=Q1SB62; Match level="QueryCoverage=57%, HitCoverage=7%, E-value=7e-07, Identity=38%"; Hit description =Integrase, catalytic region; Zinc finger, CCHC-type; Peptidase aspartic, catalytic
MSRILKKIEKVTEEALKSQVNLKSVVESSQSAQSKVCNNLNNGGRGNYRGKGQGNYKGGGCGNFNQERNNNFGSFSQGRGHRNKIVMCGRNELFSSLDEMVKSIVKIWKQCKDFVSDCPIVNIPNSVCETCEIGNKHEVSFPT

SEQ ID NO: 136809 - protein, 176 aa, Glycine max
  Coding DNA Sequence Number=SeqID_20031
  Gene Ontology: Mol. function=transmembrane receptor activity; Cellular component=membrane; Biological process=defense response
  Homolog annotation: Hit_ID=Q1S472; Match level="QueryCoverage=85%, HitCoverage=14%, E-value=9e-56, Identity=67%"; Hit description=TIR domain, putative
  Pfam annotation: Domain name=TIR; Domain location=31-164; Score =182.5; E_value=1e-51; Accession=PF01582.10; Description=TIR domain
MFDFDLVGTSNHRKGSSLSSSSFSYGWTYDVFLSFRGSDTRHGFTGHLYKALCDKGINTFIDDEELQRGEEITPTLMKAIEESRIAIPIFSKNYASSRFCLDELVHIVACSKEMRRLILPVFYDVDPSHVRHQMGSYEEALNSLKDRFKDDKEKLQKWRTALRQAADLSGYHFKPG

SEQ ID NO: 136810 - protein, 69 aa, Glycine max
  Coding DNA Sequence Number=SeqID_20032
MKPETSLKIKEEVKKQFDAGFLAVARYPEWVANIVPVPKKDGKVRMCDHTSTNAPDPIRTPQLSVLGRE

SEQ ID NO: 136811 - protein, 104 aa, Glycine max
  Coding DNA Sequence Number=SeqID_20033
MLCPFEFLESFHCSISSVSIYQGPQSYSRSFLVQIQACQYDEDMTKRKGKDPLEGLGGPMTRARARKAKEALQQVLSILFEYKPKFQGEKSKAVSCIMAQMEED

SEQ ID NO: 136812 - protein, 57 aa, Glycine max
  Coding DNA Sequence Number=SeqID_20034
RFFNVFSWTPYDLSVTDLVNSKGGGGASMPATGHPNATVVSHPASAWGRSTSRWKLD

SEQ ID NO: 136813 - protein, 184 aa, Glycine max
  Coding DNA Sequence Number=SeqID_20035
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=98%, E-value=1e-14, Identity=28%"; Hit description =UPI00006A17C9 related cluster
LAFTGQHALSLEDYTSSPSEGYTSSPSQDYTSSPSEGFMPSALGGLHVLAIRGLHVLTFRGKHVLAFRGLHALAFRGLDVLAIRGLHVLSFRGLHVLTFGGLHVLSFRELHVLAFRGLHVLAFSGRHVLPDYTSSPSEDYTSSPSAGYTSSPSEGYMPSALVDFTSSPSDGYTSSPSKDYTSWP

SEQ ID NO: 136814 - protein, 76 aa, Glycine max
  Coding DNA Sequence Number=SeqID_20036
MESRQASPDKNQILYMEELSLVLNQVESIQDILPIISVILELPPESQQQLLQLPVNLVRKLISRAAARTVCFFKWL

SEQ ID NO: 136815 - protein, 76 aa, Glycine max
  Coding DNA Sequence Number=SeqID_20037
MSFGNDVEIVRMAMMTLLLPVTLVVENGISSLDLNTLQRRRRTRRKIEFHTIHFYFVQMYLLGVNTNGVVYNCEYG

SEQ ID NO: 136816 - protein, 575 aa, Glycine max
  Coding DNA Sequence Number=SeqID_20038
  Gene Ontology: Mol. function=oxidoreductase activity; Cellular component=intracellular; Biological process=lignin catabolic process
  Homolog annotation: Hit_ID=Q84J37; Match level="QueryCoverage=75%, HitCoverage=77%, E-value=1e-146, Identity=58%"; Hit description =Putative laccase (Diphenol oxidase) family protein
  Pfam annotation: Domain name=Cu-oxidase; Domain location=105-257; Score=186.3; E_value=7.2e-53; Accession=PF00394.12; Description =Multicopper oxidase
  Pfam annotation: Domain name=Cu-oxidase_2; Domain location=371-479; Score=79.3; E_value=1.2e-20; Accession=PF07731.4; Description =Multicopper oxidase
  Pfam annotation: Domain name=Cu-oxidase_3; Domain location=10-95; Score=46.7; E_value=7.7e-11; Accession=PF07732.5; Description =Multicopper oxidase
  Pfam module annotation: Pfam domain module=Cu-oxidase::Cu-oxidase _2::Cu-oxidase_3; Domain location=105-257::371-479::10-95
MDNFQGQLLEPTMVKRYMSMFTTRENTTSPCTVKQPRNPWSDGPEYITQCPIKPGGKFRQMLIFSIEEGTIWWHAHSDWARATVHGAIYIYPRKGESYPFPTPDEEVPIVLGEWWKSDVSDVYEEFLRNGGSPNESDAITINGQPGDLYPCSKSETFKLNVHYGKTYHLRMVNAAMNLVLFFAVSKHNLTVVGVDSAYSKPLTRDYICIAPGQTADVLLHANQEPNDYYMAARAYSSALGVAFNNGITTARIHYHENHAPNKSPSLPYLPLYNDTKAVFDYYVSIKGLNEADPYQVPTNITTHMLTTLSINTFPCPENQTCAGPNGTRLASSVNNISFENPTIDILEAYYYHIKGVYHKGLPKFPPLKFDFNAEYLPLELQIPKKGTKVAVIKFGSTVELVFQGTNLVTGIDHPMHLHGTSFFAVGYGFGNFDKHKDRKTYNLIDPPLMNTILVPKNGWASIRYRASNPVKSAAAKTSDDVTLLVTRGLVSSIRIYQPTNPRDEEEEEEEEEEEEEDDDDEADVENRGSEREARWCGGALWWKCILVRQRRKCGSGVARKRFRGAKEPRKKRLGM

SEQ ID NO: 136817 - protein, 555 aa, Glycine max
  Coding DNA Sequence Number=SeqID_20039
  Homolog annotation: Hit_ID=O81120; Match level="QueryCoverage=94%, HitCoverage=95%, E-value=0.0, Identity=58%"; Hit description=Nodule -specific protein Nlj70
  Pfam annotation: Domain name=MFS_1; Domain location=25-466; Score= -23.2; E_value=0.0036; Accession=PF07690.6; Description=Major Facilitator Superfamily
  Pfam annotation: Domain name=Nodulin-like; Domain location=29-274; Score=443.2; E_value=3.5e-130; Accession=PF06813.4; Description =Nodulin-like
  Pfam module annotation: Pfam domain module=MFS_1::Nodulin-like; Domain location=25-466::29-274
  Subcellular localization annotation: CTP_CleavageSite=38; ConfidenceScore=5.47e-01
MVFSAKYGRSDGNSWASIKGFSLQVLTGRWFMMFSSFMIMSVSGATYMFSLYSREIKLVLGYDQSTLNQLSFFKDLGANIGILSGLINEVTPPWASLLIGGVLNFFGYFAIWLAVTGKIAKPQVWNMCLYIFIGANSHCSTKTGAVVTSVKNFPGIRGIVLGLLSGYQGVSAAIITQLYYAFYGNDSKSLILLMAWLPTATAIVFLPVIRNHRSIQQPNDTKAFYRFLYLSLVLAGFLMIVIIAQQCFTFSPNEYNVTTTVMLLLLILPLAVVIVEEHKIWKSRQQNINREDSQMLLANYPNIATENPYQEESSHTEQTVEEKVSCWENILRPPERGEDHTILQAIFSLDMVVLLLVSICSFGSNLTMVIQGVVAEFILSKFKVPRPFMLTSLLLLSCVGHLLIAFNVPNGLYIASIVIGFCFGANWPLLYSIISELFGLKHYSTLFNVGSISSPIGSYLLSVRVAGYLYDMEARRQMEALGQKTSPGEELNCNGDECYKLAFITMTAVCLFGACLSLILVFRTIQLYRRDLYKKFNGATTDVTETTDVTETAVS

SEQ ID NO: 136818 - protein, 312 aa, Glycine max
  Coding DNA Sequence Number=SeqID_20040
  Gene Ontology: Mol. function=protein serine/threonine kinase activity; Cellular component=integral to membrane; Biological process=protein amino acid phosphorylation
  Homolog annotation: Hit_ID=Q851M7; Match level="QueryCoverage=90%, HitCoverage=33%, E-value=1e-77, Identity=50%"; Hit description =Putative receptor-like protein kinase
  Pfam annotation: Domain name=B_lectin; Domain location=71-170; Score =58.7; E_value=1.9e-14; Accession=PF01453.15; Description=D-mannose binding lectin
  Pfam annotation: Domain name=S_locus_glycop; Domain location=172-305; Score=-11.8; E_value=0.00027; Accession=PF00954.11; Description=S -locus glycoprotein family
  Pfam module annotation: Pfam domain module=B_lectin::S_locus_glycop; Domain location=71-170::172-305
  Subcellular localization annotation: CTP_CleavageSite=75; ConfidenceScore=5.64e-01
MFLKTQFLFLLTLVLATSTVTTAIDPGSTLSASSSNQTWSSPSGTFSLLFIPVQPPTTPPSFIAAIAYTGGNPVVWSAGNGAAVDSGGSLQFLRSGDLRLVNGSGSAVWDAGTAGATSATLEDSGNLVISNGTGTLWSSFDHPTDTLVPSQNFSVGKVLTSERYSFSLSSIGNLTLTWNNSIVYWNQGNSSVNASSDSPVLALSPIGLLQLSYAKLSTVALVAYSSDYDKNDGVFRVLKLDNDGNLRIYSSSLGGGTPSVRWTAVSDQCEVYAYCGNYGVCSYNDSSPVCGCPSQNFEMVDPNDSRRGCRMK

SEQ ID NO: 136819 - protein, 104 aa, Glycine max
  Coding DNA Sequence Number=SeqID_20041
MARKLGTWRVPLVLLAGHIHAGCAAMLVPLERTKLPCSSRKVEKTQKWEVPEFHNMAPDPSTSCKLPIESNWNEPLESTKVPPPTPPEWTIPTMKEGGEIGGWT

SEQ ID NO: 136820 - protein, 219 aa, Glycine max
  Coding DNA Sequence Number=SeqID_20042
  Homolog annotation: Hit_ID=Q9FNL3; Match level="QueryCoverage=71%, HitCoverage=75%, E-value=1e-25, Identity=37%"; Hit description =Arabidopsis thaliana genomic DNA, chromosome 5, P1 clone:MCL19
  Pfam annotation: Domain name=DUF679; Domain location=47-206; Score =149.7; E_value=7.5e-42; Accession=PF05078.3; Description=Protein of unknown function (DUF679)
MSNSTSTQELILPCDDQQQQQNEDDYYDLDDYDIDESYYFYVINAILSGTARLNVLLPTVTILAFSIFAPLLTDDGECNTLNRWLMGTFLTLLAVSCVFFTLTDSFRSATGRLYYGVVTFRGIWTFNGGKKKPRMPSDYRLRWSDLFYASLSLVSFLAFAGLHQDVVKCYYPALPRKVTNTLPLVVGFFVSILFVVFPSKRRGIGYPFLLQRDPFYSKT

SEQ ID NO: 136821 - protein, 486 aa, Glycine max
  Coding DNA Sequence Number=SeqID_20043
  Gene Ontology: Cellular component=mitochondrion
  Homolog annotation: Hit_ID=Q3LHL2; Match level="QueryCoverage=99%, HitCoverage=92%, E-value=1e-113, Identity=50%"; Hit description =Hypothetical protein PPS5
  Pfam annotation: Domain name=DUF292; Domain location=1-103; Score =187.3; E_value=3.8e-53; Accession=PF03398.5; Description=Eukaryotic protein of unknown function, DUF292
MRREIAKLLETGQEATARIRVEHIIREENMMAAQEIIELFCELIAVRLPIIESQRECPLDLKEAISSVCFAAPRCADLPELLQVQMLFAAKYGKEFLSAATELRPDCGVNRQLIELLSIRAPSPEKKLNLLKEIAVEHDLDWDPEASETEFFKKHEDLLNGPLRPSGSKFPLPDEKHNEEIYSTHDTPNKEQADSDSDSDTLEFPEVPKVSVQPNANVATAPEMVTHLTMEPLDVDLDSPRHSGDFSDLKQEQVEDRSTVHKDEPHTSIGKMENKQYLPFISPPSVSSGSFFARHSDSPPSFSSTKSEGNVDLQDVLAAAHAAAETAERAAAAARNMASLAQVRINELTKKKSTEHVPDSSSSENPFYAGGGNESPTIEKHFTDQIPAGNSDALNRNNVEHHLDHHASPGSHSSSFPSFDTLKEDFASSLPNDHHVLNDKSSSHQPKRLPSMDDDTYFSYPNLFTSQNSNVGSQAHSDNSRSPHDL

SEQ ID NO: 136822 - protein, 529 aa, Glycine max
  Coding DNA Sequence Number=SeqID_20044
  Gene Ontology: Mol. function=protein serine/threonine kinase activity; Cellular component=cell surface; Biological process =protein amino acid phosphorylation
  Homolog annotation: Hit_ID=Q851M7; Match level="QueryCoverage=88%, HitCoverage=54%, E-value=0.0, Identity=68%"; Hit description =Putative receptor-like protein kinase
  Pfam annotation: Domain name=PAN_2; Domain location=12-79; Score= -1.9; E_value=0.0021; Accession=PF08276.2; Description=PAN-like domain
  Pfam annotation: Domain name=Pkinase; Domain location=182-454; Score =177.4; E_value=3.6e-50; Accession=PF00069.15; Description=Protein kinase domain
  Pfam annotation: Domain name=Pkinase_Tyr; Domain location=182-454; Score=119.2; E_value=1.2e-32; Accession=PF07714.7; Description =Protein tyrosine kinase
  Pfam module annotation: Pfam domain module=PAN_2::Pkinase::Pkinase _Tyr; Domain location=12-79::182-454::182-454
RGCRRKVSLDSCQRNVTVLTLDHTVVLSYPPEAASQSFFIGLSACSTNCLSNSGACFAATSLSDGSGQCVIKSEDFVSGYHDPSLPSTSYIKVCPPLAPNPPPSIGDSVREKRSRVPAWVVVVIILGTLLGLIALEGGLWMWCCRHSTRLGVLSAQYALLEYASGAPVQFSYKELQQATKGFKEKLGAGGFGAVYRGTLVNKTVVAVKQLEGIEQGEKQFRMEVATISSTHHLNLVRLIGFCSEGRHRLLVYEFMKNGSLDDFLFLTEQHSGKLLNWEYRFNIALGTARGITYLHEECRDCIVHCDIKPENILLDENYVAKVSDFGLAKLINPKDHRHRTLTSVRGTRGYLAPEWLANLPITSKSDVYGYGMVLLEIVSGRRNFDVSEETNRKKFSIWAYEEFEKGNISGILDKRLANQEVDMEQVRRAIQASFWCIQEQPSHRPTMSRVLQMLEGVTEPERPPAPKSVMEGAVSGTSTYLSSNASAFSVGVSPPGPSSSSSFQTSAVSTFTSGRNLEKTTSSLLQSDT

SEQ ID NO: 136823 - protein, 437 aa, Glycine max
  Coding DNA Sequence Number=SeqID_20045
  Homolog annotation: Hit_ID=O22159; Match level="QueryCoverage=89%, HitCoverage=79%, E-value=1e-47, Identity=33%"; Hit description =Expressed protein
  Pfam annotation: Domain name=DUF247; Domain location=32-424; Score =355.8; E_value=7.2e-104; Accession=PF03140.6; Description=Plant protein of unknown function
MEGQTSDSLSKQQCLETTLTNELQNVEPPEMYGFDMQCIYRVPPAIRENNPKAYTPQMVSIGPFHKARDAGKEDSIFESMEDLKVKYLKAFLNRTQVPVGTFVDTLQNLEDEIRRCYAVHIKYNSDDFLKMILIDACFIIEHFLRCHTYGDWQGKDPVLLKDWMQMQIWRDLILLENQLPFFVLEQLYNIAGMNQEFPTFLQISFNCLKHVGYGTTSCPTESPKHFTDLMRTSIISSSKFVPREQKECKGIKHVYSASQLREAGLKFKVSPNENECLLDMTYSDEGVLTMPILNITDNSEVFFRNILTFEECHLSYDTNSITQYLVILNFLINTEKDVNVLVDNKIIVNWMGDANKVATMVNNLDSNLAVPRFNSHYYSLCDSLNGFYENPRNKYKAIFIHEYFNTPWKIASTVAAIVAEDLGVKREVNWGKETSVM

SEQ ID NO: 136824 - protein, 53 aa, Glycine max
  Coding DNA Sequence Number=SeqID_20046
MVGDLEGKTPLITKSRLTHVAVVGDIVHVCFYDEVVAAQSTKLLHRRSTDAPI

SEQ ID NO: 136825 - protein, 58 aa, Glycine max
  Coding DNA Sequence Number=SeqID_20047
MVGIKGGKEAQGENGRVGGKVIAGKDQRLLFRHVAYSDVTMWTLATPWLGSWLRICTM

SEQ ID NO: 136826 - protein, 47 aa, Glycine max
  Coding DNA Sequence Number=SeqID_20048
MTDLLDFSGRDRKPRDQEFGVMALSYFVTIFTATYHCMFFRLPCGLT

SEQ ID NO: 136827 - protein, 217 aa, Glycine max
  Coding DNA Sequence Number=SeqID_20049
  Gene Ontology: Cellular component=integral to membrane
  Homolog annotation: Hit_ID=Q8XCV6; Match level="QueryCoverage=60%, HitCoverage=39%, E-value=4e-48, Identity=71%"; Hit description=YlbE protein
  Pfam annotation: Domain name=DUF1116; Domain location=5-217; Score =171.8; E_value=1.7e-48; Accession=PF06545.2; Description=Protein of unknown function (DUF1116)
MYATIEQANAAVIARIREARPHWQDVDLAHRLIPQLAEGRKLLHAGPPVTWQEMSGPVRGACIGACLFEGWAQDEQQALALLEQGEIEFIPCHSVSAVGPMGGITSAHMPMVVVRNTVHGNYAYCNMNEGIGKVMRFGAYGEDVQQRLRWMRDSLAPVLKAVLATLEEGIDLTALMAQAISMGDEFHQRNIAASALLMRRLAPEISLLPRDKAELAQ

SEQ ID NO: 136828 - protein, 509 aa, Glycine max
  Coding DNA Sequence Number=SeqID_20050
  Homolog annotation: Hit_ID=Q1ZY19; Match level="QueryCoverage=77%, HitCoverage=80%, E-value=2e-41, Identity=30%"; Hit description =Fgenesh protein 60
  Pfam annotation: Domain name=DUF247; Domain location=32-424; Score =342.8; E_value=5.9e-100; Accession=PF03140.6; Description=Plant protein of unknown function
MEGQTSDSLNEQQCLETKLTNMLQNVEPPEMYGFDMQCIYRVPPDIRETNPKAYTPRIVSIGPFHKACYAGNEDSIFESMEELKVNYLKAFLNRTQIPMGTFVVTLQALEDKIRSCYAVRIKYNSDDFLKMILIDACFIIELFLRLHKYEDWQGKDPVLLKDWMQMQIGEDLRLLENQLPFFVLEQLYNLAGMNPEFPSFLQISFNCLKVVEYGATSCPTESPKHFTDLMRTCIILSSKFVLREEEECKGIKHVYNASQLREAGLKFKVSPNENECLLDMTYSDEGVLTMPILNIADDSEMFFRNILAFEHCHLSDDTCIITQYLKILDFLIDTEKDVKELIDKKIIVNWMGDPNALAAMVNSLSSNLAMPRFNPVYFSICNSLNDFYESPCNKYKAIFIHEYFNTPWKIASTVAAIVLLLLTLIQTICSLGIGPLTGKSIGGRKHLMIVFECLTRFLPYLLFCNSSSIPVHNIGAFIVCPCQIPHVSKSTLDSLEDAIQKLSSSQLVG

SEQ ID NO: 136829 - protein, 51 aa, Glycine max
  Coding DNA Sequence Number=SeqID_20051
MGKTLEQRERLRAWTNEAIRMSDDKLEMKQLSRKGGRRPMIRLAKASNSVR

SEQ ID NO: 136830 - protein, 139 aa, Glycine max
  Coding DNA Sequence Number=SeqID_20052
CSMLVEDVFRVLQDYPHSKELWMHVAMNIPSNLTCNNIIPGIDCMHGVGKQSTKLVLFLVPAINLSLSLMLMGASFLLEGCGGNVAINGELVCESDNKNIVNLLLEEHELLGRNWSFTLSSISRLDVNGVADTLARWGT

SEQ ID NO: 136831 - protein, 373 aa, Glycine max
  Coding DNA Sequence Number=SeqID_20053
  Gene Ontology: Mol. function=ATP-dependent helicase activity; Cellular component=nucleus; Biological process=rRNA processing
  Homolog annotation: Hit_ID=Q5VRY0; Match level="QueryCoverage=71%, HitCoverage=43%, E-value=4e-42, Identity=38%"; Hit description =Putative VASA
  Pfam annotation: Domain name=DEAD; Domain location=144-321; Score =52.6; E_value=1.3e-12; Accession=PF00270.19; Description=DEADDEAH box helicase
  Pfam annotation: Domain name=PABP; Domain location=311-369; Score =29.4; E_value=2.1e-06; Accession=PF00658.8; Description=Poly -adenylate binding protein, unique domain
  Pfam module annotation: Pfam domain module=DEAD::PABP; Domain location=144-321::311-369
  Subcellular localization annotation: CTP_CleavageSite=98; ConfidenceScore=5.68e-01
MRGRGRELLSLSFSLKHKPLAKSASPSSSFFRSSITFSTSSSSVAPPIKEPKTSTSSSKSQRDSLIFERFKQRKLKGSPKDSKGTPQVCSTSVPLSLNADTEMVVQKGVQNENDPTMVVGGFKELGVSEELVEVMEGIGEFEPSEIQCVAIPAVLEGKSVLLSSPSEPGRTLAFLLPLIQLLRRDRELPGSNSKHPRAIVLCATEEKAAQCFNAAKYIIHNVELKSVKDRPSPGNGESHASIGLMIGTPCEILEYIEEGSVVPAEIRYLVLDEADCILGGGLGPDIHKILRPLQDQESKSSVKRLQTILVISAIAEVLGEQSPIVKHLECDHAGNISAMSLEMEQTEVFHFTESLHALRKKVAEAMDSLLKQQ

SEQ ID NO: 136832 - protein, 177 aa, Glycine max
  Coding DNA Sequence Number=SeqID_20054
  Gene Ontology: Mol. function=DNA binding; Cellular component=Golgi stack; Biological process=protein amino acid phosphorylation
  Homolog annotation: Hit_ID=Q1SMD3; Match level="QueryCoverage=87%, HitCoverage=86%, E-value=3e-52, Identity=36%"; Hit description=TonB box, N-terminal; Tetratricopeptide-like helical
  Pfam annotation: Domain name=PPR; Domain location=123-157; Score =23.7; E_value=0.00064; Accession=PF01535.11; Description=PPR repeat
  Pfam annotation: Domain name=PPR; Domain location=17-52; Score=24.3; E_value=0.00045; Accession=PF01535.11; Description=PPR repeat
  Pfam annotation: Domain name=PPR; Domain location=53-87; Score=34.5; E_value=3.7e-07; Accession=PF01535.11; Description=PPR repeat
  Pfam annotation: Domain name=PPR; Domain location=88-122; Score=50.0; E_value=8e-12; Accession=PF01535.11; Description=PPR repeat
  Pfam module annotation: Pfam domain module=PPR::PPR::PPR::PPR; Domain location=123-157::17-52::53-87::88-122
MNLLREMLHKNMIPDTVTYSSLIDDGLCKNQNLDKAIALFMKMKERGIQPNKYTYTALIDGLCKGGRLKKGQALFQHLLVKGYCIDVWTYTVMISGLCKEGMFDEALAMKSKMEDNGCIPNAVTFEIIIRSLLEKDENDKAEKLLHEMIAKGLLPFRNFHSERSSVTNKVIVNFHSE

SEQ ID NO: 136833 - protein, 666 aa, Glycine max
  Coding DNA Sequence Number=SeqID_20055
  Gene Ontology: Mol. function=nucleic acid binding; Cellular component= nucleus; Biological process=mRNA polyadenylation
  Homolog annotation: Hit_ID=Q1STD4; Match level="QueryCoverage=89%, HitCoverage=90%, E-value=1e-177, Identity=56%"; Hit description=RNA -binding region RNP-1
  Pfam annotation: Domain name=PABP; Domain location=554-627; Score =110.7; E_value=4.2e-30; Accession=PF00658.8; Description=Poly -adenylate binding protein, unique domain
  Pfam annotation: Domain name=RRM_1; Domain location=117-187; Score =92.4; E_value=1.3e-24; Accession=PF00076.12; Description=RNA recognition motif. (a.k.a. RRM, R
  Pfam annotation: Domain name=RRM_1; Domain location=208-279; Score =97.8; E_value=3.2e-26; Accession=PF00076.12; Description=RNA recognition motif. (a.k.a. RRM, R
  Pfam annotation: Domain name=RRM_1; Domain location=30-100; Score =90.8; E_value=4.2e-24; Accession=PF00076.12; Description=RNA recognition motif. (a.k.a. RRM, R
  Pfam annotation: Domain name=RRM_1; Domain location=312-382; Score =97.8; E_value=3.2e-26; Accession=PF00076.12; Description=RNA recognition motif. (a.k.a. RRM, R
  Pfam module annotation: Pfam domain module=PABP::RRM_1::RRM_1::RRM _1::RRM_1; Domain location=554-627::117-187::208-279::30-100::312-382
MAAAMISAPAVAMRVVVPALNGVQSGNASLYVGDLERNVDEAQLFELFGQVGQVVSIRVCRDLTMRSLGYAYVNFVNPQDAANAMEHLNFTPLNGKSIRVMFSNRDPSIRKSGYANVFIKNLDISIDNKALHDTFSAFGFVLSSKVAVDNNGQSKGYGFVQFDNEESAQNAIKKLNGMLINDKKVYVGLFVRRQARAQVNESPKFTNVYVKNFSETYTDEDLKQLFSTYGPITSVVVMKDTDGKSRCFGFVNFESPDSAVAAIERLNGTAVNDDKVLYVGRAQRKAEREAELKARFERERMRKYEKLQGANLYVKNLDYSINEENLKELFSKFGTITSCKVMLEPNGHSKGYGFVAFSTPEEGNKALNEMNGKMIGRMPLYVAVAQRKEERKALLQAQFSQMQALGAITPFHGGIPGYHPGAPSLSPQQLYFGQGPNGLVPPQPTGYGFQQQLLPNIHPGVAPNFFMPYHPQRQAPPSQRRDPRRFGNLQQVHHNQMLHPNSNQGFRYMENGRNGMDPSVIPHGMGGPMMPLPFDGSGISAVHTYNQYHAGASSNTLASALASATPENQHLMLGEHLYPLVDGLTANHQQTAKVTGMLLEMDQSEVIHLMESPEDLKIKVSEAMLALREAAPGSEEVAGSEEVGGSEEVGGSEEVGDQLGSLSLNE

SEQ ID NO: 136834 - protein, 410 aa, Glycine max
  Coding DNA Sequence Number=SeqID_20056
  Gene Ontology: Mol. function=calcium ion binding; Cellular component =mitochondrion; Biological process=protein amino acid phosphorylation
  Homolog annotation: Hit_ID=Q1SMD0; Match level="QueryCoverage=91%, HitCoverage=92%, E-value=1e-123, Identity=37%"; Hit description =Tetratricopeptide-like helical
  Pfam annotation: Domain name=PPR; Domain location=101-135; Score =27.4; E_value=4.9e-05; Accession=PF01535.11; Description=PPR repeat
  Pfam annotation: Domain name=PPR; Domain location=136-170; Score =19.4; E_value=0.013; Accession=PF01535.11; Description=PPR repeat
  Pfam annotation: Domain name=PPR; Domain location=171-205; Score =29.4; E_value=1.3e-05; Accession=PF01535.11; Description=PPR repeat
  Pfam annotation: Domain name=PPR; Domain location=206-240; Score =48.2; E_value=2.8e-11; Accession=PF01535.11; Description=PPR repeat
  Pfam annotation: Domain name=PPR; Domain location=241-275; Score =45.2; E_value=2.3e-10; Accession=PF01535.11; Description=PPR repeat
  Pfam annotation: Domain name=PPR; Domain location=276-310; Score =43.8; E_value=6e-10; Accession=PF01535.11; Description=PPR repeat
  Pfam annotation: Domain name=PPR; Domain location=311-345; Score =33.6; E_value=7e-07; Accession=PF01535.11; Description=PPR repeat
  Pfam annotation: Domain name=PPR; Domain location=346-380; Score =44.0; E_value=5.1e-10; Accession=PF01535.11; Description=PPR repeat
  Pfam annotation: Domain name=PPR; Domain location=66-100; Score=5.0; E_value=1.9; Accession=PF01535.11; Description=PPR repeat
  Pfam module annotation: Pfam domain module=PPR::PPR::PPR::PPR::PPR::PP R::PPR::PPR::PPR; Domain location=101-135::136-170::171-205::206 -240::241-275::276-310::311-345::346-380::66-100
  Subcellular localization annotation: CTP_CleavageSite=46; ConfidenceScore=5.40e-01
MSFSFSLSRRLSSSLSLSIPNFPPFLPNPTFPLCFHSQPPSIDNVVDDVVSQFDDMLLLRHIPPIIEFGKILGSLVKMKHYPTVISLSKQMEAKGIVPDLVTLSILINCFCHLGQMAFSFSVLGKILKLGYQPNTIILNTLMKGLCLKGEVKKSLHFHDKVVAQGFQMDQVSYGILLNGLCKIGETRCAIKLLRTIEDRSTRPDVVMYSTIIDGLCKDKLVDEAYDLYSEMNARGIFPDVITYTTLICGFCLAGQLMEAFGLLNEMILKNINPNIYTYNTLIDTLCKEGKVKESKNLLAVMTKKGVKPDVVIYSILMEGYCLVGEVQNAKQIFLAMVQTGVNPDVYSYSIMIHGLFKSKRVDEAMNLLREMLHKNMVPNAVTYNSLIDDLCKSGRLTYALDLMEKEMHPR

SEQ ID NO: 136835 - protein, 308 aa, Glycine max
  Coding DNA Sequence Number=SeqID_20057
  Gene Ontology: Cellular component=integral to membrane; Biological process=negative regulation of apoptosis
  Homolog annotation: Hit_ID=P0AAC6; Match level="QueryCoverage=62%, HitCoverage=88%, E-value=1e-75, Identity=77%"; Hit description=Inner membrane protein yccA
  Pfam annotation: Domain name=Acylphosphatase; Domain location=2-91; Score=47.5; E_value=4.5e-11; Accession=PF00708.8; Description =Acylphosphatase
MATTGYKIWVHGRVQGVGFRYYTQAQANALGVTGYAHNLADGSVEVLAAGEAQQVESLIAWLKAGGPPSARVDKAGDFCGLFGRTFREQAKQIAAVAFLFAIFLRHGFDQHAHRRRVAVGEAQQAQQADKDVVQRDIQADGGANVVGFTALNDVAGFPQNGTGREQNKQGADRQVQRGQLQEDIGNHGHQQHHKAGHHHAAKERHVATRGQDIGGTAEEHQRGTAQRHGDNITHTGGEERAENRAEAVTKEAGKGKRGQNTRRTVRQAIGQEHQSVKAHQHQNQSRRGQGVDGAERGGDGGKRQRQAK

SEQ ID NO: 136836 - protein, 206 aa, Glycine max
  Coding DNA Sequence Number=SeqID_20058
  Gene Ontology: Mol. function=transition metal ion binding; Cellular component=chromatin; Biological process=proteolysis
MVEKQSTLDIMVYLIVHLGREIKCCGPVYLRWMYSVEQYMKILKGYTKNLHRPETSIVERYIAKKTIEFCSEYIEKANLLGFSSLAMTIEWAHESLVKEGNRKMSKNWVLKRHNKTFLDWFKDIIFADENASETLRKLADGPKRNVITWQGYDINKYSFYTKAQDEKSTIQNTGVTLRAESQHFASVHDDNPCVASIPYFGFIEEI

SEQ ID NO: 136837 - protein, 221 aa, Glycine max
  Coding DNA Sequence Number=SeqID_20059
MKVDMEALKDQVASMMEAMLSMKRIMESNTVAIAVASATVEADPTHSHATNQAHQPTPDMVGQGGEVLGSTGGPLIGYNRNAYPYGLPPNYMPPTVHMPNENANHVVPVTFEGQQPQPIGGAHEEPQEPAQGGPPPAVEGREKLDLLEKRLRAVKGFGDYPFSDMTKLCLVPDVVIPPKFKGRETANAFLPRKLGRGGGYLVYQFGSFSHPLMERLDYYHH

SEQ ID NO: 136838 - protein, 264 aa, Glycine max
  Coding DNA Sequence Number=SeqID_20060
  Gene Ontology: Mol. function=protein serine/threonine kinase activity; Cellular component=membrane; Biological process=protein amino acid phosphorylation
  Homolog annotation: Hit_ID=Q49N12; Match level="QueryCoverage=97%, HitCoverage=28%, E-value=5e-89, Identity=61%"; Hit description =Putative receptor-like protein kinase 2
  Pfam annotation: Domain name=Pkinase; Domain location=1-228; Score= -21.7; E_value=2.9e-07; Accession=PF00069.15; Description=Protein kinase domain
  Pfam annotation: Domain name=Pkinase_Tyr; Domain location=1-228; Score=-44.6; E_value=9.8e-10; Accession=PF07714.7; Description =Protein tyrosine kinase
  Pfam module annotation: Pfam domain module=Pkinase::Pkinase_Tyr; Domain location=1-228::1-228
MEVGKFIRWDIIAVKQLSSKSRQGNLEFLIELGMISALQHPCLVKLYGCCVEGDQLLLVYEYMENNSLARALFVSIFFTNEGPAEYHIKLDWPTRQKICVGIARAKLDEEDNTHISTRIAGTYGYMAPEYAMHGYLTDKADVYSFGVVALEIVSGRSNMIQPQKEEAFHLLDCAHMLKGKGNLMELVDRRLGLDFYKNEVTAKINVSLLCTNVTPSLRPTMSLVVSMLEGRSVVQEVFSESSEALDEKKLEAMQQRYQEIIEEN

SEQ ID NO: 136839 - protein, 89 aa, Glycine max
  Coding DNA Sequence Number=SeqID_20061
  Gene Ontology: Mol. function=oxidoreductase activity; Biological process=gibberellin metabolic process
  Homolog annotation: Hit_ID=Q4W8C1; Match level="QueryCoverage=90%, HitCoverage=24%, E-value=3e-27, Identity=72%"; Hit description =Gibberellin 2-oxidase
  Subcellular localization annotation: CTP_CleavageSite=67; ConfidenceScore=5.25e-01
MVMTNGRFLSVRHRAMTNSHKSRMSVAYFGGPPLDACIVAPPVMVTSKRPSLLFKPFTWAEYKKVTYSMKLGERRIDFFRKCTTQQQIE

SEQ ID NO: 136840 - protein, 117 aa, Glycine max
  Coding DNA Sequence Number=SeqID_20062
MRPNSSTSSSSAKQATPTERCNNLVEKQLWQHLQYNLEVVIGCKPKLLEPIKFLISAWIDRHIVVQLCYKCGGNGNCNCNYNYNGQVASGKVLACWFAGWLAGWLVGWLAACIFMRP

SEQ ID NO: 136841 - protein, 94 aa, Glycine max
  Coding DNA Sequence Number=SeqID_20063
MLPQLLFNEVVAPLGGGRLFSAAAAGAAVWTHTWVGAAFLLVPQKVARAWSLGHCTVGSAFGLLEGEGDGVPDGEEQTYVGAHFMRSASGAHKA

SEQ ID NO: 136842 - protein, 77 aa, Glycine max
  Coding DNA Sequence Number=SeqID_20064
  Subcellular localization annotation: CTP_CleavageSite=50; ConfidenceScore=5.15e-01
MTSLLLISIDLSVKQGTYRSSTLYKASCNVSFTVAELWISTTYISSTLARVQVVSEDVALLSAGIVVAAFVAVVISM

SEQ ID NO: 136843 - protein, 68 aa, Glycine max
  Coding DNA Sequence Number=SeqID_20065
GIWLLDPFETAGSLHLQQKVKDACILGSVDHAAYLFRIGYCQIGILDAQHVVGQLVAEVGAWKSEGRA

SEQ ID NO: 136844 - protein, 343 aa, Glycine max
  Coding DNA Sequence Number=SeqID_20066
GFSINNHVLLSTHKYRGRAVNESNIQEYVSELATKYIPSDLPQWQVIVIPTTLANTSTSEGESPEANSSPERYYILVKVHHLIIAEEDDLHVSEMLQLQDTERRAVLDMEELDQPPSHQLSHFVRQPQHIRKLVKRLVRLVVCRWQQFIYEFESLETPDGYTRVQVRDLSQLLSLALIVIVNVVLGYRHTMDMRRKMQRRFSGYRNGMGRLQTIQAILRRECEQRNLNWELATAALSHSLQPANIAKAWTKFVWRLNMNNVLLLPYHIYCELMALWDVCFRGRTNFTDTYCARLHLYVPLLLYAQLELLKICYELFKAPRNIYEVLFVQPTRELNILHKNPMR

SEQ ID NO: 136845 - protein, 104 aa, Glycine max
  Coding DNA Sequence Number=SeqID_20067
MEAIQNLSSTKKLTSCRNLPYDGSVGEKLKERLSKRKTRESRHQRLFEENTRKTKKRYADFENKGSGVVCASGRFILIANKKSFKASWLLNMEVFWWPKLAWVS

SEQ ID NO: 136846 - protein, 461 aa, Glycine max
  Coding DNA Sequence Number=SeqID_20068
  Homolog annotation: Hit_ID=Q2HSF6; Match level="QueryCoverage=14%, HitCoverage=7%, E-value=3e-11, Identity=40%"; Hit description =Glycoside hydrolase, family 1; Zinc finger, CCHC-type; Polynucleotidyl transferase, Ribonuclease H fold
MDEARPMATPIHPSTIIYKDEKGNDTLKKEYRASHVITVKRILRYFVGTTKHGLWFEKGYEFDLVGYCDVDFVDDKAVKKVVYERYIDILKIKENVNEPIYLRLVRAFFVATEVDNNNFTLKATLKGTEILILEQLLAIMLGVLVDSSRLYDDWFEMVGLRKKKIQKKFLEYKDEYLKKIPLSLPYLIINHIIKATKPMSMEDKPRDDEKRLNTRIGKSPQSKLDEVKETSENEEENEIVSFPVAKASASKKEFSEQIEKVVEEEKTILRVLRMRKKRKHPLLEKDHFKEPLDFGSFYDASEHHSEGENKDKEDHFEPQNEDSIVDKGTQKAEVQQNKDIHPSEGVEVVESHNPLSYAPAQDDLNVDIIVDVLPKLRTIDSSTEKVYEEIPHVHLPTPPTVVGSSSRSIEVKLTSMEKQQWLAKLKSSGVAGLVEVRIEVQLGNNKVLKSSSCCSSYDWEC

SEQ ID NO: 136847 - protein, 106 aa, Glycine max
  Coding DNA Sequence Number=SeqID_20069
  Gene Ontology: Mol. function=transferase activity, transferring glycosyl groups; Biological process=nucleoside metabolic process
  Homolog annotation: Hit_ID=P93394; Match level="QueryCoverage=91%, HitCoverage=33%, E-value=2e-25, Identity=63%"; Hit description =Uracil phosphoribosyltransferase
MAGNYLGGTIVAAVSLLKERGVGNKQIKVISAVSAPPALQKLSEQFPGLHVYTGIIDPEVNEKGLVFHDITIYLCNNFFFNSLTSVIWFIIPGLGDAGDRSFGTDT

SEQ ID NO: 136848 - protein, 159 aa, Glycine max
  Coding DNA Sequence Number=SeqID_20070
MCENVKGAKNVVTYNMHQQMNCTTWHLHGHYFGGGLIYKGIYHKLWDNHVSYPNFIRGLLFDGMQPLFDRFEVLGTLCHTIREVPRHAGNQKEVLLHNSVQIATRPTWAFQILPPEGGCFWRKQPGSPGRAELAWASWVIFNRSSSFVVRSSSFFGLQP

SEQ ID NO: 136849 - protein, 91 aa, Glycine max
  Coding DNA Sequence Number=SeqID_20071
MDYEPITKTQSKVMLTELDYREDIRKATWVVEDEGDPLVKKKCAENELSKSKSEIPPKSRKRDLRSLSSQIWRKRWILMKISLSTCRFQNA

SEQ ID NO: 136850 - protein, 119 aa, Glycine max
  Coding DNA Sequence Number=SeqID_20072
MAIKISLACLFRALFEAPLLMNPLSMTYITSCSKLRGICLVSGEFALCLNLDPSRYSVLWSDLFFDVNQDFLIFLAAHRKGLIISRNSSKVFGNIFEMDTKKEDPSLTPSLVDISDSQL

SEQ ID NO: 136851 - protein, 67 aa, Glycine max
  Coding DNA Sequence Number=SeqID_20073
  Homolog annotation: Hit_ID=Q9AYM4; Match level="QueryCoverage=85%, HitCoverage=7%, E-value=1e-13, Identity=70%"; Hit description=VuP5CS protein
MELLQNGHKNFVSIKPSELPLTNGAALTLLNSLSKTQYLGNIDPSRVFVTKVKRIIVKKSNSSRLSL

SEQ ID NO: 136852 - protein, 681 aa, Glycine max
  Coding DNA Sequence Number=SeqID_20074
  Gene Ontology: Mol. function=glutamate-5-semialdehyde dehydrogenase activity; Cellular component=cytoplasm; Biological process=amino acid biosynthetic process
  Homolog annotation: Hit_ID=Q9AYM4; Match level="QueryCoverage=99%, HitCoverage=92%, E-value=0.0, Identity=84%"; Hit description=VuP5CS protein
  Pfam annotation: Domain name=AA_kinase; Domain location=1-240; Score =182.1; E_value=1.4e-51; Accession=PF00696.18; Description=Amino acid kinase family
  Pfam annotation: Domain name=Aldedh; Domain location=247-637; Score= -264.2; E_value=0.00023; Accession=PF00171.12; Description=Aldehyde dehydrogenase family
  Pfam module annotation: Pfam domain module=AA_kinase::Aldedh; Domain location=1-240::247-637
VGTAVVTRSDGRLALGRIGALCEQLKELSSQGYEVILVTSGAVGLGRQRLRYRKLANSSFSDLQKPQEELDGKACAAVGQSSLMALYDTMFSQLDVTSSQLLVNDGFFRDSGFRKQLSDTVNSLLDLRVIPIFNENDAVSTRKAPYEDSSGIFWDNDSLAGLLALELKADLLVLLSDVEGLYSGPPSDPNSRLIHTYIKEKHQGEITFGDKSRLGRGGMTAKVNAAVCAAHAGIPVIITSGYATNNIIRVLQGERIGTVFHKDAHLWTNIKEVSAREMAVAAREGSRRLQILKSEERRKILLAIADALETSESMIRHENEADVADAISSLAKSVRMLADMEEPIGQILKRTELVDKLILEKISCPLGVLLVIFESRPDALVQIAALAIRSGNGLLLKGGKEARRSNAILHKVITSVMPDTVGDKLIGLVTSRDEILDLLKLDDVIDLVVPRGSNKLVSQIKESTKIPVLGHADGICHVYVDKSANIDMAKQIVRDAKTDYPAACNAMETLLVHKDLSNNGGLHELVLELQREGVKMFGGPRASGLLNIAETNTFHHEYSSLACTVEIVEDVFAAIDHINQHGRHVGAHTECIVTEDSEVAETFLSQVDSAAVFHNASTRFCDGARFGLGAEVGISTSRIHARGPVGVEGLLTNRWILRGSGHVVDGDQGINYTYKELPLKA

SEQ ID NO: 136853 - protein, 121 aa, Glycine max
  Coding DNA Sequence Number=SeqID_20075
MPFLSLIFVFPLLLPKTLSFSHNPHNLSQKNDDLGLVHRWIVVKFEYHVCNSISRNTTVGNSKIMPDLRGEPFALQPFIFPQKPKTVSVKLRSQFHKPLDFHEIWICCSKFNCSHFHRWDL

SEQ ID NO: 136854 - protein, 374 aa, Glycine max
  Coding DNA Sequence Number=SeqID_20076
  Gene Ontology: Mol. function=nucleic acid binding; Biological process= DNA integration
  Homolog annotation: Hit_ID=Q0KIN0; Match level="QueryCoverage=97%, HitCoverage=51%, E-value=7e-20, Identity=42%"; Hit description =Integrase core domain containing protein
MDVPTNNQAHWKKIEISLYSVPWFFLALNLQSQNQDFTTSYDVWTKAKKVYSNDVHHFYGVLTSLMNIKLKNMDMQTYFGKLDRLIVEYSTLMPFTIDAKTFYKQHKQFFMVVALAGLTLDLEATRNQILLNPMLFHLSIPHTFGPSSMSTGDSSAFVSHSFHCRGHGGGGEHGERSEGHGVHSHYFKNWGHVEANCRIKARELSRLVNMLGNPIAFVSQSSSLGPWILDSDAFDHMIVSIDVPFFETTLFFSSTVDDVPLEVPPIIPVPLVAPAPPLLLVYHQRIQVALATLPTNPQASPLAPNAQTLFHHHHLHLNFPLLYAKIAPDGTIDHYKARLLAKGYTQIFGLDYGDTFCPMAKITFAHLFLDMATI

SEQ ID NO: 136855 - protein, 173 aa, Glycine max
  Coding DNA Sequence Number=SeqID_20077
  Gene Ontology: Mol. function=RNA-directed DNA polymerase activity; Cellular component=intracellular; Biological process=RNA-dependent DNA replication
MFKLSKTLSGPKLIIIQVLKAFPYKDNKAVPWRYEVKVCIDGFDEKFEGIVGNVTASNYLTFTDEEMLAKGAGHNKALHISVKCMDHVLARVLVDNGSSLNVMPKTTLAKLPSDESHMKPSTMVVCAFNRSHREVIGEISLPIQIGFITFEVVFHVMEIALVTTRLVTTMSLL

SEQ ID NO: 136856 - protein, 91 aa, Glycine max
  Coding DNA Sequence Number=SeqID_20078
  Gene Ontology: Mol. function=chromatin binding; Cellular component =chromatin; Biological process=chromatin assembly or disassembly
MALYKALYERRCRTPLCWLEPRENLTLGSEVVQQTTEKVKLIQERMRIAQSRRKNNQDKRRKDLKFEVQNPGPHALTVGICRITLWDISLS

SEQ ID NO: 136857 - protein, 80 aa, Glycine max
  Coding DNA Sequence Number=SeqID_20079
MSKETWNQCGDHVRGLPQCCVGPHHHEFHVGPNESLESLNDNNNDNDVIDGEGAQHVGQQQQSISCDHPRPREVKTHSRR

SEQ ID NO: 136858 - protein, 50 aa, Glycine max
  Coding DNA Sequence Number=SeqID_20080
MAFSEGQKVAFGTYTLVEKAKYWWENTHQCLEEQERDGVPRAQAGEHDCG

SEQ ID NO: 136859 - protein, 143 aa, Glycine max
  Coding DNA Sequence Number=SeqID_20081
MSGLSSGVEYIFQVHSGHVASVGLILGLNVGIGSFSGLNDGVESAPALPTGVGLDCCCRVDYGLNCWCRVNSRLWLPVPSRLWALTAGAGSVTGFEDGILMLGNLVIETEMIVPGKYWLEEKGQGARSKKKLEASRTKKFKWE

SEQ ID NO: 136860 - protein, 517 aa, Glycine max
  Coding DNA Sequence Number=SeqID_20082
  Gene Ontology: Mol. function=RNA-directed DNA polymerase activity; Cellular component=intracellular; Biological process=RNA-dependent DNA replication
  Pfam annotation: Domain name=rve; Domain location=371-513; Score =43.1; E_value=9.3e-10; Accession=PF00665.16; Description=Integrase core domain
MAEEDREKTTFITPWGTFCYKIMPFGLKNPNAEDHVIHMQKLFERLRKFKLWLNLAKCTFGVKSDKLLGFIVSQRGIEMDPDKVHAILEMPPLARKMRFEVSWEVAGRPLIMYLTMLDGSMGCVLGQHDDSGRKEHAIYYLSKKFTGCETRYSFLERTCCALSLLKALYAKSHNLVVKGSALADYLVHQPVEDYQSMQCEFPDEGIMALFNNKDSSKGRGWIIWFNGASNIMDHEIGVILLSLEKQYILIMARICFNCTNNISKYEACILGLQLTPYQTHIKELVKQFEEITFEHIPREDNQLVDALATLSSMFALSNDEGMPLIRIQRHDQPAYCRLVEEESDGKPWKCHKCQTYADNINVLPMSLNVLSSPWPFSMWGMDVIGPIEPKASNGHHFILVAIDYFTKWVEVVSYVRVTRNVIEKFIKKELICRYGIPSKLITDNATNLNNKMMTKLFVGFKSQHHNSILYHPKMNGIVEVAKKHNKKIIQKMAAVLPIEVEIPSLRVLMEVELQEAE

SEQ ID NO: 136861 - protein, 96 aa, Glycine max
  Coding DNA Sequence Number=SeqID_20083
MSCSTHIPTQEEICSAPKAALTVIPNKKGNSLSVRCCAQRKRPNSVPKVDFHDQCIDVFHERKYLYLGACHSVWNSLVTYVDHHGMGDGSCLCMTG

SEQ ID NO: 136862 - protein, 119 aa, Glycine max
  Coding DNA Sequence Number=SeqID_20084
MDNLLCDEVWLSKSANTFEEVISDPVALKSYENEEFEEAFAVCLEKEVLCLPEPDYTKYLHSNNLIFPRCRVIQWFIKDWEYWMLELLSIACLSIAIKFNEISGLSLHEIQGYIEALIG

SEQ ID NO: 136863 - protein, 125 aa, Glycine max
  Coding DNA Sequence Number=SeqID_20085
MSISWKPPEEGKFKLNCDGVVTGDGNASCGGVSGQRPLWWVAWSRGFTSLSMESDSKVTISRLEGQCDSRHGCYQLVQAIKEHTNRGGNYSWAHILREANQVADSTFFSWRGTYFRFSCLLMFSS

SEQ ID NO: 136864 - protein, 57 aa, Glycine max
  Coding DNA Sequence Number=SeqID_20086
MQQLEGYLEESISLVVATGRRTFYGFRDMRLLGIYNRKLLAMELCKGGFTLLCFTGY

SEQ ID NO: 136865 - protein, 83 aa, Glycine max
  Coding DNA Sequence Number=SeqID_20087
MLVKNLIRRLGVHDKTNHTLVSQVTLTWLKGALKPGVFTPKAYTPKSPSGPLPPDSGPTQKTFSTHTLSMNCTKHTTPQLFSK

SEQ ID NO: 136866 - protein, 89 aa, Glycine max
  Coding DNA Sequence Number=SeqID_20088
MRGSIHEPQAHLGADQKFSPGVLGVVLRVPRSEIEGIKRGDKEEKEERRGNEAEELPNYDRNRFLHRSSFIIRLKELHRSEFLIAPEDT

SEQ ID NO: 136867 - protein, 302 aa, Glycine max
  Coding DNA Sequence Number=SeqID_20089
  Gene Ontology: Mol. function=nucleic acid binding
  Pfam annotation: Domain name=SWIM; Domain location=176-208; Score =25.2; E_value=0.00023; Accession=PF04434.8; Description=SWIM zinc finger
NAPTIWDRHRLKGALKSGVFTPKAYTPKSPSGPLPPDSGRVWFKHSKRYWVYNNFKKKFGGGTLLRSLMMGAAKATYVEARDSKIQQIKEISREAYDYTILVARDKPLLTMCDLIRKYVMRRFANLREKVDRIQGNAMPKPKMRLEFEKEKSGNWFATLAGNFHFEVAHSMSPNKFIVDLQRWSCTYNFWDVTRIPCKHAVAAINYNCPTHWPIIDDEDLQPPEYCRGPGRPKKLRRRELDEAPKQPNLEGLAQIGHIVRKCPLPTPPPPPEPELIDEPAAETQVDQYEMVNLSQNNHVAET

SEQ ID NO: 136868 - protein, 103 aa, Glycine max
  Coding DNA Sequence Number=SeqID_20090
  Gene Ontology: Mol. function=structural constituent of ribosome; Cellular component=ribonucleoprotein complex; Biological process =translation
  Homolog annotation: Hit_ID=Q2QW49; Match level="QueryCoverage=56%, HitCoverage=12%, E-value=2e-09, Identity=55%"; Hit description =Ribulose bisphosphate carboxylase large chain, putative
MFPFCRYSGEQISSGDDGVGPVAQRIRARGYEPRCRGFESLLAHNRPKKGRIFPSGGRKIMIGLADPKLWNFPGLWNKGVSRTYTEVLTAILKYRRTEQNGIR

SEQ ID NO: 136869 - protein, 81 aa, Glycine max
  Coding DNA Sequence Number=SeqID_20091
MGCWSTEEMFGSKSKSLGRGLHQLQSRPRYKTTWLSYERGTTRGKPRTYYCTRFQYHQRGGTLEGPQGMGDNAKEGQGTQR

SEQ ID NO: 136870 - protein, 447 aa, Glycine max
  Coding DNA Sequence Number=SeqID_20092
  Gene Ontology: Mol. function=fumarylacetoacetase activity; Cellular component=nucleus; Biological process=aromatic amino acid family metabolic process
  Homolog annotation: Hit_ID=Q7W190; Match level="QueryCoverage=91%, HitCoverage=90%, E-value=1e-164, Identity=69%"; Hit description =Fumarylacetoacetase
MGRACQQLCHALVAVGITTFVAIDRANPSRPIDWRLLSVLARGQHRGAALAEADARGARLLAPAAQDHGIAILQEGAALAIGQRHGLLAAFGQLQQSAGLGGRGAGQRARAQQVTGLQVAAVDAVVGHQLGHGPVGVAVAGVGDLLGGLAFGAHAAGLQRHAQLHVERAALGIGGRAEVGQGLGICGGPRERRAIGLQRLQRHDPGRDRGGEVLRQEGAQRLVFPGLDVARRPVVQDAQAEHVRIGVRQLDAFALGVAGADEDAQFKFVVQPRARAELRRLAFVGGAGLADRTRELLVHADAGGAAVVADRHPLVVRQQGGVGSELLADGGGVVHRDVEVGVVADAGGRGVFGVGLGHQQRLDRGAQRGAFTQRARQRQAQCAPVGMAQGHQRVQAIALAGGQRLGGRAFEGLGGGQRVQVDDLVADGHAGAERFLRALAAERGVGQ

SEQ ID NO: 136871 - protein, 419 aa, Glycine max
  Coding DNA Sequence Number=SeqID_20093
  Gene Ontology: Cellular component=integral to membrane; Biological process=protein secretion
  Homolog annotation: Hit_ID=Q21NQ4; Match level="QueryCoverage=31%, HitCoverage=24%, E-value=1e-10, Identity=31%"; Hit description =Hypothetical protein precursor
  Subcellular localization annotation: CTP_CleavageSite=67; ConfidenceScore=5.29e-01
ACATSLGQQRLLGLPGLASFQRAAQPVPAGEPAGRQHTGPARPTSSCSGSRRSGRGTGTDRDLHGVRSRAGVRRDRCGVHVHATGADVRIMARRMGHDRPGHTRMGTAGLQPGVLAGLGADRPVLRRCGLWPVLEPAHADGSLGCGDRPAPPARAAAAGGIDAGPAAVPGTAAGLRTGDEAPTIDPANTPAMIFGGTPVDTAGFRQAVNRAYEDPLQRPTRQVTRWKPIEQAEEEKKEDKQLRSDTNSNGERKARKDGIAWLARLAEWGLWGLLGVLLLVLLLTARLWLPWLRGSGRRKAEAAPPVVEEQVELPVVLPPDVATQAGLLWDQGRPRQALALLYRASVRTVGERSGIALPPGATEAQCLRASRRMPEASDRDLFARIVRMWQYAAYGGRLSSRADFDALADTLRQQYRWQA

SEQ ID NO: 136872 - protein, 141 aa, Glycine max
  Coding DNA Sequence Number=SeqID_20094
MGQKQVPKGSMGKQQQAQASKGRKGLAEEELSLATSHGQRLKDEHAKIVMQSYPARALDRRLQVDWARDAKEGPRLLDEDMTKSKGKDPLEGLGGPMTRARARKAKEALQQVLSILFEYKTKFQGEKSKVVSCIMAQMEED

SEQ ID NO: 136873 - protein, 72 aa, Glycine max
  Coding DNA Sequence Number=SeqID_20095
MYNSIITYIGLHCSAHWQMVIILPKENVVIWFCSLHNRPDNYLKGIINSALKGLDDTQQSKSKPLTRWIVVK

SEQ ID NO: 136874 - protein, 36 aa, Glycine max
  Coding DNA Sequence Number=SeqID_20096
MNKVMHLGNTTTNRVEYAYWALKRLIALETYDVCSS

SEQ ID NO: 136875 - protein, 180 aa, Glycine max
  Coding DNA Sequence Number=SeqID_20097
MEALKEKITTIMEVMMSIRKMMEVNAATATVASTTTERDPTYLPDFNQECRPVSDVGGQRGSTAMIAYGPHYAQVQSRSSFPPYGLPPNHTPPIVVYAPGENTSSSTPVFIENQQPQLDHTHAHVSQAMEETHAAPQDYTLTSFRVYLGYTSERRVFFGLHVLNAQGLLSLDHHYNPCIL

SEQ ID NO: 136876 - protein, 767 aa, Glycine max
  Coding DNA Sequence Number=SeqID_20098
  Gene Ontology: Mol. function=4-hydroxy-3-methylbut-2-en-1-yl diphosphate synthase activity; Biological process=terpenoid biosynthetic process
  Homolog annotation: Hit_ID=Q84XR5; Match level="QueryCoverage=98%, HitCoverage=94%, E-value=0.0, Identity=79%"; Hit description=GCPE protein
  Pfam annotation: Domain name=GcpE; Domain location=52-468; Score =154.9; E_value=2.1e-43; Accession=PF04551.5; Description=GcpE protein
MKSMKSSARKRVSIIRNSNPGQDIAELQPASPGSPLLVPRQKYCESLHKPIRRKTSTVMVGNVAIGSEHPIRIQTMTTTDTKDVAGTVEQVMRIADKGADIVRITVQGKKEADACFEIKNTLVQKNYNIPLVADIHFAPSVALRVAECFDKIRVNPGNFADRRAQFETLEYTEEDYQKELEHIEKMRPTTIDTSGSGLWFRVLILVDPWVFTPLVEKCKKYGRAMRIGTNHGSLSDRIMSYYGDSPRGMVSSSSTSYTASATHLLCIYVCPSKNCPSYKAMIGQVESAFEFARICRKLDYHNFVFSMKASNPVIMVQAYRLLVAEMYVQGWDYPLHLGVTEAGEGEDGRMKSAIGIGTLLQDGLGDTIRVSLTEPPEEEIDPCRRLANLGMRASELQKGVEPFEEKHRHYFDFQRRSGQLPVQKEGEEVDYRGALHRDGSVLMSVSLDQLKMPEVLYKSLAAKLIVGMPFKDLATVDSILLRELPPVDDADARLALKRLIDISMGVITPLTEQLTKPLPNAMVLVNLKEISTGAYKLLPQGTRLVVSVRGDEPYEELDILKGVDATMLLHDLPYTEDRISRVHAARRLFEYLSDNSLNFPVIHHIQFPNGIHRDDLVIGAGSDAGALLVDGLGDGLLLEAPDKDFEFIRNTSFNLLQGCRMRNTKTEYVSCPSCGRTLFDLQEVSAQIREKTSHLPGVSIAIMGCIVNGPGEMADADFGYVGGTPGKIDLYVGKTVVKRGIAMEHATNALIDLIKEHGRWVDPPAEE

SEQ ID NO: 136877 - protein, 326 aa, Glycine max
  Coding DNA Sequence Number=SeqID_20099
  Homolog annotation: Hit_ID=Q1SPB9; Match level="QueryCoverage=62%, HitCoverage=45%, E-value=2e-09, Identity=25%"; Hit description =Transposase
MDENQWMHGNIMFEEVDMNEQNEDEGGVNEEDVDCSDAFNTSQMMFCIELDLLIMKLDLWRSGQYRFRKKDFVRIDTGSRKCGCLFKLHRKPVVGGQGWIMKYALNQIAAKFARVHYASKNPSHCRCVMRTTHDLPYAYQGLSEPQVSITKEVEIISKRFEELDVYGKVTLKKKVNTKGAKKKPMTRHQRPTKRDPSNWEYVDALHFVQNSNSLVKRSTSSSNQEIPRRTMLMLDQFHPCIHDFIENIVDVKVDNNSGYRAIAVLLSMGEDSWSLECTHLLKELAKWSNEYINLLSGIHRFEELKRMQQFKNLMRLKKDYVDLSEE

SEQ ID NO: 136878 - protein, 389 aa, Glycine max
  Coding DNA Sequence Number=SeqID_20100
MESKAVEVEGVEGLKVTEDVVMDVIHVEDFVPKNKENVMLNINGKNGSIYGHGCLHHSHAVFAVEACQAIAERLEQLLNLRKMTKGTETYDVMQDYLRIARGVTVDRNEAATIAEDVHHVDDAADKVFQQPLEAIVDAQGVFHSFETLHVDKAVLMLVELLEVSANEAKVETHFPSVVEVITVEDYHERKPRANRWTSMKALPVSIHIRWGPIVVRHQPKRVVLQFGYVQTIPPHYPGSRLCLEDIGDRWMHFSEYLAPVGQICVVLGQCASYFMDWFYMISHPFMRSAQLGDPVKHPPVMQDDTYVKPGMPQYPVTTATMEEALVQAPSHVEQPRHAVEAFQAIAERLEQLLNLRKMAKGTETYDVMQDYLRIARGVTVDRNVYVRSQ

SEQ ID NO: 136879 - protein, 60 aa, Glycine max
  Coding DNA Sequence Number=SeqID_20101
MFIREESHVGKHAVLAILLATFAGFGVVMSGSSILLESSRWRRRWQAQQRGSSAMTQEGL

SEQ ID NO: 136880 - protein, 246 aa, Glycine max
  Coding DNA Sequence Number=SeqID_20102
  Gene Ontology: Mol. function=RNA-directed DNA polymerase activity; Biological process=RNA-dependent DNA replication
MAEKGKLDHMEERLKAIEGGGDHAFADMSELYLVPDIVIPLKFKMRAYAKDEKLLMHFFQESLTEAAVTWYTNLEPSRVHSWKDLMVAFVRLYQYNSDKALDRMQLQNMCKKEHESFKEYAQRWRDLLAQVAPPMTEKEMITMIVDTLPVFYYEKMVGYTPSRFADLVFVGERIEVGLKKGKFDHPALINEKPGANREEEKEEGTHVVTVIPTWPKFPLAQQCHYSANISPSHYPSSNQPQRPPLN

SEQ ID NO: 136881 - protein, 197 aa, Glycine max
  Coding DNA Sequence Number=SeqID_20103
  Gene Ontology: Mol. function=transcription regulator activity; Cellular component=nucleus; Biological process=regulation of transcription
  Homolog annotation: Hit_ID=Q652L2; Match level="QueryCoverage=91%, HitCoverage=20%, E-value=1e-74, Identity=71%"; Hit description =Putative HIRA
  Pfam annotation: Domain name=WD40; Domain location=133-171; Score =16.8; E_value=0.08; Accession=PF00400.22; Description=WD domain, G -beta repeat
  Pfam annotation: Domain name=WD40; Domain location=91-129; Score =41.4; E_value=3.2e-09; Accession=PF00400.22; Description=WD domain, G-beta repeat
  Pfam module annotation: Pfam domain module=WD40::WD40; Domain location=133-171::91-129
MQIFSIDVQPGGLRFATGGGDHKVRIWNMKSVCGESGDIGNDESSQRLLATLRDRFGSINCVRWAKHVHERKSGLGTTKFGSGEPPNIEYWKVALTLRGHVAYLVGLNWSPDDSTLASGSLDNTIHIWNMSNGICTAVLRGHTSLVKGVAWDPIGSFIASQFDNKTVIGVLLIEQMVTGLNQKVSYFEIYCVEDILL

SEQ ID NO: 136882 - protein, 274 aa, Glycine max
  Coding DNA Sequence Number=SeqID_20104
  Gene Ontology: Mol. function=carbonate dehydratase activity; Cellular component=extracellular region; Biological process=one-carbon compound metabolic process
  Homolog annotation: Hit_ID=Q9SL34; Match level="QueryCoverage=89%, HitCoverage=99%, E-value=3e-84, Identity=59%"; Hit description =Putative carbonic anhydrase
  Pfam annotation: Domain name=Carb_anhydrase; Domain location=37-265; Score=56.8; E_value=6.4e-15; Accession=PF00194.11; Description =Eukaryotic-type carbonic anhydrase
MLATLVLICCLFTAFLFLSLPVMSQEVEDESEFSYDEKSENGPSNWGDIHPEWSLCNNGSMQSPIDLLNERVQIVSHLGRLQMNYQPSNATIKNRGHDIKLEWVAGAGYLQINETEYVLKQCHWHSPSEHTIDGKRLDLELHMVHETPSGQSAVIGMLYKIGSPDSFLSSLTDHLKAISDTTEAERVVGVVDPRQIKIFYKQYYRYIGSLTIPPCTENVSWTIIRKIQSVSKEQVRLLRVAVHDESDTNARPLQLINNRLVKLYGRKYTIKDKH

SEQ ID NO: 136883 - protein, 396 aa, Glycine max
  Coding DNA Sequence Number=SeqID_20105
  Gene Ontology: Mol. function=protein serine/threonine kinase activity; Biological process=one-carbon compound metabolic process
  Homolog annotation: Hit_ID=O48579; Match level="QueryCoverage=38%, HitCoverage=6%, E-value=3e-11, Identity=32%"; Hit description=Mi-2 autoantigen-like protein
MGGGWNKEKNRTLSTKVNLAENNETSPIPSHSEEPLGNGSIGGSGRVIGNYLEDLLRPKFGSDSYERIDKSLPPSKKHAAMKKFNDKNNRRFVFLLETCACLPSIKLSSVDSIIIFDSDWNPMNDIRYLQKLTLDSQFELIKIFRLYSSFTVEEKALILSKQCKIFDINSPNWTIFHMLLMWGASCLFDELKVFHDGETSSSNVKSLFGQPLLKEAMHEFSSLLSQDGEHIDSSNCSTLLKVQQNGATYHANSSLLGELKFRVLGEEPTQIFWTKLLEGKQFQWKYLNSSSQRSRKKVYHFDGSVNGPDLVNVGASKKRRKISNNIVEQPSSKSEDEKLSNGIKADRSQGNNAESEPKSRQHDEQRSLLLLLKPEIRKLCDVLLLPAYNEVGMKCY

SEQ ID NO: 136884 - protein, 231 aa, Glycine max
  Coding DNA Sequence Number=SeqID_20106
  Gene Ontology: Mol. function=DNA binding; Cellular component =mitochondrion; Biological process=DNA integration
  Homolog annotation: Hit_ID=Q1SD84; Match level="QueryCoverage=63%, HitCoverage=9%, E-value=4e-35, Identity=51%"; Hit description =Integrase, catalytic region
MHDLREKHFQAINRIIKYLKTAPGRGLLLKKKGSLSMEIYTDADYARLIIGRGSTTGYCILGGNLVTWKSKKQNAVARSSVEAEFKVMTQGECKLLWMKIILNDLKIKFEAPIRVFSDNKFVTNIAHNQVQLERTKHENRSTFHQRKIRQKTYGYNILRLFRVIKSCLLRTEQYSSEVEQSNLGSYRNSIVTTVIKGKTHLPAPTPQFSEVLSPFLWYFHDLLSFYITNIL

SEQ ID NO: 136885 - protein, 93 aa, Glycine max
  Coding DNA Sequence Number=SeqID_20107
MGRALIQYNPFGVWEYGEFTGKDTCRGIKLPLILTTTPLEGYMGVAPIPPPPEDQLIADVHPAPFVRYFYLPLSLLATHVPHSSSGSRSFSPV

SEQ ID NO: 136886 - protein, 833 aa, Glycine max
  Coding DNA Sequence Number=SeqID_20108
  Homolog annotation: Hit_ID=O48579; Match level="QueryCoverage=16%, HitCoverage=6%, E-value=5e-12, Identity=35%"; Hit description=Mi-2 autoantigen-like protein
MVNGTRSSHNAKDEENNNRRVTQDSEKGKIKSHPNVSDTTGVRRSPRETSSKKNIPNPSSSTRKSGRLENRAPPAPVDKRKSGRIEKKMPSPLRRSGRTRSQSSAGYSDSKSSGSVSSDPKPKKEKSVKQLIFEAKEVNGTEEHHLGTPQIRVKRMTARMYRSLFQLPKEEPNRTDKLNQGGNNGEGQIDECSKESHDCEEISKNGVLSSEDGKSKEMRVDIGSSGSVKDLVEITMAQGSLAPSNVALPSEDGKSKEMRVDTGLSGPVKDLVENTMTLDSLAPSNAATYETGLASESFHPDYCREETLQLLVSSNSILDEDSIRNGVGDRRGENLIPSKSKEITVDMDSDVSSMLAKGDNCNLTPDASSLSRLGGNLMGTDRPSNATLYETGLLPERVQPDCCREETLPSSYSENGVLPSEDGKSKEARVDSGLSVPVKDLVDNTVTLGSLAPSTAATYEIGLAPESIQADYLREKGNSILDEEDLIRISVGHDSSGETLLPSKRKGIMVGMDSDVSAMLAKGDYCNLVPDSGSPSQLGVNLVPDSGSPSQLGGNIMGTNGEGELANNPEFVLYGQKLKRREELDEKVRIWIRGWDEGDCVEGEVVFGEDKVGWVEEEEELDRTTVLDYNPTVRESCIPSATELQDGHYIDASMLQKDSQIDNEKESGLITNSNSSATQLKERLSSHIGYRCKSDSFSFVEYWVPVQISNLQLEQYCSILLSNASILRSSSKVDSVEAVRDVLISTRKCCSHPYLVGPELQPSLNKGLEPIEYLDFDLKASGKLQLLDSMLEELRKNDLRVLILFQGQKELKNKVQRLASKEQSEQIDLDAGE

SEQ ID NO: 136887 - protein, 562 aa, Glycine max
  Coding DNA Sequence Number=SeqID_20109
MHCWTAASLLKHKLDPIASLIQDLNFECKKEEVDYICSMLCCLKKIFLYRTGNYHDTGSPKASGPSNRAYSCTGVAREVELFKKDMSKSIKEIQKKCEKKLKKLHILQEEEKQRLRAAIEEEKAKFEERYKIESAVIRSCSPNDVTRMEKLRVLNTEYEKGIEELKFHHDSCLKDLEDKQLAEIQKFQDKEAAWVEDVKSWADNEYLSIIASKELGTGVESLQTCDQVLPDSGLKNHLAGTAANPPSSMEQKSDGGAVNELSDRELRLSNGPDNNTLLSPQNQNSGGPLDVQGLDRVLSPRACQAASSSDGPNTISIPNPLLEQQTTNGVPLSIPAAVDCHDDIEHLTNAVLGDKRTTSNQQEGAPKTMTELSQGTPVSRTVNVMDPPEQVQHLSVESSPHHDISGEMLHSSRQPELLSSAVDVAPADQSNHVSLIVKPVEQVQQVSSAELPSSHLDSTNLPFTTELEHQPTVVPNQDVQPDSNLEVDSHSHSHEVFVHPASNSDPNTVTPSEVRVQSADTTNLSTPLEINYQNMQAETHSSSRMVHLSYDPLNNELDRIQK

SEQ ID NO: 136888 - protein, 224 aa, Glycine max
  Coding DNA Sequence Number=SeqID_20110
  Gene Ontology: Mol. function=nucleoside-triphosphatase activity; Cellular component=membrane; Biological process=proteolysis
  Homolog annotation: Hit_ID=Q1SGD5; Match level="QueryCoverage=92%, HitCoverage=44%, E-value=2e-87, Identity=80%"; Hit description=AAA ATPase, central region; MIT
  Pfam annotation: Domain name=AAA; Domain location=1-141; Score=-9.5; E_value=0.0011; Accession=PF00004.19; Description=ATPase family associated with various cellular activities (AAA)
  Pfam annotation: Domain name=Vps4_C; Domain location=156-221; Score =129.5; E_value=9.6e-36; Accession=PF09336.1; Description=Vps4 C terminal oligomerisation domain
  Pfam module annotation: Pfam domain module=AAA::Vps4_C; Domain location=1-141::156-221
LGLRRRVNSMIFSAVKKERGRPIRTLEEVVKQNLVGVGHNDQKVLVLAATNTPYALDQAIRRRFDKRIYIPLPDLKARQHMFKAWAIYMMMFIGLIVHLGDTPHNLAESDFEHLARKTEGFSGSDISVCVKVKDVLFEPVRKTQDAMFFFRNPEGMWIPCGPKQQGSVQTTMQDIAAKGLASKILPPPISRTDFDKVLARQRPTVSKSDLDVHERFTKEFGEEG

SEQ ID NO: 136889 - protein, 35 aa, Glycine max
  Coding DNA Sequence Number=SeqID_20111
MVEVFSQNKVTLTSLPMISLSELTYDEFHAGDGEA

SEQ ID NO: 136890 - protein, 707 aa, Glycine max
  Coding DNA Sequence Number=SeqID_20112
  Gene Ontology: Mol. function=identical protein binding; Cellular component=cytoplasm; Biological process=negative regulation of enzyme activity
  Homolog annotation: Hit_ID=Q1RYB7; Match level="QueryCoverage=98%, HitCoverage=91%, E-value=1e-171, Identity=45%"; Hit description =Protease-associated PA; Proteinase inhibitor I9, subtilisin propeptide
  Pfam annotation: Domain name=PA; Domain location=317-414; Score=54.5; E_value=3.6e-13; Accession=PF02225.12; Description=PA domain
  Pfam annotation: Domain name=Peptidase_S8; Domain location=71-553; Score=22.0; E_value=5.9e-08; Accession=PF00082.12; Description =Subtilase family
  Pfam annotation: Domain name=Subtilisin_N; Domain location=1-55; Score=28.4; E_value=2.6e-05; Accession=PF05922.7; Description =Subtilisin N-terminal Region
  Pfam module annotation: Pfam domain module=PA::Peptidase _S8::Subtilisin_N; Domain location=317-414::71-553::1-55
  Subcellular localization annotation: CTP_CleavageSite=33; ConfidenceScore=5.04e-01
MDPPQSLSEAKAAALHHYSKSFQGFSAMITPVQASQLAEYKSVVSVFESKMNKLHTTHSWDFLGLETINKNNPKALDTTSDVIVGVIDSGIWPESESFTDYGLGPVPKKFKGECVTGEKFTLANCNKKIIGARFYSKGIEAEVGPLETANKIFFRSARDGDGHGTHTASTIAGSIVANASLLGIAKGTARGGAPSARLAIYKACWFDFCSDADVLSAMDDAIHDGVDILSLSLGPDPPQPIYFENAISVGAFHAFQKGVLVSASAGNSVFPRTACNVAPWILTVAASTIDREFSSNIYLGNSKVLKGSSLNPIRMEHSNGLIYGSAAAAAGVSATNASFCKNNTLDPTLIKGKIVICTIETFSDDRRAKAIAIRQGGGVGMILIDHNAKDIGFQFVIPSTLIGQDAVQELQAYIKTDKNPTAIINPTITVVGTKPAPEMAAFSSIGPNIITPDIIKPDITAPGVNILAAWSPVATEATVEHRSVDYNIISGTSMSCPHVTAVAAIIKSHHPHWGPAAIMSSIMTTATVIDNTRRVIGRDPNGTQTTPFDYGSGHVNPVASLNPGLVYDFNSQDVLNFLCSNGASPAQLKNLTGVISQCQKPLTASSNFNYPSIGVSSLNGSLSVYRTVTYYGQGPTVYRASVENPSGVNVKVTPAELKFVKTGEKITFRIDFFPFKNSDGSFVFGALIWNNGIQRVRSPIGLNVLST

SEQ ID NO: 136891 - protein, 69 aa, Glycine max
  Coding DNA Sequence Number=SeqID_20113
MKNQCVKENKVQKHEERRRNLTFCDREVPMLPMMELECRERLQIRVSKCSSESDQNESESVESERFQRS

SEQ ID NO: 136892 - protein, 135 aa, Glycine max
  Coding DNA Sequence Number=SeqID_20114
  Homolog annotation: Hit_ID=Q1SGD6; Match level="QueryCoverage=37%, HitCoverage=13%, E-value=2e-13, Identity=70%"; Hit description =Phosphotyrosyl phosphatase activator, PTPA
EEVLAGVGGVEADDVVGGVDAFGGGYEVVRRGQNGNFLGLWDRGEDDGAGGVGVRGDGGGADWAVGWGRGGEGGGLGRGGEGGGAAALAAESSMVAIDGDAAVKVKGGQRGPSFDRLVSFKLNVDDNSCGNLGPS

SEQ ID NO: 136893 - protein, 89 aa, Glycine max
  Coding DNA Sequence Number=SeqID_20115
  Subcellular localization annotation: CTP_CleavageSite=72; ConfidenceScore=5.41e-01
MGSKWRKVKLAIGINMCVQVPKTIEHSSSSSITSAKAFSDRVSPSADASGHRSVTSTNSSASGLRLSGSKSKCSKYSGIITKEIALIAK

SEQ ID NO: 136894 - protein, 270 aa, Glycine max
  Coding DNA Sequence Number=SeqID_20116
MGKREKQKQRHERGHRGRGSFNYLQEDHDFDDTPRSSPSEEEGADGSNEEKEEDEENVTISHENQSHDMPSKFLLYQQSVQSPKGDISYMQKFFLMYVGGRMPLHLQEDFCGTALLSTEWLRSDSRRTVVGLDLDLEALNWCMENNIPKVGADGFSRISLFHGNVLQPLQSKLNEENLQTGVPESDAPTGSIAQDDKYTKGNITLPGRDIVCAFNYSCCCLHKRAELVMYFKHARGALSTKGGIFVMDLYGGTSSEHKLRLQRRFPNFTV

SEQ ID NO: 136895 - protein, 160 aa, Glycine max
  Coding DNA Sequence Number=SeqID_20117
  Gene Ontology: Mol. function=phosphatase activator activity; Cellular component=cell fraction; Biological process=mitotic spindle organization and biogenesis in nucleus
  Homolog annotation: Hit_ID=Q1SGD6; Match level="QueryCoverage=77%, HitCoverage=32%, E-value=1e-59, Identity=86%"; Hit description =Phosphotyrosyl phosphatase activator, PTPA
  Pfam annotation: Domain name=PTPA; Domain location=1-132; Score=45.1; E_value=5.6e-17; Accession=PF03095.5; Description=Phosphotyrosyl phosphate activator (PTPA) protein
MRKLQLQYCLEPVGSHGVWGLDDYHFLPFIFGSSQLIDHKYMKPKSIHNEDILENFSNEYLYLACIAFVKKVKKGVFAEHSPMLDDISGVPNWNKVNTGLLKMYKAEVLEKVPIMQHFLFGSIIKCIILPPYSLLFGYLSGIVLGVFCRFSYEDELYKPG

SEQ ID NO: 136896 - protein, 86 aa, Glycine max
  Coding DNA Sequence Number=SeqID_20118
MGYVGVRELSWRWATGDEWYLEICRGGQETLGTSGGVLLPKTKLDQSRPNPGIVGQEAKEASGNRLPRGVIDYQAYYGNWEMVEVS

SEQ ID NO: 136897 - protein, 84 aa, Glycine max
  Coding DNA Sequence Number=SeqID_20119
MAHQKSNRVLELLALITGLCRFYGVPVAPSKVIRPPTNRAFIKKYCAPRQAQGETPQQLGDDRQRATDRSATTSRVHLSSSTKG

SEQ ID NO: 136898 - protein, 90 aa, Glycine max
  Coding DNA Sequence Number=SeqID_20120
  Gene Ontology: Mol. function=catalytic activity; Biological process =cellular metabolic process
  Homolog annotation: Hit_ID=Q1SGE1; Match level="QueryCoverage=90%, HitCoverage=21%, E-value=5e-32, Identity=82%"; Hit description =Putative dTDP-glucose 4-6-dehydratase
MALIVFYIKAYAKVSGVPASSLSTLDVSAEDFYGKGYDDSDRRIPDMTIITKQLAWKPKTPLDELLDVTLQYQHKTYSRAIQRELSKLSN

SEQ ID NO: 136899 - protein, 308 aa, Glycine max
  Coding DNA Sequence Number=SeqID_20121
  Gene Ontology: Mol. function=catalytic activity; Cellular component =integral to membrane; Biological process=cellular metabolic process
  Homolog annotation: Hit_ID=Q1SGE1; Match level="QueryCoverage=97%, HitCoverage=79%, E-value=1e-155, Identity=86%"; Hit description =Putative dTDP-glucose 4-6-dehydratase
  Pfam annotation: Domain name=Epimerase; Domain location=16-283; Score= 196.4; E_value=6.8e-56; Accession=PF01370.11; Description=NAD dependent epimerasedehydratase family
  Pfam annotation: Domain name=NAD_binding_4; Domain location=18-265; Score=-80.9; E_value=0.0022; Accession=PF07993.2; Description=Male sterility protein
  Pfam module annotation: Pfam domain module=Epimerase::NAD_binding_4; Domain location=16-283::18-265
MARVNLDGNSIPMLAICMIGGGGFIGSHLCEKLMAETNHKAVVVDVSSEKINHLLDRSLPWAHRIEFHQMNIKSDSRLETLVQTTDLTINLAAICTPADYNTRPLDTIFSNFIDAIPVIKYCTENNKRLIHFSTCEVYGKTIGSFLPEEYRQDPKYFMLKEDVTPCTFGPVEKQRWSYACAKQMTDRLIYAEHAENGLKFTIVRPYNWIGPRMDFIPGVDGPCDGVPRVLACFSNSLLRGEPLKLVEGGRSQRTFLYIKDAIDAVALMIDNPERADGHIFNVGNPDNEVSVKELAELMIKVAPPKLPF

SEQ ID NO: 136900 - protein, 154 aa, Glycine max
  Coding DNA Sequence Number=SeqID_20122
  Gene Ontology: Mol. function=nucleic acid binding; Biological process= DNA integration
  Homolog annotation: Hit_ID=Q1SB62; Match level="QueryCoverage=100%, HitCoverage=24%, E-value=2e-33, Identity=55%"; Hit description =Integrase, catalytic region; Zinc finger, CCHC-type; Peptidase aspartic, catalytic
MKYDHVMTTIIESHDTYAMIVSELQSSIESHVNRFWRRQDNRKFEHRVVDCRLKQQASVLESQNRKKELFSSLNKMVKSTIKFGNNTNIPILGKGQITIKLKDGSQNFIYDVFYTLGLHLNLLSMRQRSEKVFNMKIYQGYCTLIDKNGRFVAK

SEQ ID NO: 136901 - protein, 52 aa, Glycine max
  Coding DNA Sequence Number=SeqID_20123
MLPRRFRERFREDFPPFFIVLRSFFVVLRSSTDACVANTFPMRKYNSRTFHT

SEQ ID NO: 136902 - protein, 248 aa, Glycine max
  Coding DNA Sequence Number=SeqID_20124
  Gene Ontology: Mol. function=nucleic acid binding; Cellular component= proton-transporting two-sector ATPase complex; Biological process=DNA integration
  Homolog annotation: Hit_ID=Q1T693; Match level="QueryCoverage=99%, HitCoverage=39%, E-value=1e-54, Identity=49%"; Hit description =Integrase, catalytic region; Zinc finger, CCHC-type; Peptidase aspartic, catalytic
MPQHNGVAERKNRIIMDMVRYMLKAKKAPKEFWAKAVSTVVYILNRKARDDDIHAIEKNNTWELVNFPTNKRPIGVKWVYKTKYNPKGEIDRFKARLEEEVDVEQPTWYIVEGKEDKVYRLKKALYGLKQAPRAWEVMISCFEITDFGLMSRFLGIKVNQQDDGIFISQRKYACDILKKFKMDNSKPVSTLVEEKLKLTRDIESKRVDATLYKSLIGSLRYLTTTRPYIFFGVSLFGRFIEKPHISHL

SEQ ID NO: 136903 - protein, 199 aa, Glycine max
  Coding DNA Sequence Number=SeqID_20125
  Gene Ontology: Mol. function=nucleic acid binding; Cellular component= intracellular; Biological process=regulation of transcription
  Homolog annotation: Hit_ID=Q1SGF6; Match level="QueryCoverage=99%, HitCoverage=99%, E-value=6e-23, Identity=38%"; Hit description =Mutant transparent testa 1 protein TT1-related
  Subcellular localization annotation: CTP_CleavageSite=71; ConfidenceScore=5.07e-01
MGLMECNVEDNKNLYLHAPTFIEWLKPCSSPNYSYLNNSNTILSSSSSPSSSFSFTHNQFVQETIQFLPILSEKKASKDEEDQTFDEVKEEKVKQVTVALHIGLPDTSKGHADDEVVDEKMIFHVKEEEEESSKRSFHGCSFNNNQERRFWIPTPAQILVGPMQFACSICSKTFNRYNNMQKWKLSYVKGPCGRKKRKE

SEQ ID NO: 136904 - protein, 212 aa, Glycine max
  Coding DNA Sequence Number=SeqID_20126
  Gene Ontology: Mol. function=transferase activity, transferring glycosyl groups; Cellular component=intracellular; Biological process=protein amino acid ADP-ribosylation
  Homolog annotation: Hit_ID=Q9SWB4; Match level="QueryCoverage=94%, HitCoverage=24%, E-value=1e-109, Identity=95%"; Hit description=Poly [ADP-ribose] polymerase 3 (EC 2.4.2.30) (PARP-3) (ADPRT 3) (NAD(+) ADP-ribosyltransferase 3)
  Pfam annotation: Domain name=PADR1; Domain location=105-158; Score =119.4; E_value=9.9e-33; Accession=PF08063.2; Description=PADR1 (NUC008) domain
MKLRWCFLEISKVQETRSHVHAPGEEEKVMTRKQKAESKAHEVEHSPKKAKVEKEDGQINGKSETGVAEEYDEFCKVTNEHLPLEQMREIMEANSLDSSGSDLEIARRCQDLLFYGALDKCSVCNGSLEFDGRRYVCRGFYSEWASCTFSTRNPPRKQEPIKLPDSVQDSLASDLLKKYQDPSHRPHRDLGLAEKPFTGMMISLMGRLTRTH

SEQ ID NO: 136905 - protein, 50 aa, Glycine max
  Coding DNA Sequence Number=SeqID_20127
MGDCFLLIKSDQGSRNVSHLTTKNELRLKRRVHQTDWMSTKLDKNKGNFI

SEQ ID NO: 136906 - protein, 171 aa, Glycine max
  Coding DNA Sequence Number=SeqID_20128
  Gene Ontology: Mol. function=nucleic acid binding; Cellular component= intracellular; Biological process=regulation of transcription
  Homolog annotation: Hit_ID=Q1SGF4; Match level="QueryCoverage=81%, HitCoverage=97%, E-value=3e-75, Identity=88%"; Hit description=Zinc finger, C2H2-type
  Pfam annotation: Domain name=zf-C2H2; Domain location=116-141; Score =8.7; E_value=1.2; Accession=PF00096.16; Description=Zinc finger, C2H2 type
  Pfam annotation: Domain name=zf-C2H2; Domain location=90-112; Score =24.3; E_value=0.00042; Accession=PF00096.16; Description=Zinc finger, C2H2 type
  Pfam module annotation: Pfam domain module=zf-C2H2::zf-C2H2; Domain location=116-141::90-112
MATAWIYKGLKDDIAWSNIAALMHMWGHGSEFRKGPDSLKGSQPAAMLRLPCYCCAQGCKNNINHPRAKPLKDFRTLQTHYKRKHGTKPFMCRKCGKTFAVKGDWRTHEKNCGKLWYCTCGSDFKHKRSLKDHIRSFGKGHKPHPPFEAFEDEKECITTGSDEDEVNAHHT

SEQ ID NO: 136907 - protein, 129 aa, Glycine max
  Coding DNA Sequence Number=SeqID_20129
  Subcellular localization annotation: CTP_CleavageSite=36; ConfidenceScore=5.38e-01
MAVDHQEPNQHQPSMFPWQLRRRVPLLRRRKVQTVRLGGKKPRRRISGILRMFRRMRLRWLKLQYVRMLKRLKEQYRNIVKDLVEAGSTIETFQQRLFMESTFAIPVGVNLSTYPSRFGSDHRPRTIFM

SEQ ID NO: 136908 - protein, 89 aa, Glycine max
  Coding DNA Sequence Number=SeqID_20130
MWQGTRDCHEGKFKLKKKGFFSVQICFAEKGLGNSKNSGTNSQIRCSAGSRLLKDLIRQDLLSSHERGCLPSTAQDSSLRGGNVTCTES

SEQ ID NO: 136909 - protein, 133 aa, Glycine max
  Coding DNA Sequence Number=SeqID_20131
MDGGGYNLTTTSLSSSMEQVMRPKSPLPGLVDFHGKRKQMVKIQVLEREIGLLQALTLLLDAAKSKAPIFTIVYIIISDSKTLFQIPSHPLFHGFAAPTVACCIRKQQKVVVGTAVLHQTPSVVTVVAAAAAA

SEQ ID NO: 136910 - protein, 112 aa, Glycine max
  Coding DNA Sequence Number=SeqID_20132
MILVLGSFTIGGMVNNDLVSCSLVDPDTTRILEAEQEILFISSHNENEGSQEKAHSSNNFEHRILMHSSSSSSSSHNSDNTWSLMKNSSPNNNLLLFSYAAGNCWSSKPVED

SEQ ID NO: 136911 - protein, 104 aa, Glycine max
  Coding DNA Sequence Number=SeqID_20133
MSGNAFFSCEKAKEIWQVVGLWQLIRPKADAAKGFTKCLLDLLQHLHQTDMNKLALSCRKFGKNLLTWLYNSVLNGYLSETPMLKKPIKLHLLPLLRLLCIGHS

SEQ ID NO: 136912 - protein, 117 aa, Glycine max
  Coding DNA Sequence Number=SeqID_20134
  Gene Ontology: Mol. function=nucleic acid binding
  Homolog annotation: Hit_ID=Q1RVK6; Match level="QueryCoverage=74%, HitCoverage=18%, E-value=4e-16, Identity=46%"; Hit description=Zinc finger, CCHC-type
MNNENSKATLNGVPPQPKPPDGEGSGGARVSFQDKVMEGSVAVPRMTRTDLIANKLLRIELEDGDRWLPRCYIEDQLLEELRKPWTDALIMKLLGKRLSLFVTRESKRGVHLYEERV

SEQ ID NO: 136913 - protein, 334 aa, Glycine max
  Coding DNA Sequence Number=SeqID_20135
  Gene Ontology: Mol. function=zinc ion binding; Cellular component =integral to membrane; Biological process=ubiquitin cycle
  Homolog annotation: Hit_ID=Q1RUW9; Match level="QueryCoverage=70%, HitCoverage=68%, E-value=1e-51, Identity=48%"; Hit description=Zinc finger, RING-type; RINGv
  Pfam annotation: Domain name=zf-C3HC4; Domain location=132-173; Score= 41.5; E_value=2.9e-09; Accession=PF00097.15; Description=Zinc finger, C3HC4 type (RING finger)
MTTLTHSNFHHDLLLLFYFFLLTEFPSPLTAQLPDTLTPPSPQQQEDRFARLKFDKSMAIVLVILVAVFFVLGFLSVYTRQCAERRMRGRFDISISISRRQRGLDREIIETFPTFVYSTVKSLKLGRATLECAVCLNEFEEVETLRFIPNCSHVFHSECIDAWLANHSTCPVCRANLFPKPDDPSFDPIQIPDPEQPVISSPTRAETGGSNPRSPNLIDQNPTSRSRSTGFRIAGWFPRSHSTGHSLVQPGENCERFTLHLPEEVRNQLMLSRTKSCGVGVTFTRENSERRGYRARSVGSSLSPHVRGWFSVKDDVGERSSDRLFSTSTRDSEV

SEQ ID NO: 136914 - protein, 99 aa, Glycine max
  Coding DNA Sequence Number=SeqID_20136
MPISPCGWIVPVTHPVDPEKSNKVLGFPALIMGFCQFYGVPVTPDKVIRPPTNQAFIKKYCAPRQVQGETPQQPGDGWQRATNAPPPPLEFTSAHPQKG

SEQ ID NO: 136915 - protein, 61 aa, Glycine max
  Coding DNA Sequence Number=SeqID_20137
MATLGLEILVESASSVILKMILSFDLAFALIPLLKFSSSKVTSSTSIEERLQGFQGKGTRG

SEQ ID NO: 136916 - protein, 249 aa, Glycine max
  Coding DNA Sequence Number=SeqID_20138
  Gene Ontology: Mol. function=RNA-directed DNA polymerase activity; Biological process=RNA-dependent DNA replication
  Homolog annotation: Hit_ID=Q8H6Q8; Match level="QueryCoverage=72%, HitCoverage=49%, E-value=1e-16, Identity=28%"; Hit description=CTV.20
HISKYCRLKKKLRNLNLEPAIEEQINNLLIETSEEETETSSSVLSDENLNLIQQDDQLSSTDDDDGQINTITREQDLLFEAINSIPDPQEKKVFLEKLKKTLEVKPRQKDFITNNKFDVSNILKRLENSSTKPTTIQDLQTEINNLKREVKELRQQQEIHQIILSQLKEDSDSESTNNSEENQPENLEDDMFMGLINKIKIQKFYINIKIIINDFVLETMALFDTGTDSNCILAGLIPTKFFEKTSEKL

SEQ ID NO: 136917 - protein, 43 aa, Glycine max
  Coding DNA Sequence Number=SeqID_20139
MEGIVFSSSTLALSEIWVFDFVVVVMVGMAPRSSIWGIWGLKK

SEQ ID NO: 136918 - protein, 127 aa, Glycine max
  Coding DNA Sequence Number=SeqID_20140
  Gene Ontology: Mol. function=hydrolase activity; Cellular component =cellulose and pectin-containing cell wall
  Homolog annotation: Hit_ID=Q94DD0; Match level="QueryCoverage=89%, HitCoverage=39%, E-value=3e-26, Identity=48%"; Hit description =Putative hydrolase
MFYQGTQLPPPNNRDSPDYCVPVSPPRIKLRDGRFLAYREKGVPKDQAKHSIIIELIDELGIYILQYPNPKRSLKSEALDIEELADQLQIGSKFYVIDVSMGSYATWSCLNYIPNRQITCLSQNMHL

SEQ ID NO: 136919 - protein, 131 aa, Glycine max
  Coding DNA Sequence Number=SeqID_20141
MERDRMNLKHNKAWDCPTYIKRLRIDKLKDYEMKNEIPFFNVLKLPQRSSPPTIVVQEPAIVQDQVKESILESIQQPMNLMHEPSRKPTRVHHPPNRLNLMVLDDTSNDVYHDDDDPRSYEEAMQSLDCKK

SEQ ID NO: 136920 - protein, 971 aa, Glycine max
  Coding DNA Sequence Number=SeqID_20142
  Homolog annotation: Hit_ID=Q9FMQ6; Match level="QueryCoverage=98%, HitCoverage=74%, E-value=1e-168, Identity=40%"; Hit description =Arabidopsis thaliana genomic DNA, chromosome 5, P1 clone:MWD9
MMNASRLKSGPGGIKSEGSSELTSTGVRVMLTSEQGVSLHREHIAEQRVVAKGSNRGNTPEDPASNPNTLIKNKVSRAPRTGSVGALESSNIQPSSTTFPGSSIHPMTQWVGQRPPKNSRSRRVKVVSPASRNLEVQVSFEGCLTSEFCVKASSAGNNGFQLASSADNSTPKYKRPPDDTSSPFGLSESEESGAGENKIKEKAVNGSDFAMAADKAGASVFQMRKNKISTDESGDSVQRQGRSGRNLSLVRPDLPSGREKSENVPTMKPVQDMKPNDKSKTKYGRPPSKKQKERKILTRVGKQLNISSPDFGGEPDDDHEELYKAANAARNASNLACSGPFWKKMESIFASISLDDASYLKQQLNIAEEFDKSLSHMFCIDHDLLGVVINNKPTQGSEERKRSHCDEESTKFDALDGKKDMERLDKVTPLFQRLLCALIEEDENEESYHQSDAKNISRQCASDDSHCGSCNQIDFEPKDRDRMDSEVESEVDLQIQKNCMLDRLSCDKSTTSNTFRYPNTSSSLQSTGVWQGDEEFSLSDITHTGEICSNDLDQLQPAELSVPSFPSPDGQYQQMSLDDRLLLELQSIGLYPEILPDLAEEDEAINQDIVKLEKALYEQNGSKKNNLDKIDRAVQEGRDVERQKIEQAAFDQLIEMAYRKRLACRGSKNSKGAVHKVSKQVALAFVKRTLGRCKRYEEADINCFSEPTLQNIMFAPPSRENDAQPADCIVSGTASNTCNKVSLQIEARKSGAVSSVSDKYDCHRDYADRGLVDSFQGSIQSSEQASSKNGSMFIREKKREMLVNGGVSGSSSRASNLDGAVHGGLKGKRSERERNQSRDQSGQNSIGRAGRISLDSSQNENKPKAKKQKSTASGHDRVMEAKDSTRLPIHDAINNHSKDGATISGNQDTSQIKESNDFGNLPLPDLSSIEEFGGTQDLSSWLNFEEDGLQDHDSIGLDIPMDDLSDLNMLM

SEQ ID NO: 136921 - protein, 419 aa, Glycine max
  Coding DNA Sequence Number=SeqID_20143
  Gene Ontology: Mol. function=protein binding
  Homolog annotation: Hit_ID=Q8RZ32; Match level="QueryCoverage=99%, HitCoverage=100%, E-value=1e-149, Identity=63%"; Hit description=F -box protein-like
  Pfam annotation: Domain name=F-box; Domain location=1-47; Score=19.4; E_value=0.013; Accession=PF00646.23; Description=F-box domain
  Pfam annotation: Domain name=LRR_1; Domain location=127-148; Score =10.6; E_value=2.9; Accession=PF00560.23; Description=Leucine Rich Repeat
  Pfam annotation: Domain name=LRR_1; Domain location=150-171; Score =4.1; E_value=49; Accession=PF00560.23; Description=Leucine Rich Repeat
  Pfam annotation: Domain name=LRR_1; Domain location=221-246; Score =3.1; E_value=76; Accession=PF00560.23; Description=Leucine Rich Repeat
  Pfam annotation: Domain name=LRR_1; Domain location=345-367; Score =2.4; E_value=1e+02; Accession=PF00560.23; Description=Leucine Rich Repeat
  Pfam annotation: Domain name=LRR_2; Domain location=150-174; Score =15.8; E_value=0.11; Accession=PF07723.3; Description=Leucine Rich Repeat
  Pfam annotation: Domain name=LRR_2; Domain location=289-316; Score =2.9; E_value=6.5; Accession=PF07723.3; Description=Leucine Rich Repeat
  Pfam module annotation: Pfam domain module=F-box::LRR_1::LRR_1::LRR _1::LRR_1::LRR_2::LRR_2; Domain location=1-47::127-148::150-171::221 -246::345-367::150-174::289-316
MDQLPVEVIGNILSHLRAARDVVIASATCRKWRQACCKHLHTLSFSSKDWPIYRDLTTTRLEILITQTIFQSSGLQALSILMEDVDEFSASTVTAWLLYTRETLRQLHYNVKTTPNVNILEICGRHKLEILDLAHNSIVGVEPNYQRFPCLKSLSLSYVSISALDLNLLVFACPKIEALELVNPEIAMSDAQVTVELSSLTLKSVYVEAISLDKFLLEADGLECLHLKDCALEFFELIGKGTLKHFKIDDVSVIHLDIGETVENLETVDISNFTIIWPKFYQMISRSSNLKRLRLWDVMFDDEDEVVDLETIATCFPYLSHLSLSYDVRDGVLHYGLQGSSYLESVVVLELGWTVINDLFSHWVEGLLKRCPNLKKLVIHGIVSQVKSHEECQMLANFTTSMVELMRRYTHVDPYFKYD

SEQ ID NO: 136922 - protein, 327 aa, Glycine max
  Coding DNA Sequence Number=SeqID_20144
  Gene Ontology: Mol. function=protein dimerization activity; Cellular component=nucleus; Biological process=regulation of transcription, DNA-dependent
  Homolog annotation: Hit_ID=Q93XM6; Match level="QueryCoverage=89%, HitCoverage=61%, E-value=2e-98, Identity=63%"; Hit description=BZIP transcription factor
  Pfam annotation: Domain name=bZIP_1; Domain location=47-102; Score =20.3; E_value=0.00091; Accession=PF00170.11; Description=bZIP transcription factor
  Pfam annotation: Domain name=bZIP_2; Domain location=49-101; Score =16.3; E_value=0.016; Accession=PF07716.5; Description=Basic region leucine zipper
  Pfam module annotation: Pfam domain module=bZIP_1::bZIP_2; Domain location=47-102::49-101
MADKDAFCYPYHVHDCTSPQENLPNKGPFHSEMLPKNSRKGAGYTSEKPLDAKTLRRLAQNREAARKSRLRKKAYVQQLESSRLKLTHLEQDLQRARSQDEFMGCGGAGGSISSGAAMFDMEYAKWLEDDQRHIVELRSGLQTPLSDGELRVIVDGFLSHYDEVFRLKGVAAKTDVFHLINGTWTSPAERCFLWIGGFKPSELITMLIPQLEPLAEQQIMVICELGHSSLQTEEALSQGLEQLQQSLVDTIAGGPIADGVQQMVAAMTKLGHLEEFVAQADNLRQQTLHQLCRLLTVRQAARCFLVIGEYYGRLRALSSLWASRPRE

SEQ ID NO: 136923 - protein, 113 aa, Glycine max
  Coding DNA Sequence Number=SeqID_20145
  Homolog annotation: Hit_ID=Q8RWC5; Match level="QueryCoverage=50%, HitCoverage=13%, E-value=1e-07, Identity=50%"; Hit description =Fasciclin-like arabinogalactan protein 16 precursor
MAWEFLHRKFRSQPKGKGKKEVHTSAMLGIGRVIHLQCTLGEDDKEVVAAIEILLDGLRDDEALKIVDDVVGAKGIFSVEYLDIVDSSLVGGLGGQMKVVVGERKLMEILLLK

SEQ ID NO: 136924 - protein, 409 aa, Glycine max
  Coding DNA Sequence Number=SeqID_20146
  Gene Ontology: Mol. function=phosphopantetheinyltransferase activity; Cellular component=integral to membrane; Biological process =macromolecule biosynthetic process
  Homolog annotation: Hit_ID=Q9FHT4; Match level="QueryCoverage=82%, HitCoverage=56%, E-value=5e-66, Identity=42%"; Hit description =Endosomal protein-like
  Pfam annotation: Domain name=EMP70; Domain location=60-407; Score =26.3; E_value=3.3e-16; Accession=PF02990.7; Description=Endomembrane protein 70
  Subcellular localization annotation: CTP_CleavageSite=32; ConfidenceScore=5.48e-01
MASPAISFSFFFFFFFFSAPLLNFLHLHPPITSTMLENLSHCLSTKWDPSTTPVRHMNTMIFHSAPQVMFFTDPIVRKKESLGEVLNGDRLSNALYEFKFRVDKIDETLCQNKLTIDQFYLDDLPFWGFIGKLEEDGWTPGGGEPNYYLFTHVQFDVLYNGNWIVQVNAFGDPNRAVDITKDVGVDVKFTYYVIWNATKVRFENRMDRYSRASLMPAHRQVHWFSFINSIVVILLLIGLLALLYIRYLRSDLKKYSNATEEDKEVGWKSLQHGDVFRPPPNSSLLFAVVGTGSQLLSSSSLHQRINQPRLCVLLFLALIGTLYPYNHGGLLNCLVLLYALASVFAGYTAASFHGQFAENGWIVKGSNRNEKRRGEEDEEENELKKPDQTINNNNRSQLKNKKINNPLKK

SEQ ID NO: 136925 - protein, 167 aa, Glycine max
  Coding DNA Sequence Number=SeqID_20147
  Gene Ontology: Mol. function=RNA-directed DNA polymerase activity; Cellular component=chromatin; Biological process=RNA-dependent DNA replication
MLNKDVVFVFNDECLEVFNTLKAKLLSAPVITATDWGQKFELMCDASDYAVAIKYLLHKADSKTRLIKWILLLQEFDLVIKDKKGSENVVADHLSRLVNEEVTLKEAEIKDEFPDEFLFLIAQCRNLPFCGRVRRGSRVRLPKEENVQSHHQRLFVENVGKTEGNRS

SEQ ID NO: 136926 - protein, 193 aa, Glycine max
  Coding DNA Sequence Number=SeqID_20148
MANFVAPGHLIIKDENLNLHSKKTTKSKNSKTNGKKDGSGIAGRKALNDITNKSSLHHPEASVKKRNLPKQDINVKEEMFLHDHKKCIEAQNATMRNFNLETVLPQDGNRNWLLLQYSMYGMSCENLYGVPHSPQCYPEPVELPMPNFSDWFDHSMQWSSPPSSPLSWDSPSSLAWQNEAVEFVLKEEIAVQV

SEQ ID NO: 136927 - protein, 118 aa, Glycine max
  Coding DNA Sequence Number=SeqID_20149
  Gene Ontology: Mol. function=binding
  Homolog annotation: Hit_ID=Q10L89; Match level="QueryCoverage=68%, HitCoverage=49%, E-value=5e-21, Identity=58%"; Hit description =Tetratricopeptide repeat protein 11, putative, expressed
  Pfam annotation: Domain name=TPR_2; Domain location=17-50; Score =20.2; E_value=0.0074; Accession=PF07719.7; Description =Tetratricopeptide repeat
MEMAASLPATEDPLQQREKLYLLAVGYYRNADYSRSRDLVDRCLAIAPDWRQAVTLKTTIEDKITKDGVIGLGIAATAVGLIAGKHLYYCDFAASYCFYEKEGVNNNVYKAVEMMSKY

SEQ ID NO: 136928 - protein, 89 aa, Glycine max
  Coding DNA Sequence Number=SeqID_20150
MVRNTVMDMALNTFISITEHVSLLKILFLLPFPQSSNSKNATPLVVQYEEKVFEFLGFEKSKDCLEQVNKWQSIENIRLLINLSSSSYK

SEQ ID NO: 136929 - protein, 579 aa, Glycine max
  Coding DNA Sequence Number=SeqID_20151
  Gene Ontology: Mol. function=protein binding; Cellular component =integral to membrane
  Homolog annotation: Hit_ID=Q5N7I7; Match level="QueryCoverage=87%, HitCoverage=82%, E-value=5e-74, Identity=62%"; Hit description =Putative NTS2 protein
  Pfam annotation: Domain name=DUF1634; Domain location=110-190; Score=- 41.3; E_value=0.092; Accession=PF07843.2; Description=Protein of unknown function (DUF1634)
  Pfam annotation: Domain name=DUF6; Domain location=19-125; Score=9.1; E_value=0.02; Accession=PF00892.11; Description=Integral membrane protein DUF6
  Pfam annotation: Domain name=DUF803; Domain location=3-259; Score =385.9; E_value=6.1e-113; Accession=PF05653.4; Description=Protein of unknown function (DUF803)
  Pfam module annotation: Pfam domain module=DUF1634::DUF6::DUF803; Domain location=110-190::19-125::3-259
MGLSKENLKGLILALVSSGFIGASFIIKKQGLRRAAAVYGVRAGVGGYYYLLEPLWWVGMITMIAGEVANFVAYAFAPAVLVTPLGALSIIVSAVLADIILKEKLHNLGILGCIMCIAGSIIIFIHAPKEQPITSVLEIWNMATQPAFLAYVGSVIVLVFILVFHFAPRCGHTNVLVFTGICSLMGSLSVMSVKALGTSLKLTFEGKNQLIYPETWFFMLVVAICVIMQMNYLNKPLCICKGKAAYNIPPPYLRIAKSLRAMGYEVKEVKVKPYPCICKEAVSGFEPMTNKSPRHNFTAAPGLALKKMKNATKLLISLYMKETPLQTIWVWLWQGSEITPMNKDMRDYGEKINKLHSLILSDSKRGITFHGRTVSDKIISNGSYDFTSCMLNPPYNIQYYNMRIPMECKFKIEQTSELRTQDEYPTLNLRTKRLHNTTKVKSRYNKALDTFNTAIVSPIYYVMFTTLTILASVIMFKDWDGQSGGTIVSEICGFIVVLSGTIMLHATKDFERSSSFRGVINLIIALNSAATDYPDECSAPSSPTLSARLFTGNGDSLLKQDEENGSPESNMCSRRQELY

SEQ ID NO: 136930 - protein, 826 aa, Glycine max
  Coding DNA Sequence Number=SeqID_20152
  Gene Ontology: Mol. function=nucleic acid binding; Cellular component= chromatin; Biological process=chromatin assembly or disassembly
  Homolog annotation: Hit_ID=Q1SJG7; Match level="QueryCoverage=93%, HitCoverage=90%, E-value=0.0, Identity=76%"; Hit description =Helicase, C-terminal; Homeodomain-like
  Pfam annotation: Domain name=Helicase_C; Domain location=11-90; Score= 100.5; E_value=5.1e-27; Accession=PF00271.21; Description=Helicase conserved C-terminal domain
MVRMLDILGEYMSLRGFQFQRLDGSTKAELRQQAMDHFNAPGSDDFCFLLSTRAGGLGINLATADTVIIFDSDWNPQNDLQAMSRAHRIGQQEVVNIYRFVTSKSVEEDILERAKKKMVLDHLVIQKLNAEGRLEKKEAKKGGSYFDKNELSAILRFGAEELFKEERNDEESKKQLLSMNIDEILERAEKVEEKEADGEQGNALLGAFKARYVDSTVANFCNDEDDGSFWSRWIKPDAVFQAEEALVPRSARNIKSYAEVDPSEKSNKRKKKEPEPLDRVSKRRKAEYSAPAVPMIEGASVQVMKYGNESQVDLIVAEVGGAVGAAPPGVQIELFNALIDGCTEAVELGNLDAKGPLLDFFGVPVKANDLLTRVQQLQLLAKRIGRYEDPIAQFRVLSYLKPSNWSKGCGWNQIDDARLLLGIHYHGFGNWETIRLDERLGLTKKIAPVELQHHETFLPRAPNLKDRANALLEQELAVLGVKNANSRVGRKPSKKERENMINISLLRGQEKKKKSSSVNVQMRKDRFQKPQKVESIVKEEGEMSDNEEVYEQFKEVKWMEWCQDVMVEEMKTLKRLHRLQQTSANLPKEKVLSKIRNYLQLLGRRIDQIVLEHEQEPYKQDRMTVRLWKYVSTFSHLSGERLHQIYSKLRQEQNEAGVGPSHANGSVSVSFSRNGNPFHRHMERQRGLKNMAPYQMPEPVDNTGKSEAWKRRRRTESDNHFQGQPPPQRTLSNGIRITDPNSLGILGAGPSDKRFASEKPYRTQPGGFPSRQGFSSASAIVHSVEFFSSTHANKTLRIPFWCVLADMRNIPTLGFTSLKMAEAEKI

SEQ ID NO: 136931 - protein, 78 aa, Glycine max
  Coding DNA Sequence Number=SeqID_20153
MHEHENLADLMLLATVLAHQRHLGLEANLVQFLMELFIIKHISVFSYLGALIGGGFFLSPFGDGPPPFHWSPCVVTKA

SEQ ID NO: 136932 - protein, 73 aa, Glycine max
  Coding DNA Sequence Number=SeqID_20154
  Homolog annotation: Hit_ID=Q9SD67; Match level="QueryCoverage=51%, HitCoverage=4%, E-value=3e-09, Identity=78%"; Hit description=FtsH metalloprotease-like protein
MYQTAKLKGSEKALVARHEARHAVVGTAVANLLAGQPHVEVWTLGYLILEFIYLVLWWEIKEKYKSVMCDIKR

SEQ ID NO: 136933 - protein, 99 aa, Glycine max
  Coding DNA Sequence Number=SeqID_20155
MKSRGYIESDNLKDDLPYQVEEMSHVNEVIEVENMSSGGANPPRHLSHDSSGKGTGGKKKRYVIRLLSPRDSLLSSTTSPSTIYLPVRSSNVASTPSPL

SEQ ID NO: 136934 - protein, 92 aa, Glycine max
  Coding DNA Sequence Number=SeqID_20156
MFSALSKRKRVLIRVSYLEIYNEVILIGSFLCHDSDSTWTALYWAARFGRNLYFILGRREYQCKEREQEGQIKPLIPTQLVKHYKLLAAFKE

SEQ ID NO: 136935 - protein, 760 aa, Glycine max
  Coding DNA Sequence Number=SeqID_20157
  Gene Ontology: Mol. function=ubiquitin-protein ligase activity; Cellular component=ubiquitin ligase complex; Biological process =protein ubiquitination
  Homolog annotation: Hit_ID=Q1SHI6; Match level="QueryCoverage=94%, HitCoverage=72%, E-value=2e-66, Identity=27%"; Hit description=U box
  Pfam annotation: Domain name=Arm; Domain location=281-320; Score =13.1; E_value=0.28; Accession=PF00514.13; Description=Armadillobeta -catenin-like repeat
  Pfam annotation: Domain name=Arm; Domain location=321-363; Score=5.3; E_value=2.7; Accession=PF00514.13; Description=Armadillobeta-catenin -like repeat
  Pfam annotation: Domain name=Arm; Domain location=417-457; Score=2.4; E_value=6.2; Accession=PF00514.13; Description=Armadillobeta-catenin -like repeat
  Pfam annotation: Domain name=Arm; Domain location=460-501; Score=8.0; E_value=1.2; Accession=PF00514.13; Description=Armadillobeta-catenin -like repeat
  Pfam annotation: Domain name=Arm; Domain location=503-543; Score =21.0; E_value=0.0043; Accession=PF00514.13; Description =Armadillobeta-catenin-like repeat
  Pfam annotation: Domain name=Arm; Domain location=546-586; Score=7.4; E_value=1.5; Accession=PF00514.13; Description=Armadillobeta-catenin -like repeat
  Pfam annotation: Domain name=Arm; Domain location=619-659; Score =12.8; E_value=0.31; Accession=PF00514.13; Description=Armadillobeta -catenin-like repeat
  Pfam annotation: Domain name=U-box; Domain location=17-81; Score =17.3; E_value=6.7e-06; Accession=PF04564.6; Description=U-box domain
  Pfam module annotation: Pfam domain module=Arm::Arm::Arm::Arm::Arm::Ar m::Arm::U-box; Domain location=281-320::321-363::417-457::460 -501::503-543::546-586::619-659::17-81
MQQGIMKKWRGGTLKGLRNVMVDPVSLCTGTTCERSAIEAWFCDGNRTDPETKEVLEDTTLRSNIPLRQSIEEWRELNYCLVIRSIRENLLSYSDLQESLSQMQTLVRENSINKDWISIAELTDIVISILGSSDDREVKMKILITLKDAVEGNTRNKEKVAESQGWDNIISCLGSDSSTSKAAIDLLHELLQEQSGWNECLCRKLSENRTAVQFLVALLKNHVNHSAEVAENILMNLFELNDETITIAANFGWYKPLVDRMIQGPDSRISMTKAIVNLELKDPNLKLLGKEGAIPPLLEMLSGNIESKDLSLSALVKLAGSHANKGIIAASGGVPLIIDLMFSPQSRTLIIIKCSEIIEKLSSDGDGIDFFVDGEGKQLELDSIIANLLALQQTSNSGHNIRKPALSALLGICKFETGLVKKAILAANGVSLILPLLDDSDSEIRETSIILLFLFSQHEPEGVVEYLFRPRRLEALIGFLENEENANVQIAAAGLLANLPKSERELTMKLIELGGLDAIISILKTGKMEAKENALTALFRFTDPTNIESQRDLVKRGIYPLLVDFLNTGSVTAKARAAAFIGDLSMSTPKLTVVPKPTGCWLFRSSRVPLCSAHGSVCSVNTTFCLLEAKALPGLIKLLHGEVHATACEAIQTLSTLVLEDFPQRGARVLHEYNAIRSIMDILNWGTDSLKAEALGLLEKVFVSKEMVEYYGTTARSRLIGLTGMNIYGDGHLRRKAAKVLSLLERYSKSSSSAISGVPE

SEQ ID NO: 136936 - protein, 210 aa, Glycine max
  Coding DNA Sequence Number=SeqID_20158
  Homolog annotation: Hit_ID=Q2HS59; Match level="QueryCoverage=45%, HitCoverage=13%, E-value=5e-40, Identity=77%"; Hit description=RNA -binding region RNP-1
  Pfam annotation: Domain name=RRM_1; Domain location=15-90; Score =28.1; E_value=3.1e-05; Accession=PF00076.12; Description=RNA recognition motif. (a.k.a. RRM, R
GKKIKCSKSQAKHRLFIGNVPRSWGVEDLKKIVTEIGPGVTGVELVKDMKNTNNNRGFAFIDYYNHACAEYSRQKMMSPTFKLGENAPTVSWADPKNAESSAASQKSSPSTTAIIFSGLPLPPRSTSTLTRQHPTKPSATILGLSPTTLTNSTTSKTNQRTNQSFFFGGGGEHAGDCSHRKLEKLGLAFLRIFQGKEKLDSKLELIVRGA

SEQ ID NO: 136937 - protein, 315 aa, Glycine max
  Coding DNA Sequence Number=SeqID_20159
  Gene Ontology: Mol. function=nucleic acid binding
  Homolog annotation: Hit_ID=Q2HS59; Match level="QueryCoverage=54%, HitCoverage=23%, E-value=9e-54, Identity=65%"; Hit description=RNA -binding region RNP-1
  Pfam annotation: Domain name=RRM_1; Domain location=110-181; Score =59.6; E_value=1.1e-14; Accession=PF00076.12; Description=RNA recognition motif. (a.k.a. RRM, R
MESEIIPSDSAMVVLADSVHNGESEKEQVIAMEVWVSCSLVNSPLPELSDLDSPILANGSSMMSDLWISYYHAVEYIDYFLTDPILDALLCKQSIEYSELLCMCEQVKAVYVKNLPKNVTQEQLKKLFERHGKITKVVLPPAKSGQEKNRIGFVHFAERSNAMKALKNTERYELEGQLLQCSLAKPQADQKSGGSNTQKPGPGLLPSYPPHVGYGLVGGAYGGLGAGYAAPGLAQPMLYGGGQTPSGMAIMPMLLADGRIGYVLQQPGMQPQAPPSHHRGGRGGGGSGSGNRNVGSSSKGRHNNDGGHGRRYRPY

SEQ ID NO: 136938 - protein, 417 aa, Glycine max
  Coding DNA Sequence Number=SeqID_20160
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9ZQG9-2; Match level="QueryCoverage=79%, HitCoverage=88%, E-value=1e-139, Identity=68%"; Hit description =Isoform 2 of Q9ZQG9
  Pfam annotation: Domain name=Glyco_hydro_17; Domain location=51-370; Score=384.6; E_value=1.5e-112; Accession=PF00332.9; Description =Glycosyl hydrolases family 17
MENSIYPLVRVVIRIASQEESTTIFSFLILSTWSSIYSPHDLFVQIHGLGFGINYGQIGNNLPPPSQVAVLIKSMNVSRIRLYDSDPNVLLAFSQSNVEFVIGLGNDYLENMTNPSKFQTWIQQHVQPYLSQTKITCITVGNEVFNSNDTQQMLNLLPAMQSVHDALVNLGLDKHVTVTTAHSFNILSNSYPPSSGAFREDLVQYIQPLLDFHAQINSPFLINAYPFFAYKDNPGEVSLNYVLFQPSEGMIDQNTNLHYDNMLYAQIDAVYAAIKQMGHDHDVQVRISETGWPSNGDPDEVGATPQNAALYNGNLIKRIQQKQGTPAKPSVPIDIYVFALFNENLKPGPASERNYGLYYPDGTPVYNIGLKDYLQEIPMAAKSNFDDMVVFVVVGGGGKMTMDGIVMLVMSKKMKMG

SEQ ID NO: 136939 - protein, 152 aa, Glycine max
  Coding DNA Sequence Number=SeqID_20161
  Homolog annotation: Hit_ID=Q9LXJ8; Match level="QueryCoverage=25%, HitCoverage=8%, E-value=3e-07, Identity=65%"; Hit description =Putative RNA binding protein
MPREKAISSSAAKPSEPEEPVESDEKVDFEEANDPEEAMEEEVEYEEVEEEEEVEEIEEEVEEVEEEEEVEVEEDEEEEEEEEEEVEEVEEDDAMQNHSSDETKVEDEDEKKKHAELLSIPPHGSEVYIGGIPHASDEDLKSLCERIGEVAE

SEQ ID NO: 136940 - protein, 671 aa, Glycine max
  Coding DNA Sequence Number=SeqID_20162
  Gene Ontology: Mol. function=zinc ion binding; Cellular component =COPII vesicle coat; Biological process=ER to Golgi vesicle-mediated transport
  Homolog annotation: Hit_ID=Q9ZQH3; Match level="QueryCoverage=98%, HitCoverage=83%, E-value=0.0, Identity=74%"; Hit description =Expressed protein
  Pfam annotation: Domain name=Sec23_helical; Domain location=427-541; Score=-3.2; E_value=0.002; Accession=PF04815.5; Description =Sec23Sec24 helical domain
  Pfam annotation: Domain name=Sec23_trunk; Domain location=17-285; Score=-8.8; E_value=1.2e-10; Accession=PF04811.5; Description =Sec23Sec24 trunk domain
  Pfam module annotation: Pfam domain module=Sec23_helical::Sec23 _trunk; Domain location=427-541::17-285
MIARLCGHAFSVVQAMIEATSEEFLELTKSALLAALEALAPGSLFGLATFSHKLGLYDVQGPIPVVKNVFIPPDAEGTLPIELEDVMPLLQFLAPGKDQIIWKTASDLNCIFFLKVETYKDRIASALETLRPTTSWERTTTAGQGLDGVLIGGRGFGMAMEALCNYLGSEYGNTFALARVFAFLSGPPDYGAGQLDTRRYGEQYASKGEDADRALLPEQTPFYKDLAAVAVQAGVCVDIFAVTNEYTDLASLKFLSIESGGSLFLYTSTEDSTLPQDMYRMLSRPYVFGCVLRLRTSTEFKPGNSYGHFFPDPQYENVQHIICCDSYATYAYDFVFENNIGFSSLQPLWADLPMPCHHCGRSKSDVPTIQIAFQYSVVVPPQELSDSNSGGVSTNRTKHSLQRRLRIRTLQFGVAQNIHELYDSCDPEVVLSLLVHKVILASLEEGVREGRILLQEWLVILTAQYNDAYKLIQYDNGSSIRSQIDVAFSQCPQLQPLPRLIFALLRNPLLRFHEEGVHPDHRIYLQCLFSMLEPSSLHRAVYPVLTSYATPDKQAYPRHSLSRAALITSGSPIFFLDAFTILIVFYSSTADPTLPFPPPHDCLLRTTINKLKQERCITPKLIFIRGGHDDASIFENFLIEEQDVDGSGLTSVMGFVSFLEDTTQKVLEFMK

SEQ ID NO: 136941 - protein, 74 aa, Glycine max
  Coding DNA Sequence Number=SeqID_20163
MSPSLEAIGRKIRNGLSHTVILTNKKNPKLKLTAPLHLPFCQYQRDATLGKVHRLKSLCSPTCRLNSGSFRRLR

SEQ ID NO: 136942 - protein, 70 aa, Glycine max
  Coding DNA Sequence Number=SeqID_20164
MGVRLVTQEKRVLVVVFFGSCGVASNTLAELQEYLERGTRLLILLLMMILKGYIIWLFFRHHPFTTPKAR

SEQ ID NO: 136943 - protein, 380 aa, Glycine max
  Coding DNA Sequence Number=SeqID_20165
  Gene Ontology: Cellular component=cellulose and pectin-containing cell wall
  Homolog annotation: Hit_ID=Q9SII5; Match level="QueryCoverage=82%, HitCoverage=86%, E-value=1e-118, Identity=64%"; Hit description =Expressed protein
  Pfam annotation: Domain name=Phi_1; Domain location=94-377; Score =581.6; E_value=7.5e-172; Accession=PF04674.3; Description=Phosphate -induced protein 1 conserved region
MDPQKAFPDKGNCAEEFFNSALNIPQKAFPVEGKFWNLRHGKRKISKHMLKWVTTTNEEVQTLNTNTHFNPQVPPLRTLSSSKRFEGSSEFVKLKYHMGPVLSSPINIYLIWYGKWPQSQKLLIKDFLNSISDDHHRASPSPSVSDWWRTVSLYTDQTGANISRSVSIAGEYSDLRYSHGTHLTRLSVQDVIATAVQAKPFPVDHRNGIYLILTAEDVTMEDFCRAVCGFHYFTFPSKVGYTLPYAWVGNSGKQCPEVCAYPFAVPGYMGGGGPGHLTPPNGDVGVDGMVSVIGHELAELSSNPLVNAWYAGEDPTAPTEIGDLCEGLYGTGGGDGYIGSVMKDGEGRTFNLNGRNGRKFLVQWIWSPVLKACAGPNALD

SEQ ID NO: 136944 - protein, 120 aa, Glycine max
  Coding DNA Sequence Number=SeqID_20166
MVVAIGRPEHSWRVHSAEIDVTVKQYFRPTPKSYRMSTSMTPKSMEQLTQNIRDQLKESVIEKRNMGYMYVDDNPSCPIALVRVYERSTTVHNIPLGNDQVNVGVEEVRDVDAHVPIPTQ

SEQ ID NO: 136945 - protein, 73 aa, Glycine max
  Coding DNA Sequence Number=SeqID_20167
MKGGSVVDSIAYATEFGIVGSLFLSNTVDKENALDALMSSAEMWKPLLPSSSDRFEIWEDYMTWIIGFCFPGT

SEQ ID NO: 136946 - protein, 106 aa, Glycine max
  Coding DNA Sequence Number=SeqID_20168
  Subcellular localization annotation: CTP_CleavageSite=50; ConfidenceScore=5.56e-01
MARLGEYVTSALSNNSSAHIVTSPSSPPPPPESAPSASSPKKTRKTARLRSLAIRPIKMERLVVHMDPTTRKANCPQRKKLRMHLGIVARDKVNITFVNWKEVPTT

SEQ ID NO: 136947 - protein, 205 aa, Glycine max
  Coding DNA Sequence Number=SeqID_20169
MATMAELLTWLFLPRGIRRGVGDLGTQGSHGALGLATRVGEDYRALYALGFCKGGIYDSALATTSNIGSVRRPWYYGGSRRLEIGNMWKDKADNRYEWENFRVAGNHIRKLEAVAIAYTAQKDVFINNNNKDINVGHNGSGGNDGGGGDVNGSSDTNGGGSDNVVIAMMLVVNDGGGSGDGSGISGGGNNINDFSGDNEVDDDDK

SEQ ID NO: 136948 - protein, 394 aa, Glycine max
  Coding DNA Sequence Number=SeqID_20170
  Homolog annotation: Hit_ID=Q9LIJ8; Match level="QueryCoverage=98%, HitCoverage=98%, E-value=7e-97, Identity=56%"; Hit description =Arabidopsis thaliana genomic DNA, chromosome 3, BAC clone:F5N5
  Pfam annotation: Domain name=DUF506; Domain location=81-301; Score =368.0; E_value=1.5e-107; Accession=PF04720.3; Description=Protein of unknown function (DUF506)
  Subcellular localization annotation: CTP_CleavageSite=52; ConfidenceScore=5.34e-01
MPPMKIQPIDVDSQKLAVIRNDAVKPVLKSRLKRLFVFDRQFSNVLKTSSTSSSEKPAAGEAPQSNTKDGAAEFEPSSVCLDKMVQSFIEESNEKPAPATAKCGRNRCNCFNGNNNDSSDEELDIFGDSVSSGSFCDASDALKSLIPCASVMERNLLADTSKIVDKNSKVYKRKDDLRKIVTESLSSLGYDSSICTSKWDKTPTCPAGEYEYIDVVVEGERLIIDIDFRSEFEIARSTGTYKAILQSLPFIFVGKSDRLCQIVAAVSEAAKQSLKKKGMHVPPWRKAEYMLVKWLSSSCTRANLTSSSAVNDSTENLSDGGGGGYDAAESECGELELIFGEKTSPPKPETFPGVEKSFPPVATPTWQPPAVRVRSVERGVKVVTGLASLLKDKP

SEQ ID NO: 136949 - protein, 66 aa, Glycine max
  Coding DNA Sequence Number=SeqID_20171
MSVQCIDRVVELKIPAILQSFVGMPLLHVIQLALPNMVLQIQYAICASLQYNAFTVVSLVIAMLSG

SEQ ID NO: 136950 - protein, 49 aa, Glycine max
  Coding DNA Sequence Number=SeqID_20172
  Gene Ontology: Mol. function=signal transducer activity; Biological process=G-protein coupled receptor protein signaling pathway
  Homolog annotation: Hit_ID=P49084; Match level="QueryCoverage=78%, HitCoverage=10%, E-value=1e-10, Identity=84%"; Hit description =Guanine nucleotide-binding protein alpha-1 subunit
DAEIETRIKLETKVEKHIQKLLLLGAGESGKSTIFKQARNCIFSTACEL

SEQ ID NO: 136951 - protein, 202 aa, Glycine max
  Coding DNA Sequence Number=SeqID_20173
  Gene Ontology: Mol. function=hydrolase activity, acting on ester bonds; Biological process=lipid metabolic process
  Homolog annotation: Hit_ID=Q7X9E8; Match level="QueryCoverage=38%, HitCoverage=78%, E-value=4e-14, Identity=46%"; Hit description=Lipase
  Pfam annotation: Domain name=APS_kinase; Domain location=107-201; Score=-81.3; E_value=0.00064; Accession=PF01583.10; Description =Adenylylsulphate kinase
MDLPGFMESLVKQMSVNLKRIHSLGIKKVAVGLLQPIGCFPVLNVIFCRTNCIGLLNVISKDHNKMLLKAVQEPNKEAAVKSVFITLDLYNSFLSAIETMQKKRAEKSTLMNPLQPCCEGNKLEDSCGSVDDEGSKKYSLCENPKLSFFWDTLHPSQNGEVAKLFVDAGLICVASLISPYRRDRDTCRAMLPDANFIEARHH

SEQ ID NO: 136952 - protein, 46 aa, Glycine max
  Coding DNA Sequence Number=SeqID_20174
MMHAPDSTLRCNVGTVLSLSRPPGCARNSPPPIGDQPGSPKVFPTR

SEQ ID NO: 136953 - protein, 34 aa, Glycine max
  Coding DNA Sequence Number=SeqID_20175
MASEFNGFHSHRSETFKPDDAQDSSMLGGHDQVR

SEQ ID NO: 136954 - protein, 86 aa, Glycine max
  Coding DNA Sequence Number=SeqID_20176
MGIKHLTRTKERSHVIKQRSPDEIRWAKRASTAKCTFSSLSTTEESGRASISRPRAKREISVLSTTVVFSQAQRTTDAKLKSTYLR

SEQ ID NO: 136955 - protein, 393 aa, Glycine max
  Coding DNA Sequence Number=SeqID_20177
MASRKRKVIASRPQPHYDTYRFTSKDALNRYADNIRGWNILLERNPPKQVRVRGHLIKFDVDSLNTFLETLVVLEPGETLPTYSKFCRLRPDPQELATRLCIPCRGFVLNAEGLPWKFLRKDLTTLVQTWSVLSYFNLAPTSHTSDLNLDRARLVYGLVMKMDMNVGALISGQITLMAQSNSSRLGFLALITALCMAQGVTSDSLIFESLSPAINLAYIKKNCWNLDDPTVSFPWTHKATARGSEGPSSAPPQTSTAPSPIPSAPVPVTSGPSAQSIDLMMAMLKSIHQGQYLVAWPRVQPSSHGRGEASVAQELEPNPETTPAAQEDDLEATPPESFVPEIDPEADPMITEASPQASPVSTPVLELSTPQGSPAGMPGLHLTDDEAMDRDPP

SEQ ID NO: 136956 - protein, 242 aa, Glycine max
  Coding DNA Sequence Number=SeqID_20178
  Homolog annotation: Hit_ID=Q9FMR2; Match level="QueryCoverage=65%, HitCoverage=64%, E-value=2e-18, Identity=39%"; Hit description =Arabidopsis thaliana genomic DNA, chromosome 5, P1 clone:MWD9
MSVSGSLQHIFENPSLPENPSLLESLSGIRIKPPVKSIHSFTEIFGELHFKENHHHHHNNNNEYVSNTTPTTTTQHKNMHLCTEGLGFESSDDVEDRKNNEVNSDERENECYENKKSLGLEDWCEWRTRSSIRVNNKKKNDGVEYPPPISSIGRSGKPCVSFMSYRDNGRFVLKEVRIPIQEFLHAHREDGRLKLHFVQPDQDDDDGDCCNQEEEEDYDEVESVVGEEHMGKENDDESAIDI

SEQ ID NO: 136957 - protein, 161 aa, Glycine max
  Coding DNA Sequence Number=SeqID_20179
  Gene Ontology: Mol. function=nucleoside-triphosphatase activity; Cellular component=chloroplast
  Homolog annotation: Hit_ID=Q2PMM5; Match level="QueryCoverage=99%, HitCoverage=10%, E-value=4e-72, Identity=85%"; Hit description =Protein ycf2
DHGILFYQIGRAVSQNVLLSNCSIDPISIYMKKKSCDGGDSDLYKWYFELGTSMKKLTILLYLLSCSAGSVAQDLWSLPGPDEKNGITSYGLVENNSDLVHGLLEVEGALVGSSRTEKDCSQFDKDRVTLLLRSFRDKRIIYDEEDELQENDSEFLQGGTM

SEQ ID NO: 136958 - protein, 104 aa, Glycine max
  Coding DNA Sequence Number=SeqID_20180
ATVTTTVLKVTALCPCKGCNNRIQRVVVGEVKMKIEAIVTTAVLTVTPLCPCKGCNNRIYRANILVELCSTQMTGTDSDTTIIDGLGVAGWGVSGIEAEVAMLG

SEQ ID NO: 136959 - protein, 415 aa, Glycine max
  Coding DNA Sequence Number=SeqID_20181
  Gene Ontology: Mol. function=drug transporter activity; Cellular component=membrane; Biological process=multidrug transport
  Homolog annotation: Hit_ID=Q1SB90; Match level="QueryCoverage=95%, HitCoverage=73%, E-value=1e-120, Identity=52%"; Hit description =Multi antimicrobial extrusion protein MatE
  Pfam annotation: Domain name=MatE; Domain location=21-181; Score =130.1; E_value=6.3e-36; Accession=PF01554.9; Description=MatE
  Pfam annotation: Domain name=MatE; Domain location=243-406; Score =126.5; E_value=7.7e-35; Accession=PF01554.9; Description=MatE
  Pfam module annotation: Pfam domain module=MatE::MatE; Domain location=21-181::243-406
MHLNCMQVKEELKSLANIACPMMMTNVLLYSRSAISMLFLGRQGKVELAGGSLAIGFANITANSFLKGLTMGMDPICCQAYGAKRWSVLSQTFCKTLCLLLLVAIPISLLWLNMAPLLHWLGQDPEVTKVAQVYMVFSIPELLAQVHLNPLRSFLRTQGLTTPLTIAASFAAILHLPINYFLATYLELGVKGIALATGLNSINMILGLVLYLLVSKKPLKPWEGATILSSFHDWRPLLTLALPSCISVCLEWWCYEIMLFLCGLLSNPQTTVATMGVLIQTTGFLYVFPFSLSAALTTQIGHSLGAGQPSRAQITATIGLFIAFALGFSAFVFLLIVRNVWGKLFTNETQIVDMVTTILPILGLCEIGNWPQTAACGILSGTARPYVGARINLCAFYLIGLPVAVFAAFMHSDSH

SEQ ID NO: 136960 - protein, 96 aa, Glycine max
  Coding DNA Sequence Number=SeqID_20182
MIKHSTSRITDLSPPKCWQSPILPQVKLNVDGNYIPPSYRMGVGGLIRDAVGKWRFGFFQHIGVGDPTVAEIVAIKVRFQYCRIMGFKDVVCESNN

SEQ ID NO: 136961 - protein, 425 aa, Glycine max
  Coding DNA Sequence Number=SeqID_20183
  Gene Ontology: Mol. function=RNA-directed DNA polymerase activity; Biological process=RNA-dependent DNA replication
  Homolog annotation: Hit_ID=Q1SLA3; Match level="QueryCoverage=46%, HitCoverage=27%, E-value=2e-28, Identity=27%"; Hit description=RNA -directed DNA polymerase
MVPLEPPDTDAAVRSGNAIVSDKDGAMSLDFEEDDKLFSKFSITAQAFDHLCKPWEKVLSGGPWMVFDHYLVVRPLLPNIVASEAKIEKTVVWIHFPGEGTLLEFVEIDLSIPVVGKECQQSKGSNEVDGISNDSQPTEPSSNEVAVWSVKPRTEKGIDHGGGLGVGVVSASQGPSHASLGGGDEEGSSSMPRDVVNIRGTTNAKGQRRGTLNYEICHLVNRLRTFRTQDYLEAVCTMVTPSWLVTGDFNEIAKPFEVRLDKALVDQGWQLRFPEAYAENLCRVYCDHCQVLIMSEGQPLRSQNRPFRFQVAWATHRDFEKVVRQTWGRGSPDVLKSLQEEFLWLQKSHEKWVKFGDWNTHFFHAQTLTRWKRNKIIGLFFDDGGPSRLTEPVTVEEVRQAVMCMKSCKAPGPDNFQPFLYKQYY

SEQ ID NO: 136962 - protein, 48 aa, Glycine max
  Coding DNA Sequence Number=SeqID_20184
MQHDDELWEQLIKQCVQKPDMVGQCFIILAFYARFTYITTSYQDPVVE

SEQ ID NO: 136963 - protein, 82 aa, Glycine max
  Coding DNA Sequence Number=SeqID_20185
MEKERLLKLQTLDQTLVSREKHQLCKEMQRDQSEDQGIEVMESVGMLGTYLRKFLLKNGIILFAWGQAKCGKRGTISKKEQK

SEQ ID NO: 136964 - protein, 77 aa, Glycine max
  Coding DNA Sequence Number=SeqID_20186
  Homolog annotation: Hit_ID=Q1SR54; Match level="QueryCoverage=58%, HitCoverage=6%, E-value=2e-13, Identity=83%"; Hit description =Initiation factor eIF-4 gamma, middle; Initiation factor eIF-4 gamma, MA3
MSFTAYLITLALGRAKLGDAPAEVPAKKAKEKYIAPHLRARAGNKPEEYTQIRIRLLNRLSESNVESITGELSLIFQ

SEQ ID NO: 136965 - protein, 65 aa, Glycine max
  Coding DNA Sequence Number=SeqID_20187
  Homolog annotation: Hit_ID=Q1S419; Match level="QueryCoverage=50%, HitCoverage=3%, E-value=1e-07, Identity=81%"; Hit description=Cyclic nucleotide-binding; Ion transport protein
MTNWNYETVAFLHAPCELKLQSILQAWKVTEMRVEYFPLKEDVILQNEAPTDLYIFVIGAAFCGV

SEQ ID NO: 136966 - protein, 93 aa, Glycine max
  Coding DNA Sequence Number=SeqID_20188
MVKSRDELTAEINQGKIMTRSRLAAHCLLPTCSNRRCRNMPFCGRVKARLTGALSKGGKMRGVATNVYLWKTSGKPKETDQNENSKFGSCIYA

SEQ ID NO: 136967 - protein, 86 aa, Glycine max
  Coding DNA Sequence Number=SeqID_20189
MWMQFAEHLLPAGQLCLVPGQVSADYMEWFFRISHPFMIPTQAGDQPRDAPATDLEDYIQLPNPQVPVAFDPPPHVDDYEGYEAIA

SEQ ID NO: 136968 - protein, 388 aa, Glycine max
  Coding DNA Sequence Number=SeqID_20190
MILEIVDVLGSSFRAIMVVNTGPSQYRGRGGRGGRPFRGAGRGRGHGRGHGMGGGRHIPSHSSGPAFSNVPARVQPPVPPRKVCCEICKVECNSPEILEQHKVGRKHQKNMRVHEESQRRNAINGQQSEKIPTSQLNLTDQPKEVQESEKNECPTENMGSGVIINSHKEEMQLQNNVGNISEVPAEVPEGKTEDNSAARGQGLKRKKKGGKGGKYMRTNDGSKPVEPAQTMSFRCELCDVKCESQVVYQSHVAGKKHLSKLRRASSGVGQHQQQALSGALLGLQAIYPPDINALSNAINVQVQQGDNDPQVLLAQLLMTVLSQAQVPATAPVTGGVVAQIPVPTSMAGPSYEPQLLQTNPSGETKTELPGSSVGTQIEGGGSETKQQV

SEQ ID NO: 136969 - protein, 176 aa, Glycine max
  Coding DNA Sequence Number=SeqID_20191
  Gene Ontology: Mol. function=hydrolase activity, acting on ester bonds; Biological process=nucleobase, nucleoside, nucleotide and nucleic acid metabolic process
  Pfam annotation: Domain name=UPF0081; Domain location=15-142; Score =16.8; E_value=7.6e-08; Accession=PF03652.6; Description =Uncharacterised protein family (UPF0081)
MILWDRIDSVVLSKHTVLELRGQKLEVQIINIAEEEVLIHFISLVLLGLDPISLREVDEFIIGLPKSSDGKETPQSNKVRSVAGRLAVRAAERGWRVYLQDEHGTTEEAKDRMINMSLSKSSQQKKLDAYAAMMVLERYFSTSGQGTELVLPKNLELQAKLQRGPPKDVDFFSDED

SEQ ID NO: 136970 - protein, 97 aa, Glycine max
  Coding DNA Sequence Number=SeqID_20192
MDYSDYSYQQQPQQHSYGYDPSQIPIQPYDQSYAAYQQYYAYNPQYAYYPNAHQTQFQFQPETAPLHPPGVNPAALEPTPFIYESFSKGKLCGWVVT

SEQ ID NO: 136971 - protein, 52 aa, Glycine max
  Coding DNA Sequence Number=SeqID_20193
MEILRVAPCQLLLKHIASKVPIASQASDVGALRVNHPHGFDGYLLDPKTKLK

SEQ ID NO: 136972 - protein, 80 aa, Glycine max
  Coding DNA Sequence Number=SeqID_20194
MGLSINNQSQDKAAASPGLTKCGNFVAANTLIIQLVGDKPVQKCKYKGCEPQHSSQGKGNDIVASDYSLSLASAMAGGDT

SEQ ID NO: 136973 - protein, 310 aa, Glycine max
  Coding DNA Sequence Number=SeqID_20195
  Gene Ontology: Mol. function=nucleic acid binding; Cellular component= intracellular; Biological process=regulation of transcription
  Homolog annotation: Hit_ID=Q9M202; Match level="QueryCoverage=100%, HitCoverage=85%, E-value=9e-41, Identity=37%"; Hit description=Zinc finger protein-like
  Pfam annotation: Domain name=zf-C2H2; Domain location=227-249; Score =21.1; E_value=0.0039; Accession=PF00096.16; Description=Zinc finger, C2H2 type
  Pfam annotation: Domain name=zf-C2H2; Domain location=288-310; Score =19.6; E_value=0.011; Accession=PF00096.16; Description=Zinc finger, C2H2 type
  Pfam annotation: Domain name=zf-C2H2; Domain location=4-26; Score =19.5; E_value=0.012; Accession=PF00096.16; Description=Zinc finger, C2H2 type
  Pfam module annotation: Pfam domain module=zf-C2H2::zf-C2H2::zf-C2H2; Domain location=227-249::288-310::4-26
MEKHKCKLCLRSFANGRALGGHMRSHMMNLPVPPKQSELVPIQLSFEAESSPSQSSSSFYGLRENPKKNFRFADPEFSFAAAETSSVILQDRESETESSRNPTRRRSKRAWQQLGGDSGGGGVSDESEKKMMKVFDAVNKNNNESASSVSDTTTEEAVAFCLMMLSRDKWKENNKLLYDNKVEIAEYNDDYDDEEDEDEEEEEDEEIYESEEELKSVKKSNKVRGRYKCETCEKVFRSYQALGGHRASHKKIKLNNCENKNKNNNNNNDDEAEQLEVQHVVVVEKKIHECPVCFRVFASGQALGGHKRTH

SEQ ID NO: 136974 - protein, 178 aa, Glycine max
  Coding DNA Sequence Number=SeqID_20196
  Homolog annotation: Hit_ID=Q8H6T6; Match level="QueryCoverage=88%, HitCoverage=100%, E-value=2e-54, Identity=70%"; Hit description =Auxin-regulated protein
  Pfam annotation: Domain name=Auxin_inducible; Domain location=54-144; Score=116.2; E_value=9.2e-32; Accession=PF02519.5; Description=Auxin responsive protein
MDSDGGSKLTGIRQIVKIKEMLQKWQSVTLGPKPCNSLSDHVANDDGSISPLINKRVVNVISDNEDSCQSPAEPLPPADVPKGYLAVYVGPELRRFIIPTSYLSHSLFIVLLEKAAEEFGFDQSGGLTIPCEIETFKYLLKCMENEQKEQLGDSAQREDMEEVGEIIEVEHIKTFSPY

SEQ ID NO: 136975 - protein, 60 aa, Glycine max
  Coding DNA Sequence Number=SeqID_20197
MMKVIFVEELIPWSDNALIINVGIEVDVGHPGYIELFLLSICVDGNEVVVWHMSVGQVEE

SEQ ID NO: 136976 - protein, 197 aa, Glycine max
  Coding DNA Sequence Number=SeqID_20198
  Gene Ontology: Mol. function=lipid binding; Biological process=lipid transport
  Homolog annotation: Hit_ID=Q9M6T9; Match level="QueryCoverage=59%, HitCoverage=98%, E-value=2e-30, Identity=52%"; Hit description=Lipid- transfer protein
  Pfam annotation: Domain name=Tryp_alpha_amyl; Domain location=34-121; Score=102.3; E_value=1.4e-27; Accession=PF00234.12; Description =Protease inhibitorseed storageLTP f
MGKSVVEKLLWMAIVCLVLGVISITPKAQAAVTCNQVVSNLTPCISYVLNGGKTVPGPCCNGIKTLFNLAHSTPDRQTVCKCIKNAVSAFHYGKSNVDRAAALPKQCGVNIPYQISPSTDCTRIEWRLQVRVIYLWFISDFKNPNDMNSLEMVLLYAKSNSDIENDHGTGPGTSFCNEVSTKKIKTYNYAAYTLESA

SEQ ID NO: 136977 - protein, 512 aa, Glycine max
  Coding DNA Sequence Number=SeqID_20199
  Homolog annotation: Hit_ID=Q1SL66; Match level="QueryCoverage=99%, HitCoverage=83%, E-value=1e-164, Identity=54%"; Hit description =Aldehyde oxidase and xanthine dehydrogenase, a/b hammerhead; Membrane attack complex ...
  Homolog annotation: Hit description=component/perforin/complement C9
  Pfam annotation: Domain name=MACPF; Domain location=37-258; Score =54.9; E_value=2.7e-13; Accession=PF01823.10; Description=MACPerforin domain
MVEYFNQKANISQSFPLGTFNSAFSFTGSKHIDATETKSLSSDGFYIPLAKVQLTNAHLTLQENVKRDIPVNWDPPSLASFIENFGTHVITSITIGGKDVIFVKHHRSSPLSTLEIKNYIQDIGNQRFSDINNHTSSLQTKFKDKASFTLIPIPYSDLIQVVDPFSFNNQEIHPQSASGTYLSGKFNSFLNFLGYTQDVRVIFRRRGGDDLEQDHSMWLRTVWSSPDVIQMTFCPITDLIDEVPGKEQLTHAIGLYLEYKPPIEELRYFLEFQIAHVWAPLHERIPGQQRKEPICPSLQFSIMGQKLYVSQEQITVGRLPVTGLRLFLEGSKQNRLSVHLQHLSSLPKILRPYWDTDVTIGAPKWQGPEEQDSRWFEPVKWKNFSHVSTAPVENPETFIGEFSGIYVVTGVQLGVWDFGPRSVLYMKLLFSRLPGCTIRRSFWDHTPTNPDNSSFGSRENNTTGSKLFKYVDLSEMSKGPQDPPGHWLVTGGKLGVEKGKIVLRVKYSLLSY

SEQ ID NO: 136978 - protein, 124 aa, Glycine max
  Coding DNA Sequence Number=SeqID_20200
KPNSGSVWGSSEVCCCSVVFGIGNSVSWSLTGELRNLLAKEEDLYGADLQRVKSKAFLGGVLELEAKSLSLSTFTLSWNGMFELGGLSTEEAGPVGPEGFAAAGVVVGASDPTAVAAAAAARGS

SEQ ID NO: 136979 - protein, 39 aa, Glycine max
  Coding DNA Sequence Number=SeqID_20201
MTQPPMLRTCYLNMRVFGSKTMVVIVTPLPGYPVVCHVG

SEQ ID NO: 136980 - protein, 180 aa, Glycine max
  Coding DNA Sequence Number=SeqID_20202
  Gene Ontology: Mol. function=metal ion binding; Cellular component =integral to membrane; Biological process=ubiquitin cycle
  Homolog annotation: Hit_ID=Q9LZV8; Match level="QueryCoverage=78%, HitCoverage=91%, E-value=1e-37, Identity=54%"; Hit description=RING -H2 finger protein ATL5A
  Pfam annotation: Domain name=zf-C3HC4; Domain location=109-150; Score= 32.1; E_value=1.9e-06; Accession=PF00097.15; Description=Zinc finger, C3HC4 type (RING finger)
MQRRFLETELSMPPSYGGGNTSDTFISDANFDTNMVIILAALLCALICALGLNSIARCALRCGRPFGNETAEQAAARLAGTGLKRRELSRIPVAVYGAAGENTIPATECPICLGEFEKGDRVRMLPKCNHGFHVRCIDTWLLSHSSCPNCRHSLLEKPAAAPESGSGRRSEVVVVVEQAS

SEQ ID NO: 136981 - protein, 94 aa, Glycine max
  Coding DNA Sequence Number=SeqID_20203
MWTIFMNLVAKQPLLCVGFVGCEVIDKANLGSMRRMERWKKERFQVVSMIVVLSLIAFPTTVERGHSTVSLSSLCLEGVQGAVRGLTELEIGIA

SEQ ID NO: 136982 - protein, 238 aa, Glycine max
  Coding DNA Sequence Number=SeqID_20204
  Homolog annotation: Hit_ID=Q9SIA8; Match level="QueryCoverage=71%, HitCoverage=44%, E-value=3e-14, Identity=29%"; Hit description =Putative disease resistance response protein
  Pfam annotation: Domain name=Dirigent; Domain location=74-237; Score =40.9; E_value=1.9e-09; Accession=PF03018.5; Description=Dirigent -like protein
  Subcellular localization annotation: CTP_CleavageSite=58; ConfidenceScore=5.15e-01
MARLPSLMVKFMLLLFMTKFSSARTLGNPSSNHNHGHHRITFLMRDMFNGSTQYSEKPATTKVTGQLPFPKPLGFLPTKGGIPIPQSTPTTIPLTSSSTQTLDLSSIGFSFPTRATLQELEYGAVTPIDEELLHDDGDELHKLGRAQGVCVASSEDGSSHMVAITASFFKGEFQDGLRLFGVHKTDVFESHVAVIGGTGKYYGANGYAAVKVVDKVGSSEKEGKVTSSKFLLFDVYLS

SEQ ID NO: 136983 - protein, 239 aa, Glycine max
  Coding DNA Sequence Number=SeqID_20205
MGGLSMGSGDPGVILGGPMEESGGLGIMMGGLSTGSGEPGVMLGGPGTVSGVGVGKDTGGLGGPGKTGVGMVVEGVPGGGNTQNGGLFSGNGIGARPLNSLIDLSASGKEKANMLLSHELIAIDVNDIIKHLLTTMSERNSSQSEVEEKYPDILFHSTCFHDHDPLAVMVTAMPQDIKKKRLLIIAPLLHSNASALKDSKVEQREIDSLGGHNFDAQSSLVEDVSMKECQKCRKKCPQM

SEQ ID NO: 136984 - protein, 348 aa, Glycine max
  Coding DNA Sequence Number=SeqID_20206
  Homolog annotation: Hit_ID=Q7G3M2; Match level="QueryCoverage=24%, HitCoverage=25%, E-value=4e-22, Identity=56%"; Hit description =Expressed protein
  Pfam annotation: Domain name=X8; Domain location=259-343; Score =165.8; E_value=1.1e-46; Accession=PF07983.3; Description=X8 domain
  Subcellular localization annotation: CTP_CleavageSite=55; ConfidenceScore=5.27e-01
MAISSWLKSIFAFSFPDADKSMRLLRGPKHRRNTTNKNPKKLKTVKHFDENPTILSSNVQPYSLSSPFSLPPYESLAPIPLPENSPPFCVFPPPGTPSTTIPTPTGFQPTTPSPPYYDTSPVFPGPPSPPVSFPTPTPETVPGPPSITPGSPEPVLNPPIIIPSPPDSSMGPPRITPGSPEPILNPPIIIPSPPDSSMGPPYFEPTPPFIIPSPTGGITPGPPSPTEGTVPSPSVFQPPVVYPPPSVPPPPNYAPRTTLWCVAKPSVPDPIIQEAMNYACWSGADCTSIQPNGPCYEPNTVYAHASYAFNSYWQRTKGAGGNCEFGGTAMLVAVDPSEYHCHKMGLDS

SEQ ID NO: 136985 - protein, 540 aa, Glycine max
  Coding DNA Sequence Number=SeqID_20207
  Gene Ontology: Mol. function=IMP dehydrogenase activity; Cellular component=cytoplasm; Biological process=GMP biosynthetic process
  Homolog annotation: Hit_ID=Q9ZPA0; Match level="QueryCoverage=99%, HitCoverage=100%, E-value=0.0, Identity=84%"; Hit description =Inosine monophosphate dehydrogenase
  Pfam annotation: Domain name=CBS; Domain location=76-218; Score=19.9; E_value=0.0011; Accession=PF00571.18; Description=CBS domain
  Pfam annotation: Domain name=His_biosynth; Domain location=237-423; Score=-107.6; E_value=0.0024; Accession=PF00977.11; Description =Histidine biosynthesis protein
  Pfam annotation: Domain name=IMPDH; Domain location=22-530; Score =638.7; E_value=4.9e-189; Accession=PF00478.15; Description=IMP dehydrogenase  GMP reductase domain
  Pfam module annotation: Pfam domain module=CBS::His_biosynth::IMPDH; Domain location=76-218::237-423::22-530
MDFTTPPIEDGFTAEKLFTQGFSYTYDDVIFLPHYIDFAADAVDLSTRLTRRLPLAVPFVASPMDTVSESAMAAAMASLGGIAVVHSNVPAAVQAAILRRAKSRRVPILSDPAFAAPSAVVEHDDAFGASPFLLVTDTGTSAGKLLGYVARSDWTNQTDKGLRVGDYMAPPPKPAPWNADLNKINEIMESEKSGAVALERDGEVVDLVVREEVERVRGYPKLVAPATVGADGEFMVGAAVGTREDDKERLEHLVKAGLNVVVLDSSQGNSIYQLEMVKYVKRVYPELDVIGGNVVTMYQAENLIQAGVDGLRVGMGSGSICTTQEVCAVGRGQLWFRKLQTNGDDVTAIAVPETPKTLTDKIMINGGNDVKATAVYKVSSIAYKSGVPVIADGGISNSGHIVKALSLGASTVMMGSFLAGSLEAPGAYVYQNGQRVKKYRGMGSLEAMTKGSDARYLGDTAKLKIAQGVVGAVKDKGSVLNFIPYTLQAVRQGFQDIGASSLQSAHDLLRSRELRLEVRSGAAQVEGGVHGLVSYEKKYF

SEQ ID NO: 136986 - protein, 144 aa, Glycine max
  Coding DNA Sequence Number=SeqID_20208
  Gene Ontology: Mol. function=nucleic acid binding; Biological process= transport
  Homolog annotation: Hit_ID=Q8H6Q8; Match level="QueryCoverage=100%, HitCoverage=42%, E-value=9e-17, Identity=35%"; Hit description=CTV.20
MVATAYQTSHECSEETIIDILVAGFSGQLKGRWDNYLTNEEKSKIYSVVKIDLNGKVITIDDDKEIPDAVNTLIFTIAQHFIGDPSLWKDRSAELLSNLKCRTLADFRWYRDTFLTRVYTREDSQQPFWKEKFLAGLPRSLGDK

SEQ ID NO: 136987 - protein, 109 aa, Glycine max
  Coding DNA Sequence Number=SeqID_20209
MLQYMTKSDQRTKFVESQLTNIQSLLSQRQLGNLPSEYDQTLRENAEVVMTKSKRVQEDSKEKEDFSLKAADDILTVKDRVPKKVDVPTDRNSMPKKEKDKKKEILTSL

SEQ ID NO: 136988 - protein, 213 aa, Glycine max
  Coding DNA Sequence Number=SeqID_20210
  Gene Ontology: Mol. function=nucleic acid binding
MTANQTQTFIDYLTSTLRDTNPILLLKMLEGITFDFKHGFLQMLENNLFSGVAPKDPMQHLRKFIKLTNTMKKIKYQLNTSDFMPFASFLIGRHAIGCVHCQRTLSPHGTNAQERLQEMIRSCPHHGFSQQKLVHIFCGRVSLHDRTNLGVACGSNLMLKPPADDIKIIEDMCFNLYNNSVNKRIMKRDVNHVENEDSQIELGKQMQALYTKD

SEQ ID NO: 136989 - protein, 172 aa, Glycine max
  Coding DNA Sequence Number=SeqID_20211
MEADKDVPIILGQTFLSTCDLLVEVSLGRLTLRLADERIMFNLPDTLKQPSSFASCSYTEFVDMSDALMEGVFSSVGMPNPLERVFTDEDLNWDLNPEVQEILIFLHSQHNPRPSSLHETKKGKLLEVRRDNKEAFERSIHDIKGLYPITTPIESTLKKGFHPNGYPKGDLI

SEQ ID NO: 136990 - protein, 464 aa, Glycine max
  Coding DNA Sequence Number=SeqID_20212
  Gene Ontology: Mol. function=RNA-directed DNA polymerase activity; Biological process=RNA-dependent DNA replication
MKLVESQLTNIQSLWSQRQLGNLPSEFDQTLRENAKVVMTRSKKVQEDFEEKEDSSLKAANDILTVKNRALEKVEVPTYRNSMPKKERDKKKEILTSLQVSLTFPHIVKSDQRDVQFKKSLKVMRKLHINLHFVEAILQMSSYAKHLKEILSNKEKLENFGTVGFNDECSAMVIRKLPPTMKDLDKFIIPCLIEGFYFDKCLCDLGGGINLMPYPVFKKLGITDLEPTNIFIHLVDLSVVYSREAIEDVLVKVDKFIFSIDFVILDLEADEDAPIILQRPFLSTRDLLVDVRLGRLTLILGGAKVGAFPRVGMYDLLERILTNEDLDWELDLEVEEILSFLHSYYSLKSFSFERLEYGNGLKPKPFVEELPEVELKPIPSNLKYVFLNPPSSLPVVIVVGLHETEDKLLWVLKGNKEAFGWNIHDIKGLDSTLGTHKINTKDGFPPKRLPQRRLNPNIMKVVKG

SEQ ID NO: 136991 - protein, 130 aa, Glycine max
  Coding DNA Sequence Number=SeqID_20213
METCFHCMPAQRKLGGLREMREKRRCGEVREEGRRVGCVVKEEGGSERGREKGWGCRKKGEFLLLKKPNHEHPLTILEEEEEKRVWKEDKNGIYSIKLAYHVIKANIGGAKDVLFFEKMWVRVRGIPLKV

SEQ ID NO: 136992 - protein, 119 aa, Glycine max
  Coding DNA Sequence Number=SeqID_20214
MAWRNIRAHVKQVLLRIVGYGIIYDKFEQAKQTLFVLPSVPSTLVAPSIPIPLVGIMDRIAELVVKVFSAPVIVVAKNASIATPTTNVGPLDQAKGDGGNVDTSLIEPTDMVTDSVANP

SEQ ID NO: 136993 - protein, 64 aa, Glycine max
  Coding DNA Sequence Number=SeqID_20215
MSKFHENPTVNETEIVILLKPFWVSAGKENAEMRKVRWPAGKREGFERREKKRNCETEEAEESV

SEQ ID NO: 136994 - protein, 1408 aa, Glycine max
  Coding DNA Sequence Number=SeqID_20216
  Gene Ontology: Mol. function=RNA-directed DNA polymerase activity; Biological process=RNA-dependent DNA replication
  Pfam annotation: Domain name=Exo_endo_phos; Domain location=408-824; Score=25.0; E_value=0.00027; Accession=PF03372.13; Description =EndonucleaseExonucleasephosphatase family
  Pfam annotation: Domain name=RRM_1; Domain location=75-145; Score =13.8; E_value=0.0076; Accession=PF00076.12; Description=RNA recognition motif. (a.k.a. RRM, R
  Pfam module annotation: Pfam domain module=Exo_endo_phos::RRM_1::RVT _1; Domain location=408-824::75-145::1029-1314
MRGGARRGVDGGRGDSWRWENGGGAFHTKVQYDDGWNLVQYRKRWDGGRGSGYTKPDIYQSRDQRSKEQLQSTTIYITNFAEEMNAKHLFNSLRSYGDLQEVVIPTRRNRMGKRFGFARFCRIQEPERFAMKLDNIFIGRDKLFANLPRYQRDQAKKMPGGPISKESEPVVRKSTQVWKPKVIGQACKITNGSMHDQMGGELKYEAKVDDMKRLSKAMVGVVIHPGQSYLIQEHFAMQGVSTILVTPLGANMVLLEGSVDDEDFQGYIEEAKGWLQQWFKEIKPWNASIVDEERLVWVRCYGVPSHVWDSDFFSFLTKDIGVFVHSDDNTMKRKTMDVARLMVRTVKKEAINMIRKDQSKRELYNDENSSSDDEVWPESSPEDDLVEEDDEAGSYGNNSTLNEALIGISISNSNVGNNELVSKSGNQELGEDYVEEIKDHSKDNSLCWNSAGDFMKRLESQQVGEYSANSHNHLGPVFNNNSGPLLERLSSIQRNNLSSQIPRVKQRKLSKRGLLSKPGWASRSNKVNHDLKSISQQSSMNEAPVKSCTAIEQASTHFSGGSVLCGGSLSSADMRLCNNKFWVLQSKSVAQRVWEEARHIGVEGTEKDEVYIQQINLCESRDAVAKQQRGWETIQREGGWPKLSIQLIDWIALPSSGLSGGLLMMWKRGLWVVKSNFSGHGFIGVCVEFKSKLFFFVNVYAPCNTAGRRLLWETLYNLKYGSSAGEWCLVGDFNAVSNREERTGRSENWGHIDMVDFNAFVNEMNLIDPPLHGNKFTYFCSDGIAASRLDRFLVSDGIMNLWQVKGQRVGKRDISDHCPIWLECSNPNWGPKPFRFNNCWLEHDGFKSFIVEEWKKIQITGRKAYVIKEKLKIIRESLKKWNKEVFGWLDLNIENIVADMNELDRGIEEGCNLNVVVKKKEANALFWQQLMMKESLLKQKSRLHWIKEGDSNTKFFHSCLQDRRRKNQILSLQVEGRCVEQVGEVKMETLGSEENSFLVAPFSEEEIKDVVWSCDGNKCPGPDGFNLRFIKECWEFVKDDIVEFLQEFHITGVLPKAITASFLALIPKSAFISGRQILDGVLMINEVVDLSKRRKDECLLFKVDFEKAYDSVSWSFLTYMLNRMGFDKRWIGWIQACVFSSSMSVLVNGSPTDEFTAHKGLRQGDPLSPFLFLIVAQGLSGLVQKASQVGNFDGYQVADGLNLSLLQFADDTILLGKGSWKNLWSIKTTFRSFELVSGLRFLGVPIGANPRRRSTWKPVVDSMRAKLSCWRGRNLSIGGKEERKICWVSWEDICKPKKEGGLGVKNLEVFNISLLAKWKWRCIHDHKALWRDLLAFRYGSEPLKDAFPELFAISSQQLVSIGNAGSWRRDQWTWGLTWKRQLNPKEEESLHSLETILVDVHLVAESHD

SEQ ID NO: 136995 - protein, 42 aa, Glycine max
  Coding DNA Sequence Number=SeqID_20217
MQLKAHAQSPSITWKYQHILKLISSMQGYQKLESQPRLVGAL

SEQ ID NO: 136996 - protein, 101 aa, Glycine max
  Coding DNA Sequence Number=SeqID_20218
MSRNFTYCATKGAKYLEAVKQRLHAIKQWSPDEIRKIVPQSSNGLRRMRRKVMKKEDPRRHILHRMTITHPMVRRRRSTFYPRTMRAMTTSLKKIKQKAKV

SEQ ID NO: 136997 - protein, 141 aa, Glycine max
  Coding DNA Sequence Number=SeqID_20219
  Homolog annotation: Hit_ID=Q6CQF3; Match level="QueryCoverage=39%, HitCoverage=59%, E-value=2e-08, Identity=72%"; Hit description =Kluyveromyces lactis strain NRRL Y-1140 chromosome D of strain NRRL Y- 1140 of Kluyveromyces lactis
MPERGEARGNSVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPG

SEQ ID NO: 136998 - protein, 464 aa, Glycine max
  Coding DNA Sequence Number=SeqID_20220
MVLQFFITSSVLDLTIVGLDDGDGDSNAQGQCPHYLKTSCKANLDLGSAVYLLGYTEKQELTVGEGKVVIATDNLIKLSTDGIQWSPGSAGFDVHGNLAFMICDPMKLATSPNTKSSSTSTSSSSSSWKKDHPMQFGIPISVICDWLNQHWEGNLDELNKPKLPIMRLMSTGQKSDHSCASFTLRQVFKSTEGDDDGTPSSSNNALKARDQGPSSSAATNTVEEESLITNPNAAHVQGIPTPEIYESPRVTAGPLRRKENIPLQLLDINFPPRTAKHAVFPQLSKPKCAENLAKEPLPENQVEGEQNKHTRPTTPIPDVSSTGSVNGAAQSEVQSSSSPVEVHEMQNGYSSEGETMYSAETAESRNYTSPRELKFQQVGRSQSCVSYNRWGAAPRSQVARGMMVENQRSFMHVKRMYSQGATTSQRSNDYFSPTVSSIMKRNSSSSKPPPRQSAVHSPSPRWMF

SEQ ID NO: 136999 - protein, 161 aa, Glycine max
  Coding DNA Sequence Number=SeqID_20221
LESGYGPSCIVQTTDGLRCQEGIVRQRKGLKRMTGLECCYHRKKCHDALLWQLKWNFTSRGCDVWCGEPSSLLQERAAMRLAAEDSSFVVRAKYWHAAIGRLMKSQRLNWKKSDTFIRVWHELAGDSVTAHWLVRTLDENEVARMLFRKGRSKGRRTLQFA

SEQ ID NO: 137000 - protein, 281 aa, Glycine max
  Coding DNA Sequence Number=SeqID_20222
  Gene Ontology: Mol. function=protein binding; Cellular component =integral to membrane; Biological process=xylan catabolic process
  Homolog annotation: Hit_ID=Q1SWI7; Match level="QueryCoverage=99%, HitCoverage=88%, E-value=8e-94, Identity=36%"; Hit description =Leucine-rich repeat
  Pfam annotation: Domain name=LRR_1; Domain location=109-128; Score =0.7; E_value=2.1e+02; Accession=PF00560.23; Description=Leucine Rich Repeat
  Pfam annotation: Domain name=LRR_1; Domain location=12-35; Score=4.9; E_value=34; Accession=PF00560.23; Description=Leucine Rich Repeat
  Pfam annotation: Domain name=LRR_1; Domain location=130-151; Score =4.0; E_value=51; Accession=PF00560.23; Description=Leucine Rich Repeat
  Pfam annotation: Domain name=LRR_1; Domain location=158-177; Score =11.6; E_value=1.9; Accession=PF00560.23; Description=Leucine Rich Repeat
  Pfam annotation: Domain name=LRR_1; Domain location=182-204; Score =7.5; E_value=11; Accession=PF00560.23; Description=Leucine Rich Repeat
  Pfam annotation: Domain name=LRR_1; Domain location=206-228; Score =10.0; E_value=3.9; Accession=PF00560.23; Description=Leucine Rich Repeat
  Pfam annotation: Domain name=LRR_1; Domain location=230-253; Score =12.2; E_value=1.5; Accession=PF00560.23; Description=Leucine Rich Repeat
  Pfam annotation: Domain name=LRR_1; Domain location=255-277; Score =10.8; E_value=2.7; Accession=PF00560.23; Description=Leucine Rich Repeat
  Pfam annotation: Domain name=LRR_1; Domain location=60-83; Score=5.4; E_value=28; Accession=PF00560.23; Description=Leucine Rich Repeat
  Pfam annotation: Domain name=LRR_1; Domain location=85-107; Score =6.8; E_value=15; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=109 -128::12-35::130-151::158-177::182-204::206-228::230-253::255-277::60- 83::85-107
VVKEDDLANLTSLTEFGASGNNFTLKVGPNWIPNFQLTYLEVTSWPLGPSFPLWIQSQNKLEYVGLSNTGIFDSISTQMWEALSQVLYLNLSRNHIHGEIGTTLKNPISIPTIDLSSNHLCGKLPYLSSNVLQLDLSSNSFSESMNDFLCNDQDEPMQLEFLNLASNNLSGEIPDCWMDWTSLVDVNLQSNHFVGNLPQSMGSLAELQSLQIHNNTLSGIFPTSLKKNNQLISLDLGANNLSGTIPTWVGENLLNLKILRLRSNRFASHIPSEICQMSHLQ

SEQ ID NO: 137001 - protein, 165 aa, Glycine max
  Coding DNA Sequence Number=SeqID_20223
MYYPGHHQHQSYVEPNVPPVHVPEFMSQHHPSQAQYQSTSFSGHASQGCQQSFQPLGFSSYIPQYSFQVPSISNVFFGSSQMLATTFNTPPSTYNLAPLSSCYRPSLATQICDMSHEDEDENEDEDVLEAHVMCTLHVPLYFITLEKFVTSESGPFSIHIHLISL

SEQ ID NO: 137002 - protein, 69 aa, Glycine max
  Coding DNA Sequence Number=SeqID_20224
MKKIHDEALPRRFRERFREDSSPFFIILRSCFVILRSSTVLKELRRSDFLITIEKYVGARETPLSTTKR

SEQ ID NO: 137003 - protein, 147 aa, Glycine max
  Coding DNA Sequence Number=SeqID_20225
MILAPNNDNDNHNAFGRWKKPLQGTTKINYNGPYLNSVALAACGVVLWNDKSACDLGYRTIVVENDCIEVVKLMEDPRYHKGQFVDLISEIVKTKENFTSCSIVHPPQVAKPPCLLREPSVLRAAHSSNRALRWMSAFTFRPRFYTC

SEQ ID NO: 137004 - protein, 330 aa, Glycine max
  Coding DNA Sequence Number=SeqID_20226
  Gene Ontology: Mol. function=protein binding; Cellular component =integral to membrane; Biological process=protein amino acid phosphorylation
  Homolog annotation: Hit_ID=Q1T2W9; Match level="QueryCoverage=98%, HitCoverage=49%, E-value=2e-69, Identity=37%"; Hit description =Leucine-rich repeat; Leucine-rich repeat, cysteine-containing type
  Pfam annotation: Domain name=LRR_1; Domain location=124-146; Score =4.9; E_value=35; Accession=PF00560.23; Description=Leucine Rich Repeat
  Pfam annotation: Domain name=LRR_1; Domain location=148-170; Score =15.6; E_value=0.18; Accession=PF00560.23; Description=Leucine Rich Repeat
  Pfam annotation: Domain name=LRR_1; Domain location=172-194; Score =13.7; E_value=0.69; Accession=PF00560.23; Description=Leucine Rich Repeat
  Pfam annotation: Domain name=LRR_1; Domain location=196-215; Score =8.4; E_value=7.8; Accession=PF00560.23; Description=Leucine Rich Repeat
  Pfam annotation: Domain name=LRR_1; Domain location=24-47; Score=3.9; E_value=54; Accession=PF00560.23; Description=Leucine Rich Repeat
  Pfam annotation: Domain name=LRR_1; Domain location=50-73; Score=9.0; E_value=5.8; Accession=PF00560.23; Description=Leucine Rich Repeat
  Pfam module annotation: Pfam domain module=LRR_1::LRR_1::LRR_1::LRR _1::LRR_1::LRR_1; Domain location=124-146::148-170::172-194::196 -215::24-47::50-73
MEILDIGHNRVHDHFPCWLKNISTLRILILQSNKLHGSLKCGGAKVVWPHLQIFDLASNNFGGGIPLSFFGNWKAMIADKNDGSLSKSDHLQFEILKLDQVYYQDRVTVTSKQLQMELVKILTIFTAIDLSCNKFEGQIPEGLGELNALYILNLSHNAFSGRIPPSLGNLKDLESFDLANNNLSGNIPTQITDLSFLSFLNLSGNHLVGRIPTGTQIQSFPADSFKGNDGLCGPPLSQNCSGDGMKETPSPASNSNVDTKNSIYWNFISVEVGFIFGIGIIVLPLLFYMPWRTRYWKFVDGILYHTFPQLDFVHERRGGQSYSILRWKSH

SEQ ID NO: 137005 - protein, 144 aa, Glycine max
  Coding DNA Sequence Number=SeqID_20227
  Gene Ontology: Mol. function=nucleic acid binding; Cellular component= intracellular; Biological process=chromatin modification
  Homolog annotation: Hit_ID=Q4U314; Match level="QueryCoverage=77%, HitCoverage=20%, E-value=4e-50, Identity=82%"; Hit description =Cys2/His2 zinc-finger transcription factor
MALISDQQSNFKHFCKICKKGFGCGRALGGHMRAHGIGDESGHMDDDDQASDWEDRLGGNVPPSNKRMYALRTNPNRLKSCRVCENCGKEFLSWKSFLEHGKCTSEDAESLVSSPGSDADDGDIGGGGRRGCGWSKSKRSLRTK

SEQ ID NO: 137006 - protein, 75 aa, Glycine max
  Coding DNA Sequence Number=SeqID_20228
  Subcellular localization annotation: CTP_CleavageSite=48; ConfidenceScore=5.65e-01
MTTDSPPLRMFPRTRPNSLKTVPSGVANCRNLPLGGRATRGSRVRLPRKENARSRHQRLFEENVGKIGKGVVYEL

SEQ ID NO: 137007 - protein, 132 aa, Glycine max
  Coding DNA Sequence Number=SeqID_20229
  Gene Ontology: Mol. function=DNA binding; Biological process =regulation of transcription
  Homolog annotation: Hit_ID=Q1SCV3; Match level="QueryCoverage=81%, HitCoverage=14%, E-value=6e-29, Identity=53%"; Hit description =Octicosapeptide/Phox/Bem1p; Plant regulator RWP-RK
MLRALSFFKESGYCEFSMTFTFSTEGKWGCFLGLYGGVFTSKVSEWTSNGCYYSMSECLRFEHAINQKVHGSTIFSIFDLHSQLPCYAVLELVTTNEKPIFDRELEIVCGAENWTFTLFGCLTTSDVECDGS

SEQ ID NO: 137008 - protein, 1043 aa, Glycine max
  Coding DNA Sequence Number=SeqID_20230
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=70%, E-value=0.0, Identity=53%"; Hit description=Chromo
  Pfam annotation: Domain name=RnaseH; Domain location=698-810; Score= -34.2; E_value=0.089; Accession=PF00075.14; Description=RNase H
  Pfam annotation: Domain name=rve; Domain location=939-1043; Score= -1.6; E_value=0.0081; Accession=PF00665.16; Description=Integrase core domain
  Pfam annotation: Domain name=zf-H2C2; Domain location=883-921; Score =10.5; E_value=0.015; Accession=PF09337.1; Description=His(2)-Cys(2) zinc finger
  Pfam module annotation: Pfam domain module=RVT_1::Retrotrans _gag::RnaseH::rve::zf-H2C2; Domain location=480-649::1-75::698 -810::939-1043::883-921
MFSRTNPFHSWVAFTRALELEFGPSPYECPRAHLFKLTQATTVHDYYVQFTALANRVQGIMPEALLVCFIGGLKSDIRRDVIAQAPTTLIRTVSLAKLYEEKYVVKPRSYPSQPWPKTHNHPNSLPISQSIKSTSLPPLPPSPNQSYPTNNLKPTNVKKMTPAEMHIRREKGLCYTCDERFTLNHRCPNKQYLLLYMDDDDLNELQPDPPDSSAPTDIENSLDHHLSYNALKGSCGLDTMKFQGSINGMHVQILVDSGISDNFLQPRLAHCLKLPVEPIPNLQVLVGNGNSLVAEGLVEELEVKIQGHSFKLPVYLLPVTGADLVLGAAWLATVGPHIYDYSKLTLKFYLNNQFITLYGEQPKLPTQAQFTHLRRMHNTHAIAELFTLHIQQLDSPQDQWLDLPTDMEPEMALLLHTYKEVFSIPSGLPPPRAQNHSIPLIQGSGPIKVKPYRYPHSQKFQIESTIHDMLREGIIVPSTSPFSSPIVLVKKKDDTWRFCTNYRALNAITVKDSFPIPTVDELIDELHGAQYFSKLDLRSGYHQILVKEEDRHKTAFRTHQGLYEWLVMPFGLSNAPATFQSLMNEVFQGLLRKYVLVFFDDILVYSPSWDLHLHHLEVVLKLLLQHRLFARLSKCSFGLQQIDYLGHTVSGQGVAMDKDKLKGFLGLTGYYRRFIKGYATIASPLTNLLKRENFLWNQTAVASFTNLKSTITQAPVLSLPDFSQTFILETDASEFYAITEAIAKFRHYLLGHKFIIRTDQQSLRGLTDQAIQTPEQQKWLHKLLRYDFSIEYMPGKENIVVDSLSRSFFMAWSQPQLSILSNLREAILADPKLKAIVDLCITNQPHNPNYSVRDHLLFWKGRLVLPADHEIVQKILHEFHSSMLDGHAGFARTLARISAQFFWHGMNRDIKAYVQNCLTCQQAKTETALPVGLLQPLPIPDQIWEDIAMDFITGLPSSGGYTVILVVIDRLSKYAHFSPLKANYSSKVVAETFMKSVVKLHGFPKTIVLDRDKIFTSQFWQHLFRLSGTSLNMSTAYHPQSDG

SEQ ID NO: 137009 - protein, 331 aa, Glycine max
  Coding DNA Sequence Number=SeqID_20231
  Gene Ontology: Mol. function=structural constituent of ribosome; Cellular component=intracellular; Biological process=translation
  Homolog annotation: Hit_ID=Q0KIV9; Match level="QueryCoverage=46%, HitCoverage=59%, E-value=6e-46, Identity=62%"; Hit description =Ribosomal protein L7/L12 C-terminal domain containing protein
  Pfam annotation: Domain name=Ribosomal_L12; Domain location=264-331; Score=72.6; E_value=1.3e-18; Accession=PF00542.9; Description =Ribosomal protein L7L12 C-terminal domain
MTKGHVCDNFFVCEDWLHLNLANGKGIINKVFRLAQDSVVALEVSMLDSKSTIRRVGDDYGVYICGFAIKLGACSMDSFRGVVGYFSWSKVGLGKGLQEDLCFCSNSRCVRQIRLQIKWQVMGWCHPLKGGQPLHPTVVRLNASNLNVFSRHFGQPARKEEEEEDVEEVEINQRSLPADFDPATFDPNDHRGPPSERVFRLVDEVASLTVAEAAELGLTLMKKMGVKEMPNVGFMKAGAGNLAGMAAKAPTAAKEEQKPEKTVFELKLESYEAASKIKIIKEVRGFTDLGLKEAKDLVEKTPAVIKKGVSKEEGEQIIEKLKALGAKVVME

SEQ ID NO: 137010 - protein, 182 aa, Glycine max
  Coding DNA Sequence Number=SeqID_20232
  Gene Ontology: Mol. function=nucleic acid binding; Biological process= DNA integration
MRINQYIRDIGNFVQREKESLPEAWERLQEKIRSCQHHEITQQRLVHSFYGEVSSHNRTSLNVSCGGNLMLKPPVDAIKIIKDMCSNPYNNSRDMRIKKRGAHQMQALSLKIETLMRTQAQVPITTPLFPTCDKCRIMHGPRKCTIDDKLAATMNEINFVGGEEMILITNTITISIKDKASG

SEQ ID NO: 137011 - protein, 301 aa, Glycine max
  Coding DNA Sequence Number=SeqID_20233
  Gene Ontology: Mol. function=cation transporter activity; Cellular component=membrane; Biological process=cation transport
  Homolog annotation: Hit_ID=Q84ND4; Match level="QueryCoverage=99%, HitCoverage=76%, E-value=1e-147, Identity=82%"; Hit description =Cation diffusion facilitator 10
  Pfam annotation: Domain name=Cation_efflux; Domain location=30-294; Score=210.5; E_value=3.9e-60; Accession=PF01545.11; Description =Cation efflux family
METMTETGGFPGTLTEDELKQLAKSERIAVHVSNICNLVLFVAKVYASVASRSLAVIASTMDSLLDLLSGFILWFTAHAMKNPNQYRYPIGKKRMQPVILIESGRQLISKVKPDMDSAKLHWMMGIMVFVTVVKFILMVYCRRFKNEIIRAYAQDHLFDVITNSVGLAAAVLAVKFYWWIDPTGAIVIALYTINTWTKTVIENVGSLIGRTAPPDFLAKLTYLIWNHHEQIKHIDTVRAYTFGAHYFVEVDIVLPEDMLLHQAHNIGETLQVKLEQLPEVERAFVHIDFEFTHRPEHNTMV

SEQ ID NO: 137012 - protein, 307 aa, Glycine max
  Coding DNA Sequence Number=SeqID_20234
  Gene Ontology: Mol. function=ribonuclease H activity; Biological process=RNA-dependent DNA replication
  Homolog annotation: Hit_ID=Q1T365; Match level="QueryCoverage=94%, HitCoverage=66%, E-value=7e-33, Identity=30%"; Hit description =Ribonuclease H
MRITSQGSQYTKQLNRIKLKLASWKGNLLSFMGRVLLVKSSSKDLECWVRNFIWSGDIDSRKCVTVAWHNGHYAEVRVLRNQKPINGHISSSLWTGIKPSFALVLENAIWGKGSMSFWCDNWLGTSVADTLNIPYKNKSLIKASVWDFWNEGIWNLPNFLTQNFSQLVGHILQVTIPISQSEDRLFALIVVMIMRQLITYLSCHFARQASDIVPAAVTFAIFFIWSARNSCRFDNQKLDFTSFDTSIHLSGNFSVGTMNNSMLDFRILKNFDVPTNPRKADSIKEVIWRPPRRTWIKCNTEGSERKP

SEQ ID NO: 137013 - protein, 108 aa, Glycine max
  Coding DNA Sequence Number=SeqID_20235
  Homolog annotation: Hit_ID=Q1T2D5; Match level="QueryCoverage=42%, HitCoverage=2%, E-value=2e-12, Identity=67%"; Hit description=Chromo
MAKNTRLKELSSDIKRLLDTMETRDKEYALRFETLEYVVDGILKKNLGSESSFAATSANQPFQTKKLFPGIKCFHAPIPFIHGLLLHKLLNWNLDPLPMNVPEHICLN

SEQ ID NO: 137014 - protein, 55 aa, Glycine max
  Coding DNA Sequence Number=SeqID_20236
MWYHFPVKNLVGRLGVHDKTCLTMGLQEYSNRMTPKAYTPKSPSGPLPPDSVRLK

SEQ ID NO: 137015 - protein, 102 aa, Glycine max
  Coding DNA Sequence Number=SeqID_20237
  Gene Ontology: Mol. function=magnesium ion binding; Cellular component=chloroplast; Biological process=metabolic process
  Homolog annotation: Hit_ID=Q1SDQ3; Match level="QueryCoverage=88%, HitCoverage=11%, E-value=6e-37, Identity=81%"; Hit description =Terpene synthase-like; Terpenoid synthase
MAFRMLRLNGYDVSSDPFYQYSEDKFAESLKGYLKDVSAVIELYRASQAIIHPDESILVRQSLWTKHLLKQESSPYRLYADKLRRYVDLEVVSCLLSKTLVT

SEQ ID NO: 137016 - protein, 165 aa, Glycine max
  Coding DNA Sequence Number=SeqID_20238
MRSLLKLTVQRSENRMQEVQAIIELLYPMIRTSWMNSSALVHNLRNSIEMTWEALKTELLQRFSCSGAANPYEQLDALSQNVKPGSVWSNQTVQGAIAKCIKVVILCQGMDSGYNLAPASSSQMGDTCLNQTQLAKYASSAANSNSSVGSNSQTGNQSRNKDMRH

SEQ ID NO: 137017 - protein, 84 aa, Glycine max
  Coding DNA Sequence Number=SeqID_20239
MKNKTSLLNSWHRITKIRNILKTGKILKYIQDIACNSRTKKMQVKGGTENFITEKQGSQRNPAITETTMAEMYDRKRKNRFPKE

SEQ ID NO: 137018 - protein, 340 aa, Glycine max
  Coding DNA Sequence Number=SeqID_20240
  Gene Ontology: Mol. function=acyl carrier activity; Cellular component=chloroplast; Biological process=fatty acid biosynthetic process
  Homolog annotation: Hit_ID=O04792; Match level="QueryCoverage=88%, HitCoverage=85%, E-value=1e-135, Identity=80%"; Hit description=Acyl- ACP thioesterase
  Pfam annotation: Domain name=Acyl-ACP_TE; Domain location=50-336; Score=556.2; E_value=3.2e-164; Accession=PF01643.8; Description=Acyl- ACP thioesterase
  Subcellular localization annotation: CTP_CleavageSite=11; ConfidenceScore=5.27e-01
MAWTGLTPWPNAASRAGPPAPSLAGGGAASPDSGCRKAGRSGVGSLTEDGLSYKEKFIVRSYEVGINKTATVETIANLLQEVGCNHAQSVGYSTDGFATTPTMRKLRLIWVTARMHIEIYKYPAWSDIVEIETWCQGEGRVGTRRDFILKDYATDEVIGRATSKWVMMNQDTRRLQKVSDDVKEEYLVFCPREPRLAIPEADSNSLKKIPKLEDPAQYSRLGLVPRRADLDMNQHVNNVTYIGWVLESMPQEIIDSHELQSITLDYRRECGQHDIVDSLTSVEAIQGGAEAVPELKGTNGSATAREDKHEHQQFLHLLRLSTEGLEINRGRTEWRKKAPR

SEQ ID NO: 137019 - protein, 530 aa, Glycine max
  Coding DNA Sequence Number=SeqID_20241
  Gene Ontology: Mol. function=nucleic acid binding; Biological process= DNA integration
  Homolog annotation: Hit_ID=Q1S7C5; Match level="QueryCoverage=77%, HitCoverage=45%, E-value=5e-55, Identity=53%"; Hit description =Integrase, catalytic region
MREFLSQIKALSNSLASIGRTIMFQEHIDSILEGLPPDYHFIIAIIESKFEPLPIEQVEALLAHEARLNFLFFLSDSPSINYSQAQHKSSAISSDGYFVPNKTDQESFSAFRGGSGCGGSSPHGRGGVGRRGGGSGCGRRGGRFANFQCQNSNNSGDTRPANVWTNTSYKSTSTNHQSNPGAMLTDAQPQSNSNNWIPNSGASFHVTRESRNIQQLEPFEGPNQNLHTQWSRLPMKSYFKEMLVLMVFTVFLTFNFNLQLGGEFHPLAPLSSHTSLEWVVERKHRHVIELGLTLLHHASLPLKFWDFAFTTAVYFINRLPTASLNFSVPYHVLFNIFSDYNFLKTFGCSCFPLLRPYNNHKLDYRSHECLFLGYSTSHKGDKCLSPSGRIFISKDVSFNESKYPYSALFESPLPSSQSSSSTSIQFPSIPIIAPNLNFPISSTQPTQSEHSEPATVSSQSVPSNVSVPSETATVPLQSSDTEQTASPVADDAAIPSPSISSPFNTNSTPSSSSNISPSTPRPANTHPMID

SEQ ID NO: 137020 - protein, 256 aa, Glycine max
  Coding DNA Sequence Number=SeqID_20242
  Gene Ontology: Mol. function=RNA-directed DNA polymerase activity; Biological process=RNA-dependent DNA replication
DEEHNNKVTWVSWEDICSSKESEGLGVKNIALFNEAFFGENGGGTFSTKEGCGLSLNGERWFDKGSEWKLGDGGKMTFWVDDWITWRREGFEWEKELIQQLLHLFDTFRIHKVIADSWLWKASPCGSYTSKSTYLLYLGGSNFQVVNDIFSLAWQLKIPRKVSFLLWKLLRKRLPTKDKYTKGTSYLKTCMLGKPQIFPLLSLSIEALFRQNNAMRPYRKLKDFGMSYGVRLSYVYGGRGITSFSIGLDGNKWLNG

SEQ ID NO: 137021 - protein, 173 aa, Glycine max
  Coding DNA Sequence Number=SeqID_20243
MSTMLMASGCPPFYPLQRITVVLRHLRQSTWLTHLHRYHPHPQSRHQVDRLFRHIDHLQDYITRHRLLPTTLSHRPRRTPNNHNNQEQVLQLHHQFVELRRTHQHQLRESLTRIRHCIRPLRQYLIQEISYRALIEISDVAEYVASVEQPNKCFFSKGQGVRILCSISIIAQN

SEQ ID NO: 137022 - protein, 179 aa, Glycine max
  Coding DNA Sequence Number=SeqID_20244
  Gene Ontology: Cellular component=integral to membrane; Biological process=vesicle-mediated transport
  Homolog annotation: Hit_ID=Q9FMR5; Match level="QueryCoverage=86%, HitCoverage=61%, E-value=1e-53, Identity=71%"; Hit description =Vesicle-associated membrane protein 714
MAIFYALVARGTVVLAEFSAVTGNTGAVSRRILEKLPAESDSRLCFSQDRYIFHILRSDGITYVCMANDTFGKRHSHLFSLSASSESSDLFQPRRIPFSYLEDIQMRFMKNYSRVANYAPAYAMNDEFSRVLHQQMEFFSSNASADTLNRKVGKRSRGGIPLDLECSSAFISCLAHPKE

SEQ ID NO: 137023 - protein, 643 aa, Glycine max
  Coding DNA Sequence Number=SeqID_20245
  Gene Ontology: Mol. function=guanyl-nucleotide exchange factor activity
  Homolog annotation: Hit_ID=Q93ZY2; Match level="QueryCoverage=64%, HitCoverage=74%, E-value=1e-118, Identity=54%"; Hit description=Rop guanine nucleotide exchange factor 1
  Pfam annotation: Domain name=DUF315; Domain location=107-576; Score =693.0; E_value=2.2e-205; Accession=PF03759.4; Description=Domain of unknown function (DUF315)
MYLSTLHYQTLLTTYERCPSLAKVFTNFKRVLHEKDLVRWHGNNKQHRFLGCGRFCEGGKAAMEDEALIDYKSEGVERSIECENGCSDESFADLIKEKGGESSSNSEILLSEMTELDDQNFDLNHLIKEKGGEKSSSSEVMTELDGQSQGSAEDSSSSTSMMWQVQEMPTSNSPSPRGREDAEKKGMCNENFEEKISGLPMSVLELELMKERFAKLLLGEDMSGSGNGVPAALTVSNAITNLCATLFGQLWRLEPLAPEKKAMWRREMECLLSVSDYIVELKPTWQTFPDGSKLEVMTTRPRSDLYVNLPALRKLDNMLLEILDSFVNPEFRYVDQGVLATDADGSSSFRQALQRLEEKWWLPVPQVPPCGLREDSRKQLQHKRDSTKQILKAAMAINSITLADMEIPHTYLESLPKTARASLGDVIYRYITTDNFSLECMPACLDLSSEHQAIEIANRVEASIYIWRKKTNSRPTTGRTTRSSSRSSWEIFKDLIVEGDKMETLAERAESLLLSLKQRFPALPQTALDMSKIQCNKDVGKSILESYSRILESLSSNIVARIDDVLYVDELTKHSNPISSFPKVGVIAHKSISVPHSLPGQSIPPHKSSFGTPSFSPAQCVSLKGSKIINHQQRQPSPKRGRS

SEQ ID NO: 137024 - protein, 145 aa, Glycine max
  Coding DNA Sequence Number=SeqID_20246
  Homolog annotation: Hit_ID=Q1SRN1; Match level="QueryCoverage=58%, HitCoverage=5%, E-value=8e-18, Identity=46%"; Hit description =Integrase, catalytic region
MTESHNLFTSSSTFPNSISEKLDDSNFLLWRQQIDLVIKSHRLQCFVVNPVIPPQFLSDADREIGNENPAYEIWEQHDQILLAWLQLTLSNLVISINESKLEPLPIAEVEALLLAHEAQLRKFDELPDPPSVNLTHTYGADTHSA

SEQ ID NO: 137025 - protein, 243 aa, Glycine max
  Coding DNA Sequence Number=SeqID_20247
  Gene Ontology: Mol. function=oxidoreductase activity; Cellular component=mitochondrion; Biological process=metabolic process
  Homolog annotation: Hit_ID=Q9SAK4; Match level="QueryCoverage=45%, HitCoverage=20%, E-value=1e-38, Identity=68%"; Hit description =Succinate semialdehyde dehydrogenase, mitochondrial precursor (EC 1.2.1.24) (At-SSADH1) ...
  Homolog annotation: Hit description=(NAD(+)-dependent succinic semialdehyde dehydrogenase)
  Pfam annotation: Domain name=Aldedh; Domain location=2-242; Score= -230.4; E_value=8.3e-06; Accession=PF00171.12; Description=Aldehyde dehydrogenase family
MWEQQDQYLTITRPEISLAVNKVYQFIHLDTHWMAVKRILRHLKGIVLHGQHLKPAVLGLPYSIRALCDADWAFDVDDRIYLLCSLVDALIKPLSPNIFGFLRGKLNLAAKFRNSGQTCVCANRIIVQEGIYEKFANALRDTVQNMKVGDGFSEGVAQGPLINEAAVKKVESLIHDATSKGAKVILGGKRHSLGFTFYEPTVISDVNSDMRISRLTDINNYTVYTSQLGYVILRCKLEVDAAH

SEQ ID NO: 137026 - protein, 58 aa, Glycine max
  Coding DNA Sequence Number=SeqID_20248
MAVDTITVVHAVTVVALQTFSVKNDRTITAGKTFKQSYALEEISDFQLKQENQRSLEL

SEQ ID NO: 137027 - protein, 114 aa, Glycine max
  Coding DNA Sequence Number=SeqID_20249
  Homolog annotation: Hit_ID=Q9FMR7; Match level="QueryCoverage=85%, HitCoverage=19%, E-value=4e-40, Identity=76%"; Hit description =Arabidopsis thaliana genomic DNA, chromosome 5, P1 clone:MWD9
  Pfam annotation: Domain name=DUF1022; Domain location=1-107; Score= -101.4; E_value=4.7e-07; Accession=PF06258.2; Description=Protein of unknown function (DUF1022)
MVQQINLTVIQLSGHNRHMGHLAWADAFVVTADSVSMISEACSTGKPVYVLGAEHCKWKFTEFHKSLREQGVVRPFTGSEDISESWSYPPLTDTADAAKKVHEALAARGWKLKV

SEQ ID NO: 137028 - protein, 156 aa, Glycine max
  Coding DNA Sequence Number=SeqID_20250
MCHLTTYVCVYYDGQICNTNEGTTFVSNNTKTFMVDKVITFTQLLELVHQKLNIDPEQHIQHLHFRRPIFESGQRYMYTSFILRDDADVRQMFNIFYNNPSLPFVELFAIICHNNDPPGNQHGSTSNLEDLSGEYETCWLTIQIDNTLQFAHVSKN

SEQ ID NO: 137029 - protein, 238 aa, Glycine max
  Coding DNA Sequence Number=SeqID_20251
  Homolog annotation: Hit_ID=Q1SDN3; Match level="QueryCoverage=43%, HitCoverage=8%, E-value=5e-32, Identity=63%"; Hit description =Polynucleotidyl transferase, Ribonuclease H fold
MVSVTCELQWLTYLLEDFGIQFSRPALLYYDNRSALHIAENLVFHERTKHIEIDCHIVREKIQFGLLKLLPIASVDQLADIYTKALPPSAFQFLNCKLGMSNIHSPIPEVFWNLAAELIIDEVEFADIGGDLTGDLVAHEVQDVEGGKRGEAGGDLPGNVFSISDDEGGEAGATGFLEDWVFGLPAEVVVGDAASGGVAADVVPVEVAVGARPRVEEAKHTMAGMAVANKRNEWQAIE

SEQ ID NO: 137030 - protein, 123 aa, Glycine max
  Coding DNA Sequence Number=SeqID_20252
MEDIFKRWTEYLDSTRSRVNHPSPELHPYNQYERTPNLESVFTEFMTCHPSSTTNQNSMQNQEIQEVTESTQQAFKSLEIQVGKLVEEVTKFVARREENSVKVEAHEESLVEELEEHDSKEKR

SEQ ID NO: 137031 - protein, 136 aa, Glycine max
  Coding DNA Sequence Number=SeqID_20253
  Gene Ontology: Mol. function=DNA binding; Biological process=DNA integration
  Homolog annotation: Hit_ID=Q1SS72; Match level="QueryCoverage=94%, HitCoverage=10%, E-value=2e-24, Identity=39%"; Hit description =Integrase, catalytic region
MSEELDQSLNIHSPYYMHPSESPATTLVSPQLDPINYSSWSRSMLTALSAKNKVYSSLSQLRLMHSVSTSTRQSILWMDNIVDIWKDLKARYSQGDLSRILDLRQELASIKQGDTSITDYFTKSRVIWDELENYRL

SEQ ID NO: 137032 - protein, 118 aa, Glycine max
  Coding DNA Sequence Number=SeqID_20254
  Subcellular localization annotation: CTP_CleavageSite=45; ConfidenceScore=5.21e-01
MSEIHQSKQKFKNKSKCTRNLRPTSASLIFFQRLHNIHPNKSRVQSKHQSPNAMIDIERTSRSTKLKGIKPDIKPEITVPYASSLEIVTHSGGRRRTVAKNRLTAAEHGGRKSAARRR

SEQ ID NO: 137033 - protein, 126 aa, Glycine max
  Coding DNA Sequence Number=SeqID_20255
  Gene Ontology: Mol. function=protein kinase activity; Biological process=protein amino acid phosphorylation
  Homolog annotation: Hit_ID=Q1RV15; Match level="QueryCoverage=74%, HitCoverage=24%, E-value=2e-35, Identity=81%"; Hit description =Protein kinase
GTKQRHDDSKLPSNPEEVEDLRRDTAANPLIAFTYDELKIVTANFRPDRVLGGGGFGSVYKGFISEELIRQGLPTLAVAVKVHDGDNSHQGHREWLDTLQGDLNLIPTKSIFLDGGNTHLASASGL

SEQ ID NO: 137034 - protein, 217 aa, Glycine max
  Coding DNA Sequence Number=SeqID_20256
  Subcellular localization annotation: CTP_CleavageSite=50; ConfidenceScore=5.64e-01
MTRVLVQRGSSGGGSTSSNPNRSGGGSSSNSSARAEPQVPVLPENSDEVVVGVVSDEVLESGDKGKSDESVHFEQGDGSCDDGVAAAVVVESDVREEIVKGLSGLRVGERVVSESEVSSGDSSSLLVGGGGSCPPPPPVPPPKPSVTGNLNPRRSVSGSLNSGIVGSSRRAWPVVSARTSPAGSRPSSPRSHNESEGYNSADEQKPCLVSSYDDFVS

SEQ ID NO: 137035 - protein, 437 aa, Glycine max
  Coding DNA Sequence Number=SeqID_20257
  Gene Ontology: Mol. function=monooxygenase activity; Cellular component=membrane; Biological process=electron transport
  Homolog annotation: Hit_ID=Q1RV12; Match level="QueryCoverage=99%, HitCoverage=99%, E-value=0.0, Identity=69%"; Hit description=E-class P450, group I
  Pfam annotation: Domain name=p450; Domain location=38-431; Score =76.1; E_value=1.1e-19; Accession=PF00067.12; Description=Cytochrome P450
MEVTNLVVLPAVSAFFVLCLYFIIKVFRLGKHPNLNLPPGRLGWPVVGETLEFLRTMNEGNVLRFIQERKEKYDSRVFKTSMFGDPVVLFCGPAGNKFLFSNENKNVQVWWPSSVRRLLRLSLVNKVGDEAKMVRRLLMSFLNAETLRNYLPKMDSIAQRHIDTYWEGIIGFPLNVPGTRFYRAMKAADVIRKEIKMILKKRKVDLEEKRVSPTQDLLSHMLVTSDPSGRFMTEMEILDNILLLLFAGHDTSRSVLSLVMKYLGQLPQVYEHVLEEQLEISQGKEAGQLLQWEDVQKMKYSWNVASEVMRLSPPVSGAYREAIKDFTYADYNIPKGWKLHWNTGSSHKDPTLFSNPETFDASRFEGAGPTPFSYVPFGGGPRMCLGLEFARLEILVFMHNIVKRFKWDLVIPDEMFKYDPMLEPIKGLAIRLHPSHF

SEQ ID NO: 137036 - protein, 402 aa, Glycine max
  Coding DNA Sequence Number=SeqID_20258
  Gene Ontology: Mol. function=protein binding; Cellular component =membrane
  Homolog annotation: Hit_ID=Q9AT39; Match level="QueryCoverage=88%, HitCoverage=99%, E-value=1e-134, Identity=72%"; Hit description =SHOOT1 protein
  Pfam annotation: Domain name=TPR_2; Domain location=240-273; Score =8.1; E_value=3.8; Accession=PF07719.7; Description=Tetratricopeptide repeat
  Pfam annotation: Domain name=TPR_2; Domain location=277-310; Score =15.0; E_value=0.27; Accession=PF07719.7; Description=Tetratricopeptid e repeat
  Pfam module annotation: Pfam domain module=TPR_2::TPR_2; Domain location=240-273::277-310
  Subcellular localization annotation: CTP_CleavageSite=65; ConfidenceScore=5.90e-01
MSLPTTTSGHSSIYSALTLPRTTQIHPTLFSPTTKFFSSKSPSYSGLSNCFSNTLLSRPLLFAVKASSGVGSEASKQESDKSEEEEEEEEPYEEYEVEIEQPFGLKFAKGRDGGTYIDAIAPGGSADKAGVFTVGDKVIATSAVFGTEIWPAAEYGRTMYTIRQRIGPLLMKMQKRYGQFNMYAFLLCFECYSRKNIDSGGELTEKEIIRAERNSGFISNRVREIQMLNALRKREQKERREKDLREGLQLYKNGKYDEALEKFESILGSKPEPEEAAVASYNVACCYSKLNQIQAALSSLEEALNTGFEDFKRIRTDPDLANARASEEFDPLLKRFDESFINENAINAIKSLFGFGMYERLESRGLCLLHVMDYCPLSSNGYDLRSNPGHDLSYRLCSLCYC

SEQ ID NO: 137037 - protein, 167 aa, Glycine max
  Coding DNA Sequence Number=SeqID_20259
  Gene Ontology: Mol. function=hydrolase activity, acting on glycosyl bonds; Biological process=carbohydrate metabolic process
  Homolog annotation: Hit_ID=Q2MGR5; Match level="QueryCoverage=89%, HitCoverage=94%, E-value=9e-18, Identity=44%"; Hit description =Glycoside hydrolase, family 28
MLNRVRPEASPSFNVVSYGAKGDGKTDDSQATLNLFGNTTCNVCGATQETATLDIPGGKTFMLQPVSFQDIVVVGVKNPLIINQNYFGLEEESSGEGNAVQISQVTYRNVKGTSSVKDAVVLNCDPTVLDDICITTEDGMKTQGSCTNAQGMCSHCHPIVPCLSNKD

SEQ ID NO: 137038 - protein, 360 aa, Glycine max
  Coding DNA Sequence Number=SeqID_20260
  Gene Ontology: Mol. function=ATP-dependent helicase activity; Cellular component=membrane; Biological process=viral infectious cycle
  Homolog annotation: Hit_ID=Q8ZRQ4; Match level="QueryCoverage=88%, HitCoverage=38%, E-value=1e-110, Identity=68%"; Hit description=ATP -dependent helicase
  Pfam annotation: Domain name=DEAD; Domain location=17-180; Score =33.3; E_value=8.6e-09; Accession=PF00270.19; Description=DEADDEAH box helicase
  Pfam annotation: Domain name=Helicase_C; Domain location=247-341; Score=47.7; E_value=4e-11; Accession=PF00271.21; Description =Helicase conserved C-terminal domain
  Pfam annotation: Domain name=ResIII; Domain location=13-174; Score= -33.0; E_value=0.027; Accession=PF04851.6; Description=Type III restriction enzyme, res subunit
  Pfam module annotation: Pfam domain module=DEAD::Helicase_C::ResIII; Domain location=17-180::247-341::13-174
MRAILAQAEWELSVSELPVSEVLPALLAALAQSPQVLLAAPTGAGKSTWLPLQLLQQAQLPGQIIMLEPRRLAARNVAQRLAEQLGEQPGETVGYRLRGENCSSAATRLLVVTEGILTRMLQRDPLLEGVSLVILDEFHERSLQADLALALLLDVQQGLRDDLKILLMSATLDNQQLRTLLPDAPFIASQGRSFPVMRHYASLNPQQRFEEAVAREVAQLLRDEPGSLLLFLPGVAEIERVKRELASRVSDEVDLSPLYGALSLEAQRRAILPAAPGRRKVVLATNIAETSLTIEGIRLVVDSALERAAQFDVRSGVTRLLTQRISQASMTQRAGRAGRLAPGICLHLLPQEQALRAAAQ

SEQ ID NO: 137039 - protein, 148 aa, Glycine max
  Coding DNA Sequence Number=SeqID_20261
  Gene Ontology: Mol. function=2'-5'-RNA ligase activity; Biological process=RNA metabolic process
  Homolog annotation: Hit_ID=Q6D1Y2; Match level="QueryCoverage=83%, HitCoverage=71%, E-value=2e-41, Identity=62%"; Hit description=2'-5' RNA ligase
  Pfam annotation: Domain name=2_5_RNA_ligase; Domain location=10-88; Score=79.5; E_value=1e-20; Accession=PF02834.6; Description=2',5' RNA ligase family
  Pfam annotation: Domain name=2_5_RNA_ligase; Domain location=89-148; Score=2.5; E_value=0.19; Accession=PF02834.6; Description=2',5' RNA ligase family
  Pfam module annotation: Pfam domain module=2_5_RNA_ligase::2_5_RNA _ligase; Domain location=10-88::89-148
MATQRLFFALELPDALQQQLVQWRADCFAADAGKPVAAANLHLTLAFLGEVSTETAEQLQQLAARIRQPGFTLDLDDAGHWPRPGVVWLGCQRAPRGLLQLANLLRAQAARHGCAQSTQPFHPHITLLRHAAQARGAAAARFSLGALT

SEQ ID NO: 137040 - protein, 124 aa, Glycine max
  Coding DNA Sequence Number=SeqID_20262
  Homolog annotation: Hit_ID=Q9LVP5; Match level="QueryCoverage=67%, HitCoverage=70%, E-value=4e-25, Identity=63%"; Hit description =Arabidopsis thaliana genomic DNA, chromosome 3, P1 clone: MXE2
MSSEKETESRKLGSEEISREFKTLVSSNDLHSLNHMQHTILGRLQDSNAVLSHFNDFSQHCFAEISGDIARNTRVLKSVKSDLDYIFQKLRKEFNIEGARVKDMKAKNYLFQSNEINSRDHFEQ

SEQ ID NO: 137041 - protein, 763 aa, Glycine max
  Coding DNA Sequence Number=SeqID_20263
  Gene Ontology: Mol. function=protein binding; Cellular component =cytoplasm
  Homolog annotation: Hit_ID=Q10CW7; Match level="QueryCoverage=75%, HitCoverage=83%, E-value=1e-128, Identity=46%"; Hit description =YT521-B-like family protein, expressed
  Pfam annotation: Domain name=YTH; Domain location=610-701; Score =172.4; E_value=1.1e-48; Accession=PF04146.6; Description=YT521-B -like family
  Subcellular localization annotation: CTP_CleavageSite=76; ConfidenceScore=5.30e-01
MDLIKTMVSIFCPNPASTRFTRGLTNITHRLKETSTTDQQRPDRRNNLQRRSPVERRHVAGSTNGRRKMRSQSDLRGFLNSSIWGLNPLRFRFGFRASLSLFRLQRKTDLVVEATDLLQKLSLETQPKPLEIPEPTKKATGNQYGSVDSGNAANGQIQSYDRSVTPVLQDFIDPTMCYLPNGYPSTAYYYGGYDGTGNEWDEYSRYVNSEGVEMTSGVYGDNGSLLYHHGYGYAPYGPYSPAGSPVPTMGNDGQLYGPQHYQYPPYFQPLTPTSAPFTPTPAVLPQGEVSTSVAADQKPLPVDAANGNSNGVANGGNAKGNNAAASIKQANQNSSFSSKASNERVTMPGRGPTSGYQDPRFGFDGVRSPIPWLDAPLFSDGQPRPVSSTTITSSISGGNNTASRNPTFRPNSQFMGLHHPRPMPAMGATHSFINRMYPSKLYGQYGNTVRSGMGYGTHGYDSRTNGRAWLAVDSKYKTRGRSGGYFGYGNENADGLNELNRGPRAKGGKNQKGFAPTILAVKGQTLPATLGTDEEKDKTSTILECDQYNKADFPEEYTDAKFFVIKSYSEDDIHKSIKYNVWASTQNGNKKLDAAYQEAQQKPGGTPVFLFFSVNTSGQFVGLAEMIGPVDFNKSVEYWQQDKWNGCFPLKWHIVKDVPNNLLRHITLDNNENKPVTNSRDTQEVWEGKPADEKIEINGEVNTQKSEVSSELLKESTLAEKDSDDHKVPENGSATKTGDAPKGAKPVVPESKIVANGVVSNGV

SEQ ID NO: 137042 - protein, 37 aa, Glycine max
  Coding DNA Sequence Number=SeqID_20264
MGWIMVLALNAAEDPVGPTSINASAALWCEKVFMAIG

SEQ ID NO: 137043 - protein, 280 aa, Glycine max
  Coding DNA Sequence Number=SeqID_20265
  Gene Ontology: Mol. function=oxidoreductase activity; Biological process=electron transport
  Homolog annotation: Hit_ID=Q6D4Q2; Match level="QueryCoverage=64%, HitCoverage=98%, E-value=1e-63, Identity=66%"; Hit description =Putative nitroreductase
  Pfam annotation: Domain name=Nitroreductase; Domain location=79-234; Score=164.8; E_value=2.2e-46; Accession=PF00881.14; Description =Nitroreductase family
  Subcellular localization annotation: CTP_CleavageSite=6; ConfidenceScore=5.13e-01
MPTPARINTIRNRFRINSRIKFSTRQLQRNRPAIIRHNVRINSPYSRSQGSRYAVCPDVGISPRFVNHGRIKMDALELLVNRRSASRLTEPAPAGEVLQNILHAGMRAPDHGTLQPWRFIIIENEGRERFSHLLEQAARDSQLDDKAIEKARMSPFRAPMIITVVAHCEASAKVPRWEQVVSAGCAVMAMQMAAVAQGFNGIWRSGPWTDHPQVRAAFGCREQDAIVGFLYLGTPQLKANTTVTAAGFCGKVHATTLIAQSLCERSRLAATALTSSGQPG

SEQ ID NO: 137044 - protein, 108 aa, Glycine max
  Coding DNA Sequence Number=SeqID_20266
MYIKYGPKYIMKHSQQNKLSNETKTPHTYSQNNSKAPKFLKDMVISWKGKQGSKGLSKELIQGKSIWLEAYKNKIASIISKYACELGRINKNQAKAIVQAINGAKHTK

SEQ ID NO: 137045 - protein, 439 aa, Glycine max
  Coding DNA Sequence Number=SeqID_20267
  Gene Ontology: Mol. function=ATP-dependent helicase activity; Cellular component=membrane; Biological process=metal ion transport
  Homolog annotation: Hit_ID=Q66BW4; Match level="QueryCoverage=92%, HitCoverage=88%, E-value=1e-140, Identity=62%"; Hit description=ATP -dependent RNA helicase
  Pfam annotation: Domain name=DEAD; Domain location=7-174; Score =251.6; E_value=1.6e-72; Accession=PF00270.19; Description=DEADDEAH box helicase
  Pfam annotation: Domain name=DbpA; Domain location=354-439; Score =100.5; E_value=5.1e-27; Accession=PF03880.5; Description=DbpA RNA binding domain
  Pfam annotation: Domain name=Helicase_C; Domain location=240-316; Score=116.4; E_value=8e-32; Accession=PF00271.21; Description =Helicase conserved C-terminal domain
  Pfam annotation: Domain name=ResIII; Domain location=3-169; Score= -33.7; E_value=0.031; Accession=PF04851.6; Description=Type III restriction enzyme, res subunit
  Pfam module annotation: Pfam domain module=DEAD::DbpA::Helicase _C::ResIII; Domain location=7-174::354-439::240-316::3-169
  Subcellular localization annotation: CTP_CleavageSite=63; ConfidenceScore=5.14e-01
MGFDAMTPIQAASLPAILSGRDVRAQAQTGSGKTAAFGIGVLNRIDSGRFHTQALVLCPTRELADQVSNVLRQLARFTRNIKILTLCGGQPMSAQRDSLVHAPHIVVGTPGRILDHLKRDNLDLSQLQSLVLDEADRMLEMGFRDDMEAIIGFTPDSRQTLLFSATWPDTIASLSQRFQRDALAVATEAKSELPAIEQQFIETSASERINLLSALLSQQQPASCVVFCNTKRECDEIAAALNDRQISALALHGDLEQRDRERVLIRFANGSIRVLIATDVAARGLDIKSLALVVNFQLAWDPEVHIHRIGRTGRAGEQGLAVSFVAADEMVRAHALEDYLQQKLNWQPASTLKGKGAQPLPAAMMTLCIDGGRKAKMRPGDILGALTGEAGFSGDQIGKIDLTPTHAYVAIDAAQAKKALIKLKEGKIKGKSVRAILLK

SEQ ID NO: 137046 - protein, 95 aa, Glycine max
  Coding DNA Sequence Number=SeqID_20268
  Gene Ontology: Mol. function=unspecific monooxygenase activity
  Homolog annotation: Hit_ID=O04892; Match level="QueryCoverage=99%, HitCoverage=32%, E-value=4e-16, Identity=79%"; Hit description =Cytochrome P450 like_TBP
  Subcellular localization annotation: CTP_CleavageSite=32; ConfidenceScore=5.39e-01
QNGSVTSGKGLALRAGHGGPSPEPVGCRWTARAASAARAGRRVPVGGRIGNGPFGASSPGVEQSTQNCETTAKGTGLAESAGKEDPVELDSSPTL

SEQ ID NO: 137047 - protein, 152 aa, Glycine max
  Coding DNA Sequence Number=SeqID_20269
  Gene Ontology: Mol. function=nucleic acid binding; Biological process= DNA integration
  Homolog annotation: Hit_ID=Q1SZQ0; Match level="QueryCoverage=97%, HitCoverage=29%, E-value=3e-23, Identity=43%"; Hit description =Integrase, catalytic region; Zinc finger, CCHC-type; Peptidase aspartic, catalytic
MAEIREKNKWDNDDYICMRHILNGMSNKLFDTYQNFGLAKKLWEKLEMIFLLNNWAITISHLEEEYRKQDDTKELYVQEKMHVTEEGNQTLENECRLLKKENKKKESRATKDNLVAVISEINMIEDVGSSWIDIGATCHVCKNKYLYKTTKE

SEQ ID NO: 137048 - protein, 54 aa, Glycine max
  Coding DNA Sequence Number=SeqID_20270
MVPLGRGPKEVRKIHWVRWRKWRWNLFHQGDSLWVIMLESKYERWKGLLEGYAI

SEQ ID NO: 137049 - protein, 148 aa, Glycine max
  Coding DNA Sequence Number=SeqID_20271
MKKCVARDQANEDNALNLFGIANKLDKIMQEQANKKKTTRHTQQEYEQEMIKKEKRTKKNHEQVGVSNPLEIQSMCPKIVFAQKSSRKQTKNMTTNHKLRDMSETDGDASPILRKRKVKVWMPPSPYNESTSVDASNSHHERPPMAPI

SEQ ID NO: 137050 - protein, 55 aa, Glycine max
  Coding DNA Sequence Number=SeqID_20272
MVRLDKARFLVKVWGNQSRSNDDRLLESVIRMDLALLTSEDIKAKETRDEELNHE

SEQ ID NO: 137051 - protein, 84 aa, Glycine max
  Coding DNA Sequence Number=SeqID_20273
MWYHVKRMKFVKASSWCLAKRGLCAYENHVLSEALSPLSKLGESGGESEKHLCAQHINSSLSKTFVSSYAKHVQLAQRMFTYSH

SEQ ID NO: 137052 - protein, 72 aa, Glycine max
  Coding DNA Sequence Number=SeqID_20274
  Gene Ontology: Mol. function=hydrolase activity, hydrolyzing O -glycosyl compounds; Biological process=carbohydrate metabolic process
  Homolog annotation: Hit_ID=Q75Z80; Match level="QueryCoverage=72%, HitCoverage=8%, E-value=6e-15, Identity=66%"; Hit description=Exo-1 ,3-beta-glucanase
MSEGGSVPALQAFAETWIDMVNEFQKGVVSAKLGIPMFYGIDVVHGHNTIYKALSGKNHVLNFKGGTKLKHG

SEQ ID NO: 137053 - protein, 45 aa, Glycine max
  Coding DNA Sequence Number=SeqID_20275
MDGGDSLEDGMDEMTSEVPIMIDNVSDFSDKEQWHNVYEHGEPRN

SEQ ID NO: 137054 - protein, 806 aa, Glycine max
  Coding DNA Sequence Number=SeqID_20276
  Gene Ontology: Mol. function=protein dimerization activity; Cellular component=nucleus; Biological process=regulation of transcription, DNA-dependent
  Homolog annotation: Hit_ID=Q5D1M3; Match level="QueryCoverage=96%, HitCoverage=91%, E-value=0.0, Identity=83%"; Hit description=Class III HD-Zip protein 4
  Pfam annotation: Domain name=MEKHLA; Domain location=657-806; Score =295.6; E_value=9.2e-86; Accession=PF08670.1; Description=MEKHLA domain
  Pfam annotation: Domain name=START; Domain location=126-336; Score =230.5; E_value=3.6e-66; Accession=PF01852.10; Description=START domain
  Pfam module annotation: Pfam domain module=MEKHLA::START; Domain location=657-806::126-336
MTIIQCYGKLYGKDDLLYLPYTLPIFFCRCREKQRKEASRLQTVNRKLSSMNKLLMEENDRLQKQVSQLVYDNGFMKQQIHTASATTTTTTDNSCESVVVSGQHQPQNPKTQHPQWDANNPAGLLAIAQETLVEFLSKATGTAVNWVQMIGMKPGPDSIGIVAVSRNCSGVAARACGLVSLEPTKVAEILKDRPSWYRDCRCLNVLSVVSAGNGGTIELMYMQTYAPTTLAAARDFWTLRYSTSLEDGSLVICERSLTSSTGGPTGPAASNFIRAEMLPSGYLIRSCEGGGSIIHIVDHVDLDVWSVPEVLRPLYESPKFLAQKLTTAALRHARQIAQESSGDVHYGGGRQPAVLRTFSQRLCKGFNDAVNGFVDDGWSLMGNDGVEDVTIAINSSPNKFFGSHYNTSMLPAFGGGVMCAKASMLLQNVPPALLVRFLREHRSEWANYEVDAYSSACLKASPYAVPCARPSGFPSSHVIIPLAHTIEHEEFLEVVRIEGNAFPPDDVAWACDMYLMQLCSGIDENAIGACAQLVFAPIDESFADDALLLPSGFRIIPLDPKTDGLASTRTLDLASTLETGSGNARSAGESDSNNYNLRSVLTIAFQFTFENHLRDNVAVMARQYVRNVVRSVQRVAMAIAPSRLSTQLGPKSFPGPPEALTLARWICRSYRLHTCTELFSVESTSGDAILKQLWHHPDAILCCSVKTDASPVFTFANQAGLDMLETTLVALQDIMLDKVLDEAGRKVLCIEFSKIMQQGFAYLPAGICVSSMNRPVSYEQAIAWKVLDDDDSNHCLAFVFMNWSFV

SEQ ID NO: 137055 - protein, 122 aa, Glycine max
  Coding DNA Sequence Number=SeqID_20277
  Homolog annotation: Hit_ID=Q45RR8; Match level="QueryCoverage=47%, HitCoverage=17%, E-value=4e-14, Identity=62%"; Hit description =Plastid division regulator MinD
MEEEPQEEEEEPQPRRRRRTTTMKEITRRMKKTMTCVKENEESHYIALKVGPVLIVDEGLVEAAVAVEDLDDGVVDVVLEFEEDVEVAEADVGVNVEERGMEAKEECGVRGDGDAGEKVERG

SEQ ID NO: 137056 - protein, 402 aa, Glycine max
  Coding DNA Sequence Number=SeqID_20278
  Gene Ontology: Mol. function=DNA binding; Biological process =regulation of transcription
  Homolog annotation: Hit_ID=Q49QW7; Match level="QueryCoverage=99%, HitCoverage=99%, E-value=1e-139, Identity=69%"; Hit description=Myb family transcription factor-related protein
  Pfam annotation: Domain name=Myb_DNA-binding; Domain location=37-109; Score=34.2; E_value=4.6e-07; Accession=PF00249.21; Description=Myb -like DNA-binding domain
MERMFPPKKPSTMNSHDRPMCVQGDSGLVLTTDPKPRLRWTVELHERFVDAVTQLGGPDSTLLSPYSLSPFFFSSFFLVPKATPKTIMRVMGVKGLTLYHLKSHLQKFRLGKQPHKEFNDHSIKDGMRASALELQRNTASSSAMIGRNMNDNSHMVDAIRMQIEVQRRLHEQLEVQKHLQLRIEAQGKYMQSILEKAYQTLAGENMASAATNLKGAIVPHHQGIPDMGVVMKEFGSPLGFSSFQDLENIYGGDQIDLQQNMEKPPLDHGFMPINETLCLGKKRSNNPYSGSGKSPLIWSDDLRLQDLGGPASSCLGPQDDPFKGDQIQIAPPGSLDRGASTDIDPMSEIYDSKPVLQSEEKKFDASSMKLERPSPRRAPLQAERMSPMISTGTMAQGRGSPF

SEQ ID NO: 137057 - protein, 491 aa, Glycine max
  Coding DNA Sequence Number=SeqID_20279
  Gene Ontology: Mol. function=RNA-directed DNA polymerase activity; Biological process=RNA-dependent DNA replication
MVSREKPTEDELHSDVLDEVGLPVAQYSCVGEANWIEFGEVSKALRWFQRRRSNNVQVMVVIPSQEVQDDERADVSNPNKENRFGVWMIAGKSNFKKQSQPMIKHKGQFELVKIPWERQGEWVAISDFNNTLSSSERTRGSSNSHIDSSTFWNFLDEGNLMDMGFQGKAMTWKNGRIRVRLDQCLINLEWRFRFSNAIIVHLGPWMDEVRSLAVIVANEGQSASSSSCNIDGFTQKLKRWNRDTFGCIWKKKVSLKIKIDWLDEEEIHWYQKSRVKWLFVEDRNTKYFHGVMIIRRKRNKYHMLKDANDNWISDHTQLDVMITCFYKALYFDDDLYIPFVVAGAFPQREGQTGIKLFSSKRIGGMRSVSSKTLDLSVSAMCFVLNCQSGDNIIMAQEIFHSMRKKGEKKGQRLDGYDYLEKSCVYFSNNIGQDQRKHLSEEITLAKPVLQALPTYVMQSTLLPKSIYDDVDKACRNFVRGHDSDTRKNASG

SEQ ID NO: 137058 - protein, 120 aa, Glycine max
  Coding DNA Sequence Number=SeqID_20280
  Homolog annotation: Hit_ID=Q9LDE4; Match level="QueryCoverage=47%, HitCoverage=23%, E-value=3e-13, Identity=63%"; Hit description =Ethylene-responsive transcription factor 7
  Pfam annotation: Domain name=AP2; Domain location=24-79; Score=63.5; E_value=6.8e-16; Accession=PF00847.10; Description=AP2 domain
MRKGRGGGASATATVDVNGSILKEPRYWGMRKRLWGRFTVEIRDLLKKARVWLGTFDSAEDAARAYDIAAQTLRVEEEEEKVVPPSILFFSLHFSSSSSYYSFSISILHNTQHTTCEKPH

SEQ ID NO: 137059 - protein, 877 aa, Glycine max
  Coding DNA Sequence Number=SeqID_20281
  Gene Ontology: Mol. function=protein translocase activity; Cellular component=chloroplast outer membrane; Biological process =intracellular protein transport
  Homolog annotation: Hit_ID=Q1RV20; Match level="QueryCoverage=97%, HitCoverage=62%, E-value=0.0, Identity=71%"; Hit description=AAA ATPase; AIG1
  Pfam annotation: Domain name=AIG1; Domain location=228-419; Score =60.5; E_value=1.2e-15; Accession=PF04548.7; Description=AIG1 family
  Pfam annotation: Domain name=MMR_HSR1; Domain location=228-326; Score= 19.4; E_value=1.6e-05; Accession=PF01926.13; Description=GTPase of unknown function
  Pfam annotation: Domain name=Miro; Domain location=229-356; Score= -8.3; E_value=0.035; Accession=PF08477.3; Description=Miro-like protein
  Pfam module annotation: Pfam domain module=AIG1::MMR_HSR1::Miro; Domain location=228-419::228-326::229-356
VEEIGANGDREINGSVSDEKGDGVVFGSTDAANKFLEDLELQQSRASGSSRDDGQIVSDSDEEEETDDEGDGKELFDTATLAALLKAASGADQDGGSITITSQDGSRLFSVERPAGLGSSLSSGKPAMRQTRPSLFTPSISRASAISDSNLSEEEKKKLEKLHEIRVKYLRLVHRLGFTTEESIAAQVLYRMTHVAGRQSGQMFSVESAKETASQLEAEARDNFDFSVNILVLGKAGVGKSATINSIFGETKTSINACGPATTAVTEIVGVVDGVKIRIFDTPGLKSSAFEQNFNTKVLSAVKKLTKKSPPDIVLYVDRLDLQTRDMNDLPMLRSITSVLGSSIWRNVIVTLTHAASAPPDGPSGAPLSYDVFVAQRSHIVQQTIGQAVGDLRLMNPSLMNPVSLVENHPSCRKNRDGQKVLPNGQSWRPLLLLLCYSMKILSEASNVSKTQESPFDQRRLFGFRPRSPPLPYLLSWLLQTRTYPKLPADQGGADNGDSDIEMADLSDSDLDEDEDEYDQLPPFKPMKKSQVAKLTKEQQKAYFEEYDYRVKLLQKKQWREELRRMREMKKKGNTKENDYGYTEEDDQENGSPAAVPVPLPDMALPPSFDSDNPAYRYRFLEPTSQLLTRPVLDSHGWDHDCGYDGVNIEQSLAIINKFPAAVTVQVTKDKKDFSMHLDSSVAAKLGENGSAMAGFDIQNIGKQLAYIVRGETKLKNFKRNKTSAGVSVTFFGENVSTGLKVEDQIAVGKRVVLVGSTGVVKSQTDSAYGANVEVRLREADFPIGQDQSSLSLSLVKWRGDLALGANLQSQFSVGRGYKVAVRAGLNNKLSGQISVRTSSSDQLQIALIAILPIAKAIYKNFWPGANYAVIADFFAL

SEQ ID NO: 137060 - protein, 321 aa, Glycine max
  Coding DNA Sequence Number=SeqID_20282
  Homolog annotation: Hit_ID=Q53QH2; Match level="QueryCoverage=74%, HitCoverage=75%, E-value=1e-23, Identity=37%"; Hit description=F-box domain, putative
  Pfam annotation: Domain name=F-box; Domain location=5-67; Score=19.8; E_value=0.0095; Accession=PF00646.23; Description=F-box domain
MADNSDNTSLPPEKTESTSSLATLHSDIIHAHILTRLDGATLASAASVSSLMHRLCTQDDLWREISTATWPSLQNPIARHVISAIPGGYRSIFSDAFPSLHNSSFRRHRPPPPTPELISAVDMYYQGKPVFSRVIRTETQKNWFFASPLWIDALQHKEEGRGMAEALGGESERELDYCGPHTEACGERIEPEGGVGTAALADAGGRGGIRGGDGGGAGGRDGEGAVPGEGELHVREVNLVMEDTEGRRVSGKESVEILQRAMENGERKRVDHVRDKDRFMKFTCLMKERRERKFRREKARDLVSTFLALVALLLFCFLAGF

SEQ ID NO: 137061 - protein, 252 aa, Glycine max
  Coding DNA Sequence Number=SeqID_20283
  Gene Ontology: Mol. function=carbohydrate binding
  Homolog annotation: Hit_ID=Q2QN32; Match level="QueryCoverage=54%, HitCoverage=30%, E-value=2e-34, Identity=52%"; Hit description =Lipase, putative, expressed
  Pfam annotation: Domain name=DUF620; Domain location=132-249; Score =4.2; E_value=2.9e-15; Accession=PF04788.3; Description=Protein of unknown function (DUF620)
MGSKARWRQSWAPQPLTPLMEGPGPEMQEEGTKKESSWEVIREWFRTQKISPGGSFSQSSSFYGTIHAKTQDLRLLLGVLGCPLAPIPSAHDPTLSIHIKDTPFETSTAKYIIQQYLAATGCLKQQKDTKNMYATGMVKMICCETEISSGKNVKCLGTRSSDNGCFVLWQMLPGMWSLELVVGDHKVVAGSNGKTVWRHTPWLGTHAAKGPQRPLRRIIQTLFDGIEAWGGHGPRVQSMLYQTNIKIEETTN

SEQ ID NO: 137062 - protein, 324 aa, Glycine max
  Coding DNA Sequence Number=SeqID_20284
  Subcellular localization annotation: CTP_CleavageSite=38; ConfidenceScore=5.06e-01
MDSSSSSDPSLPQTSVLLSDQSPSLPPASDSENHHGFVSAEDGALEAQPSRPLLVNSSEPVLDSPPDDAHRPVAKVSGDDDEDGSVVEGADDVVEVANDVVLEEGGEKEESGQAMKEGDFSDSNEVFVEASGGDDDIKEIQSGVVAVENGVELSGTDKGFEAAAVELNEEEAKEKEVEEKVNDGGTDNSDSVVDEKSEGVDVEKDDGGGVDAVVDSVEVNVLGSGVAVVGDELGVDESEIKGLEEPESRGVSLDNGFEPIEKGEEEVVDKLVDGGDGQSGAEGVVVGGDDVSGENGDDGDGLKSDIVVPPEEGGGGSEFVEKDE

SEQ ID NO: 137063 - protein, 352 aa, Glycine max
  Coding DNA Sequence Number=SeqID_20285
  Gene Ontology: Mol. function=calpain activity; Cellular component =intracellular; Biological process=proteolysis
  Homolog annotation: Hit_ID=Q1SSR3; Match level="QueryCoverage=98%, HitCoverage=90%, E-value=2e-45, Identity=37%"; Hit description =Cyclin-like F-box; F-box protein interaction domain
PDSGNSNMGSSEISDAFQVRFQVLEFPHLPSRIRQIAPSTSKGFQKHPPPIKNPSSTVDDACHQLHPGYFFIGSCNGLVSLLYHSRSLVRHGSIEYRVRFWNPATRIMSLNLSHLTFHSSQDHDPGFGFGYDDLSDTYKVVLLLLDIKTNNWEVRVHCLGDTDTCWRNTVTVTCPDFPLWGGRDGKLVSGTLNWLAVRWETDTVNQLVIFSYDLNMETYKYLLLPGGLSEHADNPSLGVLKGCLCLYHGQEQVRTRFVVWLMREFGVENSWTPWLNMSFELVQLFPPWQLLAAPLCMFENDDVMLLANYPRSQYIFYNRRDNRIVRTEDFNDKVPLFSHDDYVQSLVLPYRN

SEQ ID NO: 137064 - protein, 47 aa, Glycine max
  Coding DNA Sequence Number=SeqID_20286
  Homolog annotation: Hit_ID=Q9M4P3; Match level="QueryCoverage=85%, HitCoverage=39%, E-value=5e-09, Identity=68%"; Hit description=DYW10 protein
MKLTGYVPDLEFVLHDAGEELKEQLLLWHNEKLAIAFGLPKEMLQGF

SEQ ID NO: 137065 - protein, 53 aa, Glycine max
  Coding DNA Sequence Number=SeqID_20287
  Subcellular localization annotation: CTP_CleavageSite=42; ConfidenceScore=5.09e-01
MPKTADQATANSPAKKSRRNKPLQSHAPSYNFTVEDSMVKIEASKKNGWRCSN

SEQ ID NO: 137066 - protein, 105 aa, Glycine max
  Coding DNA Sequence Number=SeqID_20288
MLPKNAVEKWERTVQRRAFVASSLMKKLILQKSHRANNYDGVSHGIEYKKMQRRRQSHKKNAAKYLGMMVRCHGDDLSWWRAVTVTAKGDKVTKMKLRRRRRKHK

SEQ ID NO: 137067 - protein, 157 aa, Glycine max
  Coding DNA Sequence Number=SeqID_20289
MERWKTLFVQVLVTVVNWWMEWVIADVESLKKLLQLTKVEMSFNCVILKIQPVASKPSNLGTSSFIRCGAVCNPDAENDVVSGCVCCGLYRFASRCDIHSARFSIFASNDAANFVNNSSIFSDDRAFDRMPSAILATKCVNESTNDAKLSRAREPPC

SEQ ID NO: 137068 - protein, 205 aa, Glycine max
  Coding DNA Sequence Number=SeqID_20290
  Homolog annotation: Hit_ID=Q8L7C3; Match level="QueryCoverage=41%, HitCoverage=60%, E-value=5e-32, Identity=77%"; Hit description =Expressed protein
  Subcellular localization annotation: CTP_CleavageSite=39; ConfidenceScore=5.67e-01
MTTTFATVAGLGGALLSSTSSRLTSGFVKSPVIARNPLRQAVAMGNGRITCFERNWLRADYSVIGFGLIGWLAPSSIPAINGKSLTGLFFESIGAELAHFPSPPALTSSFWFVTSPFVLLFFHSVLLLLLLFNGSLLHNNNYNHINIKRKRKKKMMMRNEEKNEIEMSHLDVLDLAQRENLTSMCLDCCLEFVKPIITLSNVKNK

SEQ ID NO: 137069 - protein, 89 aa, Glycine max
  Coding DNA Sequence Number=SeqID_20291
MVLNFDRDQQTTRLIVSTISNTVVVNLRATDAASILKQSKFKGKFVGERDGLISELMTKMVLPPALDYLVVHLRAISDAPIMKQCKLKN

SEQ ID NO: 137070 - protein, 662 aa, Glycine max
  Coding DNA Sequence Number=SeqID_20292
  Subcellular localization annotation: CTP_CleavageSite=42; ConfidenceScore=5.73e-01
MPSCHYTTNNNLNSKTRKRGCSSSSSSSLVRRYRFKRAILVRKKGGSSTPVPMWKTKTSSSPSVPTQQQQQHMKPLLHSSGSMLPSKDKELSVSARKLAATLWEINDLPPSRVKKEFEVDQLRGFKEKVRGREKKSVRLSRSGLLRPQMSDPSHSPASERMKGLEGDNSCKRRVSGFSHQLLSGDYYLDALDAHSSANFIEEVENQPRSEKNRGKGTGGVKNRLKEARSGLSTSKKLLKVLNQMCLREQQTSSMPLVLALGSELDRVCHQIDQLIHEQRSNQNDVEFVMKHFAEEKAAWKRRERERIHDAIKHVAEELAVEKKLRRQTERLNKKIAKEMASVKASHLKASKELEREKRAKEILEQICDELAKGIGEDRAQVEELKRESAKVREEVEKEREMLQLADVLREERVQMKLSEAKYQFEEKNAFLEKLRTELEDFMRTKDGQNEDVSPESKKIKDLESYFKNVCRGFQNEEKEDDSDVENDVGHEGDDDSDDSDLHSIELNMDDDSKGYKWSFACENVAQDKRFSIGKESIGRKSFSEKIQWGSICFNKGTSSGRKRDFSINIQEVSDHFDPDRSIEFLSQALIQDDKDETQSNRSNQGLHDTMSCANSDKRNSLLLTLQCAGGEAGENALALEVDNLKHEVAGKNLDVKNFDSVS

SEQ ID NO: 137071 - protein, 64 aa, Glycine max
  Coding DNA Sequence Number=SeqID_20293
MGFFDVEPRKRFNVAFSKSNGRKGNRQNLLYGRPPPRVWFRLDIWPLCLEVCGNLHGTRINTKL

SEQ ID NO: 137072 - protein, 324 aa, Glycine max
  Coding DNA Sequence Number=SeqID_20294
  Gene Ontology: Mol. function=RNA-directed DNA polymerase activity; Cellular component=chromatin; Biological process=chromatin assembly or disassembly
  Pfam annotation: Domain name=zf-CCHC; Domain location=208-225; Score =6.5; E_value=0.084; Accession=PF00098.13; Description=Zinc knuckle
MADSTRSKTNIIRIEDAISRLTSNQFSLTATQNSMSLKLDELLQKMATLETQPHSPSHSTSPPQPSPTLHGPRLKHEIPRFDGSDLLGWIFKITQFFEYHATPESERLTLASFSMEGQALPWFQWMASSATPDLGSSGRPSQIAGREVSGPASFPAWSLLVALLSASTCTLFKPTPLPSVASITTETTPPLPIRRLTPNEIASRREWGLCFNCDEKFHRGHRCASKIFLLIADEEDDFALGTPLLDPITDPMVTPDPAQTHITLHTLSGHLALETLHNGAHYPLTRHGGQRSPALMPSLVQSRPVQWLQSLGVLLFGKCTDSLK

SEQ ID NO: 137073 - protein, 270 aa, Glycine max
  Coding DNA Sequence Number=SeqID_20295
  Gene Ontology: Mol. function=RNA-directed DNA polymerase activity; Cellular component=chromatin; Biological process=chromatin assembly or disassembly
  Homolog annotation: Hit_ID=Q1SAV4; Match level="QueryCoverage=49%, HitCoverage=43%, E-value=8e-31, Identity=39%"; Hit description =Integrase, catalytic region
MAAIKNWCQYLLGHPFAILTDHKSLKELMTQVVQTPEQHMYLARLMGYDYMIHYHSGASNMVADALSRISEASSGMLLSLSGIHLGALPQSHTSLMLASLFMDIIRKLHGMPNSLVINHVIEQYLLTFMHKRPSSWAKFLQYAEWSYNTSKHSSSGLTPYEVSFGKKPPTIMHYVAGNSNAEAFDDFLTSQEEVYMELRKKLLKAQEQTKKYADENPNAFALLPLPAKITENQPTITPLVILSTQQLKADYYLEEKVLLDGVGSDRKKEV

SEQ ID NO: 137074 - protein, 114 aa, Glycine max
  Coding DNA Sequence Number=SeqID_20296
MAITSSTETIASVNRRGGGDHTSSMGMHGGENGEHGNLPRPLDHGGLIPLYGAAAGSALQRNNNHHHDRTVQEYQVARCCNSLEEESAEGRNMSPKAQKENSSTKIPQGRCIAK

SEQ ID NO: 137075 - protein, 130 aa, Glycine max
  Coding DNA Sequence Number=SeqID_20297
  Gene Ontology: Mol. function=hydrolase activity, hydrolyzing O -glycosyl compounds; Biological process=carbohydrate metabolic process
  Homolog annotation: Hit_ID=Q6PW04; Match level="QueryCoverage=42%, HitCoverage=9%, E-value=9e-12, Identity=66%"; Hit description =Membrane-anchored endo-1,4-beta-glucanase
QVNNVAPVGHNELDDYKRLPCDGHYQTSALNQAYRYRVHQLQHYTKLNLSNKDQRSFSSSFSIVQRLRASSVGSRLKRLGPAPGDSDCARRLWRSRSRESLAGLPTDLQLGFDLQRREARVQAVRPPGFK

SEQ ID NO: 137076 - protein, 79 aa, Glycine max
  Coding DNA Sequence Number=SeqID_20298
MAQPLDNFEEHIRSLFLELMLKSIQFQRVSSVVSVKKESGRAPESKQHAKCEIKWLSESSVSCQAQCSIGAKPKSTYSR

SEQ ID NO: 137077 - protein, 149 aa, Glycine max
  Coding DNA Sequence Number=SeqID_20299
  Gene Ontology: Mol. function=RNA-directed DNA polymerase activity; Cellular component=integral to membrane; Biological process=RNA -dependent DNA replication
  Homolog annotation: Hit_ID=Q1SLB1; Match level="QueryCoverage=99%, HitCoverage=23%, E-value=1e-30, Identity=48%"; Hit description=RNA -directed DNA polymerase
  Subcellular localization annotation: CTP_CleavageSite=42; ConfidenceScore=5.06e-01
MKGCITSSTIPVLVNGSPTFKFTPQHGLRQGDPLAPFLFNVVVEALSKLMGHARNKNAYKGWVGRNKVAVDLLQYADDMLFIGVACLSNMVAIKAMMRCFEMASDLKVNFNKSFFVGIGVEFEVLERWANVLNYRWMTIPFTYLGPPIM

SEQ ID NO: 137078 - protein, 167 aa, Glycine max
  Coding DNA Sequence Number=SeqID_20300
MQEASGLLCGSISGEVDHQLFRLAQAFVSPLYAHMLLPLACITNLKPALIHYPLQQILCHRACLYIMCLQYKPPRGYHIFHLLRPLSSALLHHINRWPPMTGKGDWKIFPGVTTAIWLAIKDGGKSVYDIGMGANSESFFTGKFIPGLVFMLGLELPMGRGCVGAKF

SEQ ID NO: 137079 - protein, 198 aa, Glycine max
  Coding DNA Sequence Number=SeqID_20301
  Gene Ontology: Cellular component=nucleus
  Homolog annotation: Hit_ID=Q10F72; Match level="QueryCoverage=80%, HitCoverage=73%, E-value=9e-83, Identity=85%"; Hit description =Expressed protein
MAYTQGVYDEAWRVNVRIQGCDLEHGYLCGTMEALNVPMADTPVVTFWEGEIVDTKNYTFFTGKWEASPEDDIRHWSKFPSFSPLLGQVEADGGKSLDLSNYPYIFMRWKEQYFVNVGTDCGLTIAGFYYICFSCSNGSISGFYYDPNSSPYQKLELKSTNDGRSGTLFVLESSLPGMLQFLSTQAYSRFLEECKKQT

SEQ ID NO: 137080 - protein, 131 aa, Glycine max
  Coding DNA Sequence Number=SeqID_20302
  Gene Ontology: Mol. function=nucleic acid binding; Biological process= RNA-dependent DNA replication
MVEAIQAIREMVAVMLQQTNQRNEEVAEFQGLSEFRRNNPSEFAGGYGPEKADLWIQEMEKIFCAMTCTNRQKVTFATYMLVDEAKYWWDSTRRLLEVVGVEGNMTVGEYATKLDELAITLLTFCFIPMKG

SEQ ID NO: 137081 - protein, 81 aa, Glycine max
  Coding DNA Sequence Number=SeqID_20303
MRVRELLTQGEGFDDARENLPDNDCHHQKAFQNGFDDAEKNSLDNDCHHQKGGECECALSTIPTWEGIALSEKLPIEQDLV

SEQ ID NO: 137082 - protein, 246 aa, Glycine max
  Coding DNA Sequence Number=SeqID_20304
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=75%, HitCoverage=13%, E-value=6e-43, Identity=44%"; Hit description=Chromo
MVHGTPQQLEFLGHIVSQEGVAPEQSKVQAMLDWHRPGFGRPIHGFLGLTGFYRRFFKGYALIEPPLTNLLKKGFSIPFFVETNASDITIGVVLMQQNYHIVYFSKHLYPRLMCASTYIHELHYITTVVKKWRQYLLGHLFVIVTNHKSLKELMTQSIQTTEQQVYLSKLLGYDYMIQYCVGHHNIVADALSRPSENSVAQFLVLSMPYFLFMHVALSSLSLWIYRFLKGAHFRALPPHFIAFQLA

SEQ ID NO: 137083 - protein, 101 aa, Glycine max
  Coding DNA Sequence Number=SeqID_20305
  Gene Ontology: Mol. function=nucleic acid binding
MASESSFVQPAIPKFDGHYDHWALLMENFLRSKEYWGLVENGIPESVEGTPLTEVERKHIDDKKLKDLKAKNYLFQALDRSVLATLLNKDTSKNIWDSLKQ

SEQ ID NO: 137084 - protein, 48 aa, Glycine max
  Coding DNA Sequence Number=SeqID_20306
MGMWIKIVTMQMWDWVLYKSERMMVLLEPELKFVMFQSLRKFLYLWVP

SEQ ID NO: 137085 - protein, 218 aa, Glycine max
  Coding DNA Sequence Number=SeqID_20307
  Gene Ontology: Mol. function=RNA-directed DNA polymerase activity; Biological process=RNA-dependent DNA replication
MKQVEGILESHIKSFLEQLIGFIGETTDTIEYAYLLTLFGDGRGSKSIMIKYLRVDALTFYNILIGCHLLNELRSIILTSHLVMKFLSKDDKTNAVRVYQIKTLECNVAGLNISIGKKVVELQVKLVACTSINNNLGNTTLDLRKVELKVKPTKEANPFQVGKKPSLYTKLGCQMSTKVEIHSPSIDKKRQPLCIVSIRHARNRSRVPWSQASHLSKG

SEQ ID NO: 137086 - protein, 78 aa, Glycine max
  Coding DNA Sequence Number=SeqID_20308
MIHIHPFPFLKEVLSLRVCFTYTWEIVMNPEDGVTFISGNTKSFTIPNNISLHELKERSMPLWKTTKHNHMLRQLQKW

SEQ ID NO: 137087 - protein, 453 aa, Glycine max
  Coding DNA Sequence Number=SeqID_20309
  Gene Ontology: Mol. function=transferase activity, transferring glycosyl groups; Cellular component=integral to membrane; Biological process=metabolic process
  Homolog annotation: Hit_ID=Q8S9A6; Match level="QueryCoverage=99%, HitCoverage=95%, E-value=0.0, Identity=75%"; Hit description =Glucosyltransferase-3
  Pfam annotation: Domain name=UDPGT; Domain location=5-451; Score= -69.1; E_value=3.8e-07; Accession=PF00201.9; Description=UDP -glucoronosyl and UDP-glucosyl transferase
MVELGKLILTHHPSLSITILFLTPPPNQDTPTSPTAFTCDATAKYIAAITAATPSITFHRIPQISIPIALPPMALTFELCRATTHHLRRILNSISQTSNLKAIVLDFMNYSAARVTNTRQIPTYFYYTLGASTLAVLLYQTIFHENYTKSLKDLKMHVEIPGLPKIHTDDMPDGANDRENEDYRVSVDIATCMRGSYGVIVNTCEAMGERVVEAFSKGLMEGTTPKVFCIGPVIASAPCRKDDNECLSWLDSQPSQSVLFLSFRSMGRFSRKQLREIAIGLEQSEQRFLWVVRSEYEDGDSVEPLSLDELLPKGFLERTKEKGMVVRDWAPQAAILSHDSVGGFVTHCGWNLVLEAVCEGVPMVAWPLYAEQRLNRVVLVEEMKVGLAVKQNKDGLVSSTELGDRVKELMDSDRGKEIKQKIFKMKISATEAMTEGGSSVVALNRLVEIWKEH

SEQ ID NO: 137088 - protein, 244 aa, Glycine max
  Coding DNA Sequence Number=SeqID_20310
  Gene Ontology: Mol. function=zinc ion binding; Cellular component =cellulose and pectin-containing cell wall
  Homolog annotation: Hit_ID=Q6Z692; Match level="QueryCoverage=87%, HitCoverage=30%, E-value=6e-35, Identity=49%"; Hit description =Putative early-responsive to dehydration stress protein
  Pfam annotation: Domain name=DUF248; Domain location=2-235; Score= -385.5; E_value=0.016; Accession=PF03141.7; Description=Putative methyltransferase
MHLTKTVRKDGSSYKVLLKTFAGICYHSKMKLSYGRKLVKGIAIVKGSTSVTCIDEIKNSYPPPLCGKGYDVKSPYYREWQNYIEGTHSSRWISIKERETWPSRDHLNKKKLAIFGLQSNKFAKDSKSWKAAVQIYWSLLSPLIFSDHPKKPGDKNPPPPYNKLRNVLDMNAHVGGFNYAMLQAEKSIWVMNVVSLIGLNYLSLIQDRARESLHYDDTKIETSIEQKPKPKTVAKPIVAELAQR

SEQ ID NO: 137089 - protein, 74 aa, Glycine max
  Coding DNA Sequence Number=SeqID_20311
MRRLRNQWALETLTSRVVLDFLNTPKKKKRVLARTACFLSFELQVLHPPPFSCFKPRYGGVMFLALACSWSILH

SEQ ID NO: 137090 - protein, 86 aa, Glycine max
  Coding DNA Sequence Number=SeqID_20312
MGFGLGLRVSSSERHEFAIVENIYFSSVYRGKTSGIGHQIDVSTLDVNKMPAFYPQMPSINAKNEDDDVHANLNDHGEGLWENTPT

SEQ ID NO: 137091 - protein, 256 aa, Glycine max
  Coding DNA Sequence Number=SeqID_20313
MEERSRRGKQMQFGDNEKESKEAIKIELSKMISQHSPPVKVPDVHVLAARVNTKGSCVEAAANPLDNVVRVSVVIVYDGDAQIPFPTSKIRFVREVVNTFIGWLTHLVKAVSDEDSHNRVPKPAGVDLLGELMKNLFDVYQKLVELPWDGMKFWIPNVQASFFVTHADSTSNGHGSVYGFLEPQSIHNAKDRCQECRHYIEAWVKESQREVYLGAYLNYAMKTLTTTFEVVLWWINFRHRGHDNTSQEMGNIFFTS

SEQ ID NO: 137092 - protein, 65 aa, Glycine max
  Coding DNA Sequence Number=SeqID_20314
ALNLVVKVFMVVSLEEAYRIDGWVRKMTMLRGAFGLIAHVVKISIESSLSLMSMMDELMMMVFNG

SEQ ID NO: 137093 - protein, 95 aa, Glycine max
  Coding DNA Sequence Number=SeqID_20315
MVMSIGSDGTEVAILNEAESGGPIGTLVVGEGSFGGNVKEIDIFLSRMSSRKGEGMRERVKAEPRVALRWWLGNLRERESNGKSKSESTRAWREK

SEQ ID NO: 137094 - protein, 199 aa, Glycine max
  Coding DNA Sequence Number=SeqID_20316
  Gene Ontology: Mol. function=transferase activity; Cellular component= integral to membrane; Biological process=fatty acid biosynthetic process
  Homolog annotation: Hit_ID=Q9M508; Match level="QueryCoverage=54%, HitCoverage=21%, E-value=3e-34, Identity=72%"; Hit description=Beta -ketoacyl-ACP synthetase I
MTSIAPLVLPISNPQTTAGTSSAGGGAIEVPTNNLAFGDHHPPRLASVFRNDVEGLYEKLLAGESSITPIDRFDASKFRTCFGSQIRGFSAEGYMDDKNDRRFNDCLHYCIVAGKKALENADLAPNKHSKRPPYEEPLDWPTRKRVALGSAMGLSYLHDHCDPKIIHRDVKAANILLDEEFEAVVGDFGLAKLMDYKDT

SEQ ID NO: 137095 - protein, 44 aa, Glycine max
  Coding DNA Sequence Number=SeqID_20317
MNTKDTKQQRVLGNVSPIPIVGAKVFQKRLPYIGDDLIQNTREV

SEQ ID NO: 137096 - protein, 62 aa, Glycine max
  Coding DNA Sequence Number=SeqID_20318
  Gene Ontology: Cellular component=mitochondrion
  Homolog annotation: Hit_ID=Q45Q23; Match level="QueryCoverage=68%, HitCoverage=14%, E-value=3e-14, Identity=79%"; Hit description=PHB2
MLRNRMLVDPAFLFKIGSEVYPKGTHFIISWFERPVIYDIRARPHLVKSTSGSRDLQMDFLH

SEQ ID NO: 137097 - protein, 92 aa, Glycine max
  Coding DNA Sequence Number=SeqID_20319
  Gene Ontology: Mol. function=oxidoreductase activity; Biological process=metabolic process
  Homolog annotation: Hit_ID=P93697; Match level="QueryCoverage=83%, HitCoverage=29%, E-value=6e-13, Identity=52%"; Hit description =CPRD12 protein
MDKAEAIEALISNQVIIVNLDEVFLGMKLTVRVMIPSRYGSIVAMASICGRIGSVALQTYMSSKHNIVELVRNAVVDLGPLRIRVNIVSPYE

SEQ ID NO: 137098 - protein, 174 aa, Glycine max
  Coding DNA Sequence Number=SeqID_20320
  Gene Ontology: Mol. function=lipid binding; Cellular component =integral to membrane; Biological process=cell division
  Homolog annotation: Hit_ID=Q56Z59; Match level="QueryCoverage=78%, HitCoverage=30%, E-value=4e-25, Identity=45%"; Hit description =Patellin-3
MGKMYEHIQTIPTNPNSNRVSDSEKNSIDELKKLLKEELEDEEVSIWGVPLLKDDRTDVILLKFVRAWELKTLSDGGRTSTSMPFWMKIWVTTWRRWCSCTDTVEKAIPSVTTSTTSSRTRTSTTRPCPLRIIKKSFSDGIFSCWSTLFDTSRIMKKKLQCFTKRTLGFKRFTK

SEQ ID NO: 137099 - protein, 72 aa, Glycine max
  Coding DNA Sequence Number=SeqID_20321
MERDRKERPKEVKSYFSPFQGNQSAPERSSYGERKPYTITVTASFMLWRKCYTPIVNSNFEKLPRYLYCGEG

SEQ ID NO: 137100 - protein, 97 aa, Glycine max
  Coding DNA Sequence Number=SeqID_20322
MAIRLFNFIGYAYEDTKGKKSLKHYQTQILGFHQRLLRSKCKFKCKSNETNKNIALEIDNDKNENEGKDKEIPPPPIPKEDAERYQEIPISNEEFND

SEQ ID NO: 137101 - protein, 449 aa, Glycine max
  Coding DNA Sequence Number=SeqID_20323
  Gene Ontology: Mol. function=calcium ion binding; Cellular component =extracellular region; Biological process=pathogenesis
  Homolog annotation: Hit_ID=Q8XQP2; Match level="QueryCoverage=100%, HitCoverage=87%, E-value=5e-92, Identity=37%"; Hit description =Probable hemagglutinin/hemolysin-related protein
APEKPVIKEVYDNQGDKQGALNPGEVTDDAQPTVRGEAEPGSLVNLYDNGQLVGSAVTNAEGQWEFTPTRPLLNGAHSLTVEAVDAAGNISEPSDSFDFMLEAGGAPTAPAITGVVDNVGDVQGAIEKGGVTDDVRPGINGTAQPDSVVTVYADGKVLGTVLTDAAGKWSFTPDSDLAEGLRNLSATATNAAGNISPSTGLYPIVIDTTAPDASSDNQLTDDVGDIQGPINSGDTTDDAQPTFSGVTEPGATIIIRDNGQPIGSAVAGKDGNWRFTPDQPLADGDHSFTAQPVDKAGNKGTESQPVDFIVDTSAVLVTINSVYDDAGSVTGNLTSGAVSDDTTPTLNGSATPDALIHIYNNGTLIGSAKANYKGEWSFTPDVALAEGEHHFTATATNAAGTSAESSPFDLTIDLTPPVVGGIDSVLDDVGTVQGPVDNGGITDDTTPTL

SEQ ID NO: 137102 - protein, 76 aa, Glycine max
  Coding DNA Sequence Number=SeqID_20324
MGPWAHLGPSGSFYMKQPARLGELGGKLLPYFGYKIAWEAEGKGFNTLGKHISLKINEKKEKEEENQGRGTSVTLP

SEQ ID NO: 137103 - protein, 264 aa, Glycine max
  Coding DNA Sequence Number=SeqID_20325
  Homolog annotation: Hit_ID=Q01093; Match level="QueryCoverage=52%, HitCoverage=97%, E-value=3e-16, Identity=43%"; Hit description=SmfE protein precursor
MTKHRLVPLMKYYSRLLIGSLLLCICWPLHAVELRLHGTLIENPPCTLNDNQSLMIEFGDALSVKKIDGVNYLQRKAIPVKCTEDPGAALQCAAQQCECAGYSLLSGQQAAGGQQHVADCFPRHTRSRRGAGTAAGRDAGGWGVHRQRGAAAGISVRRGDESGSNAGTGMAAGVTGTGDRDAAARHAGGGTLFSGAGSAAAGAQLWRYRCEIAVSESAHAGASADVELVFNGLADAEQPDLLALAGDAGAKGVAIGLSDADGTL

SEQ ID NO: 137104 - protein, 90 aa, Glycine max
  Coding DNA Sequence Number=SeqID_20326
MGSSGGGKPFQAVEKQPGQNKKQGGVEQRALRDPAIDAYRVERPGKRHAREERAHQAQQQGRDEHAVNVDFTDHVRDSSAKPWGSAAAAA

SEQ ID NO: 137105 - protein, 291 aa, Glycine max
  Coding DNA Sequence Number=SeqID_20327
  Gene Ontology: Mol. function=protein transporter activity; Cellular component=membrane; Biological process=protein secretion
  Homolog annotation: Hit_ID=Q578N8; Match level="QueryCoverage=95%, HitCoverage=96%, E-value=7e-66, Identity=45%"; Hit description=HlyD family secretion protein
  Pfam annotation: Domain name=HlyD; Domain location=47-285; Score =65.8; E_value=1.4e-16; Accession=PF00529.10; Description=HlyD family secretion protein
MFRERTLVLLRPALTLIAVLIAAGVLWQLYLYYTYAPQTRDGKIRADVVPLATDVSGKVDAVHIHDNQLVHKGQLLLSLDKVRLRNALDQAEAAVERANVQLASSQRENRRYQALQSAISQQERDNRRDAQSLAKANLDQALADRALARINLQRADLYAPVDGVITNFSLRPGAYATAGQPIMALVDSNSFYIAGYFEETKLGRIQNGDKVVIRIMGERQPLYGHVDGLSAGINDSERTTAAGNLLANVNPTFNWIRLAQRIPVRISIDTIPHGVELIAGRTATVSLIETH

SEQ ID NO: 137106 - protein, 91 aa, Glycine max
  Coding DNA Sequence Number=SeqID_20328
DIGRKGCNIFQWHDPVGNNRQKKIIVALMKEVDELKLREKDLQSRISDMKMKEKFIGIVLVGPVTRAMSKRLQEDWARAVEEGPRILMNLR

SEQ ID NO: 137107 - protein, 234 aa, Glycine max
  Coding DNA Sequence Number=SeqID_20329
  Homolog annotation: Hit_ID=Q2HRX8; Match level="QueryCoverage=67%, HitCoverage=30%, E-value=1e-14, Identity=33%"; Hit description=IMP dehydrogenase/GMP reductase
  Pfam annotation: Domain name=DUF1723; Domain location=146-196; Score =11.2; E_value=0.024; Accession=PF08330.1; Description=Protein of unknown function (DUF1723)
MVRTKGLGRALGRVVNRGLGRGDHDDPDGAPQWRSPTASACKQWVSVIVVDDEPVVPVVAADKPMVDAHAAADESEGFPGGPTDPSMLTEYAEHVVAIVWTGEERPELKLSSHRRKVQKLGRPIPTIEGLVARTGLSPLIACSVDTGNRGLISSFVERWHRETSSFHLPVGERQPWPRQDIVMDHTYACLSYETYINADVKPNTGQLQLVPIFFIFWVALFLLIRVQPMFMLCS

SEQ ID NO: 137108 - protein, 272 aa, Glycine max
  Coding DNA Sequence Number=SeqID_20330
RNILPKRKVELYHTELDDFKTELERCNFHKRLTNLVDGSIDLALVKEFYANLYSSEGRSPKQARVRGHLVKIDVDSLNTFLETPMVLAEGETLPTYSRYCRLPTDYREIEVALCIPGRGFILNADGHPGRILKKDLTNLAQMTSIAQSRTSRLEFPALITTLCRARGVVSNSLTFECLSPVINLAYIRKNCWNPEDLTVSIRGTRRARARPTELPSTSTTPTPASTSAAPSVPAQTDSQRFKAMLQRIHQGQIILLQSLLVVVPPGSIPSVE

SEQ ID NO: 137109 - protein, 232 aa, Glycine max
  Coding DNA Sequence Number=SeqID_20331
  Gene Ontology: Mol. function=chitin binding; Cellular component =extracellular region; Biological process=chitin metabolic process
  Homolog annotation: Hit_ID=UPI00006A17C9; Match level="QueryCoverage =74%, HitCoverage=100%, E-value=2e-21, Identity=34%"; Hit description= UPI00006A17C9 related cluster
  Subcellular localization annotation: CTP_CleavageSite=32; ConfidenceScore=5.21e-01
MRTRSPLKVRACSPLKARMCSPLEVKACSPLMARTYSPLKVRVCSPLLARTCSPFKVRACSPTKVRTCSPLMARAYSPLKVRACSPLLARTCSPFKVRACSPTKVRTCSPQMARACSPLKVRTCSPLKVRACSPTKVRTCSPLMARACSSLKVRTCSPLKVRVLVPKARAGSPLKIDCPFERGDNSCNLILSFANLSGNSLREGTYWVRTSNLLLGSLEVFAWCLSLPQCRA

SEQ ID NO: 137110 - protein, 137 aa, Glycine max
  Coding DNA Sequence Number=SeqID_20332
  Homolog annotation: Hit_ID=Q1T344; Match level="QueryCoverage=73%, HitCoverage=34%, E-value=2e-08, Identity=32%"; Hit description=RNA polymerase, RBP11-like
MDEDQWMYEKECGVNEPHVDCLDALNTSQETEIICTVIIRSDTNAGNRGRISFVLIGCEMSAEYRCRKKEFVRRDTGTRICGCPFKLHGKPVVRGQGWMVKLMCGIHNHEFAKSLVGHPYVRRLSKAKKTLIADMTK

SEQ ID NO: 137111 - protein, 46 aa, Glycine max
  Coding DNA Sequence Number=SeqID_20333
MGFLICNKAAMIIVVAAVNDVMLIFGMSELLFLKSQGCKGVRIIRK

SEQ ID NO: 137112 - protein, 177 aa, Glycine max
  Coding DNA Sequence Number=SeqID_20334
MPPFYHEQWAPHYPEFARFDYDGASYQIRLRQYRGKLFFTVGLKQLRNHLNIYELVTINFMACEHKWIFNLHFTPLLEQQACGRPLPVFRMHVGTIELTQALLGDPKPLRLPPIAAVHLPSCGFHMTILRKFGPPLQWPIVLVSPGFHGKYVAQPWYRFLAEDDFVHGDELLFYYRP

SEQ ID NO: 137113 - protein, 128 aa, Glycine max
  Coding DNA Sequence Number=SeqID_20335
  Gene Ontology: Mol. function=peptidase activity; Biological process =proteolysis
  Homolog annotation: Hit_ID=Q116U1; Match level="QueryCoverage=61%, HitCoverage=83%, E-value=1e-20, Identity=59%"; Hit description=ATP -dependent Clp protease adaptor protein ClpS
  Pfam annotation: Domain name=ClpS; Domain location=45-121; Score =126.4; E_value=7.9e-35; Accession=PF02617.7; Description=ATP -dependent Clp protease adaptor protein C
MAVLATGPGKGGGVLEKPVIEKVTPGRESEFDLKIFWDISFGKSRKSAPPYRVILHNDNFNKREYVVQVLMKVIPGMTLDNAVNIMQEAHYNGLSVVIICDQADAEDHCTQLRGNGLLSSIEPASGGC

SEQ ID NO: 137114 - protein, 357 aa, Glycine max
  Coding DNA Sequence Number=SeqID_20336
  Gene Ontology: Mol. function=RNA-directed DNA polymerase activity; Biological process=RNA-dependent DNA replication
MRRWCFPSFNTGVELTASSATERYKSRGISSRVESRQAEPRQGCWSIVQLLDFLDVGRTVHLQYRCAFVGVGFYSPMCDHKAQELASTDLENAFFWVEAHVDINCAPVLMAGEVPAELCTLPGPFVHAHDLSIATNCGVRLSRLPSGRIERNFQAFGIALSYLLLIYLDSHDLSRQGGKLHLEMRHGENGFKLVQHFPSNQSKVRELVLTDGGHEVNVASSLYSFSCKADEWTKVRQDSFDGAALANEDLGHHEVGDYDGDNHRVDTTDVDAPDGMVVVDRVFACGVFVFFDLLICLFFCRHHGFCVFLVSFGYLRVEGLLEDCSAIAIRACNAHTWALMGEADACPTCAFCPTYVS

SEQ ID NO: 137115 - protein, 231 aa, Glycine max
  Coding DNA Sequence Number=SeqID_20337
  Gene Ontology: Mol. function=transcription cofactor activity; Cellular component=nucleus; Biological process=regulation of transcription, DNA-dependent
KLNLPVSTYAVDDSWNWNLLNILLPPEVCAKIAVIHPPFANGQDIPTLFHIFGIRKVLSEEGSLCGSYYKISLLVPIAWKPPRDGYCKVNINDNESFYAHSFQAACGGLISNSMGVPISTFHVKLGYYNSLCAELWALKHGIKIARDLQVQNVDFEMDSKAVVSIISKATSDVKQLFPFIAKISKLLNCTGWRVSLAHIYIEANKCVDFLAYLDHTGSFDVSFLDVYPPPS

SEQ ID NO: 137116 - protein, 75 aa, Glycine max
  Coding DNA Sequence Number=SeqID_20338
MHAFVKDSQASVKMIVHASIFDCDAGIVAVGEEAEKRDARDFLLHIISGPNNRILCFEVYDMKTDTDRQTEHGHG

SEQ ID NO: 137117 - protein, 164 aa, Glycine max
  Coding DNA Sequence Number=SeqID_20339
MVEALSIYKKWKGYSLDYEGSGKLVFSLRESNSCLVKNNAIRIFTRNRGSDFKINADQPNYSSAKVEEMETALTLTVDSGEALHGNLLNAPHCNSTSLQMTMPRKKNTKIAQGNKDHGTQGNEKLGEEEEEYESRERESEALGEEEEEYKKWERESEALGAQMF

SEQ ID NO: 137118 - protein, 601 aa, Glycine max
  Coding DNA Sequence Number=SeqID_20340
  Gene Ontology: Mol. function=protein serine/threonine kinase activity; Cellular component=myosin complex; Biological process =protein amino acid phosphorylation
  Homolog annotation: Hit_ID=Q8SA64; Match level="QueryCoverage=99%, HitCoverage=99%, E-value=0.0, Identity=62%"; Hit description=NIMA -related protein kinase
  Pfam annotation: Domain name=Pkinase; Domain location=4-227; Score =145.6; E_value=1.3e-40; Accession=PF00069.15; Description=Protein kinase domain
  Pfam annotation: Domain name=Pkinase_Tyr; Domain location=4-227; Score=-26.6; E_value=7.7e-11; Accession=PF07714.7; Description =Protein tyrosine kinase
  Pfam module annotation: Pfam domain module=Pkinase::Pkinase_Tyr; Domain location=4-227::4-227
MEQYEILEQIGKGAFGSALLVRHKHEKKKYVLKKIRLARQTERSRRSAHLEMELISKLRNPFIVEYKDSWVEKGCYVCIIIGYCEGGDMAEAIKKANGVLFPEEKLCKWLVQLLMALDYLHMNHILHRDVKVVGTPSYMCPELLADIPYGSKSDIWSLGCCIYEMTAHKPAFKAFDIQALINKINKSIVAPLPTKYSSSFRGLVKSMLRKNPELRPRASELLGHPHLQPYVLKVHLKINSPRRSTLPVHWPESNYMKKTRFLVPEDDPVSIYRDKRHSFTNDRTLNPSVSGADQDSVCSTLEIDCTPDHLNQRLAELRIGDSHQVKSIQKPVVSRTSSIVKTPKFASSKVSATNKKSMKSSKNCKTTRRELLDIWSNLKLPLSQNTTKSANTNRRASFPLPTRGGNRQPPCRSVSLLSHVSSPDISVNSPRIDKMAEFPLTSYEDSLFPINKTSSSARGSSGFPSHSNHSTVIDKCTVEVYGRASNKPGSMDAWQGIKQSVLKEIDEDKSGSSDQNATAGASSHTSSDLRRRQFDPSSFQQRAEALEGLLEFSARLLQQARYDELGVLLKPFGPGKVSPRETAIWLSKSFKENTFNPEESM

SEQ ID NO: 137119 - protein, 109 aa, Glycine max
  Coding DNA Sequence Number=SeqID_20341
  Gene Ontology: Mol. function=chitinase activity; Cellular component =cellular_component; Biological process=defense response to bacterium
  Homolog annotation: Hit_ID=O81228; Match level="QueryCoverage=98%, HitCoverage=89%, E-value=2e-23, Identity=51%"; Hit description=PR-4 type protein
MMAKLILLVCVLALASAQSAIVQFTYHLYQPEQHNYCATWDGEANMVGQPSVDLLGLKAHLLVAGDKHSNRRSAKRELWINAKMGRWTWTLVCSKDSTRTEVEMLKAIL

SEQ ID NO: 137120 - protein, 268 aa, Glycine max
  Coding DNA Sequence Number=SeqID_20342
  Homolog annotation: Hit_ID=Q41231; Match level="QueryCoverage=40%, HitCoverage=51%, E-value=2e-50, Identity=78%"; Hit description =Pathogen-and wound-inducible antifungal protein CBP20
  Pfam annotation: Domain name=Barwin; Domain location=15-130; Score =242.9; E_value=6.9e-70; Accession=PF00967.8; Description=Barwin family
MATRTRTRVLVSGESAKNVRATYHLYNPEQIGWNLVTASAYCATWDANKPLAWRKKYAWTAFCGPVGPRGRESCGKCLRVTNTGTGTEATVRIVDQCANGGLDLDVNVFRQLDTNGVGNQQVFGSSFVKDEGFLSHDEVVLDVFSELGNTLEIDLDALLECYNDVAPLSDEALHDQHVLDHVVAEVSVVLPREARDQGQGKSKEGEIKKEVRCKVAVVGHAIKEYGLAKGGGGGGVEEVREDTWSCVTEAMEGVGFEGEEGKLEVRKR

SEQ ID NO: 137121 - protein, 110 aa, Glycine max
  Coding DNA Sequence Number=SeqID_20343
MISHPFMSLTQHGDPPRHLPMQHDDTFVELDVTPHSVATAVMDEPPEDAHTDVGQPQHAVEACQAIVERLGKAAQPRIVIEGIEAYTVTKESLRIARGVTGQRNVYVRSR

SEQ ID NO: 137122 - protein, 236 aa, Glycine max
  Coding DNA Sequence Number=SeqID_20344
MRGAPTEESLSPFLVRDFGVQSLKVVQKVHKAWRSPLRKDKELRGIRNGIIGGYHEWLRVHTRGLDWLSKLKVINEENFEAPEEDEEVQALKLELGKARLAKEKFKSAATNIRKECTELREENAATARALEQETKRARNEEHGRDKYRGALWGSNNELKLRREERDQSRVHGMILKEELTACSRSKRSLAQHLEANHASYHRAIKGRVKPVVDPRTKTSRGLRTSVRREGSKREGD

SEQ ID NO: 137123 - protein, 1063 aa, Glycine max
  Coding DNA Sequence Number=SeqID_20345
  Gene Ontology: Mol. function=nucleic acid binding; Cellular component= intracellular; Biological process=DNA integration
  Homolog annotation: Hit_ID=Q1T010; Match level="QueryCoverage=86%, HitCoverage=78%, E-value=0.0, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=399-578; Score =62.6; E_value=1.2e-15; Accession=PF00665.16; Description=Integrase core domain
  Pfam annotation: Domain name=zf-CCHC; Domain location=268-285; Score =19.6; E_value=0.00058; Accession=PF00098.13; Description=Zinc knuckle
  Pfam module annotation: Pfam domain module=RVT_2::rve::zf-CCHC; Domain location=744-986::399-578::268-285
TTKNLDPFQQLAPELHDPRQRNPTKLTMVMLKNKDQIPAKLPIFDGTNYKRWTTQMKVVFRYQGVLDIISTSITPLEMNPTEAHRATHCEQMKKYDKAIFLIHHCVDSNVLEKIIDYETAKEAWDVLATTYTGDKQTKKMKSCGEVVTDSMKVEKVLTGLTPNFDHIVSAIEQSKDLETLKLEQLLGSLEAHELKMKNREGIKKEEKAFEKALFAKNQKKGGGDSWKNKKGKGKWKYNKQESSGSKSENQKKEGENNGKGKKKSKEHIQCYNYRKYGHYADECSNPKVPRKRGEEAKLACDSNDEEAVMLMATVNGETSIEEEWWYLDTGCSNHMTGHKDWLCEIDETVKRNIKFGDGKSVMAKGIGKVAIRRVDGSKVTISDVLYVPNMESNLLSLRQLLEKGFSMHMEGEHMEVVDSNGKYVLKVVVSKNRTFKVGVSTIEQKCLTAQSNDRKQPRKAYNATIPTRAKEKLAVIHSNVCDPFEIKSHGGGKYTSLEFENFCKEEGIIHEVMAPYTPQHNGTTERRNRTVLNMVRCMLREKHLPHDFWAEAVFTTTHILNRCPTKRLDSLTPEEAWSGLKPSVKHFKVFGSLCYRHVPEQNRRKLDAMAQTLILVGYHSIGAYKLFDPLSKKIVISNDVIVDETKEWDWNIGIERQTNETVEVELEGEEIQDEVQIDNEQYVNDEQNVNDGPDITPPVRFQDYDVFPDAAINVNGELMNLVLLAEVEPVSLEEALAIPHWRKAMEEELRSIQKNNTWEMVNLPSNKKAIEVKWVFKTKVKPSGEIAKYKARLVAKGFLQKPGLDFNEVYAPVARIETVRLIVAIASMRKWPVSQLDVKSAFLNGPLEEEVYTRQPPDYEKIGMEDKVMKLNKALYGLKQAPRAWNKRIDGFLQKQKFLKCTTEHGVYLKDCGVTGVVMLCLYVDDHLVTRDNKQEIDMFKKEMMDEFEMSDIGIITYFLGIKLSTDITYEVGLVSRFMKKPCKDHLLAAKRILRYMQIGVEMLVIERAHPAEYISAAFGASQALWLGMLLEELNIKCSNVMKLRIDNKSAIDLAKHPITHGR

SEQ ID NO: 137124 - protein, 58 aa, Glycine max
  Coding DNA Sequence Number=SeqID_20346
MVIHRLELCINMVQLAIEFVVSVAETVVIVQQRTVEPLGMLNRAIKFEDRVYNHLHIC

SEQ ID NO: 137125 - protein, 260 aa, Glycine max
  Coding DNA Sequence Number=SeqID_20347
  Homolog annotation: Hit_ID=Q1T2A5; Match level="QueryCoverage=28%, HitCoverage=7%, E-value=6e-10, Identity=52%"; Hit description =Integrase, catalytic region
MADTKSAMVSGKSSAVQLTEQQQQGQSLNVHSPYYLHPGENPAIALVSLTYIRSCASYSLEEVQLYGGFAHGYPHGRKYHKPQGPSINNENAINEENANSNVEQNQEAQGLDVKVTTQQYKALMTLLQQQGSSTHNSSHVNQIGTMTGSGHALTMAKLTTIKLLLALAAINKWNLKQLDVNNVFLHGDLNEEVYMVIPLVARTSTGINLCQRKYALDVLTNTGMLGSKPVSTSFDYTAGLYQHYGSPLSVEDASSYRRLI

SEQ ID NO: 137126 - protein, 84 aa, Glycine max
  Coding DNA Sequence Number=SeqID_20348
  Gene Ontology: Mol. function=RNA-directed DNA polymerase activity; Biological process=RNA-dependent DNA replication
MVMSFGLNNVGEAYQRAMVTLFHDMIHKEIEVYEDDMIVKSRMKDEHIVNLQKLFERLCSQKGIKVDQDKVKAILVMLEPLTEK

SEQ ID NO: 137127 - protein, 85 aa, Glycine max
  Coding DNA Sequence Number=SeqID_20349
MAVKKRLSQEVLKVTVELSSSKNQTRLICFKINTRLVQQVKPCFKIISRSSLAIETKCFQDIQGSGNRLPGSVIDYQKTGLTKSC

SEQ ID NO: 137128 - protein, 115 aa, Glycine max
  Coding DNA Sequence Number=SeqID_20350
  Subcellular localization annotation: CTP_CleavageSite=82; ConfidenceScore=5.33e-01
MESFQKICQQSHLFNGFVNGHQRPINSLSLLRLLRPQGPTRASTSRSCPKHEISALSVADLCTLFQSAYFEKRALQATRRTACALKPRFCKLREISEFESECEMLRRGGGIPFLV

SEQ ID NO: 137129 - protein, 176 aa, Glycine max
  Coding DNA Sequence Number=SeqID_20351
MARAGDNGGVYHQLDESQRLFLDAWTTQMQRLLNRNKEKPYRRIAKSSSFTLKPLSPREVCDDQIRMGEKREQEKENSEAPQRNMKKKSDTPEEKSDTHERKFNYFAEASEVRKVLPAHEPLNPQYCKDSRLGFFVRAQPKLRFGRHRHVFIYSARKTLAHLGKKTRFTDIDRKKC

SEQ ID NO: 137130 - protein, 66 aa, Glycine max
  Coding DNA Sequence Number=SeqID_20352
MEMTRKEELVLWVLQMVRGVDGQQQRWWWKSPFAFSSIQAFEEVFVDFNQWNQKRIEMMKFGLYGT

SEQ ID NO: 137131 - protein, 101 aa, Glycine max
  Coding DNA Sequence Number=SeqID_20353
DRARRTPSGTKEVQQGPGVSSSDYGPLSVLRSACHPSKVIRPPTNRAFIKKYCAPMQAEGETPQQPGDGQQQATNAPPPPPEPLSSSIKRLEYCLRHMADQ

SEQ ID NO: 137132 - protein, 302 aa, Glycine max
  Coding DNA Sequence Number=SeqID_20354
  Gene Ontology: Mol. function=nucleoside-triphosphatase activity; Cellular component=membrane; Biological process=cobalt ion transport
  Homolog annotation: Hit_ID=Q6DB29; Match level="QueryCoverage=99%, HitCoverage=93%, E-value=2e-92, Identity=51%"; Hit description=ABC transporter ATP-binding protein
  Pfam annotation: Domain name=ABC_tran; Domain location=33-230; Score =205.1; E_value=1.7e-58; Accession=PF00005.17; Description=ABC transporter
  Pfam annotation: Domain name=CbiA; Domain location=36-243; Score= -29.6; E_value=0.022; Accession=PF01656.13; Description=Cobyrinic acid a,c-diamide synthase
  Pfam annotation: Domain name=SMC_N; Domain location=5-233; Score= -124.4; E_value=0.017; Accession=PF02463.9; Description=RecFRecNSMC N terminal domain
  Pfam module annotation: Pfam domain module=ABC_tran::CbiA::SMC_N; Domain location=33-230::36-243::5-233
MNVLSVENLTISYRSGGLWREVVHRVSFTIKRGEMLAFVGESGSGKTTTAQAIIGLLAENARLDAGTVRLNGEEISRWSGKRLDNLRGARISLVPQDPGNSLNPVQTIGAQVSEILRLHQKSSKTERRQQVIALLEKVGLSHPEQRFDQYPHQLSGGMKQRVLIAIAIALKPDLIIADEPTSALDVTVQKRILNLLDHLRRESGTAVLFVTHDLALAAQRADRLVVFRHGEIQEQGNTGDVIRTPQHGYTRQLLCDLQGQNLHLTTTIRPFVTPAIRVEGYPCAGRRIGFRKNHPRPYLAGF

SEQ ID NO: 137133 - protein, 236 aa, Glycine max
  Coding DNA Sequence Number=SeqID_20355
  Gene Ontology: Mol. function=3-hydroxybutyrate dehydrogenase activity; Cellular component=cytoplasm; Biological process=aromatic compound catabolic process
  Homolog annotation: Hit_ID=UPI00005EE944; Match level="QueryCoverage =99%, HitCoverage=92%, E-value=1e-103, Identity=77%"; Hit description= COG1028: Dehydrogenases with different specificities (related to short-chain alcohol dehydrogenases)
  Pfam annotation: Domain name=adh_short; Domain location=1-151; Score =60.4; E_value=5.9e-15; Accession=PF00106.15; Description=short chain dehydrogenase
IAKVLAQAGAQLVLNGFGDSTSARAEVAALGKIPGYHDADLRDVGQIEAMMRYTESEFGGVDIVINNAGIQHVAPVEQFAVEKWNDILAINLSSVFHTSRLALPGMRERNWGRIINIASVHGLVASKEKSAYVAAKHGVIGFSKTLALETARTGITCNAICPGWVLTPLVQQQIDKRIAEGADPEQARAQLLAEKQPSGEFVTPQQLGEMALFLCSDAAAQVRGAAWNMDGGWVAQ

SEQ ID NO: 137134 - protein, 130 aa, Glycine max
  Coding DNA Sequence Number=SeqID_20356
  Homolog annotation: Hit_ID=O82913; Match level="QueryCoverage=98%, HitCoverage=90%, E-value=1e-38, Identity=55%"; Hit description =Plasmid pO157 DNA, complete sequence
MKKAWIFVAAVVALSGCAPLHPSDCHKTSALGSCDSGRFSDEDEYGQQARGIKEAFESQLADRYAWRGKKCRLHLEFAQDGTLEKMNTAEGNKAYCAALREAAKSATFPPFTNDKVYKAFAQSRFDMKGE

SEQ ID NO: 137135 - protein, 66 aa, Glycine max
  Coding DNA Sequence Number=SeqID_20357
MAEPSKKHKGSSSRSQRHSEVQDTPIPSSISSSSLFSSEEQHIRYTNLFSSPSIIDPKFIDLDLLF

SEQ ID NO: 137136 - protein, 209 aa, Glycine max
  Coding DNA Sequence Number=SeqID_20358
  Homolog annotation: Hit_ID=UPI00006DB690; Match level="QueryCoverage =70%, HitCoverage=51%, E-value=3e-45, Identity=59%"; Hit description =COG3662: Uncharacterized protein conserved in bacteria
LRDGGRPQRGGHARRFAVVLILQIAGKMGVAVAQVAGQKTAALRDVYPGQQRRIAGGIRRAVAADAGHPQMDGFDFGNQPLRLGGRAEGGNRHELAGAAQAANHIFAEVGVIPHPGQRQRVQHLQQQGADTAAQHRGEIAVNLPDDRLRAEQARIAGRVLKIDAAERQPGQAEHLFFYRCAYRFHPAASAVHPAASVPRVGRLIAPCGG

SEQ ID NO: 137137 - protein, 130 aa, Glycine max
  Coding DNA Sequence Number=SeqID_20359
  Gene Ontology: Mol. function=nucleic acid binding
  Homolog annotation: Hit_ID=Q1S0E9; Match level="QueryCoverage=54%, HitCoverage=32%, E-value=5e-09, Identity=40%"; Hit description=Zinc finger, CCHC-type
ALQALAQAMRNQNKGEATGVVEYQGVRRGRRLLLGNLIVGEYATKFEELVRYFPCYQGRDGESSKCAKFLNSLRPEVKQAVNYQGVCQFPLLAKPYSTPPKQHGNLPNNKRTVVMGFAGGSGCKPTTFSI

SEQ ID NO: 137138 - protein, 94 aa, Glycine max
  Coding DNA Sequence Number=SeqID_20360
  Homolog annotation: Hit_ID=Q8VYE2; Match level="QueryCoverage=59%, HitCoverage=15%, E-value=2e-07, Identity=49%"; Hit description =Import inner membrane translocase subunit TIM50, mitochondrial precursor
PLPPPPSAASPSRWNFLKYAVVGALTGGTAFAGYASYAYSLEEVEEKTRSFRESAKYAAGDGATALDVSIDYFSGFLHFHSSLLILCFRIILGV

SEQ ID NO: 137139 - protein, 312 aa, Glycine max
  Coding DNA Sequence Number=SeqID_20361
  Gene Ontology: Mol. function=aminoacyl-tRNA ligase activity; Cellular component=cytoplasm; Biological process=tRNA aminoacylation for protein translation
  Homolog annotation: Hit_ID=Q9PAG3; Match level="QueryCoverage=85%, HitCoverage=100%, E-value=5e-85, Identity=68%"; Hit description =Lysyl-tRNA synthetase
  Subcellular localization annotation: CTP_CleavageSite=38; ConfidenceScore=5.26e-01
MNCVPVSGICRDKSIIPLTEASAETRNSVQSSMFRNVRTALTRGRSRRPAHRRYAACGSSPSATDQHPPPRRRRRASRAMRPAMLRPAPAAPGRAHGGAAGRAGNAHAARGRRSVRDSRWPVPLHPGTARNAPPAAARRHGCVPMRPGWRANRGPRSSQSSRVSPTGSMCTSPSAARSAASSASNGSTPHVLLEQLAVAEHTQRRTAPDQGQRLANQLGGFLHQAMVVPTDPVPLQHGEFRIVAAARLAVAEHPAQFVTVTHARRQQALERILRRGAQPAAASAGIDMAGEIGSASPPPARRARRRSGAPAH

SEQ ID NO: 137140 - protein, 175 aa, Glycine max
  Coding DNA Sequence Number=SeqID_20362
MTRTRGLGRVIGRLVGGDRHDDHDVADVPERRMPIVSARRQRVHQMTADTRDLAEDVADMADDVPDLAKEAPEMRADIDGADGAEGSDADDAEGFPGGPRDPSVLTSFADHVAHAVWSGHERPDLKLVSHGRKVTLIGRPVPQIEGLVAATGLSPLIDFSVVTGDPGLIFAFVER

SEQ ID NO: 137141 - protein, 100 aa, Glycine max
  Coding DNA Sequence Number=SeqID_20363
EVVAAQLAQASWVASTRRHHLLLEHPGRPKMLRNFTDCPTMLPFDFRHVSELHGLPNDGFNIPTSGTSAIALDRPWMTKGAEDDVSLCASTGSFALDRRK

SEQ ID NO: 137142 - protein, 175 aa, Glycine max
  Coding DNA Sequence Number=SeqID_20364
TEIEKAQIVKEKFKSAALKIRKENAELRDVNIATTKALEQETKRARREEHGRNKFRGALWGSNNELKLRREERDQSRVDSLILKDELRICLRSKRSLSQRLCETETNMLAIISKYQEELNLATAHEHKVADEYARVYVEKEARGRAKVMSDAYSAPKEIHKLLSYCQHMIDIRNR

SEQ ID NO: 137143 - protein, 93 aa, Glycine max
  Coding DNA Sequence Number=SeqID_20365
MGAGDVSGRMWNGESRSADRLGTLTDADCDARALGVPRHLRAPGVGLWAPHSARLETRTKESDMCASQRASKPVRRKEADWWDPPVGCTADRP

SEQ ID NO: 137144 - protein, 274 aa, Glycine max
  Coding DNA Sequence Number=SeqID_20366
  Gene Ontology: Mol. function=RNA-directed DNA polymerase activity; Cellular component=chromatin; Biological process=RNA-dependent DNA replication
MLQHGIIRPSTSPFSSPIFLVKKRDGSWRFCVDYKALNAITVKDRFPIPTIDELLDELGGACWFSKLYLLQGYHQILMNKDNVQKISFRTYHGHYKFLVMPFVLCNAPSSFQATMNKILLEAVQMLCCPNTGGILEPHDFGVRHRTFAREGICDYCYPFNATADEGPIYMDTRNLELPDFTLPFVVETETSGVKMGAVLSQQGWPIVFFSKSFCPKLLRSSTYVRELVAITMMTDRQLVGLPTGWTDVTKDVLYLTLFLCSMLSPGLLNPDVYV

SEQ ID NO: 137145 - protein, 33 aa, Glycine max
  Coding DNA Sequence Number=SeqID_20367
MTVRLCAKVVVTLSELSGLSAYPSLSAASARLA

SEQ ID NO: 137146 - protein, 48 aa, Glycine max
  Coding DNA Sequence Number=SeqID_20368
MGANKSHSQALCELSFEHPDDLPMRKNDKTAGLSDDVSEVHGWQFSAT

SEQ ID NO: 137147 - protein, 192 aa, Glycine max
  Coding DNA Sequence Number=SeqID_20369
MHYIIVRILLPRSSNLAQASEEDLILMWDFLIGRPIDWAHLIRYRMHKALRSNAPLPYPQLVTLFLHHFQTPLDNEPFVKVKRSFAIGAGVVTSFSYRKDMDGQWLKKDAQPPQDERTHSPPPQRDDYSALMNEVLSELRGLCTYVGERFDSLDGRINAIDARFAGMDTRITQLEEDISYVRQCFDLPSPSS

SEQ ID NO: 137148 - protein, 102 aa, Glycine max
  Coding DNA Sequence Number=SeqID_20370
  Subcellular localization annotation: CTP_CleavageSite=34; ConfidenceScore=5.02e-01
MWINPSGYPYKRFMLILTREVRGKQKTNVVICTLCQSGASKPVGTRRLTSSSAPLSSRDSESDDMRIYPSGYPYKRFLLILTREVRWHAVIPKWLFVQNGFC

SEQ ID NO: 137149 - protein, 88 aa, Glycine max
  Coding DNA Sequence Number=SeqID_20371
MTTLVSACYQTLSLMDSERVFIRITTWVSPPATDFTDNHLGISACHLTSRVRIAKGGAVNKSEAFAPTYPQSVMRNSDLRSSCFERLK

SEQ ID NO: 137150 - protein, 90 aa, Glycine max
  Coding DNA Sequence Number=SeqID_20372
MANIRIPSCFIGYSSQNYAQMPLRHFTQHLMGAYIHVLYGSVFACLKPLGHEFKGLGCPPVALLDRPEPDAGRRSADHGPSAHSYPSPST

SEQ ID NO: 137151 - protein, 195 aa, Glycine max
  Coding DNA Sequence Number=SeqID_20373
MAPKKLFMKRSRKDTTGEGSSAALEFDSHQFQSAEHQQRFEAIKGWSFHRERHVQLREDEYPDFQGEIARRHWARLVTLMAKFDLKIVIEFYANAWPTEEEEDQQCEFSQRRSQADGFDEEAIAQQLCISGQDFSRTTAGRWVRIMRTSMTTLTQIWMTLLLSNVLPSDHNFDLPLPKCQLVYAILTRMSVHVAQ

SEQ ID NO: 137152 - protein, 75 aa, Glycine max
  Coding DNA Sequence Number=SeqID_20374
MVKEDFKEVSVSSKSIATPLGLEVIPQLKELLDEALVRKSLNPCALLVSKIGVPTNPKRIKATPEWPTPPSIRKI

SEQ ID NO: 137153 - protein, 88 aa, Glycine max
  Coding DNA Sequence Number=SeqID_20375
MTIQRLMSLRSLFYEDIFECMWEKEKVLGGGEGKMNLRRKESVSVTLQDYELCFTVLISNAKKFLFDYCWNTKTMVMIAQARIAWEIT

SEQ ID NO: 137154 - protein, 406 aa, Glycine max
  Coding DNA Sequence Number=SeqID_20376
  Gene Ontology: Mol. function=protein serine/threonine kinase activity; Biological process=protein amino acid phosphorylation
  Homolog annotation: Hit_ID=Q0ZCC5; Match level="QueryCoverage=75%, HitCoverage=18%, E-value=1e-27, Identity=36%"; Hit description=CCHC -type integrase
  Pfam annotation: Domain name=B_lectin; Domain location=70-184; Score=- 17.0; E_value=0.082; Accession=PF01453.15; Description=D-mannose binding lectin
  Subcellular localization annotation: CTP_CleavageSite=62; ConfidenceScore=5.35e-01
MVSPQLATWPCSMVLLQIFVVAQTRSNKIIGHSLLKKTSKASWMVSPHGQSRRNIVVGDSLLAETTSNNNNLSSWVVSPLGDFAFGFVLLEDTNNFLVFIWYAKIPEKIVVWYTNGETPASKGSKVELTADDESVLTVPNGELLWKNDNHNGKTLKDPRDTLLPSQPLEKGEKLLSRFLESNFSKGRFELLLQMDGILSIHALNSPSEYANENYCETRTEESNTSSPGTRLVFEPLGFCTLGGDQRSSCQCPKWYSLLDPNHPYGSSKLDFIQGCAEDELIGRKEDVAEYDFEVLINTDWPLSDYVLLKPFTEEQSFSFPTETQRCLGKTMIPTFIVGICEIIFVEGEKGIAQRQYKWRLQSLLILSNIWEPYQSNQRKKLRNPRNLLEMLLSLFGRHVSLLRGKG

SEQ ID NO: 137155 - protein, 188 aa, Glycine max
  Coding DNA Sequence Number=SeqID_20377
MTIICLRVSSAPPPVDHKRRRMTIIYLCVPSDMIVSGRQKVSGMTIICLRVSSGPPPLDDKRRRMTIICLCVPSDTIVSGWEKVSGMTIICLRMSSGPPPLDDKRRRMTIICLCVPSDTIVSGWQKVRGMTIICLCMSLGPQPLDDKRRRMTIICLCVPLDTIVSGWEKVSGITIICLCVPLDTIVSE

SEQ ID NO: 137156 - protein, 134 aa, Glycine max
  Coding DNA Sequence Number=SeqID_20378
GTIVDDWKFDYSSHDAHRIVCNDQVEITASEEDLILMWGFLTGCQIDWAHLVRYRMHKALRANAPLPYPQLVTLFLRHFQIPLDDEPFVQVNRSFAIGAGAITSFGYRKDRNGQWLKKDALPPLDERTPSPSPQ

SEQ ID NO: 137157 - protein, 44 aa, Glycine max
  Coding DNA Sequence Number=SeqID_20379
MVAFTLIWQRFEQLKNPRKKSVPHTSNSMINNEDLLTIYIYFTN

SEQ ID NO: 137158 - protein, 164 aa, Glycine max
  Coding DNA Sequence Number=SeqID_20380
GCISYNPVLAIRQLGYPMRGAPLKEEELAPIIARGSNNGPIGGYHRWLKAHMQGLDWLPSLRTSKVVEVEAPEEDEEVQALRAELEKAQTVKERFKSAALKIRKENAELRDVNIANTKALEQETKRARKGPITSRQFDLEGWVKGLPKVQEKLVSMFMRDKDQH

SEQ ID NO: 137159 - protein, 216 aa, Glycine max
  Coding DNA Sequence Number=SeqID_20381
MVSTLDFESSDPSVFRTRAADYLVEKQNQIENKVKHCVSTSRGQQRRSAMTPSRPEGTAFVITVNPCARRERHLSPALATSRLRVMRGRALASKKGRVFRYRESNPGHLGESQVVAQRRASRAAAARGGGRRCPAAAFNLSGWPSGLRRQTQGLSLARSTRVRVFWSSSEGRSRNYRNDKQYQQKVFRPLTTPGGTRTLNPRFRRPMPYPLGHRGR

SEQ ID NO: 137160 - protein, 43 aa, Glycine max
  Coding DNA Sequence Number=SeqID_20382
  Subcellular localization annotation: CTP_CleavageSite=4; ConfidenceScore=5.02e-01
MGPAAMVRRGTPPRPASSYPAAGSSLARLTTATAWVMRTPHGP

SEQ ID NO: 137161 - protein, 103 aa, Glycine max
  Coding DNA Sequence Number=SeqID_20383
MATMMEAMMSMKKIMEVNTVTVATVSVVSGNKHVFPPYGLPLNYTPPNENVNNSTPILIESQQPQTDHAHVSQPMGETHEISHRNLADFEPHLGYATKGKAVG

SEQ ID NO: 137162 - protein, 928 aa, Glycine max
  Coding DNA Sequence Number=SeqID_20384
  Gene Ontology: Mol. function=microtubule motor activity; Cellular component=microtubule associated complex; Biological process =microtubule-based movement
  Homolog annotation: Hit_ID=Q27IK7; Match level="QueryCoverage=94%, HitCoverage=43%, E-value=0.0, Identity=50%"; Hit description=Kinesin POK1
  Pfam annotation: Domain name=Kinesin; Domain location=124-431; Score =410.3; E_value=2.7e-120; Accession=PF00225.13; Description=Kinesin motor domain
MSKETRTSARRNPQTESNENEFEPCPPNQINFPPPRTPFSSIPDPSRFGNATPRLSVRFGKPHSEPNSAQSTPSRNTSRLSLGGGRLSSCAFVKETEFCVHVPHFDLKDDPSFWTDHNVQVLIRIRPLSNSEKVSQGHGRCLKQESAQTLVWLGHPETRFTFDHIGCETLSQENLFRVAGVPMVENCLSGYNSCMFAYGQTGSGKTYTMMGEIKETEGYLTEDSGITPRVFDYLFTRIKAEEERRKYYKLKYSCKCSFLEIYNEQITDLLEPSSTNLQLREDLKKGVYVENLTEHSVDTVYDVLRLLLQGTANRKVAATHMNCESSRSHSVFTCIIESQWEKDSMTHFRFARLNLVDLAGSESLVIMTLVDLAHGKPRHVPYRDSRLTFLLQDSLGGNSKTMIIANVSPSICCANETLSTLKFAQRAKLIQNNAKVNEDASGDVSALQWQIQQLKGQLSFLMNNKKFPSSVPNLEPNPESCRLSEVSEEYESLGERVTTDHQLLIPSKENKCMKTALVSALRREKMAETTIQNLKAEIDHTNCLVRQKEEEIQHTSSMLRHYKEKIKQLELLVDGKLSAEKYLMEENRALQEEIQLLKVNIDKNSESSRLALENDRLLQQLQLFQNFYEHGERERLLTELSELRDQLLVHLQEKFTYSMKNENQDTDTAQELEECQNMNSKLLREVGILQANLGKYLNYNQILNSSFEHPGEILKTDKCSLVETISMRSDSGDEIPSSTWEADDALANIIEGNALRSSIMLAKDNEYNNEELEAKLEKMSKDLEEARLVNDQYQEKWALQLYQKRQTETICQEVEMETTNTILHLQEEVAHLQSEFEERLCTIAQENTELRNMVAEKEEEIRSRCLDWEKAILELTTFLLEGSRSLKDACGQANAWISEHVDMAVKKYIEKEETIQQLQSSLKDAQKM

SEQ ID NO: 137163 - protein, 195 aa, Glycine max
  Coding DNA Sequence Number=SeqID_20385
  Gene Ontology: Mol. function=ubiquitin thiolesterase activity; Biological process=ubiquitin-dependent protein catabolic process
  Homolog annotation: Hit_ID=Q9SLV3; Match level="QueryCoverage=92%, HitCoverage=44%, E-value=2e-12, Identity=28%"; Hit description=ZW9 protein
  Pfam annotation: Domain name=MATH; Domain location=61-185; Score =35.6; E_value=1.7e-07; Accession=PF00917.16; Description=MATH domain
MKAEWGIDQFIPLRDLNLASKGYLVDDTCAFGAEVFVCKERSTGKGECLVMMKEAITYKYLYEFDNLKLDSECYNSKPFNAGNFKWKIKLYPKGKGAELGNYLSLYLALADPLALSTCSKIYAQIILLILDQKQANHHFGKANYWFSVSSQENGAARFMPINNFTNQNLGYVVKDSCLVEAESDLAKTQVDPRID

SEQ ID NO: 137164 - protein, 1179 aa, Glycine max
  Coding DNA Sequence Number=SeqID_20386
  Gene Ontology: Mol. function=microtubule motor activity; Cellular component=microtubule associated complex; Biological process =microtubule-based movement
  Homolog annotation: Hit_ID=Q27IK7; Match level="QueryCoverage=72%, HitCoverage=40%, E-value=1e-178, Identity=42%"; Hit description =Kinesin POK1
MNDDIQDISIPELDVQARLGNCTISENQDVQNNLILNDLMAQVELTKLEVLEMENAVKASFVDTETQIEAFQTGVSGLYSAYRNLIQDIVKETQDTKKEIRDLKIYHRSSKGYRVDSLTSNANKCKEYANQHHTLHQIKEQLVEVNRRLNVIDNFIRAENMSSFQLLDEDLIDADDLSADSSSVSDLSTETDSFASGSKSHESTYTCNFKFPGKTTEQIVHLKSERCSVIQSHGSCKSSNTGKLVERRIHNEAVVCCLSKELNVTYDSFQRLYLRLSALLQELDDGSCFYPKELKKVAPYFQLEMQKDKAGCENDKEILGYMEIKPDDGFLTKFMEAHATVQEADLTLHALTEAYEDSKQLTAMWKQAGEDLMIERASLVEEIQKLKFSIFHKEEENRLLKDHIHFSLMDMTNSVSMLEEHFLQMQIDVEKKFLTMYSDILVTGQEMLYFMHNLRSSVEDICSQMVGEGFISFVLYNCCVTELVSKFACTSVNRDLQSARPGELHKLPQICSSVAAPAISTGKEGAEKRDQCVLIQKVQEQPDLPNVNVLYENMALRKELERKQELLEGLLFDFRLLQEQASNSKDIKDQTEKLIFSLTQVRYELEIKASQLDDILVQNRKLEGSLADTEKALTTSNYDLQLAKESIEKLSNQNVELRELLKELYANKTEADGKLEEHKEVIRGLEKEISNLTASQENQSLALFESIEDELNQVIIERDQLHEEVCVLNGKLEMAYSLADEKEAIAMEARQESESSKLFAEQKEEEVKILEHSVEELESTINVLEKKVHEMDEEVGRHRLISDSLRMELQALKERLLLVDNFPKNAYSESTSGQTDEHISRQPSKILELREALSRIRFLEKENAEQDKEIKKCKEYISEIVLHAEAQALQYQQKYKCLESMFHEVKTEVSNSTSMVSASEKIEKSSVRTRGSSSPFRCISNIVQQMNQEKDQELLVSRLRVEELEALAASRQKEVCMLQTRLAATESMTHDVIRDLLGVKLDITDYANLIDENQIVKLVEEAHHHREEFIAKEKENLDLRLQINDLIEERECCISELKTKEADILATQIAMQQLQERDQLLSAQNEMLKMDKTNLIRKVAELDDMVKTLVGTRNTQPAPQSSKTKACLLIFLFLDKGALNLGNGGYNKRLSLSQPERRLSRFNDEPSRYRKFAGNNSQG

SEQ ID NO: 137165 - protein, 60 aa, Glycine max
  Coding DNA Sequence Number=SeqID_20387
GNRNQPSRGKSKAKQPRGARSEIEAILKKEKVAATEGKKSTLKGRRRAERGSVNEERCGG

SEQ ID NO: 137166 - protein, 998 aa, Glycine max
  Coding DNA Sequence Number=SeqID_20388
  Gene Ontology: Mol. function=monooxygenase activity; Cellular component=nucleus; Biological process=electron transport
  Homolog annotation: Hit_ID=Q339A6; Match level="QueryCoverage=93%, HitCoverage=90%, E-value=1e-177, Identity=39%"; Hit description =Anther ethylene-upregulated protein ER1, putative, expressed
  Pfam annotation: Domain name=Ank; Domain location=647-679; Score=6.3; E_value=3.8; Accession=PF00023.20; Description=Ankyrin repeat
  Pfam annotation: Domain name=Ank; Domain location=680-712; Score =23.2; E_value=0.00093; Accession=PF00023.20; Description=Ankyrin repeat
  Pfam annotation: Domain name=Ank; Domain location=719-749; Score=0.9; E_value=24; Accession=PF00023.20; Description=Ankyrin repeat
  Pfam annotation: Domain name=CG-1; Domain location=17-135; Score =212.8; E_value=7.9e-61; Accession=PF03859.7; Description=CG-1 domain
  Pfam annotation: Domain name=IQ; Domain location=852-872; Score=24.9; E_value=0.00028; Accession=PF00612.17; Description=IQ calmodulin -binding motif
  Pfam annotation: Domain name=IQ; Domain location=875-895; Score=31.1; E_value=3.8e-06; Accession=PF00612.17; Description=IQ calmodulin -binding motif
  Pfam annotation: Domain name=TIG; Domain location=447-533; Score =10.7; E_value=0.079; Accession=PF01833.14; Description=IPTTIG domain
  Pfam module annotation: Pfam domain module=Ank::Ank::Ank::CG -1::IQ::IQ::TIG; Domain location=647-679::680-712::719-749::17 -135::852-872::875-895::447-533
MEKLTDNGDNRTQLAKLASPTHQRKDLDRYICFACYEDGVLILTSNCYSFLPAGSLFLFDRKALRYFRKDGHRWRKKKDGKTVREAHEKLKAGSVDVLHCYYAHGEDNEYFQRRSYWMLDEQLEHIVLVHYREIKEGCKSGISHLPVVPVTLVGSSQNTSVLSSTKINSPISLVQTSFTSSANKVYQNGRASEHEDVNSKNGPQASSHAQPISNYVLHSAPWLTHEAAGFSELLRNPLISSWPSSFPSYSPGTGLSPWTSIQNSSRNTINMHDGKHHVEASEADLTVRKLSNAGLDSVHRMQDGVIFRDRLITDMCVQPVIDLPTVNQVKNEHGLDSFHAQVHDHNDHPVVATTKILVEQKLQDGGLYNDESEQVEYGEMKKLDSFGRWMDKEIGGDCDNSLMASDSGNYWSTLDAHSEDKEVSSLRHMQLDVDSLGPSLSQEQLFSIHDFSPDWAYTGVRTKVLIVGTFLGSKKPSSETKWGCMFGEIEVSAEVLADNVIRCQTPLHSPGRVPFYITCSNRLACSEVREFEFDENPTKFLGPEGIKISPEEEVRLQMRLLKLVDLGPDNKWLKCSVSECEKCKLKGTMYSVRDDSGVFEETFQIDGIGHINHRDILFQRLVRDKLYEWLIYKVHEGGKGPHVLDDEGQGVIHLAAALGYVWAMAPLVAAGISPNFRDSRGRTGLHWASYFGREETVIVLVQLGATPGAVEDPTSAFPRGQTAADLGSSRGHKGIAGYLAEADLTNQLSVLTVKENETGNIATTIAANSALQSVEDDSSSMTMDEQHYLKESLAVFQKSAHAAASILAAFRARSFCQRQLAQSSSDISEVLDVVADSLSKVQNKGHFEDYLHFAALKIQKRYRGWKGRKDFLKIRDRIVKIQAHIRGHQVRKQYKKVVWSVSIVEKAILRWRRKGAGLRGFRVGQPVGVVVKDAEKSDEYEFLSIGRRQKSDDVKKALDRVKSMVRNPEARDQYMRLIMKYEKFKIDDGGSSQSQHVG

SEQ ID NO: 137167 - protein, 113 aa, Glycine max
  Coding DNA Sequence Number=SeqID_20389
MTFKEVTNPSTTLAQARLACGVLMGSGALVPVTHPSTTLAQARLTADAGMIAPDKYCTINYYIPSAYPDGPTFDRVDGLDKPDATQTHADSCLSPKSVFLSYLSKGTQKQTPL

SEQ ID NO: 137168 - protein, 205 aa, Glycine max
  Coding DNA Sequence Number=SeqID_20390
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-28, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
QHVHLFKRLHSLAFRGQHILAFTGLHVLLFRGLHALTFRWLQALIFEGLHVLAYRGLQALTFRGLHTLSFSGLHILAFRGVHALAIRGLHVLAFRGLHALAFRGLHVLPFRGLHALTFRWLHALTFRWLHALTFRGLHFLAYRGLHALAIRGLHVLAFRGLEVLTFRGLHVLTFRGLHVLLFRGLHTLTFRWLHALTFGGLHILA

SEQ ID NO: 137169 - protein, 75 aa, Glycine max
  Coding DNA Sequence Number=SeqID_20391
MSIKGGAGGAGGGDSISTSGEAGSCPLNKLCNIGIMGGACWASGSMVAVRGDGLNDEGMSSTLALFLEAIYKKRM

SEQ ID NO: 137170 - protein, 55 aa, Glycine max
  Coding DNA Sequence Number=SeqID_20392
MTKVKARAISRLGGVDGDPVLRGARIRATWECVSSVERWATEDGVFMFDLWKWES

SEQ ID NO: 137171 - protein, 230 aa, Glycine max
  Coding DNA Sequence Number=SeqID_20393
MYDSTEFPFECKKWPRGSLPQRDLGRIKRLKEPVPFPNMTATVLGVLSTSSATRPSRDGQWIPFDADALSQFLGYPLVLEEGQECEYGQRRNRSDGFDEEAIAQLLCIPGQDFARTAAGRRVRIMRTNMTTLTQIWMTLLLSNIQPSDHNSDLPLPKCQLVYAILTRMSIHVAQLIADAIYLFAGMAPTRHPLDPDKSNRDLGFPALITGLCQSFGVPVAPNKVVRPPIT

SEQ ID NO: 137172 - protein, 66 aa, Glycine max
  Coding DNA Sequence Number=SeqID_20394
  Homolog annotation: Hit_ID=Q9M3I5; Match level="QueryCoverage=41%, HitCoverage=7%, E-value=2e-07, Identity=82%"; Hit description =NAD(P)H-quinone oxidoreductase chain H, chloroplast (EC 1.6.5.-) (NAD(P)H dehydrogenase, chain H)
MDNYECYEEFDREVQWQKEGDSLARYLVVLANEVPREVELEVLVDDVEHEVEGVGGVMKVGRNSWT

SEQ ID NO: 137173 - protein, 112 aa, Glycine max
  Coding DNA Sequence Number=SeqID_20395
MACTSGDPTQPSPKTARLMAEIIKLGDQMRRMSCENKERMERMRKENEEKYEGYEDDEGGRINERYKERRNHRRYGGRQREEEMKVEQVYACYNYNEEKKIKLASLEFEDMP

SEQ ID NO: 137174 - protein, 200 aa, Glycine max
  Coding DNA Sequence Number=SeqID_20396
MKSPCHRAIRPVRVGFSKIYLTWSILDTVATYPSVGGRCEAHGCVFQERNTCSTNVYSRKTSEKPEKEKGGGGCRPARPGDLSSPRRAGLLPPHPFSYKKAVGGGSKDPSAPWLCISAVLGEKNCFREENPSRGASVTLPRCFRKQIREGFCPFFIVLHPFFGLQRNYVGLISSSQLRIRRSYKPRFCQPPQEIVNGPMP

SEQ ID NO: 137175 - protein, 177 aa, Glycine max
  Coding DNA Sequence Number=SeqID_20397
MHKALRLNAPLPYPHLVTLFLQHFNIPLDSEPYVPIKRSFLIGTSVIASFGYQKEHDGSWVKKGARHVDEEGHGGEDSSLLSKILDRFDGLQTFVGERSCHHQKGGDCRSKLHDESRPIQRVLMITKMMTKSKAQKSRTLHDNKDDDLQESKNEFKIESRTLQGSRGNLISRIKNQV

SEQ ID NO: 137176 - protein, 187 aa, Glycine max
  Coding DNA Sequence Number=SeqID_20398
  Gene Ontology: Mol. function=sequence-specific DNA binding; Cellular component=intracellular; Biological process=regulation of transcription, DNA-dependent
  Homolog annotation: Hit_ID=Q6CYN5; Match level="QueryCoverage=97%, HitCoverage=98%, E-value=6e-59, Identity=62%"; Hit description =Putative DNA-binding protein
  Pfam annotation: Domain name=Cupin_2; Domain location=111-182; Score =63.0; E_value=9.6e-16; Accession=PF07883.2; Description=Cupin domain
  Pfam annotation: Domain name=HTH_3; Domain location=12-66; Score =65.2; E_value=2.1e-16; Accession=PF01381.12; Description=Helix-turn -helix
  Pfam module annotation: Pfam domain module=Cupin_2::HTH_3; Domain location=111-182::12-66
MQELAGHLAHTLRTLRAQRGWSLTQAAEYTGVSKAMLGQIERGESSPTVATLWKIATGFNVAFSAFLEASPAQQQATLHRYGDLPVYDQDNADMRVVPLFPYDHQLGFDMFVIDLAPGALSESSPHEPGVIEHVIVISGRLELAIDGEWHSLAAGEAMRFQADRPHAYRNASSQTVRIHDLIHYPQS

SEQ ID NO: 137177 - protein, 72 aa, Glycine max
  Coding DNA Sequence Number=SeqID_20399
  Gene Ontology: Mol. function=RNA-directed DNA polymerase activity; Biological process=RNA-dependent DNA replication
MPGLNLDIVQHRLPLNPSCSPVKQKIRRMKPEMSLRIKEEVKKQFDVGFLAVARYPEWVAKIVPVPKKDGKV

SEQ ID NO: 137178 - protein, 110 aa, Glycine max
  Coding DNA Sequence Number=SeqID_20400
MVVSLFLTHLLLEVAFPIIFLHSPFRCHDLQEAKDSIDEEYPRLTSSTRSYVTPASLFFLLPLLSLFLFLFPTSEPLNPSPSMAIYRKKPFWSRGSSPRRAGAHPRELVT

SEQ ID NO: 137179 - protein, 104 aa, Glycine max
  Coding DNA Sequence Number=SeqID_20401
MDKSLKVGEDEWRERERRGTKFCASNEHEGHAQDPNERVYHTGYDSYNNILLFIHTYTHNNPMNQSHIHAQDKKAEIHTMCDLTSLPETYFQVSEIHSIHTARP

SEQ ID NO: 137180 - protein, 183 aa, Glycine max
  Coding DNA Sequence Number=SeqID_20402
DQGVPLLTKASPSGKGYTAFVLLSGPHKGVYTNFKDLCLAKEGIQSPIYKAKLDMDQFKSFGYEDLAITAKCLLDYGCLESILIPSSDRFEGFNPSINEAINLIQAEMMDYIAIKITTCPSNFTAQNYPCHVMKLLPEDHRDYPCLFNDEYESWDVQGNTQYQYNLMRAQIQGYQWFFSEEDK

SEQ ID NO: 137181 - protein, 241 aa, Glycine max
  Coding DNA Sequence Number=SeqID_20403
LEGPSPKQVRIRGHLIRIDADSLNAFLETPVVLAEGHPGKILKKDLTTLAQVWSVLSYSNLAPTSHTSDLTVDRARLIFGLVTQLDMNVKALISGQITSMAQSNSSRLRFPILITALCRTRGVAFDSLIFACLSPVINLAYIRKNCWNPDDPTVIIRGARRPRARPAETPSTSTAPHPASTSATPLLARLTAAPSTLPPIDFQHFKAMLQSIHQGKIILLQSLQLVAPPNSIPTVEQFNEW

SEQ ID NO: 137182 - protein, 63 aa, Glycine max
  Coding DNA Sequence Number=SeqID_20404
MGCCDGGVNTLVKIIAITGRSSFLEESGASFRAGLQAKKIPAEARSFFGGAQERTRTSTVLPR

SEQ ID NO: 137183 - protein, 102 aa, Glycine max
  Coding DNA Sequence Number=SeqID_20405
  Gene Ontology: Cellular component=integral to membrane
  Homolog annotation: Hit_ID=Q4KIM9; Match level="QueryCoverage=66%, HitCoverage=28%, E-value=2e-14, Identity=57%"; Hit description =Membrane protein, putative
AGIAARGAGAGFGAGLHCVDDFADHRPGAAWRIRHPAAEAECVGGAAGIAGHVAGAGDPAAHQCTGVPGLLPGFPAAARAGAGAAAVVVMPAVDRGDAESRA

SEQ ID NO: 137184 - protein, 248 aa, Glycine max
  Coding DNA Sequence Number=SeqID_20406
  Gene Ontology: Mol. function=DNA binding
  Homolog annotation: Hit_ID=Q1SFS3; Match level="QueryCoverage=96%, HitCoverage=47%, E-value=6e-57, Identity=48%"; Hit description =Lambda repressor-like, DNA-binding
TNDDKLSWPRRIMTLDPSDIVWYQAASDVGEIIVGCGEYPNVPLLGMRGGISYNPLLARRKFGYPIKTKPNNLALTNEFYLNHGDHSNKRERFAQAWSAIRRLNRSQLGKKSDYVHESYTQWVIDRTKSFGLPYRLPRYLSSTIPPSSLPIPFDTKEEFHEQLTKERQEKETWKRRCQELEQENETLKGKIAQQSRELFIQNQRMIEKDDLLRRKDALLHRDARRKRRFMDLFSRAHSDSEDPSTPGV

SEQ ID NO: 137185 - protein, 49 aa, Glycine max
  Coding DNA Sequence Number=SeqID_20407
MDIVEQENQSLREEVATLREGMDRLTTMMSALLSAQNSQAAAAAVEQPL

SEQ ID NO: 137186 - protein, 115 aa, Glycine max
  Coding DNA Sequence Number=SeqID_20408
MDEFRVCLRSKKSLSQRLCETETNMLAIISKYQEELNLATAHEHIVVDEYARVYAEKEARGTVIDSLHQEATMWMDRFALTLNRSQELPQLLARAKAMANAYSAPEEIHGLLSYC

SEQ ID NO: 137187 - protein, 54 aa, Glycine max
  Coding DNA Sequence Number=SeqID_20409
MSTYVRLVDQTISLNVLVESRSARRPVVSDLVLESPVSARSQLASVSGWPFYFD

SEQ ID NO: 137188 - protein, 200 aa, Glycine max
  Coding DNA Sequence Number=SeqID_20410
  Gene Ontology: Mol. function=protein kinase activity; Biological process=protein amino acid phosphorylation
  Homolog annotation: Hit_ID=Q2QZ78; Match level="QueryCoverage=77%, HitCoverage=27%, E-value=4e-43, Identity=54%"; Hit description=AT hook motif-containing protein, putative
  Pfam annotation: Domain name=DUF889; Domain location=123-199; Score= -125.3; E_value=0.0054; Accession=PF05970.5; Description=Eukaryotic protein of unknown function (DUF889)
MFFLYGFGGTGKTFIWRTLTSSLRAKNQIVIIVASSGIASLLLPGGRTAHSRFKIPVPIFEDSTCNIHQGTELAELLNQTSLIIWDEAPMAHKFCFEALDQSLRDIIIDKSKSNQIFGGKVIVFCGDFCQILSVIPRGTRSDIVNAAINSSYLWDSYIGDGIIDDENDGYATIQILAHLLITQYDDPISAIVKSTFPDLD

SEQ ID NO: 137189 - protein, 81 aa, Glycine max
  Coding DNA Sequence Number=SeqID_20411
MSSRRGQVPVVTMAKGGELDTAEPEEIAQDECLALSESGSKASYSTDSDYSTLDASDASSAAQYVLLFGESVPYLARTLSD

SEQ ID NO: 137190 - protein, 32 aa, Glycine max
  Coding DNA Sequence Number=SeqID_20412
ERGEACLLVRVRGKGFRKLNPLLVVFEPELAG

SEQ ID NO: 137191 - protein, 77 aa, Glycine max
  Coding DNA Sequence Number=SeqID_20413
MGDKLHRREGNSPDHQLRPLNDRSVIKEREGPARAVLDEAEARNVGLSNANVWGESNASKTQGVPPQGPSTEGGVRA

SEQ ID NO: 137192 - protein, 155 aa, Glycine max
  Coding DNA Sequence Number=SeqID_20414
MSGFTRNSPQISASPHQLDLAPYASEPYHAQWNAPGLLRDKHTLRSSRILGEMEVDEPWIGLWLPLRYQVDMGASFLAAKFTSWLVFLVCAKGGVRHWKCGRQTLWNGSHNMGFSLILTLFICPSFLIRPSGMIKFASFQTRFDPSAGEVQIRKA

SEQ ID NO: 137193 - protein, 286 aa, Glycine max
  Coding DNA Sequence Number=SeqID_20415
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=6e-32, Identity=30%"; Hit description= UPI00006A17C9 related cluster
LTFRGLHVLAFRGLHVLAFRGLHALTFRGLHALNFRGLHVLICRGLHPLIFRGLHVLTFRGWHAPTFKGLHALTFRGLHVLTFRGLHVLAFIGLHALTFKGLHVLTFRGLHVLTFGGLHVLALRGLHVLTFRGLHVLAFIGLHALTFRGLHVLTFRGLHVLTFGGLHVLALRALHLLVIRGLHALNLQRVTSTHLQRTRRLHALTFRGLHVLTFRGSRTLTFRGLYVLTFGGLHVLALRGLHVLAIRGLHALNLQRVTSPHLQRTRRPRLQRTTRLHLHRATRPHL

SEQ ID NO: 137194 - protein, 66 aa, Glycine max
  Coding DNA Sequence Number=SeqID_20416
MKADMEAMKEQMTTMMEAMMNMRKMMEDNTAIVVDASTSIEMDLIHPTGFNQVNHPVSDVVGQGDE

SEQ ID NO: 137195 - protein, 107 aa, Glycine max
  Coding DNA Sequence Number=SeqID_20417
MVGYTPSSFADLVFAGEMIEVGLKRGKSDPHALINEKTEANEEGENEGETHAATAVPTWPSFPPIQQCHFSVNNNHSPYPPPSYPQRPSLSQPQNPPTTQPMPKHHP

SEQ ID NO: 137196 - protein, 108 aa, Glycine max
  Coding DNA Sequence Number=SeqID_20418
LFVLQTAKKNVYTDNHSGISARQRDSNVSMTDLVSAEDDVNLRVSTGLSAAIDEGLFVLQTAKKNVYTDNHSGISARQRDSNFSMTDLVSAENDINLRVSTGLSAAID

SEQ ID NO: 137197 - protein, 262 aa, Glycine max
  Coding DNA Sequence Number=SeqID_20419
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=99%, E-value=3e-18, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTQSLAFSKGWTLGGLHALTFRGLHALAFRGLHVLAFRGLHILPLRRPHVLAIRGLHRTKHPRFPRLHALTFRGLHALAFRGLHALTFIGLHALNFRGLHILALRTTCPHLQTTICPHTKRATRPRLQRTTRPRLEDYTSSHSEDYKGLHAHTFIGLHALNFKGLHVLALRTTCPHLQTPACPHTQRATRPRLQRTTRTRLEDYTSSPLEGCTPSPSEDYKSSPSEDCTSSPSEDYTSSPSEDYTFSPLKGCTPSLSEDYTS

SEQ ID NO: 137198 - protein, 58 aa, Glycine max
  Coding DNA Sequence Number=SeqID_20420
MAMEDFRVQQSEVYFEPFSHAMVGSLTIHASLAQINVRPISHSISTPTTKYGKKKKGI

SEQ ID NO: 137199 - protein, 65 aa, Glycine max
  Coding DNA Sequence Number=SeqID_20421
  Gene Ontology: Mol. function=cysteine-tRNA ligase activity; Cellular component=mitochondrion; Biological process=cysteinyl-tRNA aminoacylation
  Homolog annotation: Hit_ID=Q9FMB9; Match level="QueryCoverage=83%, HitCoverage=11%, E-value=2e-12, Identity=61%"; Hit description =Cysteine-tRNA ligase
MDLESVVLFYIIKRANETGEDPLMLSNRFCDEYNADMADLQCETPSREPRVSEHLNEIKDMITQV

SEQ ID NO: 137200 - protein, 102 aa, Glycine max
  Coding DNA Sequence Number=SeqID_20422
MAEKTKKRLEEAAQSRSTQAIIDPLSPIRCHVKWKLARTKKTGQMTSEAAKEITEKIASQGLFVPHGRQDALTAAIGRPEHPGQVRAVGAGVTIKQYFGSAP

SEQ ID NO: 137201 - protein, 230 aa, Glycine max
  Coding DNA Sequence Number=SeqID_20423
  Pfam annotation: Domain name=PIN; Domain location=102-227; Score =55.5; E_value=1.8e-13; Accession=PF01850.12; Description=PIN domain
  Subcellular localization annotation: CTP_CleavageSite=88; ConfidenceScore=5.71e-01
MSSTRSRSAPGAIPARWKPRCAMCSRASPRRTRAASSHTWRRGSAAGGAGRSPPSRSWQESKRPRPHPIRTRCGRNGWPSWMPTGRIRSSSMGSRTRGRAVILLDTNVVIRLDSVLLPPDDVGLSAIVYAELQLGVERAADRTLRRRRRNELMRLSALLEADWLPFDQAAAEGYAHLAADVIRARPAHARSKDIMLAGHAYALGARLLTFNPKDFELVSGEVEILVPDLR

SEQ ID NO: 137202 - protein, 182 aa, Glycine max
  Coding DNA Sequence Number=SeqID_20424
MHYIIVRILLPRSSNLAQASEEDLILMWAFLTGRQIDWAHLVRYRMHKALRANARLPYPQLDRDGQWLKKDAQPLQDERTPSPPPQRDDSSALMNEVLSELRGLRTYVGKRFDSSDGRFEGMDTRITQLKEDELNCHHQKGGDCRSKDFDFDVLIMPCDHALLKFNSRQKSKKFKIHHQEDL

SEQ ID NO: 137203 - protein, 248 aa, Glycine max
  Coding DNA Sequence Number=SeqID_20425
KERALGCPYLTHSRARVMSEIEEVQEQMRVDIEAMKYQMAAMMEAMLSMKKIMEVNATAVATTSTAAKVDPTHPSGVNQISHPVPDMVGQGGEALGSIDSPHVVQSKNSFPPYGLPPNYAPPDVAHTPDENDHTLTDFEPYPGHATEGQAFVGRVPFAMVEREKFNHIEERLRAIEGGGDHAFADMEDLCLVPDVVIPPKFKVPDLDKYKGTTCLKNHLKMYCRKMGAYSKDEKLLMHFFQESLTGLA

SEQ ID NO: 137204 - protein, 58 aa, Glycine max
  Coding DNA Sequence Number=SeqID_20426
MATIALSSRYGSKLAYDTGIWGFVVDLGMAFVDNWVVGKEVIHFDPFTGEDQIRKALR

SEQ ID NO: 137205 - protein, 81 aa, Glycine max
  Coding DNA Sequence Number=SeqID_20427
MKVVIALSNKDGYSGGYNPHKITGHTKKAENNLWTYHNLFLLMQSYPARALDRKLQVDWARDAREGPRVLMSLRVDFGPMG

SEQ ID NO: 137206 - protein, 529 aa, Glycine max
  Coding DNA Sequence Number=SeqID_20428
  Gene Ontology: Mol. function=nucleic acid binding; Cellular component= intracellular; Biological process=regulation of transcription
  Homolog annotation: Hit_ID=Q1RSK1; Match level="QueryCoverage=99%, HitCoverage=100%, E-value=1e-155, Identity=59%"; Hit description =Zinc finger, C2H2-type
  Pfam annotation: Domain name=RS4NT; Domain location=153-190; Score =15.6; E_value=0.028; Accession=PF08071.2; Description=RS4NT (NUC023) domain
  Pfam annotation: Domain name=zf-C2H2; Domain location=168-190; Score =19.5; E_value=0.012; Accession=PF00096.16; Description=Zinc finger, C2H2 type
  Pfam annotation: Domain name=zf-C2H2; Domain location=195-216; Score =17.5; E_value=0.05; Accession=PF00096.16; Description=Zinc finger, C2H2 type
  Pfam annotation: Domain name=zf-C2H2; Domain location=92-114; Score =25.6; E_value=0.00018; Accession=PF00096.16; Description=Zinc finger, C2H2 type
  Pfam module annotation: Pfam domain module=RS4NT::zf-C2H2::zf -C2H2::zf-C2H2; Domain location=153-190::168-190::195-216::92-114
MSNITSCDSGSFSTENTREDAVVKQQPEILGQFHSPHSHTSTTTTTNNSNGSNTDSQSPAPVKKKRNLPGNPDPSAEVIALSPTTLMATNRFICEICNKGFQRDQNLQLHRRGHNLPWKLKQRTSTEIRKRVYVCPEPSCVHHNPARALGDLTGIKKHFCRKHGEKKWKCDKCSKKYAVQSDWKAHSKICGTREYKCDCGTIFSRRDSFITHRAFCDALAEENNKANEGQLPKIGPNLQCQQIPNLVSSSLPINTNIVPNPQMGGTSEFNHADHKHPLSLPHELMPMPAQKSFNNMAAGTTVFTRSLSSTSSPSLQLSSNMFEENGLHLAAGSPHMSATALLQKAAQMGATVTEKTFVTNMAPPSFGVLQQHHQQPNGQPFMNQYMHSGQQQQDVNISAQYNSFGANGMGGGSVGMNGVDMFNAILDQSKALSKIMEQNNRSSSGGPTNGGSNSSAINVAGSKGGSGDVMTLDFLGIGGGGGGGGGGGDAHGNFYGGAQQGETGAPDVVWRNWSSKNAGFESFSATSSI

SEQ ID NO: 137207 - protein, 338 aa, Glycine max
  Coding DNA Sequence Number=SeqID_20429
  Gene Ontology: Mol. function=zinc ion binding; Cellular component =nucleus; Biological process=regulation of transcription, DNA -dependent
  Homolog annotation: Hit_ID=Q1RSK3; Match level="QueryCoverage=81%, HitCoverage=24%, E-value=5e-88, Identity=64%"; Hit description=Zinc finger, RING-type; Transcription factor jumonji, jmjC
MMQKDKANKESEAKESDRDPQISSGGSSPDSLLGTKSSGLEMDSNQNKSIMDQGFEIYSSAEGNTANCKLPFTQNGDVFEKTHPGVLWDVFRRQDVPILTKYLKIHWKEFGKSDDLGNEFVEWPLYDGAIFLDKHHKRKLKEEFEGRDVKNYCLDVLSKGSEWSSCPSFGGVEPWSFEQNLGEAIFVPAGCPFQARNVQKIRNNTNLPYQKESNVQLGLDFLSPESVGDAVRLAEEIRCLPNEHEAKLQVLEVGKISLYAASSAIKEVQKLVLDPKYANFTLVLAIALVLSLPTSLSLKMENKLFCLTDGSYSLALTFVILGFWNWPVVLLGPLQGQP

SEQ ID NO: 137208 - protein, 154 aa, Glycine max
  Coding DNA Sequence Number=SeqID_20430
MKIKKRTEERKEGFPIKDRKEVKREKKQFSINERKRTKILQARLPLKIILDWKYPTPHEQEEKTETPSFLSKNTNLEKILLVRSRVQNRVMVQLWYGNRIKHLPVLARCFPCMFIKKLKVDILPFILGYKEDYPWHKWKNPVDRSVLPIFIGAP

SEQ ID NO: 137209 - protein, 268 aa, Glycine max
  Coding DNA Sequence Number=SeqID_20431
  Gene Ontology: Mol. function=ATP-dependent helicase activity; Cellular component=proteasome core complex (sensu Eukaryota); Biological process=ubiquitin-dependent protein catabolic process
  Homolog annotation: Hit_ID=Q1RSK4; Match level="QueryCoverage=91%, HitCoverage=40%, E-value=1e-107, Identity=80%"; Hit description =Helicase, C-terminal
  Pfam annotation: Domain name=Helicase_C; Domain location=19-128; Score=35.9; E_value=1.4e-07; Accession=PF00271.21; Description =Helicase conserved C-terminal domain
MKENASAKLVASSYSPPCGLIHFGIRSAVLNPELPQNSRLHILEEFNAGLFDYLIATDLSQSKEKDEVPKESNVGSWKSRQHAKIKLDSEFGVVRGIDFKNVYTVINFEMPESVAGYVHRIGRTGRAYNSGASVSLVSTDEMDTLEEIRSFVRDDENKGTNSIAEFPLLTKNAVESLRYRAEDVAKSVTRIAVRESRAQDLRNEILNSEKLKAHFETNPKDLDLLKHDKVLSKNPPPPHLRDVPEYLLDKPTKEAREMVKLARDPREN

SEQ ID NO: 137210 - protein, 233 aa, Glycine max
  Coding DNA Sequence Number=SeqID_20432
  Gene Ontology: Mol. function=zinc ion binding
  Homolog annotation: Hit_ID=Q1RSK3; Match level="QueryCoverage=99%, HitCoverage=24%, E-value=8e-34, Identity=68%"; Hit description=Zinc finger, RING-type; Transcription factor jumonji, jmjC
  Pfam annotation: Domain name=WRC; Domain location=16-61; Score=79.0; E_value=1.5e-20; Accession=PF08879.1; Description=WRC
MDNARSANGEENAAGIPDDLRCKRSDGKQWRCTAMSMPDKTVCEKHYIQAKKRAANSAMRANLKKAKRKSHSLSLNESDNVYLESKSDDFDLPLSSIGLSQKKLSKNEFRYEPERDARRGSSARRASNLNDDDDDDDDDVVVDVDGDGDGDAALYEEENWVSYDSPPDSSRKRSRRSLEANAVSWNIRMEHPVRLTRTPAGRLVTSAGGMTAIELLGVNGVIGGDIVIAVYQH

SEQ ID NO: 137211 - protein, 148 aa, Glycine max
  Coding DNA Sequence Number=SeqID_20433
  Homolog annotation: Hit_ID=Q1SWG0; Match level="QueryCoverage=57%, HitCoverage=30%, E-value=3e-27, Identity=69%"; Hit description=CCT
  Subcellular localization annotation: CTP_CleavageSite=36; ConfidenceScore=5.04e-01
MNIFNSTCVYNFFPSNWGTLDSSNHKTKFSHCPMILCATINTHPCILMTLFSLLPCQKKPAIEPPFSEILEIEVPLLNIDENTIQENKLLPDVQLARSVSLGSLSSMDWMRGDAMKPDFIDIPVIDFNTDYGMQRSFSEGDIMNTPLL

SEQ ID NO: 137212 - protein, 148 aa, Glycine max
  Coding DNA Sequence Number=SeqID_20434
  Gene Ontology: Mol. function=ribonuclease H activity
  Homolog annotation: Hit_ID=Q1T293; Match level="QueryCoverage=53%, HitCoverage=13%, E-value=1e-14, Identity=46%"; Hit description =Ribonuclease H
MMPRSFCVAPSGSGVSKADLLLSYGYENHIKAFTPHVPRSCQCLLMSATSRDSSAAMLGCFSDNLCIKHALYADLVGAMMAIELVFKNGWQKWLDCDSLLVVKVFSSDNIVPWDIRNRWKNCTVLLKSMYFTTVLLLLVFFSLKKNLH

SEQ ID NO: 137213 - protein, 720 aa, Glycine max
  Coding DNA Sequence Number=SeqID_20435
  Gene Ontology: Mol. function=protein binding
  Homolog annotation: Hit_ID=Q1RSL1; Match level="QueryCoverage=63%, HitCoverage=60%, E-value=2e-87, Identity=45%"; Hit description=IMP dehydrogenase/GMP reductase
RRTKREGHVLVAFFGDSSYGWFEPSELIPFDANFAEKSRQISSRNFLKAVEEAVDEASRRCGLGLVCRCRGPGNFCPTDVEGYYSVQVPDYEPGVYSDAQIRKARSEFGAAEMLSFLKQLALNPHGGDQRSIGFTKNRSTAFAFRRAVFEQYDETYAQAFGVQPRRPSDSAGNHLDRPVRLPAKAPLSGPMVIAETLGGEKSATKSVKAKGNFKTDKYLFMRRDEPSNTSQLPSRETSDAAGSYVLQKRPLAVSAAPEALEKHEDTGFMSQGIAASTVKGEIAVADQVQSDGIGHASQEMTRSVEPVEVASKSMGRPGEMALPNIVNETSQSTNMESKTSIDVKNDGDLTPSVPHEDFQQIEQGFLATSGEVKHHKLNVDGVPKKIKVHKRPANDLKSKTSAVQLSGQSEKPVSIGLASREDLRSEPMQVDASTSNLMPMDSIAEVNIELPHLLGDLQALALDPFHGVKRGIPAVTRQFFLRFRSLVYQKSLPVSPPMVTENEAVEDRRPPSSIGTSDSPDDRARASPLIKPVKHIVRPDDPTKAGRKRALSDRQEEISEKRLKKIKNIKALAAEKKAGSQKTSEARQGDGKESMAQAPPKVVKPELTRKVERPAKAVEPTILVIKFPPETSLPSVAELKARFARFGPIDQSGLRVDAQSAYKYALANQSLFGNVGMKCFLREFGDASSEVSEAAKARGDNGANESPRVKDPAVVQRQSS

SEQ ID NO: 137214 - protein, 289 aa, Glycine max
  Coding DNA Sequence Number=SeqID_20436
  Gene Ontology: Mol. function=DNA-directed DNA polymerase activity; Biological process=DNA recombination
  Homolog annotation: Hit_ID=Q1RSL9; Match level="QueryCoverage=93%, HitCoverage=30%, E-value=1e-107, Identity=72%"; Hit description =Helicase, C-terminal; Calcium-binding EF-hand; DNA-directed DNA polymerase B; UBA-like
MLLFFFFFFFAPLTFAHQPVLYANLANKPSLLPSRKSEDQMKQAYIMLSDCFRYGMNTSCCRAKILVEYFGEDFSHQKCLLCDVCIDGPPQRQNVKEEACILLQTIGAHNECNNYLDCSYDDDIHFHSKHRGLRERPNLQILVGKIRQQFQKFLTTDILWWRGLARILEVKGYIGEGDDKTHVQAKYLEPTELGLEFVKSMSEQDFYVYPEADMLLARKTNKPFSSFSEWGKGWADPEIRRERLERMRVNRKPGMLPSPKKQRKRKARKGWAGLRTSRGRLAAKLSKHK

SEQ ID NO: 137215 - protein, 195 aa, Glycine max
  Coding DNA Sequence Number=SeqID_20437
  Gene Ontology: Mol. function=metal ion binding; Cellular component =nucleus; Biological process=protein transport
  Homolog annotation: Hit_ID=Q1RSL7; Match level="QueryCoverage=99%, HitCoverage=47%, E-value=2e-86, Identity=82%"; Hit description=WD40 -like
  Pfam annotation: Domain name=WD40; Domain location=51-89; Score=19.3; E_value=0.014; Accession=PF00400.22; Description=WD domain, G-beta repeat
MAHDSRIACFALTHDGRLLATASSKGTLIRLFNTLDGSLLQEYYSFTSVIYIIKVRRGADRAEIYSLAFSPTAQWLAVSSDKGTVHVFNLKVDSGLLGHDRSHSTSEANLASPTAMSSLSFFKGVLPKYFSSEWSVAQFRLQEGLQYVVAFGHQKNTVVILGMDGSFYRCQFDSAAGGEMTQLEYYNFLKAEETF

SEQ ID NO: 137216 - protein, 49 aa, Glycine max
  Coding DNA Sequence Number=SeqID_20438
MEQSEPANKSASYTSRGLSPSPLSTTDQEDLALTPTYSSLVFLVLNHPV

SEQ ID NO: 137217 - protein, 132 aa, Glycine max
  Coding DNA Sequence Number=SeqID_20439
MDFGNIVLAIIGFSTSFLFCVPIKRWQRKQVAAEKLKIVSEALEAAEERAVRFQERHDTILSQICASYLTNTEVVEALAGARATMSQALDFAVELREIQFRIIASFPDAIDVLLDLDTSKHTPSRSALMNCS

SEQ ID NO: 137218 - protein, 155 aa, Glycine max
  Coding DNA Sequence Number=SeqID_20440
  Gene Ontology: Mol. function=metal ion binding; Cellular component =membrane; Biological process=protein transport
  Homolog annotation: Hit_ID=Q1RSL7; Match level="QueryCoverage=94%, HitCoverage=45%, E-value=4e-56, Identity=76%"; Hit description=WD40 -like
MVAETCERSHRPLGFAMDDDDSVAAEADALDLRAEGELADAAGQVVVPDHDLVGRVAGVGGGAAADEGEDVAAEEHVDEADAAAGAEVAAEDLAEGVAVVDAEAAVGGGGEAPGVLIEGEVEEGRGLGGVGGLRRLIGIEGLGWGLRHYYWESNE

SEQ ID NO: 137219 - protein, 892 aa, Glycine max
  Coding DNA Sequence Number=SeqID_20441
  Gene Ontology: Mol. function=actin binding; Biological process=actin cytoskeleton organization and biogenesis
  Homolog annotation: Hit_ID=Q1RSM0; Match level="QueryCoverage=99%, HitCoverage=99%, E-value=0.0, Identity=60%"; Hit description=Actin -binding FH2
  Pfam annotation: Domain name=FH2; Domain location=468-866; Score =512.1; E_value=6.3e-151; Accession=PF02181.13; Description=Formin Homology 2 Domain
MGCGSEHFIMIFNITLLMLLSSQSTHILTVAGSLFNAVGSFQVHGLPEMYFIEENDEKQVKKISGIDENEEKQALILEKFRSLLGLKSFHTKVPFNGDSEFLSPSPSPSPIIEETQAPSPSPLPHVPHHSHHHPPHHKNLPLHQTHHEDRGRAKRILIAVLVSAGVATLLGACGLFWVWRKFSNHTKKPKRTMPLYNSKSKGSGGGYQSSSSKVSLNSGLDLFYLNALGEDIEQHSCSLKKTRKDGLEYDNVSGSSAKEIASVHEDAESVEGELESGGGNSSSGDKIIPEDCHSSDNESFHSFVNDSHSNASACSLSDKNSLSRQNSTSLPNQFPSSAHNSMSNIQLHHSPNIPKTFTSPPPPPPPPPPPPLRMPLFSLHSLTSSSRLSSHSPLSLTSNNLSSPVNSDTSSGSNQSPEKELPSPHGPYPTQSPPNIPPPPCPPPFLKGNSAKTPPPPPSQLPQFTPLGKDGAPLPKLKPLHWDKVRAAPNRTMVWDKLRSSSFELDEEMIESLFGYNLQNSIKNDETKSKTPSPGKHVLEPKRLQNITILSKALNATAEHVCEALMQGKGLSLPQLEALVKMVPTKEEESKLFNYKGDINELGSAERFVRAMLDVPFAFQRVEGMLFRETFDDEVVHLKNSFSMLEEACKELRSSRLFLKLLEAVLKTGNRMNVGTIRGGARAFKLDALLKLADVKGTDGKTTLLHFVVQEIVRSEGIRVSDSIMGKISQRSKNRTEEEKEEDYKRMGLELVSGLSTELYNVKKTATIDLDVLASSVSTLSEGMKKLQHLVEKELLKNERSMNFVQCMKSFLNYADGNLKELRGDEDRVLARVKEITEYFHGDVSKEDGNPLRIFVIVRDFLGMLDNVCKELRRSKAPRSPNPLAMLPLDRS

SEQ ID NO: 137220 - protein, 246 aa, Glycine max
  Coding DNA Sequence Number=SeqID_20442
  Homolog annotation: Hit_ID=Q593S0; Match level="QueryCoverage=42%, HitCoverage=49%, E-value=5e-15, Identity=38%"; Hit description =Expressed protein
MFHALFYSNFQVQIAVEVNKRKKRSAVRRFFKKDMADLLGSSLDYNAYGRELLQVIQERTSCRCFGSPLLWVVQCKSEALLSMASDVAVKVEVATPCAIALNLVISNLSATSEKAVMEALKETETSMRIVGNRKDFAEGAKKIEYFEETTFLLSTITRRWPPSGFPVGNDVILMKVLANIHTRTDKATLLSKLFLLQFHSIPHKSLCILDFTRTYPLCKNPFFTFLASYIRILGSENVRCAILFQV

SEQ ID NO: 137221 - protein, 104 aa, Glycine max
  Coding DNA Sequence Number=SeqID_20443
  Gene Ontology: Mol. function=ribonuclease H activity; Biological process=RNA-dependent DNA replication
MKLIMVSWMKICRPLSEGGPGLRSLKAINKASILSLTWKFISSADHWAELMRARVLKDGFQLISRVICKPQLQTSSSMIIGVGEAFSAIHCSWEDYMTLMVGSF

SEQ ID NO: 137222 - protein, 200 aa, Glycine max
  Coding DNA Sequence Number=SeqID_20444
  Gene Ontology: Mol. function=zinc ion binding; Biological process =ubiquitin cycle
  Homolog annotation: Hit_ID=Q1SR15; Match level="QueryCoverage=67%, HitCoverage=59%, E-value=1e-53, Identity=74%"; Hit description=Zinc finger, RING-type; RINGv
MEEAWTIDEVAFNVRGLSIDCFIPTTGLRTTSVNETCKLPKDERAKNSLAVHRAKVLALEKSHNCRDAHSIPSSIQGAASITSAASLDNSLSDMYRSPPRPLPYDAEPRYFRSQRDGLVSRREKGSSHSNEETEPLRSNADVDPESLNSGDKWKESACEAGSKEYRSKSSLRLQSTKYSTGVGLVYASSEEEDVCPTCLE

SEQ ID NO: 137223 - protein, 143 aa, Glycine max
  Coding DNA Sequence Number=SeqID_20445
MPCYTDDSNARADACIVESTDIVPNGVANTTASTTGGTSTTNAGTVEGLGRHARTNAGIDACTNEGTSRNATTFAAANADKYAIFEDKNIDWDKVRNQRSIITRNLLGNSEGILRRVNYRLATDVCDKIVRHRSTPSNGTVKE

SEQ ID NO: 137224 - protein, 129 aa, Glycine max
  Coding DNA Sequence Number=SeqID_20446
MAICPNLKKGRTSKFYIRIAKRQNPSMRMVMKPLKLINESTEAQTHVLAKQTYMEFDLGVTSTNGPKVNGGQLAGGGQPPTTMPMIEGSQSYVAPTPDDPQPAKEPSSVDSHNEVDRRLVIFVEEVDDP

SEQ ID NO: 137225 - protein, 88 aa, Glycine max
  Coding DNA Sequence Number=SeqID_20447
MQKKLPKPSSRNKQPLEEVHMGIGLESHAGIMGFQCGICKALVSLTTKASLCDVILPRFLLIGIKAFLHVSPLQMSGAGGDAKITIFT

SEQ ID NO: 137226 - protein, 191 aa, Glycine max
  Coding DNA Sequence Number=SeqID_20448
  Gene Ontology: Mol. function=RNA-directed DNA polymerase activity; Biological process=RNA-dependent DNA replication
MELKTINKKLEDGSALSRLDHFLVTDAWMNMFLNVTQWGCMRGLSDHRPIILKNKETNCGPKPFKVINSWSQMEGYREYVIAQWKFLKFEGWSTFVLNEKLKLKEFGPNGFNFGFLKEFLKDMKMDFCDFLMKFHWNDGVLITNELVEETRRSGRALVLFKVDFEKTYDSVDWEFLLLVMERMGFPKQLWD

SEQ ID NO: 137227 - protein, 110 aa, Glycine max
  Coding DNA Sequence Number=SeqID_20449
MSYNLYTTCYYTGSHKRDGRRGMLVQQLLMHTRGKHLGCRVMSYNLYTTCYYTGSHKRDGRRGMLVQQLLMHTRGKHLGCRGIGGKYNSQDTSSRVTIISLTDKCKEGVS

SEQ ID NO: 137228 - protein, 1057 aa, Glycine max
  Coding DNA Sequence Number=SeqID_20450
  Gene Ontology: Mol. function=oxidoreductase activity; Cellular component=integral to membrane; Biological process=hydrogen peroxide catabolic process
  Homolog annotation: Hit_ID=Q5ENY3; Match level="QueryCoverage=80%, HitCoverage=95%, E-value=0.0, Identity=79%"; Hit description =Respiratory burst oxidase 2
  Pfam annotation: Domain name=FAD_binding_8; Domain location=580-690; Score=155.9; E_value=1.1e-43; Accession=PF08022.2; Description=FAD -binding domain
  Pfam annotation: Domain name=Ferric_reduct; Domain location=381-539; Score=183.1; E_value=6.7e-52; Accession=PF01794.9; Description =Ferric reductase like transmembrane component
  Pfam annotation: Domain name=NADPH_Ox; Domain location=124-221; Score= 224.5; E_value=2.3e-64; Accession=PF08414.1; Description=Respiratory burst NADPH oxidase
  Pfam annotation: Domain name=NAD_binding_6; Domain location=706-865; Score=202.8; E_value=7.9e-58; Accession=PF08030.2; Description =Ferric reductase NAD binding domain
  Pfam annotation: Domain name=efhand; Domain location=222-250; Score =27.5; E_value=4.9e-05; Accession=PF00036.22; Description=EF hand
  Pfam annotation: Domain name=efhand; Domain location=266-294; Score =3.5; E_value=6.2; Accession=PF00036.22; Description=EF hand
  Pfam module annotation: Pfam domain module=FAD_binding_8::Ferric _reduct::NADPH_Ox::NAD_binding_6::efhand::efhand; Domain location=580- 690::381-539::124-221::706-865::222-250::266-294
MEIHENQHESWSETESTGSRSKQVGFSGPLSGPLSGPLSGPLVSSNKRNSSKNKSARFKDDEEMVEITLDVRDDAVSVQNIRGGDSETAFLASRLEMRPSSFSDRLRQVSRELKRMTSNKAFDRVDRSKSGAARALRGLKFMTKAGTEGWSQVEKRFDELAIDAKLPKTRFSQCIGMTESKEFAGELFDALARRRGITSASITKDQLREFWEQITDQSFDSRLQTFFDMVDKDADGRINEEEVKEIITLSASANKLSKLKDRAEEYAALIMEELDPDNLGYIELYNLEMLLLQAPAQSTNITTDSRILSQMLSQKLVPTKEYNPIKRGFRALAYFVQDNWKRLWVIALWLSICAGLFTWKFIQYKHRAVFHVMGYCVTVAKGGAETTKFNMALILLPVCRNTITWLRSRTKLGAIIPFDDNINFHKVVAFGIAIGVGLHAISHLTCDFPRLLHATDVEYKPMKQFFGDERPNNYWWFVKGTEGWTGVVMVVLMAIAFILAQPWFRRNRLKLPKPLKKLTGFNAFWYSHHLFVIVYVLFIIHGYFLYLSKKWYKKTTWMYLAVPMILYGCERLLRAFRSGYKSVRILKVAVYPGNVLALHVSKPHGFKYSSGQYIYVNCSDVSPFEWHPFSITSAPGDDYLSVHIRTLGDWTSQLKGVFAKACQPASDGQSGLLRADMLQGNNKPRHDAQATNRWTLWSSSTRLQNYEVILLVGLGIGATPLISILKDVLNNIKQHKDVEEGAVEKDNKRKPFATKRAYFYWVTREEGSFEWFKGVMNEVEENDKEGVIELHNYCTSVYEEGDARSALITMLQSLHHAKNGVDIVSGTRVKTHFARPNWRNVFKHAAIKHPDQRVGNADEIREVEAEALASKTLVLPRLQKESPENSSRRNNVTIFRIQNKTTVLDPGVNNIDIDLRQHKVVVTGNVNSETLIRRLTKAGKHAELWPESKAKELTKLLLKRHPKTAMKQMKVRDHPIKNNKVMFNLNQMEHNKGKLKVIMEIDAVINLPTLAGQTKPNKIKETLKKPHVSEQSAQCNNTVLITGEDVDTDTVCSLLNS

SEQ ID NO: 137229 - protein, 227 aa, Glycine max
  Coding DNA Sequence Number=SeqID_20451
  Gene Ontology: Mol. function=metal ion binding
  Homolog annotation: Hit_ID=Q1RZ04; Match level="QueryCoverage=45%, HitCoverage=17%, E-value=2e-27, Identity=54%"; Hit description=Zinc finger, RING-type; Zinc finger, RanBP2-type; Zinc finger, C6HC- type
MVKIGQWLEAENGSSTTVVWKLFHPGESSRSWNIVGLLEKLVFPNSNTRKLTCGIYFGTYPCAQVESVACDHPYCYSCWAGHIGTSTNDSLGCLVLRCPNPICGAANGQDMIKLLAYDEDKEKYDYYLLKSYIEDNKKDTRIKESIRTNFGHQTWTAWLPTDVAPCGACRPWIFFINGVFCFLKINGSGMEKEERLLETSLQGEDDSRTSSPPQEAMDKSLKVGEDE

SEQ ID NO: 137230 - protein, 74 aa, Glycine max
  Coding DNA Sequence Number=SeqID_20452
MRSNFNGSDLFEKHGQFLAINVMVIGAIGVAGNVEAGEEARRREWILNLEKKHCCCRGSHFWKTNIITDKGRIR

SEQ ID NO: 137231 - protein, 71 aa, Glycine max
  Coding DNA Sequence Number=SeqID_20453
MVAPPDSIPSVEQFNEMVAWPRAFYTRGGYTLTSACNRPLHSSSRDARGPDYISPGYGHFSSSYSSITSDR

SEQ ID NO: 137232 - protein, 354 aa, Glycine max
  Coding DNA Sequence Number=SeqID_20454
  Homolog annotation: Hit_ID=Q589Y1; Match level="QueryCoverage=43%, HitCoverage=32%, E-value=1e-52, Identity=59%"; Hit description =Glycosyltransferase NTGT5b
MEEDLESGNFECGFGLEDVLNSLLKEDLEIVGRFEKFGVLCLGLDFGMIDQFEEDLVMESLGLEECVNKWGRVGKNQLDPYAASFMRNLCGSSLTLLRIISVLTFVYCGSTQRLCGSSTPNLCLVRINSKAMRIKRSHRKWDEEEEDTTTHAESTGLEKNDTGTRRRRAGLLKKKKNRRKKEKAQSWHEKRFLAQGHVNPFMQLAKLLHCVGFHITFVNTEFNHNRFVKSHGPDFVKGLPDFKFETIPDGLPPSDKDATQDVPALCDSTRKTCYGPLKELVMKLNSSSPEMPPVSCIIADGVMGFAGRVARDLGIQEVQLWTASACGFVGYLQFEELVKRGILPFKGARCLFVI

SEQ ID NO: 137233 - protein, 83 aa, Glycine max
  Coding DNA Sequence Number=SeqID_20455
MGCGNLKPVSVLPRCPHLVDFLKQGCRPIWVSEVVIEKRGHCLKHVVNDAIPMERSSSLYTLEPWSCVMCLCNVKGPLGISEN

SEQ ID NO: 137234 - protein, 131 aa, Glycine max
  Coding DNA Sequence Number=SeqID_20456
  Gene Ontology: Cellular component=cellulose and pectin-containing cell wall
  Homolog annotation: Hit_ID=Q84UC9; Match level="QueryCoverage=85%, HitCoverage=96%, E-value=5e-33, Identity=63%"; Hit description=Rapid alkalinization factor 1
  Pfam annotation: Domain name=RALF; Domain location=53-117; Score =112.6; E_value=1.1e-30; Accession=PF05498.2; Description=Rapid ALkalinization Factor (RALF)
MAKSSSLAITLICAATVLVAMSRWPTAVGGGDHHLGMGWVSSTCKGTIAECLGGEEYELDSEINRRILATNKYISYVALQRNTAPCSRRGASYYNCRPGAQANPYSRGCSAITSYYSRTFVVMVIHFGLLL

SEQ ID NO: 137235 - protein, 128 aa, Glycine max
  Coding DNA Sequence Number=SeqID_20457
MAASDIAILKDRAHVPTKKSLLELTSQDALLAQNKLLSKQLEALTETLTSSINSKDNGKITLLVAQPTSISRSRAKHEISALSATVVLSRLNARLALSSNPLTCAKAWVALSATSQIRSLFKAYFVQN

SEQ ID NO: 137236 - protein, 86 aa, Glycine max
  Coding DNA Sequence Number=SeqID_20458
MIKEVYGARLQSKSVVCTLWEIYKHWRILINVCAERRHPKLDLRNTIFEEVRIDENHETDQIQAKGPSGEGRRPKWRRTKPPSGEG

SEQ ID NO: 137237 - protein, 64 aa, Glycine max
  Coding DNA Sequence Number=SeqID_20459
MTQVMYGEMLCQYRVVMPVREREECEDEGDGVRKNVVGEGGSHNEVVRESVAGLCKREREEQIG

SEQ ID NO: 137238 - protein, 39 aa, Glycine max
  Coding DNA Sequence Number=SeqID_20460
MQRLMETEVAKVDGDSGCRGISLERVTSGAIWRLTETEA

SEQ ID NO: 137239 - protein, 185 aa, Glycine max
  Coding DNA Sequence Number=SeqID_20461
  Gene Ontology: Mol. function=calcium ion binding; Cellular component =cytoplasm; Biological process=translation
  Homolog annotation: Hit_ID=Q5J907; Match level="QueryCoverage=78%, HitCoverage=80%, E-value=2e-51, Identity=77%"; Hit description =Translationally-controlled tumor protein homolog
  Pfam annotation: Domain name=TCTP; Domain location=11-143; Score =121.3; E_value=2.7e-33; Accession=PF00838.8; Description =Translationally controlled tumour protein
MNVSLPFHVTPLSTTNPTELKIRAITKWVVQGALNVDIGANPSAEGGDEDEGVGDQAVKVVDIVDTFRLQEQPSFDKKQFIAYMKRYIKLLTAKLEGEKQELFKKHIEGATKSLISKLKDLQFYVLHLFFGYILVLWGRACTMMEALSLLTTGKVLLIQLLSTLPMDGRKSSAEHMQCRPRSYLI

SEQ ID NO: 137240 - protein, 134 aa, Glycine max
  Coding DNA Sequence Number=SeqID_20462
  Homolog annotation: Hit_ID=Q1SZU4; Match level="QueryCoverage=47%, HitCoverage=7%, E-value=1e-10, Identity=61%"; Hit description =Protein kinase PKN/PRK1, effector
MYTYIHSITIEGFVSGAVHFPCKSWVQGERILRKQEDTFIELSKLLEEATTRNQTEGNKDLNHNEKDYLLPKVVEFSEENRHGGKDTSKVELSANEGLNSNKAYRNKSLMTEKWNLGTRGIIPPCLLPLVCNPW

SEQ ID NO: 137241 - protein, 463 aa, Glycine max
  Coding DNA Sequence Number=SeqID_20463
MNSSPRWRSETCSPRDEHGRVQRQNIKAAGALILLWNIEAKLSILNPVTVRVQSLACAFAVRVMSFIYHGDSNHKMLQHQIVQSPARLGLANPNSPSIPNPTPPKLPPTQTHHPQDRNSSTPSSALLSLLPPLPRAQALLAQMASLASKLFDVSPNRSLWVTAFRGSLPTFLSSHSSTPLDTSPSNAKEIISLFTVLQTQIFEAVAELQEILDLQDAKQKIDREIRSQDSTLLAFANKLKEAESCLDILVDDYSDYRRSKRSKSGDDDSMTSSTVSSQLKLSDILSYAHRISYTTFAPPEFGAGQAPLRGALPPAPQEEQMRASQLYNFADLDVGLPKEVETKEKIVEAIVEPPPQVDTNAVPNLSAFQGMLPPMPPGWKPGMPVQLPIDLPLPPPGWKPGDPVPLPPMDSLQIPRFAEQQMQPHIPQPKQPEVIQVQPVNLDLGGSDTSDYSSDDASSDDED

SEQ ID NO: 137242 - protein, 88 aa, Glycine max
  Coding DNA Sequence Number=SeqID_20464
MDDQEKLIVCCIGVLQCIGFLVNEGETEYNECSIFRGAYSRNTKPPAETEDISPLYNTKKANKETIDRSIHNMTLDSDITIKCKIPHL

SEQ ID NO: 137243 - protein, 411 aa, Glycine max
  Coding DNA Sequence Number=SeqID_20465
  Gene Ontology: Biological process=ripening
  Homolog annotation: Hit_ID=P92990; Match level="QueryCoverage=83%, HitCoverage=58%, E-value=4e-92, Identity=42%"; Hit description =Probable polygalacturonase non-catalytic subunit JP650 precursor
  Subcellular localization annotation: CTP_CleavageSite=73; ConfidenceScore=5.11e-01
MQVGYGGRNLGDKNPFTPKAYVARYWDKHVLNNLPKPSFLLSKASSMSASDTTSFAKLAAANKLSTSLPELCSAAHLLCFQEVRPSLEKHTEDAGFETYNDGQNFTNYGIYFAGGIDAFKNYSKTILVNDFRRYSRSSAGHGESFTGYGEDTNVADKSFHTYSTNAGGGSGEFKNYSSNSNVPDVRFATYFDSIGGRTQSFSSNNEDDNYDRQSFQSYGKNSADAANSFAGYGTNSNVATLAFINYGVEMNVPEVTFKSYAVRTHASTESFANYRDQANIADDSFQSYAKNTKERTKLDFKNYGNSFNPGSDTFKGYAKGAEGDHKVGFTTYNVNTNATFKDYAKQGVSFASYNVSFSSSSESKTIRRSFSPFLIEINCFTLWKKTVGVETWSGEAKVESHKREKRKAKFQ

SEQ ID NO: 137244 - protein, 242 aa, Glycine max
  Coding DNA Sequence Number=SeqID_20466
  Homolog annotation: Hit_ID=Q2HSE9; Match level="QueryCoverage=68%, HitCoverage=38%, E-value=2e-46, Identity=56%"; Hit description =Pollen Ole e 1 allergen and extensin
  Pfam annotation: Domain name=DUF1210; Domain location=23-237; Score= -33.9; E_value=0.0035; Accession=PF06735.2; Description=Protein of unknown function (DUF1210)
  Pfam annotation: Domain name=Pollen_Ole_e_I; Domain location=23-145; Score=29.5; E_value=2.5e-07; Accession=PF01190.8; Description=Pollen proteins Ole e I family
  Pfam module annotation: Pfam domain module=DUF1210::Pollen_Ole_e_I; Domain location=23-237::23-145
MLSLIYASLLEASHDKKLLSAVVVGSVYCDTCFQQNFSTRNHFISGAAVAVECKFGKSVPSFKKEVKTNYHGEFKVKLPFKVWKHAKRIKGCTFKLISSSEPHCSVASLATSSLVSLKAMKQGEHIFSAGLFSFKPTKKPNFCNHKQSVPNSKAHAKNEFPPNTNPSRLDKKLAEDTFFPFPPIPFLPPIPFLPPIQFPPIPFLPPIPFLPPNPFLPPTPFLPPQVPNPLQPLSPPPLFPPV

SEQ ID NO: 137245 - protein, 58 aa, Glycine max
  Coding DNA Sequence Number=SeqID_20467
  Homolog annotation: Hit_ID=Q1STG1; Match level="QueryCoverage=91%, HitCoverage=60%, E-value=3e-24, Identity=96%"; Hit description =Hypoxia induced protein conserved region
MSEAKTQIESIRKWVVEHKLRTVGCLWLSGITGSIAYNWSRPNMKTSVKIIHARFVLL

SEQ ID NO: 137246 - protein, 257 aa, Glycine max
  Coding DNA Sequence Number=SeqID_20468
  Gene Ontology: Mol. function=nucleic acid binding; Cellular component= nucleus; Biological process=mRNA processing
  Homolog annotation: Hit_ID=Q64HC0; Match level="QueryCoverage=72%, HitCoverage=71%, E-value=5e-70, Identity=71%"; Hit description =ASF/SF2-like pre-mRNA splicing factor SRP30
  Pfam annotation: Domain name=RRM_1; Domain location=113-180; Score =43.2; E_value=8.9e-10; Accession=PF00076.12; Description=RNA recognition motif. (a.k.a. RRM, R
  Pfam annotation: Domain name=RRM_1; Domain location=9-77; Score=81.2; E_value=3.3e-21; Accession=PF00076.12; Description=RNA recognition motif. (a.k.a. RRM, R
  Pfam module annotation: Pfam domain module=RRM_1::RRM_1; Domain location=113-180::9-77
MSGRSSRTIYVGNLPGDVRLREVEDLFYKYGPIVDIDLKIPPRPPGYAFVEFEDARDAEDAIQYRDGYNFDGFRLRVELAHGGRGYSSSVDRYSSYSGGSGSRGVSRRSDYRVLVTGLPPSASWQDLKDHMRKAGDVCFSQVFRERGGMTGIVDYTNYDDMKYAIRKLDDSEFRNAFSRAFIRVREYDRGYSRSPSRDSRRSYSRSLSRSPCISRSRSHSRSRSHSYSDRSRRFTLVALVNYDSVYIFGSFEELTKS

SEQ ID NO: 137247 - protein, 55 aa, Glycine max
  Coding DNA Sequence Number=SeqID_20469
MDVNHEQIVVDIGSVVEAVSADDGHAPLYSIESLCMRCHENGAGCGSNNSTQQHP

SEQ ID NO: 137248 - protein, 68 aa, Glycine max
  Coding DNA Sequence Number=SeqID_20470
MQREKLLQERETRVRNFARMKEVSDAVKLSVAVKNEGAQTFRCSHRKPPSAAECGGFREKPRERIVKG

SEQ ID NO: 137249 - protein, 83 aa, Glycine max
  Coding DNA Sequence Number=SeqID_20471
MTPHLNPQRIWVDLLSYFKLHAQALTLGALAGAALVEYYDLIGIGYKPLAAERLDVRRKNGVRNLKRNGGIVRNQGEGRGTFF

SEQ ID NO: 137250 - protein, 283 aa, Glycine max
  Coding DNA Sequence Number=SeqID_20472
  Gene Ontology: Mol. function=peptidase activity; Cellular component =integral to membrane; Biological process=aromatic compound metabolic process
  Homolog annotation: Hit_ID=Q67VK9; Match level="QueryCoverage=98%, HitCoverage=71%, E-value=1e-103, Identity=64%"; Hit description =Cgi67 serine protease-like
  Pfam annotation: Domain name=Abhydrolase_1; Domain location=1-220; Score=-10.2; E_value=0.049; Accession=PF00561.10; Description =alphabeta hydrolase fold
  Pfam annotation: Domain name=Peptidase_S9; Domain location=6-168; Score=-75.9; E_value=0.027; Accession=PF00326.11; Description=Prolyl oligopeptidase family
  Pfam module annotation: Pfam domain module=Abhydrolase_1::Peptidase _S9; Domain location=1-220::6-168
MGIITYDYSGYGQSSGKPSEQNTYADIEAVYKCLQEKYGAKEEDIVLYGQSVGSGPTIDLASRLPNLRAVILHSPILSGLRVMYSVKRTYWFDIYKNIDKIPLVNCPVLVIHGTADDVVDCSHGKQLWENCKQKYEPLWIKGGNHCDLELYPQYIKHLKKFITVIEKSPHQKTGSDLIPDQLDKPRNSIDFREKSRLSMDQKENLKSIDQKEKPSASTDRKEKSRASVDRRDKSRNSIDHPEKSFNGSDIPEKARNSIDRFGEMVRSVGLCNIDCFRPTATHA

SEQ ID NO: 137251 - protein, 82 aa, Glycine max
  Coding DNA Sequence Number=SeqID_20473
  Subcellular localization annotation: CTP_CleavageSite=52; ConfidenceScore=5.07e-01
MDSESSHLKSKHIISTQALQLDVIGGNRLHAFHGSYLSMKTMMFLKKNERSRCHMGVTTPCSSVGVPDCQFLFQCSTYTPVD

SEQ ID NO: 137252 - protein, 253 aa, Glycine max
  Coding DNA Sequence Number=SeqID_20474
  Gene Ontology: Mol. function=metal ion binding; Cellular component =integral to membrane
  Homolog annotation: Hit_ID=Q60DL1; Match level="QueryCoverage=93%, HitCoverage=45%, E-value=3e-25, Identity=35%"; Hit description=Zinc finger, C3HC4 type (RING finger) containing protein
MQPGFTGKRTKNSTRKAAALRGCSFLLDESIKKEQTNGDDNMDSPMPEHSKKHKPHEDTENSVQHTEGKVDLWTPLNCLVEAANRTKSSRSNSQATPLAKLESPTTPHGGQDASETTTKTDLPASAQSELNIPKSKNKDTGLKPIFGDDKDANSLPSGPVKRRRLRPAGQKRVAASEMSASSPAPLDATGGKCNRKNSPIWFSLVASEDQDGTVPVSFIQKYLMKKLNLASEAEEVKQHIASLVDIVWGLRLS

SEQ ID NO: 137253 - protein, 72 aa, Glycine max
  Coding DNA Sequence Number=SeqID_20475
MVVGKNSNNKGKGKYAPKRKPLGPKGDMIKPKKIGPMLAKLMLDISFVKRKDTKKIIQAVFLTFAIHCRGCR

SEQ ID NO: 137254 - protein, 123 aa, Glycine max
  Coding DNA Sequence Number=SeqID_20476
  Subcellular localization annotation: CTP_CleavageSite=36; ConfidenceScore=5.45e-01
MAESSKRRKGSSSSATTGSHHYHGPSVDFSAPPNPSLSSPRSLTLFSIDIQSERYYSSFSNRDIIDPKYLDSEFFEEENFDCYQVFQNSELVDFMTLKLPYYPELVRAFYNNLEIHEGVIFSK

SEQ ID NO: 137255 - protein, 107 aa, Glycine max
  Coding DNA Sequence Number=SeqID_20477
  Gene Ontology: Mol. function=metal ion binding; Biological process =ubiquitin cycle
  Homolog annotation: Hit_ID=Q9ZQF5; Match level="QueryCoverage=85%, HitCoverage=45%, E-value=7e-20, Identity=48%"; Hit description =Putative RING-H2 zinc finger protein
  Pfam annotation: Domain name=zf-C3HC4; Domain location=60-100; Score =28.7; E_value=2e-05; Accession=PF00097.15; Description=Zinc finger, C3HC4 type (RING finger)
MGFAYINLIILVRQNNTKCVEGKRTSIIVLHTEEYGSKKSGSRRFSWTKWSWKASEQEECAVCLESFRVGETLIHLPCAHRFHDRCLKPWLENNSYCPCCRTTILPL

SEQ ID NO: 137256 - protein, 114 aa, Glycine max
  Coding DNA Sequence Number=SeqID_20478
  Gene Ontology: Mol. function=kinase activity; Biological process =purine nucleotide metabolic process
  Homolog annotation: Hit_ID=Q10M74; Match level="QueryCoverage=92%, HitCoverage=41%, E-value=5e-23, Identity=57%"; Hit description =Guanylate kinase family protein, expressed
  Subcellular localization annotation: CTP_CleavageSite=37; ConfidenceScore=5.04e-01
MALVERLVRSRSNKFGSVSRRAATLKKVLEKSTVFVFVAAKSEMALVERLVDRKTEIVESLLVRIGTARKEMKHVKNFDYVVANAKGKLDNAVKLMESIIDAEKARVSQRSPLL

SEQ ID NO: 137257 - protein, 344 aa, Glycine max
  Coding DNA Sequence Number=SeqID_20479
  Gene Ontology: Mol. function=protein binding; Cellular component =integral to membrane; Biological process=xylan catabolic process
  Homolog annotation: Hit_ID=Q949G7; Match level="QueryCoverage=93%, HitCoverage=70%, E-value=4e-87, Identity=33%"; Hit description =HcrVf3 protein
  Pfam annotation: Domain name=LRR_1; Domain location=111-133; Score =11.6; E_value=1.9; Accession=PF00560.23; Description=Leucine Rich Repeat
  Pfam annotation: Domain name=LRR_1; Domain location=135-157; Score =12.7; E_value=1.2; Accession=PF00560.23; Description=Leucine Rich Repeat
  Pfam annotation: Domain name=LRR_1; Domain location=14-33; Score =11.8; E_value=1.8; Accession=PF00560.23; Description=Leucine Rich Repeat
  Pfam annotation: Domain name=LRR_1; Domain location=207-229; Score =7.9; E_value=9.6; Accession=PF00560.23; Description=Leucine Rich Repeat
  Pfam annotation: Domain name=LRR_1; Domain location=231-253; Score =15.1; E_value=0.25; Accession=PF00560.23; Description=Leucine Rich Repeat
  Pfam annotation: Domain name=LRR_1; Domain location=255-277; Score =17.0; E_value=0.068; Accession=PF00560.23; Description=Leucine Rich Repeat
  Pfam annotation: Domain name=LRR_1; Domain location=279-300; Score =6.8; E_value=15; Accession=PF00560.23; Description=Leucine Rich Repeat
  Pfam annotation: Domain name=LRR_1; Domain location=38-60; Score=8.1; E_value=8.6; Accession=PF00560.23; Description=Leucine Rich Repeat
  Pfam annotation: Domain name=LRR_1; Domain location=62-84; Score =10.5; E_value=3.1; Accession=PF00560.23; Description=Leucine Rich Repeat
  Pfam annotation: Domain name=LRR_1; Domain location=86-109; Score =11.5; E_value=2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=111 -133::135-157::14-33::207-229::231-253::255-277::279-300::38-60::62 -84::86-109
MQDFLCNNLDKPMQLEILNLASNNLSGEIPDCWINWPFLVEVNLQSNHFVGNFPPSMGSLAELQSLEIRNNLLSGIFPTSLKKTRQLISLDLGENNLSGCIPTWVGEKLSNMKILRLRSNSFTGHIPNEICQMSLLQVLDLAKNNLSGNIPSCFHNLSAMTLVNRSPYPQIYSHAPNHTEYSSVSGIVSVLLWLKGRGDEYGNILGLVTSIDLSSNKLLGEIPREITDLNGLNFLNLSHNQLIGPIPEGIGNMGSLQTIDFSRNQISGEIPPTISNLSFLSMLDVSYNHLKGKIPTGTQLQTFDASSFIGNNLCGPPLPINCSSHGKTHSYERKSWAWSELVFC

SEQ ID NO: 137258 - protein, 95 aa, Glycine max
  Coding DNA Sequence Number=SeqID_20480
MSIIRIGLNFSAAQHIKVLKECNNQVVVALPFDIGIVHVNDVRDDVRMTAQKQSSRKKKHWTWDWEFALGSGGLSYRCLNLVSHKRERNFIMVIS

SEQ ID NO: 137259 - protein, 44 aa, Glycine max
  Coding DNA Sequence Number=SeqID_20481
MVRCQFQLPREVAVEMEAGWDSSIFGSTVRGGAVKGERNLTHGD

SEQ ID NO: 137260 - protein, 470 aa, Glycine max
  Coding DNA Sequence Number=SeqID_20482
  Homolog annotation: Hit_ID=Q1SNE2; Match level="QueryCoverage=13%, HitCoverage=29%, E-value=1e-09, Identity=43%"; Hit description =Expressed protein, putative
MASLLEGRFYLREMHLSFLNITYNELQGEIPKCIGSCTYKNLELTHIRRDVLKVGSWTLHVRLRVTFVRRTRWGNCKTKDSNTQGSKEPSSYRSGMKLQYIRPPSFESTCGRKRLSSVEDCIMSGVVALTNKRVTSLLSPQAWTNVVQCRAAFVKLPEMDMLLILQARSDVYFFVTMPSFLSDSAIDMGGCDSNVFHSFKDHFFKVLTTDVVANGFVDPYGEGRQSYFGTIVGLAGLVSHSVSSFNERSPHCLGRRSILLVGPCHHLLSPLLLEKGGQPVGEVGPVTVVAEVTPGAPSSILAKRKLDDGVGLFGHKNSRAPMSLPAPRQAVGLTPVAVAPASATVVTATPAPPPPPVVPIWEVTLAAGVDAPTTLTSSVVASSSTVAIPLLSPGVAITSAVEKNDDKEHSSFEENSPIPESTIGAEHVKDSDTPECSDNQPLVASVPPVVRKTSWFSCCGLFDVLSGSNR

SEQ ID NO: 137261 - protein, 54 aa, Glycine max
  Coding DNA Sequence Number=SeqID_20483
MEIYSALANAEQHMSSLAADLTTNHEYGEPCIAVLREKQKLVHLYTARQERVAG

SEQ ID NO: 137262 - protein, 465 aa, Glycine max
  Coding DNA Sequence Number=SeqID_20484
  Gene Ontology: Mol. function=amino acid-polyamine transporter activity; Cellular component=integral to membrane; Biological process=amino acid transport
  Homolog annotation: Hit_ID=Q9FMC0; Match level="QueryCoverage=93%, HitCoverage=95%, E-value=1e-115, Identity=50%"; Hit description =Amino acid transporter-like protein
  Pfam annotation: Domain name=Aa_trans; Domain location=44-454; Score =121.6; E_value=2.3e-33; Accession=PF01490.8; Description =Transmembrane amino acid transporter protein
  Pfam annotation: Domain name=Trp_Tyr_perm; Domain location=44-448; Score=-211.0; E_value=6.7e-05; Accession=PF03222.4; Description =Tryptophantyrosine permease family
  Pfam module annotation: Pfam domain module=Aa_trans::Trp_Tyr_perm; Domain location=44-454::44-448
MTIGSLEYKAKNTKSRKNKLVVDEKAPLIPKTHDADAEGFDEFNGASFSGAVFNLSTTAIGAGIMGLPACVKKLGMVPGLLAIILTALLTEKSIGFMIRNSRAGNLSSYGNLVGDSFGKFGKALVQICVIINNIGMLIIYMIIIGDVISGTSSSSEFHHSGVLEGWFGVHWWTGRTFVLLFTTFAVFAPLSCFKRIDSLRYTSALSFGLAVAFLVIAVGISIFKISIGGIGMPRLFPIITDVASVFELFTVTPVVVTAYLCHFNVHSIDNELEDSSQINGIVRTSLALCASVYLLTSFFGFLLFGEGTLDDVLANFDIDLGIPFGSVLNDAVRFSYAAHLVLVFPVVFYAVRINLDGLIFPSSRPLVLDNFRFASITMVLIVASFLGANFIPSIWDIFQFTGATAAACLSFIFPSAITLRDRYNIATKKDKILSVFMIVLAVLANVVAVYSDAFALIKNSITKRE

SEQ ID NO: 137263 - protein, 80 aa, Glycine max
  Coding DNA Sequence Number=SeqID_20485
MCLRRTGFLRSVFKVVFHHTLVIAALLSLLATKTENVLNEEKAERVFEEQLNNDPALGKKEEEAVVIGEEVADGERKFTN

SEQ ID NO: 137264 - protein, 370 aa, Glycine max
  Coding DNA Sequence Number=SeqID_20486
  Homolog annotation: Hit_ID=A0C2I4; Match level="QueryCoverage=33%, HitCoverage=49%, E-value=6e-10, Identity=30%"; Hit description =Chromosome undetermined scaffold_144, whole genome shotgun sequence
MDCGFLLLLLFFHLFLPHSSGVDIKEKGSCGGSKFYIGQAFSSQLGTLILLGTCLKLVLYNLKTHVYHFFILVSAHFLFHQLKLGNWASFSLLYARHIVTSKPSGVCVSQGGRFPPFKSEGGAPKNGPKDLTLCRIFRKKTCCDVTHTHPALLSVRKLASTGEATQECLHLWELLECSICDPRVGTQPGPPLICASLCERIYEACSNAYFSMDVKTQILAPCGVNDFVCGRAAEWVSNGTDLCLAAGFRVKPSDIVDIASEETSCYGDKASLGSVVDSWKASQFELTEKGESLRMLDDFQQWAREMPFGERVSWAIGGMVLTAGLMFISKRKSHNQRQKLAAIKRTARKLESRMMEQRPSNAQENRRVSR

SEQ ID NO: 137265 - protein, 91 aa, Glycine max
  Coding DNA Sequence Number=SeqID_20487
  Pfam annotation: Domain name=Auxin_repressed; Domain location=4-89; Score=1.7; E_value=0.0025; Accession=PF05564.3; Description =Dormancyauxin associated protein
MKQDLGGGCSLCDFGGSESDSGSVKSYGEDSPKNAVRVTRSIMIVKPPGNQSPSGSAPASPAGSTPPVSPFSDLGLALGTVNVSRGSGVTL

SEQ ID NO: 137266 - protein, 82 aa, Glycine max
  Coding DNA Sequence Number=SeqID_20488
  Homolog annotation: Hit_ID=Q8H0W7; Match level="QueryCoverage=43%, HitCoverage=25%, E-value=1e-12, Identity=86%"; Hit description =Expressed protein
MDLGRACMRTLGGGRSESEGVVLSELAEAVLRARTGEGVIPQVIEEAHGENSEETRCMRSGPWIRSGSTWAHMTWLYGSGFS

SEQ ID NO: 137267 - protein, 712 aa, Glycine max
  Coding DNA Sequence Number=SeqID_20489
  Homolog annotation: Hit_ID=Q1STF1; Match level="QueryCoverage=28%, HitCoverage=45%, E-value=2e-88, Identity=68%"; Hit description =Pectinesterase; Pectinesterase inhibitor
  Pfam annotation: Domain name=Pectinesterase; Domain location=497-697; Score=203.5; E_value=5e-58; Accession=PF01095.10; Description =Pectinesterase
SYPTVYCEDLKALVIEGDLEKVATLSEKVKEKEFEETKKLWDRAFNQPYEKAGGEVPLTLEGVISIKSPVYWEDSGTDACVFVRLKQRITTSQKDVNRDFLRLQIIRCHSELKLDKAFSNFTNDSWKKAWHFYCEFGTKGVMFDYRRHGGNCLRGSSLLDTVSFRWNDLLRADSLTLEKEVSQQVNVVTSITPPVQAPYLLKCVPDRVTDDSGAMISDVILKMNSYRPQEGRWLSRTVLDHAGRVCFVIRIRVGGGFWRRGGEAPSAVKWEDRIIEIREGSWSYVAGYIGRAPEKVVATATPKEPTEQCKAAWCFSTGDELTIQWDSSQSVSGLTFSLLNQTSPESSVLLLRGRQMQYQVKKTKSKRKGEDMKTELEEKEVDEEEDEESFITVVRFTEDNPDGKATALLNWRLLVVEVLPEEDAVLMLLLCLSILKSVSEMKKQDVGGLLVRRRLKEARLGSRDWGSVILHPSSWSSSIDSTYLQPWHWNAGVLMKSDAVDQLKRYPTLSQSPVEAVVGKGFVAVNITFRNTAASSKHQAVAVRNGADMSTFYSCSFEVDFIFGNAAAVLQDCNMYPRLPMQNQFNAITAQGRTDPNQNTGVSIQNCCTIAASDLGDATNNYNGIKTYLGRPWKEYSRTVYMQSFTDGLIDPKGGANEFANWGPGSNTSNRVTWEGYHLIDEKDADDFTVHKFIQGDKWLPQTGVPFKAGFQ

SEQ ID NO: 137268 - protein, 130 aa, Glycine max
  Coding DNA Sequence Number=SeqID_20490
  Gene Ontology: Mol. function=DNA binding; Biological process=DNA integration
  Homolog annotation: Hit_ID=Q1SJY5; Match level="QueryCoverage=65%, HitCoverage=10%, E-value=1e-15, Identity=45%"; Hit description =Integrase, catalytic region
MTGKMCMFQCLTSMHGGKVIFNGNQKGKIAGVGKIKQSLPVEKVWSGSSERLLKMNMVMLFAYKDESFEVFFKFFEMVQNEKGVCITAIINDHGGEFENENFHLQNGVVERKNRSLQEMTITILNDNFYT

SEQ ID NO: 137269 - protein, 83 aa, Glycine max
  Coding DNA Sequence Number=SeqID_20491
MTSEFTSVSPPQILANMHQSDLAPYVSRSYNAQWNAPKLPHDKHMPHSSCILEEMEVDFVVNLGVAFVADWVFLLGRVVGVIP

SEQ ID NO: 137270 - protein, 67 aa, Glycine max
  Coding DNA Sequence Number=SeqID_20492
MKMGYVVRNSIAHTFTVGICEIIFMEGEKKSHEDSTSGGFNLFSVSLTFGNSIGAFGGITGEISRNC

SEQ ID NO: 137271 - protein, 219 aa, Glycine max
  Coding DNA Sequence Number=SeqID_20493
  Gene Ontology: Mol. function=sulfate adenylyltransferase (ATP) activity; Cellular component=intracellular; Biological process =sulfate assimilation
  Homolog annotation: Hit_ID=Q1S9P0; Match level="QueryCoverage=86%, HitCoverage=39%, E-value=4e-57, Identity=63%"; Hit description=ATP -sulfurylase
  Subcellular localization annotation: CTP_CleavageSite=38; ConfidenceScore=5.45e-01
MSLSLAIKLHLASSSPSFSLLTLNNHQHANKLTTSETCSNTKVRPKPIYSTNPLIIPTCKVRPRVQYCGTMIKSSLIEPDGGALVDLVVPEGERGAKITLAESLPKVQLTRIDLEWVHVVGEGWASPLKGFMREDEYLQSLHFNSLRVKDGSVVNMSLPIVLAIDDETKERIGSSSHVGLLGPDGDCVAILRSPAILVATLRFLNSVTAIRATLAAFVP

SEQ ID NO: 137272 - protein, 104 aa, Glycine max
  Coding DNA Sequence Number=SeqID_20494
MSPVETCPSQASEGEAHGCAFQRRKNARSRHQRLFVENVGKTEGNRSTKAGLLLLRTLHQRGNQTYVVLSFMRESSDSFYLRGDHFKVLYLKNDPFYLIKREMT

SEQ ID NO: 137273 - protein, 87 aa, Glycine max
  Coding DNA Sequence Number=SeqID_20495
MDEKQWMYDNIMSEKVDMNVGNEEGVSVKVEHVDCSDVFDTFQLFANDIGFVVMIMRLDTNTSVRGKVSFLLIACKRKGEYRPKKND

SEQ ID NO: 137274 - protein, 71 aa, Glycine max
  Coding DNA Sequence Number=SeqID_20496
MVSPSMHHLEEGWCREGDTKMPPVLRLWEMDMNAAVVVGTEGMIYVYRYPTSVRMRIKVVICLGMRPNWWQ

SEQ ID NO: 137275 - protein, 605 aa, Glycine max
  Coding DNA Sequence Number=SeqID_20497
  Gene Ontology: Mol. function=protein binding; Cellular component =intracellular; Biological process=actin cytoskeleton organization and biogenesis
  Homolog annotation: Hit_ID=Q23GQ3; Match level="QueryCoverage=73%, HitCoverage=43%, E-value=2e-13, Identity=20%"; Hit description=Viral A-type inclusion protein repeat containing protein
  Pfam annotation: Domain name=Tropomyosin; Domain location=278-516; Score=-104.4; E_value=0.011; Accession=PF00261.10; Description =Tropomyosin
MSTEIAEHDGRVVDLEGGVVSSSSGNVMGDLVDVYSTMLKNLDLGLACFSEKVFNLSNFLMHVETMECEFEALEKEDHIGYLEKGLEFDLLSGVFDSEVRELEGVLDTLQGGVGEARDWVSSCTHLGEAFVAMQEKLVGYEQRLKQSEEEFNDIKMQSVSFQRTLPSLKKEENGNDDASEIITEDDKSLSANAEIRLQTVEQQRHILRMLEKSLAREMDLEKDINDSREIQENLRLRMFFSEQELDNMEEEAIDVWERWLEADNTSEILLGISQGLLGRLHISQFSLNGLSHRESELRANLKDAEDKLTFSNSEASALSNKVSSLEKQLKESEFQLLNAKASADEYQKQYNVQCSEARDMGNIIVELKEAVSNAESRAISAETKCQLLTETNSKLDEELALLRGATTRAELLERKLKESNLRLQKTVASAKASQEKQSNLYSTIRDMENVIKDLKSKVSKAQGRADSAEDNCIILSESNAELNEELSFLRSRLESLEGSLQREEEVKMATVEDIGKQAKVFKKLVTQLAVERERLKQQIIDALVWDKHQCYSAHAYFTLPLDIFPSKREQNFGIEVKANMLRIPHKKLVRLQPLTMRLIGKNPFN

SEQ ID NO: 137276 - protein, 319 aa, Glycine max
  Coding DNA Sequence Number=SeqID_20498
  Gene Ontology: Mol. function=sulfate adenylyltransferase (ATP) activity; Cellular component=intracellular; Biological process =sulfate assimilation
  Homolog annotation: Hit_ID=Q1S9P0; Match level="QueryCoverage=94%, HitCoverage=60%, E-value=1e-164, Identity=92%"; Hit description=ATP -sulfurylase
  Pfam annotation: Domain name=ATP-sulfurylase; Domain location=3-307; Score=546.9; E_value=2.1e-161; Accession=PF01747.8; Description=ATP -sulfurylase
MWKTKEVLRLSEEVRFGGIEIYKHNKEERIARTWGTTAPGLPYVEEVITPAGNWLIGGDLEVLKPIKYNDGLDNYRLSPKQLREEFDKRQADAVFAFQLRNPVHNGHALLMNDTRKRLLEMGYKNPILLLHPLGGFVKADDVPLDVRMEQHSKVLEDGVLDPETTIVAIFPSPMHYAGPTEVQWHAKARINAGANFYIVGRDPAGMGHPTEKRDLYDPDHGKKVLSMAPGLEKLNILPFRVAAYDTKVNKMAFFDPTRAKDFLFISGTKLGAVRDMRAFAKSGENPPEGFMCPSGWKVLVKYYESLQAEEPSQQPVLST

SEQ ID NO: 137277 - protein, 1001 aa, Glycine max
  Coding DNA Sequence Number=SeqID_20499
  Gene Ontology: Mol. function=phospholipase D activity; Cellular component=endoplasmic reticulum; Biological process=lipid catabolic process
  Homolog annotation: Hit_ID=Q2HW42; Match level="QueryCoverage=80%, HitCoverage=86%, E-value=0.0, Identity=80%"; Hit description =Phospholipase D/Transphosphatidylase; Pleckstrin-like
  Pfam annotation: Domain name=PH; Domain location=101-226; Score=29.8; E_value=9.5e-06; Accession=PF00169.19; Description=PH domain
  Pfam annotation: Domain name=PLDc; Domain location=361-388; Score =40.3; E_value=6.8e-09; Accession=PF00614.12; Description =Phospholipase D. Active site motif
  Pfam annotation: Domain name=PLDc; Domain location=769-796; Score =40.0; E_value=8.1e-09; Accession=PF00614.12; Description =Phospholipase D. Active site motif
  Pfam module annotation: Pfam domain module=PH::PLDc::PLDc; Domain location=101-226::361-388::769-796
MVQDDEEPDDGAVPLHHEDSVKNRYVPSVAALSIIRPSIGGQQTIADRAKVAMQGYLNRFLGNLDIVNSQEIMFSRPSDICRVCRFLEVSRLSFLQEYGPKLKEGYVMVKHLSNISQDSDVSCFPCNWFHCCNNSWKKVWSVLKPGFLAFLDDPFNNKPLDIMIFDILPYSNGDGGTKIFLADPVKERNPLRYTFKVTSGNRSILLRTTSSAKVKAWVTAINEASLRPLEGWCCPHRFGSFAPIRGLTEDGSQAQWFVDGQAAFEAIATSIQDAKSEIFITGWWLCPELYLRRPFDSFSTSRLDSLLEEKANQGVQIYVLLYKEVSLALKINSLYSMRRLFKIHENVRVLRYPDHFAARVYLWSHHEKLVIIDYKICYIGGLDLCFGRYDTPEHKVGDCPSVIWPGKDYYNPRESEPNSWEDTMKDELDRKKYPRMPWHDVHCALWGPPCRDIARHFVQRWNHAKRTKAPNEHGIPLLMPHHHMVLPHYMGRSKEIDIDEKKDKDKRKGIGRQDSFSSESPMQDIPLLLPQEADGLDTSNGDHTNLSENFPLSQKLEHETLVSDTQMKGFQDEVVPLNLGAQPVANALDDWWETPEETNDDITLEYGEVGPRTTCHCQVIRSVSQWSAGTSQPEESIHTAYCSLIEKAKHFIYIENQFFISGLAGDDIILNRVLEALYRRILQAHKDQKDFRVIIVMPLLPGFQGGLDDGGAATVRALTHWQYRTISRENHSILDNLEAILGPKTQDYISFYGLRSHGRLYENGPVATSQVYVHSKLMIIDDRIAFIGSSNINDRSLLGLRDSEIGVLIEDKEYVDSLMNGKPWKAGKFSYSLRCSLWSEHLGLHAGEISKISDPVADTTYKDLWSATAKENTRIYHEVFACIPNNQIHSRAALRQSMVHWKEKLGHTTIDMGIAPDKLVCHENGEIKIIDPIDRLKSVKGHLVSFPLEFMREEDLRPAVIESEFYVAPQKGNVEDKLGDKGLNTMEKKAEGERIHNMVIN

SEQ ID NO: 137278 - protein, 138 aa, Glycine max
  Coding DNA Sequence Number=SeqID_20500
MKKSSNRDYTSHIEFQTGNDFDPKYHKAKFSRENIHEIRQSEDVQKLQRIFSVAENTRKTMIDMSNRECDGTSNITVRKNWFLLNKTWEKAPKEPMHGSRYFKRSGSTTYTAFSITKSPLNCLQLFLFIGSYLSTVYN

SEQ ID NO: 137279 - protein, 348 aa, Glycine max
  Coding DNA Sequence Number=SeqID_20501
  Gene Ontology: Mol. function=protein phosphatase type 2C activity; Cellular component=nucleus; Biological process=protein amino acid dephosphorylation
  Homolog annotation: Hit_ID=Q2HW33; Match level="QueryCoverage=96%, HitCoverage=100%, E-value=1e-153, Identity=75%"; Hit description =Protein phosphatase 2C-like
  Pfam annotation: Domain name=PP2C; Domain location=59-331; Score =43.7; E_value=6.1e-10; Accession=PF00481.12; Description=Protein phosphatase 2C
MGHFSSAFNRLAKSFTTKKGRSSDECNGREAAEAMAKEAKRNHFMLHSSGTVNVDGSNNFASVFSRKGQKGVNQDCCIVWEEFGCQEDMIFCGIFDGHGPWGHFVAKRVRKSMPPSLLCNWQETLSQTPLHSDVDFDIETEKKQHRFNLWKHSYLKTCAAIDRELEQNRKIDSFYSGTTALSIVRQGELIIIANVGDSRAVLATTSDDGSLVPVQLTIDFKPNLPQEAQRILESQGRVFCLDDEPGVHRVWLPDEEFPGLAMSRAFGDYCVKKYGLISVPEVWDVISNQEAVDIVSSTPDRTDSSKRLVECAMRAWKRKRRGIAMDDISAICLFFHSSPSLDQVATPE

SEQ ID NO: 137280 - protein, 374 aa, Glycine max
  Coding DNA Sequence Number=SeqID_20502
  Gene Ontology: Mol. function=zinc ion binding
  Homolog annotation: Hit_ID=Q1S9P3; Match level="QueryCoverage=91%, HitCoverage=92%, E-value=5e-78, Identity=49%"; Hit description=Zinc finger, RING-type; RINGv
  Pfam annotation: Domain name=zf-C3HC4; Domain location=301-341; Score= 23.6; E_value=0.00057; Accession=PF00097.15; Description=Zinc finger, C3HC4 type (RING finger)
MSNHHRSSNPFSSTHSDSDSDSVSCFVTDLFETRSRLCSCDDDTDINPFSDVVCDLHRTEHMLGLGLGFGVEIDPESQTNDRDNHRGDRVLEADRVFNFTVGDGSGGLRVVGFGSESESSSEEGGIRDGGGFDDFDVRLCWDSLCLEDQRTLNEGFEWEEVEERVNEREDLGLVVDEVEIESDDGDGNSVASGFTNAVEEEDAGEEALRYLEWEILLAVNNLERNVNDVLEHEGNAVGGADLLTIQDGYVYAAEYDVLFGQFLENESALKGSPPASKSVVESLPLVELSKEELLQGKNVACAICKDEVLLEEKVRRLPCSHCYHGDCILPWLGIRNTCPVCRFELPTDDPDYEQGKVQRAAHGLLELAAARMQF

SEQ ID NO: 137281 - protein, 119 aa, Glycine max
  Coding DNA Sequence Number=SeqID_20503
MAASKATYLEAYEEKMNQIKEINNKAYEWLATEFLKKTWCKYAFSVYSKCDVTNTLLTRKFIVNLATRNACNFWGLVGIPYRHVPIVGFQVPTEAQGAGSQVPNVGSQVGSKSTKHQTK

SEQ ID NO: 137282 - protein, 209 aa, Glycine max
  Coding DNA Sequence Number=SeqID_20504
MKVNKECDALDCYGNCLTKMVTIKGVLLNAIIIINDEKENLRGAFVAAVELLIAIEAKAVLVPASPLEDERVSLLEPTLMVVRPGPQNGFPAACRKTDQDIQSRGSLSSNRGTSSFMRWEFTEVAEEGVVVEEDGEEVVESLVAKVWIYSSSFSVMVWMVSLRDKWFEVSFTMASSSLSEDTFERVDSTMGEGQGEHQNVRLITHNSGL

SEQ ID NO: 137283 - protein, 100 aa, Glycine max
  Coding DNA Sequence Number=SeqID_20505
MDEEVATKAKSSKVEVDVSILALAAETPVEKADKAVTKQTSHEATSKDTSTVKDMIGQAIGSFANRHRAENEEFRHSMQEVITTQFSSLGASLIQNLQQT

SEQ ID NO: 137284 - protein, 200 aa, Glycine max
  Coding DNA Sequence Number=SeqID_20506
MVSSARVLKQSDTSSTIQEDDLHLQSTKKVKDHTEASVGEEALSYVDKLLTTMGGVTGDDVSMEGVTVNGVMEEVPIMEHQNSVEQNMDGSAIPLSDVELMRWASSWLNTLVIIDLHEGFYQVVFSNEDDYNIALFEGLWMITVHYLIVQRRRPFFLINAETTKKMAIWINIYRLPIKFYNDVFFRGLARVLANFSRWIN

SEQ ID NO: 137285 - protein, 363 aa, Glycine max
  Coding DNA Sequence Number=SeqID_20507
  Gene Ontology: Mol. function=RNA-directed DNA polymerase activity; Cellular component=chromatin; Biological process=RNA-dependent DNA replication
MQFFHDGHLVELKEGTHLPSTSPFSSLVLLVKKHDDTWCICVDYRALNAITIKDHFPIPTIDELLDELRGANWFSKLDLLQGYHQILMHEEDICKTTFQTHHGHYEFNVMSFGLCNAPSSFQATMNAIFRSYLRHFFIIFFDDILIYSRTLDEHLDHLEKAFQVMLDEQFVLKLSNCSLAQNQVEYLGHRFVILTDHQSLKELLTQVAQTPEQQMYLARLMGYDYCIQYCAGNTNLVVDALSRLPDPSKSTMLLLSIPYPTFLEELKKNVSRDPNFIQFRQNITTKLEAHPECVVKDDLILKRGHIWLPKWSNFIPTLLKEYHSTPIGGYMGIAKTMARLTENFDWPGFRNDVEHFVAACLDC

SEQ ID NO: 137286 - protein, 388 aa, Glycine max
  Coding DNA Sequence Number=SeqID_20508
  Homolog annotation: Hit_ID=Q1RVQ5; Match level="QueryCoverage=32%, HitCoverage=8%, E-value=4e-28, Identity=54%"; Hit description =Integrase, catalytic region; Zinc finger, CCHC-type
MERPVGNGMCPDLTPSRKRSIMGIVLVLSKDGSSSCDNGLSRSNIDCLKKEFEMKDLGRTKFAWDYIEYFNKGVFVHQETYIMMVLKRFYMDKSHLLCTLDVDKDPFRPQEKDEELLGPEVPYLSVIGALVDSTTATTYPFNIFNLSRIFFFFFLATLVHGSNEKKLIFEVAMQQPLLLLPLLFAAPFLAAAEAIGGVTATEELPPEAAAATEAELGGAEEGQRGTDDEEEEWRAEDEEKVPDPAVAQPRGGGGGGAGHHARRGLMAAAVEVVGICGCGGGGCDDVSVPPHGRVFRFELLVHCCVLFDRGALFTVVRGQVMVVVVVDLAINGGGKMEEDQWMYDSIMSEEVDINEQNEDEADVFATRDDVLHWARSIAYEIGFVAVIM

SEQ ID NO: 137287 - protein, 82 aa, Glycine max
  Coding DNA Sequence Number=SeqID_20509
MKIGRQGGLRQGGLTQWQTKLSAHHYAVKQSPLDMAMGRGRDEYCLPNPRPRLPNMSPYPYPIPDGLKFIILSSYPLGIGYP

SEQ ID NO: 137288 - protein, 129 aa, Glycine max
  Coding DNA Sequence Number=SeqID_20510
  Homolog annotation: Hit_ID=Q00M75; Match level="QueryCoverage=23%, HitCoverage=4%, E-value=2e-09, Identity=100%"; Hit description=PPR -repeat containing protein
MLLINNSSPTSEVENETAAATNKRKRRHAGTPDPDAEVVSLSPKTFAGIRLLCVASPGAAVKLCLGDLLVMGSNPETASLHMQGFLLCAVVAHIARERKRNRRRHLSSLRRKSQFPLCRSVASLVVCGC

SEQ ID NO: 137289 - protein, 368 aa, Glycine max
  Coding DNA Sequence Number=SeqID_20511
  Gene Ontology: Mol. function=phosphoinositide phospholipase C activity; Biological process=intracellular signaling cascade
  Homolog annotation: Hit_ID=Q2HRX8; Match level="QueryCoverage=86%, HitCoverage=55%, E-value=1e-32, Identity=28%"; Hit description=IMP dehydrogenase/GMP reductase
  Pfam annotation: Domain name=DUF1723; Domain location=84-132; Score =34.9; E_value=2.9e-07; Accession=PF08330.1; Description=Protein of unknown function (DUF1723)
MVRTGGSGWTLDRVIRKALVAPVVEHVDHATKEVHEQPQEAPGGPYDTLVLMDYAYHVTVTVWNKEEHPELKLSSHVRKVEKFGRHAPEIEGLERWHKETSSFHIPIGEVTITLDDVTSLLHLPITGAFHSFETLHVDDVIFLLVELLKVSFEEDKSWDGIMPQGICCTLFANKSATHVHVVFLDAFRDLTQSGSYASGAAALVHMYDILNDASKSSARQLAGYITLLQHFPSIVFAITARDYDERKPHACRWKSGKALSMLTYCKHLDVLVSYAICWIPYSDHRAFREFELISLFFRHMCWGPSIIIHRPERVMRQFEYVQTIPPHPATPCLSVEEIDDRWIQFFEYLALVGQACVAPRQCATDYME

SEQ ID NO: 137290 - protein, 554 aa, Glycine max
  Coding DNA Sequence Number=SeqID_20512
  Gene Ontology: Mol. function=protein binding; Biological process =multicellular organismal development
  Homolog annotation: Hit_ID=Q2HW32; Match level="QueryCoverage=99%, HitCoverage=51%, E-value=0.0, Identity=81%"; Hit description =Lissencephaly type-1-like homology motif; CTLH, C-terminal to LisH motif; Nitrous oxide ...
  Homolog annotation: Hit description=reductase, N-terminal; WD40-like; Quinonprotein alcohol dehydrogenase-like
  Pfam annotation: Domain name=WD40; Domain location=312-350; Score =23.6; E_value=0.0007; Accession=PF00400.22; Description=WD domain, G- beta repeat
  Pfam annotation: Domain name=WD40; Domain location=379-416; Score =0.5; E_value=32; Accession=PF00400.22; Description=WD domain, G-beta repeat
  Pfam annotation: Domain name=WD40; Domain location=423-463; Score =16.0; E_value=0.13; Accession=PF00400.22; Description=WD domain, G -beta repeat
  Pfam module annotation: Pfam domain module=WD40::WD40::WD40; Domain location=312-350::379-416::423-463
MGLEKESGFFFNMKYFEEKVQAGEWEEVEKYLSGFTKVDDNRYSMKIFFEIRKQKYLEALDQQDKAKAVEILVGDLKMFSTFNEELYKEITQLLTLTNFRENEQLSKYGDTKTARSIMLIELKKLIEANPLFRDKLIFPTLKSSRLRTLINQSLNWQHQLCKNPRPNPDIKTLFTDHTCAPPNGPLAPTPVNLPIAAVAKPAAYTSLGAHGPFPPAAAATANANALAGWMANASASSSVQAAVVTASTMPVPQNQVPILKRPRTPPANPGMIDYQNADHEQLMKRLRPGHSVEEVSYPLARQASWSLDDLPRTVTMTLHQGSSVTSMDFHPSHHTLLLAGSNNGEISLWELSLREKLVSKPFKIWDVSACSLPFQLRICQAAAVKDAPISVSRVTWSPDGSFVGIAFTKHLIHLYAYTGPNELTQRIEVDAHVGGVNDLSFAHPNKQMCIVTCGDDKLIKFIFSTAIDGKIKAWLYDNMGSRVDYDAPGHWCTTMLYSADGTRLFSCGTSKDGESFLVEWNESEGAIKRTYNGFRKKSTGVVQFDTTQNRFLAA

SEQ ID NO: 137291 - protein, 172 aa, Glycine max
  Coding DNA Sequence Number=SeqID_20513
GKRIWMIVGIPGRRASQEKEVAAHPFFLSDLSLAAHANAHGYGAITAATVILPHSKRVLPSAHLLSKTSSMRGCLKVFFSGLVAVRSFSFTYGYTSLLSQQEDARTIVPKIGESREPEKRNLCQEESEAGFLPKAYDCLFAIADHTVTLSTSDKARFETLAIKDLEPTLVCE

SEQ ID NO: 137292 - protein, 239 aa, Glycine max
  Coding DNA Sequence Number=SeqID_20514
MALARRNRPNFARAIETLRGRCAEKGTGHPEAKHYPPRVVSWGTDIMIDPSSPIRRHIKWKMALTKKTGQMTSEAAKQLLTRLSRRHRIPLSPMDVRIRCDDQAILWTCSMNLPHFFLHGSRRHRAADSTNQGPAGGVDHKKSQMQSHGLVLPPEPEVCPLAARVSTNESYVDPLGNDPDTGSTECGYYVMHWMSTIILGSFKNNWETYFNDARPVELERLKALRIQWAKYYLKVRNET

SEQ ID NO: 137293 - protein, 255 aa, Glycine max
  Coding DNA Sequence Number=SeqID_20515
MTKRLLAGSLAFECRIMHYMIVCILLPRSSNLAQAHLVRYRMHKALRSNAPLPYPHLITLFLHHFNVPLDFEPFVKVKRSFFIGANVVSSFGYRKKRGGSWVKKDPAQALEDRSPSPPPQRDDSSSLMHNILDAMDARFAGMDTRITKLEEDDCHRQKGEDCGNVASKPILMMPKTQVKNQESNKFQESKSCSIKNQDSSKESREDSRYARTIKITQFCSREFFERKIIYQEFYFLVIDYQKAVIDYQKAVIDYQ

SEQ ID NO: 137294 - protein, 67 aa, Glycine max
  Coding DNA Sequence Number=SeqID_20516
MTGKADGPHNKKLKTYLGIVARDKLNVTYKNWKQVSATQKDMIWEDIQCFQDIQGSGNRLPGSVIDY

SEQ ID NO: 137295 - protein, 65 aa, Glycine max
  Coding DNA Sequence Number=SeqID_20517
MGSYGGHSSTREGGDQPRDAPAADPEEYIQPPNPQVPVAFDPPPHVDDYEGYEAIAQRLERVLKP

SEQ ID NO: 137296 - protein, 109 aa, Glycine max
  Coding DNA Sequence Number=SeqID_20518
MSQEVDMDYDYDNEEECGVNEPHVNCSNAINTSQVFGTRDDVLQWARTVAYENGFVVVIMRSDTDTDIRGRSSFVLIGCERSASLTSPDTSISTGSPSDNRQAVLHNLI

SEQ ID NO: 137297 - protein, 73 aa, Glycine max
  Coding DNA Sequence Number=SeqID_20519
  Subcellular localization annotation: CTP_CleavageSite=37; ConfidenceScore=5.41e-01
MYFMFKILVMNDGHWHMATPPNSPPPPPESATPSSPSTSKKTRKATRLRSLATRPIGVERPVVHVHPEIGKFD

SEQ ID NO: 137298 - protein, 192 aa, Glycine max
  Coding DNA Sequence Number=SeqID_20520
  Homolog annotation: Hit_ID=Q5S1T9; Match level="QueryCoverage=44%, HitCoverage=40%, E-value=4e-17, Identity=52%"; Hit description =Prenylated Rab acceptor protein 1
  Pfam annotation: Domain name=PRA1; Domain location=28-179; Score =198.2; E_value=2e-56; Accession=PF03208.9; Description=PRA1 family protein
  Subcellular localization annotation: CTP_CleavageSite=46; ConfidenceScore=5.52e-01
MSHIPTAGYGTLAGATPTPTPTGITPSTAATSSVTPRPWREFLDLSALSRPYSYDDAMIRVRRNLSYFRFNYAAVTLLIVFLSLLWHPISMIVFLLVLVAWYYFYFSRDVPLVVFNQTLDDRTVLCVLGLLTVVSLVSTHVGLNVLLSLIVSVVLVGLHAAFRVTEDLFLDEESSLLSVVGTQPIRTNYTPI

SEQ ID NO: 137299 - protein, 268 aa, Glycine max
  Coding DNA Sequence Number=SeqID_20521
  Gene Ontology: Cellular component=cytosol
  Homolog annotation: Hit_ID=Q2HW31; Match level="QueryCoverage=68%, HitCoverage=74%, E-value=2e-97, Identity=93%"; Hit description=PRP38
  Pfam annotation: Domain name=PRP38; Domain location=1-177; Score =283.4; E_value=4.3e-82; Accession=PF03371.5; Description=PRP38 family
MANRTDPAAKSIRGTNPQNLVEKILRSKIYQNTYWKEQCFGLTAETLVDKAMELDHLGGTYGGNRKPTPFMCLVMKMLQIQPEKEIVIEFIKNEDYKYVRILGAFYLRITGSDIDVYRYLEPLYNDYRKLRRKLADGQFTLTHVDEVIDELLTKDYSCDIALPRVKKRWTLESLGSLEPRRSALEEDFEEEEEKEDNEQPVDEIEDKAYEKDHYRGRSPTRERDRDRRHDSHRHSVGVYLDCFPFLSLYYIPLSVQSTKGYSLQSPPS

SEQ ID NO: 137300 - protein, 525 aa, Glycine max
  Coding DNA Sequence Number=SeqID_20522
  Gene Ontology: Mol. function=DNA binding; Cellular component =membrane; Biological process=DNA integration
  Homolog annotation: Hit_ID=Q1SS72; Match level="QueryCoverage=99%, HitCoverage=37%, E-value=1e-152, Identity=49%"; Hit description =Integrase, catalytic region
  Pfam annotation: Domain name=zf-CCHC; Domain location=275-292; Score =16.6; E_value=0.0018; Accession=PF00098.13; Description=Zinc knuckle
  Pfam module annotation: Pfam domain module=Retrotrans_gag::zf-CCHC; Domain location=81-196::275-292
MALQNFVDFSTNSANPYYLHPNENPALVLVSPSLTAKNYHTWSRSMHIALISKNKDKFIDGSLPKPPVSDPLYAPWIRCNTMVLAWIHRSISDSIAKSVLWIDTAAGVWKNLRIRFSQSDIFRISDLQEDLYRFRQGTLDVSDYFTQLKIYWDELENYRPIPHCKCSIPCSCGGIDSVRVYCEQDYVIRFLKGLNDRFSHSKSQIMMMNPLPDIDHVFSLVIQQEREMLGSNSDSVSEATSDSAMAMQVNSNQSNFNGKGGYYNKGKGSSKGGNRVCTHCGKTNHIVDNCFEKIGYPPGYKTNKSKNSSSSSQANNTSNASALESTQQGSSAQSSFQFTQEMYQGILEALQQSKVGSQPKANSVTTSPFALHSPSSNPNGKNPSLWILDTGATNHITFDLSSLTTYQNIVPVPVSLPNGSQVLASISGSVIISPLITIHHVLYIPCFHVNLMSVTKLASTNNCHLSFTTDLCKILQNHSLETIGTAKLQRGLYVIDTADMIRSCNSLSSHSFELWHSRLGHVSHS

SEQ ID NO: 137301 - protein, 272 aa, Glycine max
  Coding DNA Sequence Number=SeqID_20523
  Gene Ontology: Mol. function=protein binding; Cellular component =integral to membrane; Biological process=defense response to fungus
  Homolog annotation: Hit_ID=Q1ST34; Match level="QueryCoverage=84%, HitCoverage=61%, E-value=3e-53, Identity=49%"; Hit description =Leucine-rich repeat
  Pfam annotation: Domain name=LRR_1; Domain location=112-133; Score =6.3; E_value=19; Accession=PF00560.23; Description=Leucine Rich Repeat
  Pfam annotation: Domain name=LRR_1; Domain location=135-157; Score =11.9; E_value=1.7; Accession=PF00560.23; Description=Leucine Rich Repeat
  Pfam annotation: Domain name=LRR_1; Domain location=159-182; Score =10.7; E_value=2.9; Accession=PF00560.23; Description=Leucine Rich Repeat
  Pfam annotation: Domain name=LRR_1; Domain location=184-204; Score =3.7; E_value=59; Accession=PF00560.23; Description=Leucine Rich Repeat
  Pfam annotation: Domain name=LRR_1; Domain location=209-231; Score =2.8; E_value=86; Accession=PF00560.23; Description=Leucine Rich Repeat
  Pfam annotation: Domain name=LRR_1; Domain location=59-81; Score =12.8; E_value=1.1; Accession=PF00560.23; Description=Leucine Rich Repeat
  Pfam annotation: Domain name=LRR_1; Domain location=83-108; Score =7.0; E_value=14; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=112-133::135-157::159 -182::184-204::209-231::59-81::83-108
  Subcellular localization annotation: CTP_CleavageSite=23; ConfidenceScore=5.18e-01
MNQKIEGDQRFNRKGKNNNFGRSATMATRTHVSSDTMLTRGSSNQLSGKIPEGIGLPFHLESVSIQSNSLEGGIPKSFGNSCALSSLDMSHNNLNQELSVMIHHLSGCARYSLEQLYLGMNQINGTLPDLSIFSSLKLLNLDENKLNGEIPKDIKFPPQLEELVMQSNSLQGVLTDYHFANMSKLDFLELSDNSLLALTFSQNWVPPFQLSHIGLRSCKLGPEFPKWLQTQNQFGNIDISNAGIADMVPKWFWANLAFREWISMNISYNNLH

SEQ ID NO: 137302 - protein, 183 aa, Glycine max
  Coding DNA Sequence Number=SeqID_20524
  Pfam annotation: Domain name=DUF1777; Domain location=35-182; Score= -75.4; E_value=0.0043; Accession=PF08648.2; Description=Protein of unknown function (DUF1777)
MILPGFSALTVCSEKYDGSNSYVALVDGAPQILLRDRDYDRDYDRDYDRERGRGRDRDRDRERDRDRDRYRLREEKDYGRDREGRERERREKDRDRGRRRSHSRSRSRSRDRREHDGGDYRKRHARSSVSPRRHGDGLEDGEPKKKKKKEKKEKKDDGTDHPDPEIAEANKLRAALGLKPLRV

SEQ ID NO: 137303 - protein, 232 aa, Glycine max
  Coding DNA Sequence Number=SeqID_20525
  Gene Ontology: Mol. function=single-stranded DNA binding; Cellular component=mitochondrion
  Homolog annotation: Hit_ID=Q2HW28; Match level="QueryCoverage=76%, HitCoverage=71%, E-value=4e-72, Identity=75%"; Hit description =Single-stranded DNA binding
  Pfam annotation: Domain name=SSB; Domain location=86-197; Score=96.6; E_value=7.3e-26; Accession=PF00436.15; Description=Single-strand binding protein family
  Subcellular localization annotation: CTP_CleavageSite=27; ConfidenceScore=5.25e-01
MNSMAVRLVKHLQLSAPTSSSFGGVPRSGASWYSTSLSGGEYQPSQDNVAPKNEALDGELDDFLGEKAELQLQGVDPKKGWGFRGVHKAIICGKVGQAPVQKILRNGRNLTIFTVGTGGMFDQRIQGPKDLPKPAQWHRIAVHNDILGAYAVQKLFKNSSVYVEGDIEIRVYNDSINGEVKSIPEICVRRDAYISFLRQMLTGALRALVKEVKGKGFYWDAEMQKKALPYDF

SEQ ID NO: 137304 - protein, 183 aa, Glycine max
  Coding DNA Sequence Number=SeqID_20526
  Gene Ontology: Mol. function=RNA-directed DNA polymerase activity; Biological process=RNA-dependent DNA replication
  Homolog annotation: Hit_ID=Q1S4N5; Match level="QueryCoverage=94%, HitCoverage=33%, E-value=4e-35, Identity=42%"; Hit description =Peptidase M, neutral zinc metallopeptidases, zinc-binding site
MAIHHRIVGPWLMLGDFNDILASNEVRGGSFSLSKASLFANMRKNIQNGIHVRKKLDRCLSNSDWRLSFPYALVEILPTYNSNYNPILMSYLKAKSKKNLFHFQKAWISLPEYSNLVDSTWKGSAGNIYHKLDKIKSNSKDFNEKVFGNIFSKKRQLEARLKGAHRELDFAYDRQLENFEKEH

SEQ ID NO: 137305 - protein, 198 aa, Glycine max
  Coding DNA Sequence Number=SeqID_20527
MAESNPHPSAPLPFLHLLLLRIQSLRSSLIQTSCCRGINYANEAVQDSGTVNPAYTTREIQDQMLLTWLQSSLCRSILSRLLESVHAFQEQHVDIIHKGLPYDYNSGCGDQNNRDAGRGHGRGPGSCNFLSRISNLSLNNRSVMITNAGILILVHVLQLVALGSQTQKLPIMSLQIIITSANSALLKDHRQIFISNGQ

SEQ ID NO: 137306 - protein, 284 aa, Glycine max
  Coding DNA Sequence Number=SeqID_20528
  Gene Ontology: Mol. function=protein-tyrosine kinase activity; Cellular component=integral to membrane; Biological process=protein amino acid phosphorylation
  Homolog annotation: Hit_ID=P33543; Match level="QueryCoverage=80%, HitCoverage=33%, E-value=4e-87, Identity=66%"; Hit description =Putative kinase-like protein TMKL1 precursor
  Pfam annotation: Domain name=LRR_1; Domain location=124-146; Score =7.0; E_value=14; Accession=PF00560.23; Description=Leucine Rich Repeat
  Pfam annotation: Domain name=LRR_1; Domain location=148-170; Score =9.5; E_value=4.7; Accession=PF00560.23; Description=Leucine Rich Repeat
  Pfam annotation: Domain name=LRR_1; Domain location=172-194; Score =15.9; E_value=0.15; Accession=PF00560.23; Description=Leucine Rich Repeat
  Pfam annotation: Domain name=LRR_1; Domain location=197-220; Score =10.8; E_value=2.7; Accession=PF00560.23; Description=Leucine Rich Repeat
  Pfam annotation: Domain name=LRR_1; Domain location=224-246; Score =10.9; E_value=2.6; Accession=PF00560.23; Description=Leucine Rich Repeat
  Pfam annotation: Domain name=LRR_1; Domain location=248-270; Score =13.0; E_value=1; Accession=PF00560.23; Description=Leucine Rich Repeat
  Pfam module annotation: Pfam domain module=LRR_1::LRR_1::LRR_1::LRR _1::LRR_1::LRR_1; Domain location=124-146::148-170::172-194::197 -220::224-246::248-270
  Subcellular localization annotation: CTP_CleavageSite=27; ConfidenceScore=5.76e-01
MAFLNPFSLHIPMSLLLFLLFFFCFCKASTTTTTSTTTKSLSPSSSPSTTTSSSDVQLLLGKIKASLQGSNSDNLVLSSWNSSTPLCQWSGLKWVFSNGTPLSCTDLSSPQWTNLTLHKDPSLHLLSLRLPSANLSGSLPRELGGFPMLQSLYLNINSLEGTIPLELGYSSSLSEIDLGDNMLSGVLPPSIWNLCERLVSLRLHGNSLSGSVSEPALPNSSCKNMQLLDLGGNKFSGSFPEFITKFGGLKQLDLGNNMFMGTIPQGLTGLRLEKLNLSHNNFSG

SEQ ID NO: 137307 - protein, 68 aa, Glycine max
  Coding DNA Sequence Number=SeqID_20529
  Homolog annotation: Hit_ID=Q8GT87; Match level="QueryCoverage=52%, HitCoverage=16%, E-value=9e-07, Identity=75%"; Hit description=Fiber protein Fb2
MFLEEKCSRIGFRELSGGREDEEMWRHQPCQLRIRRRRQKDASLFKGCCCPPYLMIIYEGNSWRWLLQ

SEQ ID NO: 137308 - protein, 159 aa, Glycine max
  Coding DNA Sequence Number=SeqID_20530
MAITLDDVSCLLYIPMTGKTIDHVPSLFDREAMKIPMMTHLGIPTYAEAATNKHKCQNGVGVVDTLSSTHVHVALLQYFNNLDAFHKYAWGVATLEYLYNNLSYTSQSKDYVVEDPIATRWKALRGTGLAFPTICEIDVRPYCPEKVLRQFGHIQEIPR

SEQ ID NO: 137309 - protein, 359 aa, Glycine max
  Coding DNA Sequence Number=SeqID_20531
  Gene Ontology: Mol. function=RNA-directed DNA polymerase activity; Cellular component=chromatin; Biological process=chromatin assembly or disassembly
  Pfam annotation: Domain name=rve; Domain location=232-359; Score =23.0; E_value=7.2e-05; Accession=PF00665.16; Description=Integrase core domain
MTQIPVLTTPDFSIPFTLEKNAPSSAMDVILLQNTHPIAYYSKVLCPRLQRAFTYFCELHIITVSVCKWRHYLLGNSFTILTNYKSLKDIMLQVIQTPKQQTYMSKILGYDYTIKYKVGSTNVVANALSRILAPEEMHLFSLSMSNSVILGKFRQALVQDPNMMLYYDKSTSNPRLAQTSPCIKMSSSGKEIFGCLSRRDSHMYYWRNFTLPLSVTKYETKKSVGLLQPLPIASNVWENLSPDFIIGLPPSHGSTVILVVVGRYSKEAHFSALPHHHSTYKVALLFLDMVCKLHGFPRSLISDRDPIFVSNFWRELFRLSGTKLRISTANHSQSDGQTEVTNRILEQYLRSFVHDRPSH

SEQ ID NO: 137310 - protein, 188 aa, Glycine max
  Coding DNA Sequence Number=SeqID_20532
  Gene Ontology: Mol. function=RNA-directed DNA polymerase activity; Cellular component=chromatin; Biological process=chromatin assembly or disassembly
MTIISATRDPRRDYPILGPTVEKKFSAGTGMKNPLQLIWGRGLCSPPRRIHGFHQIRMAEDDVHKTAFRTHHGHYKFKVMLFGLCNTPSTFQATMNDTLRPFLRKYVVVFFNDILVYIPSLSSHVEHLEVILSTLSQQQFLLQQSKCVFAQNQLNYLGRMLSTKGVALDPDKVQAMSDWPIPATPIAL

SEQ ID NO: 137311 - protein, 539 aa, Glycine max
  Coding DNA Sequence Number=SeqID_20533
  Gene Ontology: Mol. function=nucleotidyltransferase activity; Cellular component=intracellular; Biological process=tRNA processing
  Homolog annotation: Hit_ID=Q9C7K6; Match level="QueryCoverage=95%, HitCoverage=97%, E-value=1e-144, Identity=47%"; Hit description=3' -5' exonuclease, putative
  Pfam annotation: Domain name=3_5_exonuc; Domain location=325-503; Score=62.4; E_value=1.4e-15; Accession=PF01612.11; Description=3'-5' exonuclease
MGLEENVAKTSTTKDDASQMLTLCTHAFYDLTHVSPVVFLFLLKKCYYYDHSQGFTHLIISALRRFLKRSTITTEDSLEVKDLVAHLLVDIIRGQIHHDEKIVMKLLEIFDVKLTNVEKAMCQIKEKHELSYGTANEFVEQYIVELVKSQFYMTAVTLIEQFSIHQYGQSFLLDMIQSNQFKAAEKWATFMGKPMLSTLVEEFIERNMLKNAYEIIKKNNLKQDFPDVYKRCKESSLKNLAEKGCWDVAEARTNNDRQLMEYLVYLALEAGYMEKVDELCDRYCLDRFLDIKDDKHKFALCPAVPETSNLQGRYLHLDELLVDSIIWVDEVEGLLDATRHIKGFKVIGLDCEWKPNYVKGSKPNKVSIMQIASEKMVFIFDLIKLHKEVPDILDDCLSCILLSPRILKLGYNFQCDAKQLAYSYEELRCFKNYEMLLDIQNVFKEPRGGLAGLAEKILGASLNKTRRNSNWEQRPLTPNQLEYAALDAVVLVHIFHHLPGQGHDKSEWKSCIVSHTENAKKFKKCVPKVVDTDMETSKH

SEQ ID NO: 137312 - protein, 841 aa, Glycine max
  Coding DNA Sequence Number=SeqID_20534
  Gene Ontology: Mol. function=metal ion binding; Cellular component =integral to membrane
  Homolog annotation: Hit_ID=Q10MN1; Match level="QueryCoverage=38%, HitCoverage=40%, E-value=4e-65, Identity=43%"; Hit description=PHD -finger family protein, expressed
  Pfam annotation: Domain name=PHD; Domain location=482-529; Score =48.3; E_value=2.6e-11; Accession=PF00628.19; Description=PHD-finger
  Pfam annotation: Domain name=YL1; Domain location=121-338; Score= -75.2; E_value=0.015; Accession=PF05764.4; Description=YL1 nuclear protein
  Pfam annotation: Domain name=zf-C3HC4; Domain location=390-431; Score= 11.9; E_value=0.0093; Accession=PF00097.15; Description=Zinc finger, C3HC4 type (RING finger)
  Pfam annotation: Domain name=zf-P11; Domain location=386-440; Score =4.8; E_value=0.031; Accession=PF03854.4; Description=P-11 zinc finger
  Pfam module annotation: Pfam domain module=PHD::YL1::zf-C3HC4::zf -P11; Domain location=482-529::121-338::390-431::386-440
MVRGGRFSGKRNFRKRVRSKEGVSDDSDEDYVVSDEEEGFDSLMEEEEEEFRRVRSLNRSKSEKGIAGRWKNGIKNSYKRGRITYEEEEEEEEVEEEFEEEEEEEIQEVRNFNRSKAKNGVCSKKKRAGKISPKRGRKIRAEHLEEEEEEEEEKQVVEDEEEEKVERSGDEEEEPEGDRDGEDEDFEYDDEDDEFLPEEEDYSDEEEEMGGRKKKNDGVKMEKEVLQKKRASVVSTRGRKRRSSIASKKPLRNKRRKNGRLRKKEKCEDDFIDNGTTIGTTTRRKQGQKRRRVLLSDSDYASSGSSDFEFTISEEEREQVREAKRLCGNLRNNLRSSSHLINNEEVGVHEYQHPQRKPPARKGKEKIEEPLGRKGKEKVEDLKSKGKQTCGICLSEEDKRRVRGVLNCCTHFFCFACIMEWAKVESRCPLCKQRFKAISKPARSTTGIDLREVVIQVPERDQVYQPSEEELRSYIDPYEYVICSECHQGGDDGLMLLCDICDSPAHTYCVGLGREVPEGNWYCDGCRPVALGSSSSQVQEGVADPRVSVQSHPVRPPPVLHVRESIDLNLISSPRAAFNQGFGHLPSSRFSGRSAEGASPVSGGAPTLSERRWIHRQIQQLLSIDRMASTPGRTNGISATSSTSNLYSSHFDQSRGTTTLHARTQDVGTSYHTFFDERLCNNSSPLMQNGALWSGLMGTPPVPDCEQVHQFSRSNIVPDGGLSPAVREESNFHFAKEQLQSMVKSHLKSLSQNIDLGHNTIKDIARSSMHTILAACDLEHMKSEVCTVPPPSACSHMELMAGGQTSLIKGCCSSCFDSFVGDVVKRILDTRISSQWLRLGL

SEQ ID NO: 137313 - protein, 73 aa, Glycine max
  Coding DNA Sequence Number=SeqID_20535
MAKGTRQNNMPRVDMEQNNPDGSSGGHQLKTICQHHVQSLLTPYGIKNGMQLPGLIKYSWYHAIHKAWSKCIH

SEQ ID NO: 137314 - protein, 838 aa, Glycine max
  Coding DNA Sequence Number=SeqID_20536
  Homolog annotation: Hit_ID=Q10MM5; Match level="QueryCoverage=98%, HitCoverage=90%, E-value=3e-76, Identity=30%"; Hit description =Expressed protein
MDNNRVNPSNNASCDIDCAISINSDEGCGAKVPGLVARLMGLDSLPVSTVSGLSSSSTSLYGSNSLGSSHSPDDDVLHSMVDCCCPVDPINMRLKPEKSSWAAMQSRAQKVGNPAMKRFQTEMLPPKSVKPIPVTHNKLLSPIKSPGYTQPKHAAHVMEAAAKIIEASSQPCRRNRMSSSGSSSVPLRILDLKEKLEAAQYEFKFMDTHTANPLNGKPSERRNNLYKSSSSFKGSRDSVKNSSCQLASKGKSASLAMPSKTNAQSRDELTLNGNRRYMRQNKQNDVKSNQFPRSQKKQIVDRARVMQQRACTGQSSNVLGKNNQKQNSVTNKGGSASKVDSNKPTQTWSSESSTGAKKTTKKVVVNANIEPKRFGTRITDTIKEFPVSKRKGIFQKKNYSSSDVHNEARGSNSAANTYENKSVKCNITTDRSIDQDAFSMKGSNGVISFTFTSPLRRNMPELQSSTEQVMGTRNEIEVNSCNSDKLYPQKSSFSPPRLHVIDGDALSVLLEKKLQELTSRINPPQCSLTTEGSSTGLRSSLEDKCQSVLSTTVREQDRIFRNKLDSMHDNCSSSDIMMLSMNQQLQTSESMEEPSCSSNSESQNGSYLHSAYGSTIYSSMQDEEVSNFSPMNESLSLENKAEWSEQSSSIVMGDNMASEQLSLMSNSAEYTRSARNMELEYVKDIFSNAELMAEEFVVGETDKIIMENLFDKLENEGLGAENYEEYSKIERKIIFDTVSECLELRCKQVFVGSCKAWPKWVASVQRKKCLAEEFYKEMLSFRNMEDGVEVDELVSKDMSTGWGRWLDFDIEACEEGSELEFDIVTCLINELVSDLLYV

SEQ ID NO: 137315 - protein, 61 aa, Glycine max
  Coding DNA Sequence Number=SeqID_20537
MQVVEHVGGSVIPTSNSFSPICISNDDVFFGSNSSGTLEKRNLNGELFEQLMGDSEGHGFY

SEQ ID NO: 137316 - protein, 180 aa, Glycine max
  Coding DNA Sequence Number=SeqID_20538
  Gene Ontology: Mol. function=protein kinase activity; Cellular component=integral to membrane; Biological process=protein amino acid phosphorylation
  Homolog annotation: Hit_ID=Q9FI77; Match level="QueryCoverage=74%, HitCoverage=51%, E-value=6e-44, Identity=44%"; Hit description =Receptor protein kinase-like protein
  Pfam annotation: Domain name=LRRNT_2; Domain location=47-88; Score =37.3; E_value=5.2e-08; Accession=PF08263.3; Description=Leucine rich repeat N-terminal domain
  Pfam annotation: Domain name=LRR_1; Domain location=116-138; Score =9.3; E_value=5.3; Accession=PF00560.23; Description=Leucine Rich Repeat
  Pfam annotation: Domain name=LRR_1; Domain location=140-162; Score =14.5; E_value=0.38; Accession=PF00560.23; Description=Leucine Rich Repeat
  Pfam annotation: Domain name=LRR_1; Domain location=164-178; Score =1.9; E_value=1.3e+02; Accession=PF00560.23; Description=Leucine Rich Repeat
  Pfam module annotation: Pfam domain module=LRRNT_2::LRR_1::LRR_1::LRR_ 1; Domain location=47-88::116-138::140-162::164-178
MPRQVLSNQNHNHMSRQAFITNHHHHDHHHLLHILLFTLLVPLSFAANDEVSALVSWMHSSSNTVPSAFSSWNPLDSNPCNWSYIKCSSASLVTEIAIQNVELALHFPSKISSFPFLQRLVISGANLTGAISPDIGNCPELIVLDLSSNSLVGGIPSSIGRLKYLQNLSLNSNHLTGPIP

SEQ ID NO: 137317 - protein, 34 aa, Glycine max
  Coding DNA Sequence Number=SeqID_20539
MVFAQNFIQNSSHWPTAIHVSKNIHEHVRDKRNS

SEQ ID NO: 137318 - protein, 163 aa, Glycine max
  Coding DNA Sequence Number=SeqID_20540
METALPSNTSSPRVRYSILTILYYLCDPVHLPEANKFLAPLPGNLFLFGKSPTDNLVPLDLEIEATLRRDRAERRRKLLQDITVASILEEKTHFSDSLSPDSPSSRESATQLPETTIMADEQHQRITLEDYSSNSVSQFFTSIARPEVQAHNINYPHSLIHLI

SEQ ID NO: 137319 - protein, 1410 aa, Glycine max
  Coding DNA Sequence Number=SeqID_20541
  Gene Ontology: Mol. function=ATPase activity, coupled to transmembrane movement of substances; Cellular component=integral to membrane; Biological process=transport
  Homolog annotation: Hit_ID=Q9M3B9; Match level="QueryCoverage=96%, HitCoverage=99%, E-value=0.0, Identity=77%"; Hit description =Multidrug resistance protein 14
  Pfam annotation: Domain name=ABC_membrane; Domain location=813-1089; Score=72.6; E_value=1.3e-18; Accession=PF00664.13; Description=ABC transporter transmembrane region
  Pfam annotation: Domain name=ABC_membrane; Domain location=82-351; Score=74.1; E_value=4.3e-19; Accession=PF00664.13; Description=ABC transporter transmembrane region
  Pfam annotation: Domain name=ABC_tran; Domain location=1137-1322; Score=199.4; E_value=8.5e-57; Accession=PF00005.17; Description=ABC transporter
  Pfam annotation: Domain name=ABC_tran; Domain location=421-604; Score= 148.0; E_value=2.4e-41; Accession=PF00005.17; Description=ABC transporter
  Pfam annotation: Domain name=DUF1558; Domain location=1241-1351; Score=1.1; E_value=0.084; Accession=PF07594.2; Description=Protein of unknown function (DUF1558)
  Pfam annotation: Domain name=Viral_helicase1; Domain location=1140 -1320; Score=-56.8; E_value=0.041; Accession=PF01443.9; Description =Viral (Superfamily 1) RNA helicase
  Pfam module annotation: Pfam domain module=ABC_membrane::ABC _membrane::ABC_tran::ABC_tran::DUF1558::Viral_helicase1; Domain location=813-1089::82-351::1137-1322::421-604::1241-1351::1140-1320
MGSRGLFGWSPPHIQPLTPVSEVSEPPESPSPYLDLGAETSATQPMEVEEEMEEADEIEPPPAAVPFSRLFACADHLDWFLMLVGSIAAAAHGTALVVYLHYFAKVLRVPQQGLPEEQFHRFKELALTIVYIAGGVFAAGWIERQTAVIRSKYVQVLLNQDMSFFDTYGNNGDIVSQVLSDVLLIQSALSEKVGNYIHNMATFFSGLVIAFINCWQIALITLATGPFIVAAGGISNIFLHRLAENIQDAYAEAASIAEQAVSYIRTLYAFTNETLAKYSYATSLQATLRYGILISLVQGLGLGFTYGLAICSCALQLWVGRLLIIHGKAHGGEIITALFAVILSGLGLNQAATNFYSFDQGRIAAYRLFEMISRSSSSFNHDGSAPASVQGNIEFRNVYFSYLSRPEIPILSGFYLTVPAKKTVALVGRNGSGKSSIIPLMERFYDPTLGEVLLDGENIKNMKLEWLRNQIGLVTQEPALLSLSIRDNIAYGRDTTMDQIEEAAKIAHAHTFISSLDKGYDTQVGRAGLALTEEQKIKLSIARAVLLNPSILLLDEVTGGLDFEAERSVQEALDLLMLGRSTIIIARRLSLIKNADYIAVMEDGQLVEMGTHDELLTLDGLYAELLRCEEATKLPKRMPVRNYKETATFQIEKDSSESHSFKEPSSPKMIKSPSLQRVSAIFRPSDGFFNSQESPKIRSPPSEKLMENGQSLDSSDKEPSIKRQDSFEMRLPELPKIDVQCVHRQTSNGSDPESPISPLLTSDPKNERSHSQTFSRPDCHSDDLLVKMSETKDARHRKQPSIWRLAELSFAEWLYAVLGSIGAAIFGSFNPLLAYVIGLVVTDYYRIDEAQHLQGEINKWCLIIACMGIVTVVANFLQHFYFGIMGEKMTERVRRMMFSAMLRNETGWFDEEENSADNLSMRLANDATFVRAAFSNRLSIFIQDSAAVIVAFLIGVLLHWRLALVALATLPVLCVSALAQKLWLAGFSKGIQEMHRKASLVLEDAVRNIYTVVAFCAGNKFLLFACNALLLWYTALCVNKSYVDLPTALKEYIVFSFATFALVEPFGLAPYILKRRKSLMSVFEIIDRVPKIDPDDSSALKPPNVYGSIELKNIDFCYPSRPEVLVLSNFSLKVNGGQTIAVVGVSGSGKSTIISLIERFYDPVAGQVLLDGRDLKQYNLRWLRSHLGLVQQEPIIFSTTIRENIIYARHNASEAEMKEAARIANAHHFISSLPHGYDTHVGMRGVDLTPGQKQRIAIARVVLKNAPILLLDEASSSIESESSRVVQEALDTLIMGNKTTILIAHRAAMMRHVDNIVVLNGGRIVEEGTHDSLVAKNGLYVRLMQPHFGGGLHVARMGVLDQHSALVGIRRGYCGRGSVGIKDRNLEFGCFETLVLKLRMHILLEASSLD

SEQ ID NO: 137320 - protein, 1089 aa, Glycine max
  Coding DNA Sequence Number=SeqID_20542
  Gene Ontology: Mol. function=RNA-directed DNA polymerase activity; Cellular component=chromatin; Biological process=chromatin assembly or disassembly
  Pfam annotation: Domain name=Chromo; Domain location=1010-1059; Score= 20.2; E_value=0.0041; Accession=PF00385.14; Description='chromo' (CHRromatin Organisation MOdifier
  Pfam annotation: Domain name=RnaseH; Domain location=450-571; Score= -24.1; E_value=0.01; Accession=PF00075.14; Description=RNase H
  Pfam annotation: Domain name=rve; Domain location=709-865; Score =105.2; E_value=1.9e-28; Accession=PF00665.16; Description=Integrase core domain
  Pfam annotation: Domain name=zf-H2C2; Domain location=650-691; Score =7.2; E_value=0.041; Accession=PF09337.1; Description=His(2)-Cys(2) zinc finger
  Pfam module annotation: Pfam domain module=Chromo::RVT_1::RnaseH::rve: :zf-H2C2; Domain location=1010-1059::192-361::450-571::709-865::650 -691
MVGDGTDIDCTRVCRNVTLTIQEHQFIVDLHVKGLGGADLILGVAWLTHIGPITTDYSHLTMRFSHQGKPITIYGDASLGPSEISHGQVKRLVSTYQIAGLFHLQLQATHPITADNHTPHSPICTLLSKYPRLFQPLHHLPPSRSTDHIIHLEPHSKPVNVRPYRYPYFQKTEIEKHVQDMLHRQLIRPSRSPYSSPVLLVKKKDGTWRFCVDYRALNSITIKDRFPLPTIDELLDDLGNSSWFSKMDLAQGFHQIRMSDADIFKTAFRTHEGHYEYVVMPFGLCNAPSTFQATMNSLFRPFIRKFVLVFFDDILVYSSDLQSHLNHLDCVLRTLQQADFRLKASKCIFGQRRIEYLGHFVSRRGVEPDSSKIQAMLHWPPPTTTKALRGFLGLTGFYRRFVKNYAQIAAPLTHLLKKDQFVWTPETQQAFEALKSAMTTTPVLALPDFNIPFTVETDASGSGMGAVLMQRGHPLAFFSKQFCPKLLRSSTYIRELHAITTAVKKWRQYLLGHTFIILTDHKSLRELMTQPVQTPEQHVYLAKLLGYDYTIQYKAGHNNAVADALSRVQESPLPAAEAFYILSIPHFKFLEELKRELSASLEFQTLVAGIRNDPQQYSDFSFRDSLLLHKERLWLNRGNSLIPSLLEEFHKSPLGGHMGLSKTLSRLQQNFSWEGMRKDTQTFIRQCTDCMQTKYITQKPTGLLQPIPPPTRPWEDLAIDFIIGLPNFKGHTVIMTVVDRFSKGAHFGTLPTQFTAHMAAQLFLELVCKLHGFPRSLISDRDPIFISKFWRELFKLSGTQLRMSTSYHPQSDGQTEVLNRVLEQYLQSFVHGKPSQWGKFLSLAEWCYNTTCHSSMNLSPFEITYGKPPPAILDYLPGASSVEAVDFLLSSRQEMFETLRGKLERAQCKMKRYADSHRRDVSFEVGDWVYVRLRPHRQTSIANKYQKLGKRYYGPYQITEVIGKVAYRLALPPTAKIHPVFHCSKLKPHHGPLTTDQSLPPTSWDNNPLIESLTILDHKWDDQTPPCLSVLVQWTGLPPEDSTWEDWTQLQSIYHLEDKVFSDVVGDDKNGPRPRRISRRPSGWEEFIH

SEQ ID NO: 137321 - protein, 167 aa, Glycine max
  Coding DNA Sequence Number=SeqID_20543
  Gene Ontology: Mol. function=nucleotide binding; Cellular component =endoplasmic reticulum; Biological process=small GTPase mediated signal transduction
  Homolog annotation: Hit_ID=Q38M59; Match level="QueryCoverage=98%, HitCoverage=77%, E-value=5e-64, Identity=75%"; Hit description =NtSar1 protein-like
  Pfam annotation: Domain name=Arf; Domain location=2-166; Score=183.1; E_value=6.9e-52; Accession=PF00025.11; Description=ADP-ribosylation factor family
MRLVQHQPTQYPTSEELSIGRIKFKAFDLGGHQIARRVWKDYYAKLLLALLFASIKHAWTLVDAVVYLVDAYDKERFAESKKELDALLSDESLTTVPFLILGNKIDIPYAASEEELRYHLGLTNFTTGKGNVNLSDSKVRPMEVFMCSIVKKMGYGDGFKWLSQYIK

SEQ ID NO: 137322 - protein, 240 aa, Glycine max
  Coding DNA Sequence Number=SeqID_20544
  Pfam annotation: Domain name=DUF674; Domain location=1-214; Score= -283.9; E_value=0.00024; Accession=PF05056.3; Description=Protein of unknown function (DUF674)
MASSASTKLTMKLLIDSKREKVLFAEASKEIIDFLLNLLCLPLSAVIRLLNKDGMVGSIGNLYQSVENLSDTYLQPHLHKDVLLKPRAPISSQQFSALLPAIGNNSANHNAEASFYTCHNSYSCGYHVTCDNKTLCPQCLNAMSRKVTYVGKKVAEDVFPNNSGFVKEVVTYMVMDDLVIQPMSTISSITLLNKFNVIEIGALKEKVVELGMTQGVDLLKASLQSKAVLTRVFLKNNAAI

SEQ ID NO: 137323 - protein, 231 aa, Glycine max
  Coding DNA Sequence Number=SeqID_20545
  Gene Ontology: Mol. function=calcium ion binding; Cellular component =chloroplast thylakoid membrane; Biological process=photosynthesis
  Homolog annotation: Hit_ID=O80634; Match level="QueryCoverage=99%, HitCoverage=97%, E-value=4e-64, Identity=54%"; Hit description=PsbP domain protein, putative
  Pfam annotation: Domain name=PsbP; Domain location=45-229; Score =168.7; E_value=1.5e-47; Accession=PF01789.7; Description=PsbP
  Subcellular localization annotation: CTP_CleavageSite=37; ConfidenceScore=5.56e-01
MAISLSWISPCLSHKLNLPHSNCLPRNTATSSTSTVFCALETTPGGESHCQRRPLLLGIGALTANLQPTNLVFAQEKSDRCRVFLDYEDGYSYIYPIDWKEFDFRALDSAFKDRYLQLQNVRVKSIPTEKKDIRDLGPMEEVIYNLVKHIYAAPNQRPTIKDMQEKTIDGKHYYTFEYILTSPNYSSASFATIAIGNGRYYTLIVGANERRWKRFRDQLKVVADSFRLLDI

SEQ ID NO: 137324 - protein, 36 aa, Glycine max
  Coding DNA Sequence Number=SeqID_20546
MKVFDLILLKLKVVWVEADYCSSKFLGQQDEGKVKI

SEQ ID NO: 137325 - protein, 99 aa, Glycine max
  Coding DNA Sequence Number=SeqID_20547
MSHAVKDNRGKWAPNYEGPFVVKRAFFWGGRIVLGHGQKSRQVDGWKSTKVLRDGCKWGIGSRSTDRCPFLALDKQRTSLEGSPVSFEFTVFITIVCFK

SEQ ID NO: 137326 - protein, 164 aa, Glycine max
  Coding DNA Sequence Number=SeqID_20548
MRGCINYNPALSIRQLGYPMRGAPTEESLSPFLVIDFGAQGFKVIQRVHKAWEGPLRKDKELRGIRNGIIGGYHEWLKVRTRRLDWLSKLKIINEENFEASEEDEEVRALKTELGKARLAKEKFKLVATDVRKECVELREENAATARALERETKRDRKEEHGRD

SEQ ID NO: 137327 - protein, 361 aa, Glycine max
  Coding DNA Sequence Number=SeqID_20549
  Gene Ontology: Mol. function=identical protein binding; Cellular component=cytoplasm; Biological process=negative regulation of enzyme activity
  Homolog annotation: Hit_ID=Q9ZTT3; Match level="QueryCoverage=69%, HitCoverage=34%, E-value=1e-121, Identity=84%"; Hit description =Subtilisin-like protease C1
  Pfam annotation: Domain name=Peptidase_S8; Domain location=39-326; Score=-26.9; E_value=2.4e-05; Accession=PF00082.12; Description =Subtilase family
MRAKKGLTFGGLSNEGHDRVVVVFPNKKKQLHTTRSWDFIGFPLQANRAPTESDVIIAVLDSVIWRESESFNDKGFGPPPSKWKGTCQTSKNFTCNSKIIGAKIYKAGGFFSDDDPKSVRDIDGHGTYVASTAAGNPVSTTSMLGLGRGTPRGAATKACIVVYKVCWFDGCSDADILAAFDDAIADGVDIITVSLGGFSDENYFRDVIAIGAFHAMRNGVLTVTSAGNNGPRPSSLSNFLPWSITVAASTIDRKFVTKVELGNRITYEIDYHILSLGVPPKTKLKHLLVIFSIYLSIQCGGIKVFATGRNTHNLVTLSSSHKTNFSKDSPCGDILQFSVSIYPSRDFAENQRKNKALNVES

SEQ ID NO: 137328 - protein, 74 aa, Glycine max
  Coding DNA Sequence Number=SeqID_20550
MVETSQINTKRGVKDKAPNTLPMKGLFVTKLESNEALKVVGPFLLDSNSSRDGTNPPSNSLYGNPQPRKQRDKQ

SEQ ID NO: 137329 - protein, 50 aa, Glycine max
  Coding DNA Sequence Number=SeqID_20551
MQCPEASRTSTTASTASFCFSTTAAPAACDGGGRARGTHLALPRREGMMG

SEQ ID NO: 137330 - protein, 68 aa, Glycine max
  Coding DNA Sequence Number=SeqID_20552
MDNYNVGEHLIWSHIRWYYIIATCMMFISAGLEAIRCVSKVSGKATVIAAIGVRQNFFGTDNVRWRCM

SEQ ID NO: 137331 - protein, 157 aa, Glycine max
  Coding DNA Sequence Number=SeqID_20553
MVEALSPRMPLMSIHCHIDRRVSSNSELGGMLGPEVSRIGQESIFGSFVHLSYLEHNSKEYIDNNVEEHVKSISAGDMVILEEEDGVLYAFNKESYSDRQAMFNIQTCTLKGFTLSKFTCMYEMLFWNLDLAIPFDEFKCDVLNALNVAPIQLHLNS

SEQ ID NO: 137332 - protein, 59 aa, Glycine max
  Coding DNA Sequence Number=SeqID_20554
MGVAVINGNSESLQSLLGWHPKHYRPQPLTKKFIPKDEEKTEDHGGHEPNPWEGNQENL

SEQ ID NO: 137333 - protein, 152 aa, Glycine max
  Coding DNA Sequence Number=SeqID_20555
  Gene Ontology: Mol. function=monooxygenase activity; Biological process=electron transport
  Homolog annotation: Hit_ID=Q1T1B4; Match level="QueryCoverage=83%, HitCoverage=31%, E-value=2e-13, Identity=32%"; Hit description =Cytochrome P450
MTLWSIWTRRNDKLWSNITVNDSSVIHRADEFYQVWFDAKEMHGSSARDTTVSNTGRWSPPRLGFTKSNVDASFKHNWRRDVTDFMEPCLSVPEGEAWALAAATRFIAERGYQNVMFEVGSKSIVDKINRVQWIILSWITRSNNEGVCFLII

SEQ ID NO: 137334 - protein, 54 aa, Glycine max
  Coding DNA Sequence Number=SeqID_20556
MAPHLTSPRSPNPRDISPGGDQVMVQINSPTYTNQTLTYHPQLPTFKLRSRTPT

SEQ ID NO: 137335 - protein, 265 aa, Glycine max
  Coding DNA Sequence Number=SeqID_20557
  Gene Ontology: Mol. function=hydrolase activity, acting on carbon -nitrogen (but not peptide) bonds, in linear amidines; Cellular component=nucleus; Biological process=metabolic process
  Homolog annotation: Hit_ID=O49434; Match level="QueryCoverage=88%, HitCoverage=45%, E-value=1e-91, Identity=70%"; Hit description=HyuC -like protein
  Pfam annotation: Domain name=Peptidase_M20; Domain location=103-250; Score=-7.4; E_value=0.0047; Accession=PF01546.18; Description =Peptidase family M20M25M40
MGRVVLAKGKEDDVSIETGDLEKRDDLFPQILRDEAVARLYELGKVSDASGYLERTFLSPASMKAIDLIRKWMEDAGLRTWVDQMGNVHGRVDGANENAEALLIGSHMDTVVDAGMFDGSLGIVSAISAVKAMHVNGKLQKLKRPVEVIAFSDEEGVRFQTTFLGSGAIAGILPGTTLEISDKREVMIKDFLKENSMDITEESLLKLKYDPKSVWGYVEVHIEQGPVLEQVGFPLGVVKGIAGQTRLKLLGSVMVVPYDGTTRYN

SEQ ID NO: 137336 - protein, 234 aa, Glycine max
  Coding DNA Sequence Number=SeqID_20558
  Gene Ontology: Mol. function=glutathione dehydrogenase (ascorbate) activity; Cellular component=membrane; Biological process=tRNA aminoacylation for protein translation
  Homolog annotation: Hit_ID=Q0ZNW5; Match level="QueryCoverage=99%, HitCoverage=99%, E-value=2e-91, Identity=72%"; Hit description =Dehydroascorbate reductase
  Pfam annotation: Domain name=GST_N; Domain location=12-82; Score =26.3; E_value=0.00011; Accession=PF02798.10; Description=Glutathione S-transferase, N-terminal domain
MALEVAVKAAVGAPNVLGDCPFSQRVLLTLEEKKIPYKLHLIDLSNKPEWFLGVNPEGKVPVVLFDGKWVADSDVIVGILEEKYPEPSLITPPEFASVGSKIFGSFVSFLKSKDTNDGTEQALVAELSALDEHLKTHVCNYPFVIFKSSMLICWRHGQGPYIAGEKVTAVDLSLAPKLYHLVVALGHFKNWNIPESLVHVHNYTKLLFSRESFEKTKPPKEEYVIAGWAPKVNA

SEQ ID NO: 137337 - protein, 606 aa, Glycine max
  Coding DNA Sequence Number=SeqID_20559
  Gene Ontology: Mol. function=protein serine/threonine kinase activity; Cellular component=integral to membrane; Biological process=protein amino acid phosphorylation
  Homolog annotation: Hit_ID=Q9LFS4; Match level="QueryCoverage=97%, HitCoverage=93%, E-value=0.0, Identity=70%"; Hit description =Receptor protein kinase-like protein
  Pfam annotation: Domain name=LRRNT_2; Domain location=10-50; Score =50.2; E_value=6.7e-12; Accession=PF08263.3; Description=Leucine rich repeat N-terminal domain
  Pfam annotation: Domain name=LRR_1; Domain location=102-124; Score =22.0; E_value=0.0021; Accession=PF00560.23; Description=Leucine Rich Repeat
  Pfam annotation: Domain name=LRR_1; Domain location=126-148; Score =7.8; E_value=10; Accession=PF00560.23; Description=Leucine Rich Repeat
  Pfam annotation: Domain name=LRR_1; Domain location=150-172; Score =11.4; E_value=2.1; Accession=PF00560.23; Description=Leucine Rich Repeat
  Pfam annotation: Domain name=LRR_1; Domain location=78-100; Score =17.2; E_value=0.059; Accession=PF00560.23; Description=Leucine Rich Repeat
  Pfam annotation: Domain name=Pkinase; Domain location=283-556; Score =102.0; E_value=1.7e-27; Accession=PF00069.15; Description=Protein kinase domain
  Pfam annotation: Domain name=Pkinase_Tyr; Domain location=283-556; Score=118.1; E_value=2.5e-32; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=10-50::102-124::126 -148::150-172::78-100::283-556::283-556
ENFELSLYVSLDVVQALMGIKASLVDPHGILDNWDGDAVDPCSWNMVTCSPENLVISLGIPSQNLSGTLSPSIGNLTNLQTVVLQNNNITGPIPSELGKLSKLQTLDLSDNFLSGEIPPSLGHLRRLQYLRLNNNSFDGECPESLANMAQLAFFDLSYNNLSGPIPKILAKSFSIVGNPLVCATEKEKNCHGMTLMPMPMNLNNTEDASPSGRKKAHKMAIAFGLSLGCLSLIVLGVGLVLWRRHKHKQQAFFDVKDRHHEEVYLGNLKRFHLRELQIATKNFSNKNILGKGGFGNVYKGILSDGTLLAVKRLKDGNAIGGDIQFQTEVEMISLAVHRNLLKLYGFCMTPTERLLVYPYMSNGSVASRLKGKLNGKPVLDWGTRKQIALGAARGLLYLHEQCDPKIIHRDVKAANILLDDYCEAVVGDFGLAKLLDHQDSHVTTAVRGTVGHIAPEYLSTGQSSEKTDVFGFGILLLELITGQRALEFGKAANQKGAMLDWVRKLHQEKKLELLVDKDLKTNYDRIELEEIVQVALLCTQYLPGHRPKMSEVVRMLEGDGLAEKWEASQSADTSNCKPQELSSSDRYSDLTDDSSLLVQAMELSGP

SEQ ID NO: 137338 - protein, 1214 aa, Glycine max
  Coding DNA Sequence Number=SeqID_20560
  Gene Ontology: Mol. function=nucleic acid binding; Cellular component= nucleus; Biological process=protein complex assembly
  Homolog annotation: Hit_ID=Q9LD60; Match level="QueryCoverage=99%, HitCoverage=100%, E-value=0.0, Identity=86%"; Hit description =Spliceosomal-like protein
  Pfam annotation: Domain name=CPSF_A; Domain location=857-1157; Score =294.1; E_value=2.7e-85; Accession=PF03178.5; Description=CPSF A subunit region
MYLYSLTLQRPTGIICAINGNFSGGKSQEIVVARGKVLDLLRPDDNGRIQTILSVEIFGAIRSLAQFRLMGAQKDYIVVGSDSGRIVILEYNKEKNVFDKIHQETFGKSGCRRIVPGQYLAIDPKGRAVMIGACEKQKLVYVLNRDTAARLTISSPLEAHKSHTLVYSICGVDCGFENPIFAAIELDYSEADQDSTGLAASEAQKHLTFYELDLGLNHVSRKWSEQVDNGANLLVTVPGGGDGPSGVLVCAENFVIYKNQAHPEVRAVIPRRTDLPAERGVLIVSAAMHKLKNMFFFLLQTEYGDIFKVTLEHNNDRVSELKIKYFDTIPVTASMCVLKSGFLFAASEFGNHALYQFKSIGDEDDVEASSATLMETEQGFQPVFFQPRRLKNLVRIDQVESLMPIMDMKVSNLFEEETPQIYTLCGRGPRSSLRILRTGLAVSEMAVSKLPGIPSAVWTVKKNAIDEFDAYIVVSFTNATLVLSIGETVEEVSDSGFLDTTPSLAVSLIGDDSLMQVHPNGIRHIREDGRINEWRTPGKRTISKVGSNRLQVVIALSGGELIYFEVDVTGQLMEVEKHEMSGDVACLDIAPVPEGRQRSRFLAVGSYDKTIRILSLDPDDCMQALSVQSVSSAPESLLFLEVQASVGGEDGADHPASLFLNAGLQNGVMFRTVVDMVTGQLSDSRSRFLGLRAPKLFPIIVRGKRAMLCLSSRPWLGYIHQGHFLLTPLSYETLEYAASFSSDQCVEGVVAVAGEALRIFTIERLGETFNETVIPLRYTPRKFVLQPKRKLLVMIESDQGALTAEEREAARKECFESAQAGENGTESADQMENGGEDEDKDDPLSDEHYGYPKAESDKWASCIRVLDPRTGNTTCLLELQENEAAFSICTINFHDKEYGTLLAVGTAKGLQFLPKRTITAGFIHIYRFVEDGRSLELLHKTQVEGVPLALCQFQGRLLAGIGPVLRLYDLGKRRLLRKCENKLFPNTIVSIHAYRDRIYVGDVQESFHYCKYRRDENQLYIFADDCVPRWLTASYHIDFDTMAGADKFGNIYFVRLPQDVSDEIEEDPTGGRIKWEQGKLNGAPNKVEEIVQFHIGDVVTCLQKASLIPGGGECIVFGTVMGSVGALHAFTSRDDVDFFSHLEMHMRQDHPPLCGRDHMAYRSAYFPVKDVIDGDLCEQYPTLPMDLQRKIADELDRTPGEILKKLEEVRNKII

SEQ ID NO: 137339 - protein, 428 aa, Glycine max
  Coding DNA Sequence Number=SeqID_20561
  Gene Ontology: Mol. function=hydrolase activity; Cellular component =plastid chromosome; Biological process=cobalamin biosynthetic process
  Homolog annotation: Hit_ID=Q69IK7; Match level="QueryCoverage=88%, HitCoverage=87%, E-value=1e-142, Identity=67%"; Hit description=PRLI- interacting factor L-like
  Pfam annotation: Domain name=CobW_C; Domain location=333-427; Score =131.0; E_value=3.4e-36; Accession=PF07683.4; Description=Cobalamin synthesis protein cobW C-ter
  Pfam annotation: Domain name=MobB; Domain location=84-211; Score= -30.4; E_value=0.01; Accession=PF03205.4; Description=Molybdopterin guanine dinucleotide synthesis protein B
  Pfam annotation: Domain name=cobW; Domain location=84-263; Score =240.7; E_value=3.1e-69; Accession=PF02492.9; Description=Cobalamin synthesis proteinP47K
  Pfam module annotation: Pfam domain module=CobW_C::MobB::cobW; Domain location=333-427::84-211::84-263
  Subcellular localization annotation: CTP_CleavageSite=59; ConfidenceScore=5.75e-01
MTFTAEVACSFFGLAYRNRKPFTLSLQTTLLPLLRRTTTHSHSQSLTFPLRPSRRFSVPATTTAPPQSEDSDVSTLIPPDNRIPATIITGFLGSGKTTLLNHILTAEHGKRIAVIENEFGEIDIDGSLVAAKAAGAEDIMMLNNGCLCCTVRGDLVRMISELVAKKKGKFDHIVIETTGLANPAPIIQTFYAEENIFNEVKLDGVVTLVDAKHAGFHLDEVKPKGVVNEAVEQIAYADRIIVNKKINSLANLKRTEYGKVNLDYVLGIGGFDLERIENAINDEGAKEDHDHSHDHEHEHHDHDHHHHDHAHSHDHKHEHHDHHSHDHSHDPGVSSVSIVCEGSLDLEKANMWLGTLLLDHSEDIYRMKGLLSVQGMNERFVFQGVHDMFQGSPERLWGPDEPRINKIVFIGKKLDAKELEKGFKACLL

SEQ ID NO: 137340 - protein, 167 aa, Glycine max
  Coding DNA Sequence Number=SeqID_20562
  Gene Ontology: Mol. function=hydrolase activity; Biological process =aromatic compound metabolic process
  Homolog annotation: Hit_ID=O80629; Match level="QueryCoverage=73%, HitCoverage=38%, E-value=5e-49, Identity=69%"; Hit description =Putative phospholipase
MRPNTVVVSVLSALSKVVPSWRIVPIPDIIDVAFKVPEVREEIRANQYCYKGNPRLRTAYELMRVSTEIEQSLHEVSLPFLVLHGEEDQVTDKAVSKQLYDVAASSDKTLKFYPKMWHGLLYGEPPENLQIVFSDIIGWIEQKTHHGNSRLERELKEEHEHLVKSDL

SEQ ID NO: 137341 - protein, 108 aa, Glycine max
  Coding DNA Sequence Number=SeqID_20563
  Gene Ontology: Mol. function=phosphoglycolate phosphatase activity; Biological process=metabolic process
  Homolog annotation: Hit_ID=Q655Y3; Match level="QueryCoverage=88%, HitCoverage=37%, E-value=3e-40, Identity=74%"; Hit description=Dreg -2 like protein
MSLLAKLRCVTIDVTGTLMAYKGELGDYYCMAAKAAGKPCPDYQRMHEGFKLAYKEMAKNYPCFGHAAKMPNIVWWKTCVRDSFVRLHYKLPKSSIELQVHDICNLTC

SEQ ID NO: 137342 - protein, 339 aa, Glycine max
  Coding DNA Sequence Number=SeqID_20564
  Gene Ontology: Mol. function=[ribulose-bisphosphate carboxylase] -lysine N-methyltransferase activity; Cellular component=nucleus
  Homolog annotation: Hit_ID=Q6Z2I7; Match level="QueryCoverage=80%, HitCoverage=61%, E-value=1e-09, Identity=25%"; Hit description=SET domain-containing protein-like
  Pfam annotation: Domain name=SET; Domain location=30-187; Score=13.5; E_value=4.6e-05; Accession=PF00856.18; Description=SET domain
MATSYRVQMSALAYFLLQSFCVEVGSCFKTRKNLRDALPGSYLKIFDWPTQKSGWSKEELLELQDPDLASTIRKQQQRSLEFWENNWHSDVPLKIKRLARDPQRFAWAVGIAQSRCINMQTRIGALNQEANMLIPYADMLNHSFEPNCFFHWRFKDRMLEVLINAGQQIRKGDEMTVNYMSAQKNDMFMQRYGFSSPVNPWDKIKFSGNARIHLDSFLSIFNISGLPEEYYHNNCLSKAGDSFVDGAVIAAARTLPTWSDGDVPPIPSMERKAAKELQDECQKMLAEFATTSKQDQKLLDSMADATRTLEAAIKYRLHRKLFMEKVFQALEMYQEQILF

SEQ ID NO: 137343 - protein, 916 aa, Glycine max
  Coding DNA Sequence Number=SeqID_20565
  Gene Ontology: Mol. function=hydrolase activity; Cellular component =intracellular; Biological process=metabolic process
  Homolog annotation: Hit_ID=Q1T265; Match level="QueryCoverage=84%, HitCoverage=94%, E-value=1e-152, Identity=31%"; Hit description =Tetratricopeptide-like helical
  Pfam annotation: Domain name=PPR; Domain location=144-178; Score =32.0; E_value=2.1e-06; Accession=PF01535.11; Description=PPR repeat
  Pfam annotation: Domain name=PPR; Domain location=245-279; Score =38.7; E_value=2e-08; Accession=PF01535.11; Description=PPR repeat
  Pfam annotation: Domain name=PPR; Domain location=347-381; Score =20.8; E_value=0.0051; Accession=PF01535.11; Description=PPR repeat
  Pfam annotation: Domain name=PPR; Domain location=449-482; Score =27.7; E_value=4.1e-05; Accession=PF01535.11; Description=PPR repeat
  Pfam annotation: Domain name=PPR; Domain location=568-601; Score =29.3; E_value=1.3e-05; Accession=PF01535.11; Description=PPR repeat
  Pfam annotation: Domain name=PPR; Domain location=609-643; Score =16.1; E_value=0.093; Accession=PF01535.11; Description=PPR repeat
  Pfam annotation: Domain name=PPR; Domain location=645-679; Score =17.7; E_value=0.041; Accession=PF01535.11; Description=PPR repeat
  Pfam annotation: Domain name=PPR; Domain location=712-746; Score =18.7; E_value=0.022; Accession=PF01535.11; Description=PPR repeat
  Pfam module annotation: Pfam domain module=PPR::PPR::PPR::PPR::PPR::PP R::PPR::PPR; Domain location=144-178::245-279::347-381::449-482::568 -601::609-643::645-679::712-746
  Subcellular localization annotation: CTP_CleavageSite=63; ConfidenceScore=5.60e-01
MHSFLSLTQPPLPYPSSLQTHPLTLTLPTPPPTTVERRSPSQWIDLLRSQTHSSSFRDAISTYAAMLAAPAPPDNFAFPAVLKAAAAVHDLCLGKQIHAHVFKFGHAPPSSVAVANSLVNMYGKCGDLTAARQVFDDIPDRDHVSWNSMIATLCRFEEWELSLHLFRLMLSENVDPTSFTLVSVAHACSHVRGGVRLGKQVHAYTLRNGDLRTYTNNALVTMYARLGRVNDAKALFGVFDGKDLVSWNTVISSLSQNDRFEEALMYVYLMIVDGVRPDGVTLASVLPACSQLERLRIGREIHCYALRNGDLIENSFVGTALVDMYCNCKQPKKGRLVFDGVVRRTVAVWNALLAGYARNEFDDQALRLFVEMISESEFCPNATTFASVLPACVRCKVFSDKEGIHGYIVKRGFGKDKYVQNALMDMYSRMGRVEISKTIFGRMNKRDIVSWNTMITGCIVCGRYDDALNLLHEMQRRQGEDGSDTFVDYEDDGGVPFKPNSVTLMTVLPGCAALAALGKGKEIHAYAVKQKLAMDVAVGSALVDMYAKCGCLNLASRVFDQMPIRNVITWNVLIMAYGMHGKGEEALELFRIMTAGGGSNREVIRPNEVTYIAIFAACSHSGMVDEGLHLFHTMKASHGVEPRGDHYACLVDLLGRSGRVKEAYELINTMPSNLNKVDAWSSLLGACRIHQSVEFGEIAAKHLFVLEPNVASHYVLMSNIYSSAGLWDQALGVRKKMKEMGVRKEPGCSWIEHGDEVHKFLSGDASHPQSKELHEYLETLSQRMRKEGYVPDISCVLHNVDDEEKETMLCGHSERLAIAFGLLNTPPGTTIRVAKNLRVCNDCHVATKIISKIVDREIILRDSLLVINGGVDMVKDLAKFDGIDDGDDALKVLHNVYGYVMNETFVEWRHNNGTQA

SEQ ID NO: 137344 - protein, 128 aa, Glycine max
  Coding DNA Sequence Number=SeqID_20566
MAKSSENMKGFWCGHPSQSIETDLGNSAGGRFNGKGDVGVSGRSKTGLASMIESSFLVKMIAEAFVSAHLHFFRCQSLKINFGGWVSAQRWRRQSRGGKSQTAVLFAGHRRRIEQTETLELGASWAMR

SEQ ID NO: 137345 - protein, 100 aa, Glycine max
  Coding DNA Sequence Number=SeqID_20567
  Gene Ontology: Mol. function=oxidoreductase activity; Cellular component=membrane; Biological process=electron transport
  Homolog annotation: Hit_ID=Q6WNQ9; Match level="QueryCoverage=99%, HitCoverage=28%, E-value=2e-22, Identity=62%"; Hit description =Isoflavone 3'-hydroxylase
MAELLNNPEVLKKAKEEIGKDRLVNEQDLSKLQYLKDIISETFGLHPPTPLLLPHESSKDFTIGGYHIPQDTIVLTNGLPWIGPGPTYGGPHNGIVDPML

SEQ ID NO: 137346 - protein, 537 aa, Glycine max
  Coding DNA Sequence Number=SeqID_20568
  Gene Ontology: Mol. function=calcium ion binding; Cellular component =integral to membrane; Biological process=protein transport
  Homolog annotation: Hit_ID=Q9FYH7; Match level="QueryCoverage=94%, HitCoverage=74%, E-value=0.0, Identity=68%"; Hit description =Vacuolar sorting receptor 6 precursor
  Pfam annotation: Domain name=PA; Domain location=55-205; Score=53.9; E_value=5.3e-13; Accession=PF02225.12; Description=PA domain
MKPFVAAAVLLLLLVVVVVVVDARFVVEKSSITVLSPHKLKAKRDGAIGNFGLPDYGGFIVGSVVYPAKGSHGCENFEGDKPFKIQSYRPTIVLLDRGGICLSFGSVFVDFDPFIDLNLMLPDPVFMVCSEISLVMFVECYFALKVWHAQLAGAAAVLVTDSIEESLITMDSPEESSDADGYIEKITIPSALIEKSFGDTLKDALNNKDEVLLRIDWRESVPHPDSRVEYEFWTNSNDECGARCDEQMNFVKNFKGHAQILERGGYTLFTPHYITWFCPPPFILSSQCKSQCINRGRYCAPDPEKDFGEGYEGKDVVYENLRQLCVHRVANESNRSWVWWDYVTDFHVRCSMKEKRYSKDCAEEVMKSLDLPMDKIKKCMGDPEADVENEVLKNEQQVQIGRGSRGDVTILPTLVINNVQYRGKLERTAVLKAVCSGFKETTEPSVCLSGDVETNECLERNGGCWQDKHANITACKDTFRGRVCECPVVNGVQYKGDGYTTCEAFGPARCSINNGGCWSETKKGLTFSACSVQYCIT

SEQ ID NO: 137347 - protein, 151 aa, Glycine max
  Coding DNA Sequence Number=SeqID_20569
  Gene Ontology: Mol. function=sequence-specific DNA binding; Cellular component=nucleus; Biological process=regulation of transcription, DNA-dependent
  Homolog annotation: Hit_ID=Q4R0U0; Match level="QueryCoverage=71%, HitCoverage=13%, E-value=9e-12, Identity=34%"; Hit description =Homeobox protein OCL1
MELKGGFGHLIECVRVLLGLQLTTCPLKHLNKTYNRIEGDVMMFQDSYIDPMGSYMVYAPISAKNVSMIMNGGDSMVPIFPSGFLISEDHSRAVAESSNSRPGGSVLTMSYQLLICSNNNASIQDQNRETVVRIVASTLQNIITSLNISKD

SEQ ID NO: 137348 - protein, 286 aa, Glycine max
  Coding DNA Sequence Number=SeqID_20570
  Gene Ontology: Mol. function=nucleic acid binding; Cellular component= membrane; Biological process=DNA integration
  Homolog annotation: Hit_ID=Q1T010; Match level="QueryCoverage=97%, HitCoverage=28%, E-value=3e-58, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVEENTHPEKLKVFVRKWTINMQWLHPILLNIMDLQRGEIRQSSTCAKHIPGAKRKKLHDKIECMILIGYHGTSAYRLFNPIKRKVEINTDMLVCENELWGWEKQKGQLRLVIFEVDSHQEVKTRNEEHNDSDIEGTDDANLMPKNFKEVAREQTWKQAMIEKLQSIEKNHIWEPTELPPKKKPIEVKWIFKLKLNSDGSVARHKARLVAKGFMQKAEVDYKEIFAPMTIIETIRLAMALASKRNWLVYHYVKYAFLNGSLNEDVYVTQPPRFEIKGKKETSLQAE

SEQ ID NO: 137349 - protein, 224 aa, Glycine max
  Coding DNA Sequence Number=SeqID_20571
MGGHSSREGKRSKWVSVNCCVAVMGFQGRNKKQQRRGRGGSNGGVELVGTGGGGGLGGFGEAQQQAEAEPQPEPAASRIVGLPFGGGLVDLSLLQSYRDHCVSHIWIHQERLEVRSPYYDVVSYCNQRLDEYLFGERGSENPTDESFGYFDKDKGFCGDKHRRQGEVKSRWGSNNAGGGGGASWNMNAGGAMRLGFGWGGVAHCNMKGSESHKGRGVGIWWVGK

SEQ ID NO: 137350 - protein, 41 aa, Glycine max
  Coding DNA Sequence Number=SeqID_20572
MAFNLRWYFKAAGKNLHSAVRGCACWLEVVEVGAAAEECKF

SEQ ID NO: 137351 - protein, 584 aa, Glycine max
  Coding DNA Sequence Number=SeqID_20573
  Gene Ontology: Mol. function=transferase activity, transferring phosphorus-containing groups; Cellular component=outer membrane -bounded periplasmic space; Biological process=two-component signal transduction system (phosphorelay)
  Homolog annotation: Hit_ID=Q3K942; Match level="QueryCoverage=99%, HitCoverage=47%, E-value=1e-86, Identity=33%"; Hit description=Multi- sensor Hybrid Histidine Kinase precursor
  Pfam annotation: Domain name=HisKA; Domain location=544-580; Score =4.5; E_value=0.062; Accession=PF00512.15; Description=His Kinase A (phosphoacceptor) domain
  Pfam annotation: Domain name=PAS; Domain location=395-521; Score =22.3; E_value=0.0018; Accession=PF00989.14; Description=PAS domain
  Pfam annotation: Domain name=SBP_bac_3; Domain location=123-340; Score=33.1; E_value=3e-10; Accession=PF00497.10; Description =Bacterial extracellular solute-binding proteins, family 3
  Pfam module annotation: Pfam domain module=HisKA::PAS::SBP_bac_3; Domain location=544-580::395-521::123-340
FPQASIVRYPSSQAALAAVASGEADYALGSLLAAAFLIERSYVNQLALAAILPQDALYGSRLVVKADNQPLLQALNAAIAAIPGEQQRLISRQWTQRPDVWRLQEPLSLTPREQQWLQQHAQVKVAFNPFSAPLALLDEQGEFQGISADLLHLIQLRTGLFFSPVPAYSWRDGVQQLEQHQVAMLAAVAQDGGHQEAVRFTRPYLKVSLVLLVPDQPDAPQALYPGMKLSIVKGNPARQALLDRFPTLQLSEVDNASLALQLLQEGKVAGLIDNQLSVNTLLARYAQQPLKIVSRLALPPVELSFAVSRDQPELLSIIDKALADIQPSEISLIASRWQGTPQTTRTTWQLYRAQFYAISLLTALLLIACLAWVYYRGKEVKHRRRAEADLQAELRFRDALLNGLPTPVYVLDRNWNVVSANGAFQRFFAGVDAQRLSFSLYDQRHPLSPLISKLYPLMSPEAVNDPELVALAHNSLWGDTAQDLEIEIENGSEARMVHHWAQEQRDAQGNITGLICGWQDVTAYELLMLALQAEKKVADEANRAKSSFLATMSHEIRTPISAIIGLLELEGRKQRDNEAIQIAY

SEQ ID NO: 137352 - protein, 206 aa, Glycine max
  Coding DNA Sequence Number=SeqID_20574
  Homolog annotation: Hit_ID=UPI00005F72F9; Match level="QueryCoverage =88%, HitCoverage=95%, E-value=4e-12, Identity=30%"; Hit description =COG2197: Response regulator containing a CheY-like receiver domain and an HTH DNA-binding domain
  Pfam annotation: Domain name=Response_reg; Domain location=16-128; Score=-1.3; E_value=0.0044; Accession=PF00072.14; Description =Response regulator receiver domain
MGMDILFNTGDDNKPKKIIIALSCNFALTGLHELCRSLPGCEVQTILGAPEAISDELMFSYADLVITDLPRDAAGLAELLLIPEWFKGNTLILLDEETTAMRRTLLDADFSDVVMKKENLTTLRQVIHNLLQAKPESVEEQLIGKNALIREKRVICALLRGVKPSLIAREMGLHPREISRSKINCLARSGFSSLNAMLACASRTSQ

SEQ ID NO: 137353 - protein, 81 aa, Glycine max
  Coding DNA Sequence Number=SeqID_20575
  Gene Ontology: Mol. function=two-component response regulator activity; Cellular component=intracellular; Biological process=two -component signal transduction system (phosphorelay)
  Homolog annotation: Hit_ID=Q4ZPK2; Match level="QueryCoverage=99%, HitCoverage=38%, E-value=1e-14, Identity=43%"; Hit description =Regulatory protein, LuxR:Response regulator receiver
  Pfam annotation: Domain name=Response_reg; Domain location=2-81; Score=29.0; E_value=1.6e-05; Accession=PF00072.14; Description =Response regulator receiver domain
MANFIVVDDHPMARMAVTFLLEKEGHTLIAETDDGREALELVDQHYPEIVVMDIDIHSINGIEVVKTLRARSFPGIIIIVS

SEQ ID NO: 137354 - protein, 161 aa, Glycine max
  Coding DNA Sequence Number=SeqID_20576
  Gene Ontology: Mol. function=magnesium ion binding; Cellular component=chloroplast; Biological process=metabolic process
  Homolog annotation: Hit_ID=Q9ZTN8; Match level="QueryCoverage=78%, HitCoverage=17%, E-value=9e-16, Identity=36%"; Hit description =Copalyl diphosphate synthase 1
MYHEEKDSSDSYGGLWWSTVNNSDRATCMDLDDQVSMHAHDSGNDNLWQGWLSSWQNKRNNFGREELHLNPQYHRLLVVTNRVWPGLRNYQSNKAHDSGNDNLSPTSITIPQIESDMQELVQLVLQNSSDGMHSNVTNSFLTVAKGFYYGAYCNPETINSH

SEQ ID NO: 137355 - protein, 166 aa, Glycine max
  Coding DNA Sequence Number=SeqID_20577
  Gene Ontology: Mol. function=transferase activity; Cellular component= mitochondrion; Biological process=DNA integration
  Homolog annotation: Hit_ID=Q1SX87; Match level="QueryCoverage=98%, HitCoverage=13%, E-value=9e-62, Identity=65%"; Hit description =Polynucleotidyl transferase, Ribonuclease H fold
MDDHMHALRRILCYIQGTLHSGLHLYPSLATSLTSYIDANWGGCPDYKKSTFGYCVFLGDNLLLWSSKRQPTLSRSNVEAEYQGVANVVFESCWLCNLLLELHCPIHIATLVYYDNVSAIYLVENLVQHQYTKHIEMNIHFVREKVAHGQGRDSLSVRQPSASTAR

SEQ ID NO: 137356 - protein, 105 aa, Glycine max
  Coding DNA Sequence Number=SeqID_20578
MTKLGLCLSSGPPPLDDKKVRITVRMTKLGLCLSSGPPPLDDKRVRITIRMTKLGLCLSSGPPPLDDKRVRITVRYLRGLPALESWQQKVVWSTKAMLLLLRILP

SEQ ID NO: 137357 - protein, 71 aa, Glycine max
  Coding DNA Sequence Number=SeqID_20579
MAGEQGDRFSSVTIPLLDDEKLHQVNGSDEALVSKTCVLHTPHVGNTSFFMTCFHLINALSALPFGSVLEH

SEQ ID NO: 137358 - protein, 170 aa, Glycine max
  Coding DNA Sequence Number=SeqID_20580
MGREVTGMQVVDKKPNGVIPASNGSSNDKVCFSPKMEAAKVQAKDHKVNECTKTNSFEEKSHEKMDGLSAKTTNCNTDLPEEEIEISEVQKMGDSKKLSSPSARKEHTSHLVTHPSDLVTEKHGSHIQIVDAEADATGLNLSPNTINMLSPISSKNSQRISFSTCGHLNK

SEQ ID NO: 137359 - protein, 79 aa, Glycine max
  Coding DNA Sequence Number=SeqID_20581
MTFRTLTQHWLRYYKKAIIDQDPNGSILLGGTAQGKRLLPDQECSQIRIDELRFRNKSISTIYDSHSLSLVPNFRNSQP

SEQ ID NO: 137360 - protein, 843 aa, Glycine max
  Coding DNA Sequence Number=SeqID_20582
  Gene Ontology: Mol. function=protein serine/threonine kinase activity; Cellular component=membrane; Biological process=protein amino acid phosphorylation
  Homolog annotation: Hit_ID=Q9SCZ4; Match level="QueryCoverage=93%, HitCoverage=89%, E-value=0.0, Identity=52%"; Hit description =Receptor-protein kinase-like protein
  Pfam annotation: Domain name=Pkinase; Domain location=520-792; Score =116.5; E_value=7.9e-32; Accession=PF00069.15; Description=Protein kinase domain
  Pfam annotation: Domain name=Pkinase_Tyr; Domain location=520-792; Score=122.6; E_value=1.2e-33; Accession=PF07714.7; Description =Protein tyrosine kinase
  Pfam module annotation: Pfam domain module=Pkinase::Pkinase_Tyr; Domain location=520-792::520-792
MHSTIACLLLVFCFPVFLNAVPPDKGGGDSLMLGCGLGEGGGKDSDGRQWTPDNKYLSGGNSVTSKASFQDPSLFSEVPYMTSRVFTSEATYKFPVKPDKRYWLRLHFYPAVYNTFDPANSYFSVTSNAVTLLSNFSASITCQALSQAYLDREYSLAPLDSDTLTLTFKPSEKQNGAFAFVNGIQLIEMPELFDSAPLVGYSDQTMDTKSLHFQTMFRLNVGGQFISPKQDSGLSRMWYDDTPYLYGAATGVTNQATKDVKIDYKTMPQNIAPPNVYSTSRSMGNNKDVNMGFNLTWIFQVDPGSMYLTRLHFCDYYYSKVNEIVFKIFINNQTAEAEADVIGWTGGKGVPTYKDYVIYVKDEAGDDQLWLALHPALETKPEFYDSLLNGVEVFKLNDTDLSGPNPQPSEMLIQHEEHAKTFQNKHGSNKTFVIGSAAGGAAGFALVAAILVVVQHQKKKKAPGSYNTSSWLPIYGNSHTAGTKTSGSGKSVGSANISAMAQGLCRYFSLQEMKQATKNFDESNVIGVGGFGKVYKGVIDNGFKVAIKRSNPQSEQGVNEFQTEIEMLSKLRHKHLVSLIGFCEEDNEMCLVYDYMAHGTMREHLYKGNKPLDTLSWKQRLEICIGAARGLHYLHTGAKYTIIHRDVKTTNILLDENWVAKVSDFGLSKTGPNMNQGHVSTVVKGSFGYLDPEYFRRQQLTEKSDVYSFGVVLFEALCSRPALNPSLPKEQVSLAEWALYNKRRGTLEDIIDPNIKGQINPESLKKFADAAEKCVSDLGFERPSMNDLLWNLEFALNVQQNPNGTTHEPCLEESEFEDVNLEKNDMAAHYKNLSLGSEHDLSH

SEQ ID NO: 137361 - protein, 112 aa, Glycine max
  Coding DNA Sequence Number=SeqID_20583
MEEEEEEPQRRGKWRKKKERRRTTVVRKVKEEEEPQPQRNTNHQENEGNHDVREEERRSRRRMKETTTRRKKDNMKEEEALRRNYTDAHYSRIYINGMKGILAFSPRVLGVP

SEQ ID NO: 137362 - protein, 208 aa, Glycine max
  Coding DNA Sequence Number=SeqID_20584
  Gene Ontology: Mol. function=L-isoleucine transporter activity; Cellular component=integral to membrane; Biological process=amino acid transport
  Homolog annotation: Hit_ID=Q2HUS3; Match level="QueryCoverage=91%, HitCoverage=44%, E-value=4e-62, Identity=60%"; Hit description=Amino acid/polyamine transporter II
MPYALASGGWLSISLLFVIAIACCYTGILVKRCMDMDPVIKNFPDIGQRAFGDKGRIIVSIAMNSELYLVVTGFLILEGDNLNKLVPNMQLELAGLTIGGTSIFTMIAALVILPSVLLEDLSMLSYVSASGALASSIFLLSIFWNGTIDGTGFHAKGTIFRLSGIPAAVSLYAFCYSAHPILPTLYNSMRDKIIKDRYRGLQQVTHPA

SEQ ID NO: 137363 - protein, 312 aa, Glycine max
  Coding DNA Sequence Number=SeqID_20585
  Gene Ontology: Mol. function=transferase activity; Cellular component= nucleus; Biological process=flavonoid biosynthetic process
  Homolog annotation: Hit_ID=Q2HVM4; Match level="QueryCoverage=98%, HitCoverage=61%, E-value=8e-37, Identity=34%"; Hit description =Transferase
  Pfam annotation: Domain name=Transferase; Domain location=2-306; Score=-84.6; E_value=7.4e-07; Accession=PF02458.6; Description =Transferase family
MNRWAKLSRGEELDPNEIPFLDRTLLKFPDILLEKPREVNTREISKLDTSTLQHIPTSKLLDQWKKPVVPQTPEDDGIDKPKKRSGAMLKLTSSQVERLKNKAMANNHQSSKQGSRPNYSRFEVVAAHIWRCASKALGDDLTQVRFSVNFRNRMNPPLPHNYFGNAVANVATPEGDIISNPLGFAAHKIREASHAVTDEFVKSQLNVSRLGQVQLDNIRAFFMRQGHRVNIPYALNHNVLFLTSFTNMPVYESDFGWGKPVHFGLASRSPADRAAILPSPDGDGVIVALFFQTALMQLFKNYFYEDMYLSLL

SEQ ID NO: 137364 - protein, 211 aa, Glycine max
  Coding DNA Sequence Number=SeqID_20586
  Gene Ontology: Mol. function=transcription regulator activity; Cellular component=nucleus; Biological process=regulation of transcription
  Homolog annotation: Hit_ID=Q5N8F6; Match level="QueryCoverage=38%, HitCoverage=19%, E-value=2e-13, Identity=48%"; Hit description=BHLH protein-like
MKIEVGLGGVWNEEEKAMVVEVLVPGSFDYLVVNSVSNENLLMAFGIDENLEKKLSDLVERLNPSNFRDGCCREPRKGEEVGEVRIIVDRKVKRKRKRVLKKLHMTFGGSDDDIYAFGLDHVIDTQMFFLASMYFSFPQGLGGLGKCFASGKHLWILDMFKSRFDYYVRSFLAKFVGIQTVVLVPTNLGMVEMVVRGGGGIEEDRGERRES

SEQ ID NO: 137365 - protein, 110 aa, Glycine max
  Coding DNA Sequence Number=SeqID_20587
  Gene Ontology: Mol. function=sequence-specific DNA binding; Cellular component=nucleus; Biological process=regulation of transcription, DNA-dependent
  Homolog annotation: Hit_ID=Q1SAB2; Match level="QueryCoverage=84%, HitCoverage=36%, E-value=2e-29, Identity=67%"; Hit description =Transcription factor, MADS-box; Transcription factor, K-box
  Pfam annotation: Domain name=K-box; Domain location=15-100; Score =76.5; E_value=8.2e-20; Accession=PF01486.8; Description=K-box region
MENVLERYERHAHIGQLVGDGDDSQGNWSLQCFKLTGKVEVLERNLRNFVGQDLDPLNLRELQSLEHQLDTAIKRIRTRQNQVMNESISDLQKKVTGWGRGFTTGYWRVH

SEQ ID NO: 137366 - protein, 84 aa, Glycine max
  Coding DNA Sequence Number=SeqID_20588
MKNNVGCWMARQLQEQNGTLTKKIKEKGKPVVEPPHCGPETLGLTFPPELQPQQRLVPSLTLWVTPNREVHLKMRREIMTISIF

SEQ ID NO: 137367 - protein, 750 aa, Glycine max
  Coding DNA Sequence Number=SeqID_20589
  Gene Ontology: Mol. function=nucleic acid binding; Cellular component= nucleus; Biological process=DNA repair
  Homolog annotation: Hit_ID=Q9SR14; Match level="QueryCoverage=99%, HitCoverage=100%, E-value=0.0, Identity=78%"; Hit description =Mutator-like transposase
  Pfam annotation: Domain name=SWIM; Domain location=619-651; Score =37.0; E_value=6.4e-08; Accession=PF04434.8; Description=SWIM zinc finger
  Pfam annotation: Domain name=zf-CCHC; Domain location=731-748; Score =15.9; E_value=0.0023; Accession=PF00098.13; Description=Zinc knuckle
  Pfam module annotation: Pfam domain module=MuDR::SWIM::zf-CCHC; Domain location=147-308::619-651::731-748
MANHDLILGQSHNLALGHDQQLVLGHDHNLGLSQNHALEMGSAHEHHLDLGQTHDHELGLGHAHDHELGLGQNHEHEGDDGHTYEHEHERELAMDQKPEHDDHDLPLPGQNHELVLSENNDLTVSENQELDENMGLAAVQNSEMGIDSANDMDVQQSQLVVPPIIQARTASPSYELSVGQEFPDVKSCRRALRDTAIALHFEMQTIKSDKTRFTAKCASEGCPWRIHAAKLPGVPTFTIRTIHENHTCGGISHLGHQQASVQWVANSVEQRLKENPNCKPKEILEEIHRVHGITLSYKQAWRGKERIMAAMRGSFEEGYRLLPQYCEQVKRTNPGSIASVYGNPADGCFQRLFISFQASIYGFLNPCRPLLGLDRTYLKSKYLGTLLLATGFDGDGALFPLAFGVVDEENDDNWMWFLSELHNLLEIHTENMPRLTILSDRQKGIVDGVEANFPTAFHGFCMRHLSDSFRKEFNNTMLVNLLWEAANALTVIEFEAKILEIEEISQDAAYWIRRIPPRLWATAYFEGHRFGHLTANIVESLNTWILEASGLPIIQMMECIRRQLMTWFNERRETSMQWTSILVPSAERRVAEALDRARTYQVLRANDAEFEVITHEGTNIVDIRNRCCLCRGWQLYGLPCAHAVAALLSCRQNVHRFTESCFTVATYRKTYSQTIHPIPDKSLWKELSEGDANVSKATEVVINPPKSLRPPGRPRKKRVRAEDRGRVKRVVHCSRCNQTGHFRTTCAAPI

SEQ ID NO: 137368 - protein, 57 aa, Glycine max
  Coding DNA Sequence Number=SeqID_20590
MTQCTRLPLRLEKGTLDIVQVSFSVSQYAGQHRRGVGWGLGGAEFKETYMKILKCKD

SEQ ID NO: 137369 - protein, 71 aa, Glycine max
  Coding DNA Sequence Number=SeqID_20591
  Homolog annotation: Hit_ID=Q1SR15; Match level="QueryCoverage=48%, HitCoverage=15%, E-value=5e-13, Identity=82%"; Hit description=Zinc finger, RING-type; RINGv
  Pfam annotation: Domain name=zf-C3HC4; Domain location=30-64; Score =12.9; E_value=0.0072; Accession=PF00097.15; Description=Zinc finger, C3HC4 type (RING finger)
MAPPCGKHTIRRAGSLEIILTFLQLFLLAEYTKENPKIMTKCSHHFHLGCIYEWMERSDNCPVCGKVCKVC

SEQ ID NO: 137370 - protein, 233 aa, Glycine max
  Coding DNA Sequence Number=SeqID_20592
QAKKERLPTGSPDGKKEEPGGCIIYNPVLAIRQLGYPMRGAPLEEELTPIIARGFNNTNVEALQKVRKAWEMVQKKDKELIGSNNGPIGGYRRWLKAHMQGLDWLPSLRTTKGVEVEAPEEDEEVQAHRVELEKAQTVKEKFKSAALKIRKENAKLRDDELKVFLRSKRSLSQGLCETETNMLAIVSKYQEELNLATAHEHKGVKNFPDCWPTPKQWRTPTPPPRRSMFFSAI

SEQ ID NO: 137371 - protein, 54 aa, Glycine max
  Coding DNA Sequence Number=SeqID_20593
MSGESASAAIHKGFQDMVSKSKKKKIKKQAKLSNSVEVVASKFPKGIRHRPLSK

SEQ ID NO: 137372 - protein, 160 aa, Glycine max
  Coding DNA Sequence Number=SeqID_20594
  Homolog annotation: Hit_ID=Q10RE9; Match level="QueryCoverage=48%, HitCoverage=33%, E-value=3e-12, Identity=43%"; Hit description =Expressed protein
MGSSKLLGTMAMLFVVLLPMAAKGDNITDFLDKVCEEVECGKGSCVVNTSYPLNFVCECDSGWKRTQDDDDKYAASFLPCVIPECSLNYGCQPAPPPVPEKSFPHNFSAFDSTLGSDCSRLGIKVANSSTDSGSQDSSASIFTGKFHWIVMLLMSTGMVM

SEQ ID NO: 137373 - protein, 177 aa, Glycine max
  Coding DNA Sequence Number=SeqID_20595
  Gene Ontology: Mol. function=RNA-directed DNA polymerase activity; Biological process=RNA-dependent DNA replication
MVNQQAKYLAGIYASTSHVVCKQLCSDLPSLQDQHLGAWCFIGNFNTILSYHEKRGGNVSSQNSCKDFHAWVEAYSLTHLHSLVPFFTWSNGRRGQQDIDIRLDGSICNEAFISYWDQISCNVLPRSSSDHHLLLLTLNHTTMRLTSSFKFMSMWLEQPQCSKVISDAWRTPAVGYP

SEQ ID NO: 137374 - protein, 207 aa, Glycine max
  Coding DNA Sequence Number=SeqID_20596
  Gene Ontology: Mol. function=protein binding; Cellular component =integral to membrane; Biological process=protein amino acid phosphorylation
  Homolog annotation: Hit_ID=Q1T2W0; Match level="QueryCoverage=99%, HitCoverage=80%, E-value=3e-66, Identity=36%"; Hit description =Leucine-rich repeat; Leucine-rich repeat, cysteine-containing type
  Pfam annotation: Domain name=LRR_1; Domain location=122-141; Score =13.8; E_value=0.63; Accession=PF00560.23; Description=Leucine Rich Repeat
  Pfam annotation: Domain name=LRR_1; Domain location=147-169; Score =10.8; E_value=2.7; Accession=PF00560.23; Description=Leucine Rich Repeat
  Pfam annotation: Domain name=LRR_1; Domain location=171-193; Score =8.1; E_value=8.6; Accession=PF00560.23; Description=Leucine Rich Repeat
  Pfam annotation: Domain name=LRR_1; Domain location=28-49; Score=8.7; E_value=6.7; Accession=PF00560.23; Description=Leucine Rich Repeat
  Pfam annotation: Domain name=LRR_1; Domain location=4-26; Score=18.2; E_value=0.03; Accession=PF00560.23; Description=Leucine Rich Repeat
  Pfam annotation: Domain name=LRR_1; Domain location=52-71; Score=9.3; E_value=5.1; Accession=PF00560.23; Description=Leucine Rich Repeat
  Pfam annotation: Domain name=LRR_1; Domain location=73-95; Score=6.9; E_value=14; Accession=PF00560.23; Description=Leucine Rich Repeat
  Pfam annotation: Domain name=LRR_1; Domain location=98-121; Score =9.0; E_value=5.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=122-141::147-169::171- 193::28-49::4-26::52-71::73-95::98-121
NQSRLTTLDLSDNHIQGTVPNWIWKLQILERLDISHNLLTHLEGPLQNLSSHLIYLDLHQNKLQGPIPAFSGKTLYLDFSSNNFSSIIPRDFGNYMSCTFFLSLSNNTLSGSIPDSLCNALYLKVLDLFNNNISGTIPSCLMMMSGTLEVLNLKNNNLSSPIPNTVTVSCGLWTLNLHGNQLDGPIPKSLTYCSKLEVLDLGSNQIT

SEQ ID NO: 137375 - protein, 173 aa, Glycine max
  Coding DNA Sequence Number=SeqID_20597
  Gene Ontology: Mol. function=phosphoribosylaminoimidazole carboxylase activity; Cellular component=phosphoribosylaminoimidazole carboxylase complex; Biological process=purine nucleotide biosynthetic process
  Homolog annotation: Hit_ID=O80937; Match level="QueryCoverage=84%, HitCoverage=23%, E-value=6e-65, Identity=79%"; Hit description =Putative phosphoribosylaminoimidazole carboxylase
  Pfam annotation: Domain name=ATP-grasp; Domain location=105-173; Score=-53.9; E_value=0.00066; Accession=PF02222.12; Description=ATP -grasp domain
DNESPVHGLSEVVVGVLGGGQLGRMMCQAASQMAIKVMVLDPQENCPASSLSYHHMVGSFDDSTTVEEFAKRCGVLTIEIEHVNVDTLEKLEKQGVDCQPKASTDKYQQKVHFSQHGIPLPEFMKIDDLEGAKKVGELFGYPLMIKSRRLAYDGRGNFVVKSEEELPSAVDGN

SEQ ID NO: 137376 - protein, 102 aa, Glycine max
  Coding DNA Sequence Number=SeqID_20598
MVFFILSIHRILKKITFLILPGIRTEESVSQSPQPQREPSLEDGNEAWKMRNSRRLMIGSTAPTCTYNECRGCKYKCRAEQVPVEGNDPINSPYHYRCVCHR

SEQ ID NO: 137377 - protein, 121 aa, Glycine max
  Coding DNA Sequence Number=SeqID_20599
  Homolog annotation: Hit_ID=Q1SMF0; Match level="QueryCoverage=77%, HitCoverage=17%, E-value=3e-11, Identity=38%"; Hit description =Tetratricopeptide-like helical
MDEDQWVYDSIMSEKIDMDNQNEQECGVNAQHIDCSDAQYFSDDVLQWAQSVAHENGFVAVIMRSDTNTGSRGRSSFVLIGCERSGQYKSRKKDFVRRDTESRKCECPFKLRGKPVVEGQS

SEQ ID NO: 137378 - protein, 94 aa, Glycine max
  Coding DNA Sequence Number=SeqID_20600
MGLNGVLLGNRAALAVRVASEADLAVRCVPTDLVVGSVVRWFPTDLCGGLESSRGVTLSAPKRSPVTAALVGEWSWKTPGGRVRRRRKEDRDLM

SEQ ID NO: 137379 - protein, 86 aa, Glycine max
  Coding DNA Sequence Number=SeqID_20601
MGRYTKMLMFTTILLLGLQQIWAFRPLKEDQWLKQRLVIQSLQRGHVQHSERNPCSTVPGRSKGRCTSEINVADHVAHAPPLEVAN

SEQ ID NO: 137380 - protein, 99 aa, Glycine max
  Coding DNA Sequence Number=SeqID_20602
MRINYIRKKLKTRNASDREDEAYFDGGATPLMHVHNADGGEEGSKPNEGKGRRIAAAQTEGREEQMRQRKWKLQCWCTHHPNMYGTRPKRLDLGQRKNY

SEQ ID NO: 137381 - protein, 563 aa, Glycine max
  Coding DNA Sequence Number=SeqID_20603
  Gene Ontology: Mol. function=ubiquitin-protein ligase activity; Cellular component=ubiquitin ligase complex; Biological process =protein ubiquitination
  Homolog annotation: Hit_ID=Q1SAW5; Match level="QueryCoverage=64%, HitCoverage=78%, E-value=1e-115, Identity=59%"; Hit description=U box
  Pfam annotation: Domain name=Arm; Domain location=308-348; Score=2.7; E_value=5.6; Accession=PF00514.13; Description=Armadillobeta-catenin -like repeat
  Pfam annotation: Domain name=Arm; Domain location=349-390; Score =17.6; E_value=0.045; Accession=PF00514.13; Description=Armadillobeta- catenin-like repeat
  Pfam annotation: Domain name=Arm; Domain location=391-431; Score =26.7; E_value=8.4e-05; Accession=PF00514.13; Description =Armadillobeta-catenin-like repeat
  Pfam annotation: Domain name=Arm; Domain location=471-512; Score =15.9; E_value=0.13; Accession=PF00514.13; Description=Armadillobeta -catenin-like repeat
  Pfam annotation: Domain name=U-box; Domain location=200-252; Score =16.5; E_value=8.1e-06; Accession=PF04564.6; Description=U-box domain
  Pfam module annotation: Pfam domain module=Arm::Arm::Arm::Arm::U-box; Domain location=308-348::349-390::391-431::471-512::200-252
MAKPGVLESDPGVMVKKAKELKRELQRLVKSIVHDEDCSTETIDQAKETLCVLKELKLRNRSSLSLKLHNKSVASSCPDEFKCPLSKELMRDPVIVASGQVLFLTCLIVLLLHFAVQCEWDLLDFILELFYICCQWKFNAKYFLFDLRNFCDLPSIYVVSFTAFMFQMYVSRNKKEEKEKGKGQFDDMPMIAIVDGKRKSGETYDRPFIQKWLNAGNRTCPRTHQVLSHTVLTPNHLIREMIEQWSKNQGIELSNTVQYIDEEGLNEADREHFLCLLKKMSSTLSDQKTAAKELRLLTKKYPCFRVLFCDSADAIPQLLKPICGSDSFGSVHPDLQEDVITTLLNISIHDNNKKLVAETPMVIPLLMRALRSGTIETRSNAAAALFTLSALDSNKELIGKSGVLKPLIDLLEEGHPLAMKDVASAIFNICVMHENKARAEKDGAVRVILAKINKQIHVAELLAILALLSSHQRAVHDMGDLGAVPSLLRIIRESSCERNKENCVAILQTICLYDRSKLKEIREEENSHKTISELAKHGTSRAKRKASGILERLNRAVNITHTA

SEQ ID NO: 137382 - protein, 225 aa, Glycine max
  Coding DNA Sequence Number=SeqID_20604
  Gene Ontology: Mol. function=nucleotide binding; Cellular component =membrane; Biological process=small GTPase mediated signal transduction
  Homolog annotation: Hit_ID=Q08145; Match level="QueryCoverage=55%, HitCoverage=58%, E-value=3e-53, Identity=84%"; Hit description=GTP -binding protein
  Pfam annotation: Domain name=Arf; Domain location=8-170; Score=-99.0; E_value=0.041; Accession=PF00025.11; Description=ADP-ribosylation factor family
  Pfam annotation: Domain name=MMR_HSR1; Domain location=13-121; Score=- 9.7; E_value=0.0077; Accession=PF01926.13; Description=GTPase of unknown function
  Pfam annotation: Domain name=Miro; Domain location=14-127; Score =49.1; E_value=1.5e-11; Accession=PF08477.3; Description=Miro-like protein
  Pfam annotation: Domain name=Ras; Domain location=14-165; Score =142.6; E_value=1.1e-39; Accession=PF00071.12; Description=Ras family
  Pfam module annotation: Pfam domain module=Arf::MMR_HSR1::Miro::Ras; Domain location=8-170::13-121::14-127::14-165
MAENGEGGEEYLFKIVLIGDSAVGKSNLLSRFARNEFDSNSKATIGVEFQTQLVEIDGKEIKAQIWDTAGQERFRAVTSAYYRGAVGALVVYDISRRGTFDSIKRWLQELTNSLQSLVLVQFIPQKDVCEMYLESWYLVELVRNGLMFHKNMVLISLANVRRLLRIRDTVIVGYLFIPVIAVKTLILYQGTISDKSSMTPLCVSTKLHGSLELSTLASQFSSLLR

SEQ ID NO: 137383 - protein, 190 aa, Glycine max
  Coding DNA Sequence Number=SeqID_20605
  Gene Ontology: Mol. function=ubiquinone biosynthetic process monooxygenase activity; Biological process=aromatic compound metabolic process
  Homolog annotation: Hit_ID=Q00M75; Match level="QueryCoverage=16%, HitCoverage=5%, E-value=4e-08, Identity=93%"; Hit description=PPR -repeat containing protein
MNRVIKKTVSNICALKVPRKSFCSTEGVKVAGCSIPEVSNDHEKKQAISKVIPQYDIAIVGGGMVGMALSCFLASNPMTKQLSVAIIDSNPALGSSLHIKKEDPPDPRVSTVTPASISFLQGIKSLRNSKKLRTPLPGGSSLCEGMGEGYCTQPYPCICKEAVSGFEPMTNKSPRHNFTAAPRLVLINQE

SEQ ID NO: 137384 - protein, 136 aa, Glycine max
  Coding DNA Sequence Number=SeqID_20606
  Gene Ontology: Mol. function=hydrolase activity
  Homolog annotation: Hit_ID=Q672P8; Match level="QueryCoverage=83%, HitCoverage=75%, E-value=1e-33, Identity=63%"; Hit description =Histidine triad family protein precursor
  Pfam annotation: Domain name=HIT; Domain location=2-85; Score=31.1; E_ value=9.1e-07; Accession=PF01230.13; Description=HIT domain
  Subcellular localization annotation: CTP_CleavageSite=35; ConfidenceScore=5.29e-01
MAGTQTINKNYLAWHSLIIPKSHFPSLDATPPSVVAAMCSKVPFISNAIMKATGCSSFNLLVNNGAAAGQVIYHTHMHIIPRKAYDCLWASESLLRRRLNLEDEKVSQLAARIQKQLLPSDICQDSKNESFCSSKS

SEQ ID NO: 137385 - protein, 215 aa, Glycine max
  Coding DNA Sequence Number=SeqID_20607
  Gene Ontology: Mol. function=transcription regulator activity; Cellular component=nucleus; Biological process=regulation of transcription
  Homolog annotation: Hit_ID=Q84WG8; Match level="QueryCoverage=37%, HitCoverage=17%, E-value=5e-08, Identity=36%"; Hit description =Putative selenium-binding protein
MHMLRNNVMPTSYSFSSLIKACTWLMDSAFGKGVHGHNWKHGFDSQVFVQTTTLVEFYSTLGDVGGSRGCLMVCLKEMFCLEDDDFGSCLGWGYGFCSLCSSMDALCMVDLLSKAGLLEDALEMEIAQCSSESDDSGLYSLLVNINMYSVNRWSEVAKIRTTMRDLGVEKTCEGSSWVEINKRINLFAATYIYHSSYSQVHLFLAEQDDQLRLAG

SEQ ID NO: 137386 - protein, 445 aa, Glycine max
  Coding DNA Sequence Number=SeqID_20608
  Gene Ontology: Mol. function=protein serine/threonine kinase activity; Cellular component=membrane; Biological process=protein amino acid phosphorylation
  Homolog annotation: Hit_ID=Q9LSF1; Match level="QueryCoverage=94%, HitCoverage=96%, E-value=1e-96, Identity=47%"; Hit description =Serine/threonine-protein kinase OXI1
  Pfam annotation: Domain name=Pkinase; Domain location=27-348; Score =214.3; E_value=2.7e-61; Accession=PF00069.15; Description=Protein kinase domain
  Pfam annotation: Domain name=Pkinase_Tyr; Domain location=27-348; Score=-23.4; E_value=4.9e-11; Accession=PF07714.7; Description =Protein tyrosine kinase
  Pfam module annotation: Pfam domain module=Pkinase::Pkinase_Tyr; Domain location=27-348::27-348
MYGGDSDNSDGGSDDLRRGDTLDFRNLKVVSAVGRGAKGVVFLARQYGAAAGGGEWVALKVVSKALLRKKNKNGYGGCKRVSFERHILRHLDHPLFPRFRGAFETEQLTGFAIDYCHGGNLHSLRKKQPEKTFSEKSIRFYAVELVLALEYLHNFGVVYRDLKPENIMIQETGHIMLVDFDLSKKLKLKSNSSSCNSSPNSDSSSEKEKRKRQISRFNCFCHTGMSLYDLDIPSQLDTIPTRQSLSDLLEKSNSFVGTEDYVAPEVILGQGHDFGVDWWSLGIVLYEMLYGATPFKGANRKETFQRIITKEPYLMGETTPLKDLIIKLLEKDPNGRIEVDEIKSHDFFKGVKWDTVLEIARPPYIPQNDHEIEDLIGFSKKDVESFVHGIFFPKNKREKDKTNEGDKKGNTIESRKDEDNNHNNKNVWVDKLNQDSIKDDNFLVF

SEQ ID NO: 137387 - protein, 356 aa, Glycine max
  Coding DNA Sequence Number=SeqID_20609
  Gene Ontology: Mol. function=sugar porter activity; Cellular component=intracellular; Biological process=metabolic process
  Homolog annotation: Hit_ID=Q1SZI6; Match level="QueryCoverage=99%, HitCoverage=46%, E-value=7e-43, Identity=28%"; Hit description =Tetratricopeptide-like helical
  Pfam annotation: Domain name=PPR; Domain location=126-160; Score =30.1; E_value=7.9e-06; Accession=PF01535.11; Description=PPR repeat
  Pfam annotation: Domain name=PPR; Domain location=161-195; Score =15.0; E_value=0.12; Accession=PF01535.11; Description=PPR repeat
  Pfam annotation: Domain name=PPR; Domain location=26-60; Score=17.9; E_value=0.036; Accession=PF01535.11; Description=PPR repeat
  Pfam annotation: Domain name=PPR; Domain location=298-332; Score=5.5; E_value=1.7; Accession=PF01535.11; Description=PPR repeat
  Pfam module annotation: Pfam domain module=PPR::PPR::PPR::PPR; Domain location=126-160::161-195::26-60::298-332
MDLFSKNCNFKEALRFFYDASSNNVACWNAIISLAVKSGERWVALNLFRGMCHASLMPDSYTFPSNLTACCVLKELHIGRGVHGWAIKCGATDVFVETAIVDLYAKFGCMSEAFRQSSQMQVHNVVSWTAIISGFVQEDDIIFALKLFKNMRAIGQEINSYTMTSVLSACAKPGMIKEAGEIHSLVLKLGLNLDAKVGDALVNMYAKIGEVGLSELAFSEMKNIKDQSLWAAKLSSFTQNQNSERAVELFLSKCGCLEESCKVFQQLPAKDNVSWTSMISGKEIHGYAFQLGIGTDTVVGGALVNMYTKCGNLNLASAVFDMLPQKDVFACSSLVLGYAQKDLIEESFLLFHDMLD

SEQ ID NO: 137388 - protein, 113 aa, Glycine max
  Coding DNA Sequence Number=SeqID_20610
MAHPARNHGLHGPYSWHAALVKLVLYSSSPRGAICCTRYYANILYPLSYSRTPLAPKGFVPLRSAIVLECCTRIYTWWSYRCCTRRLQDEDTWRIRVILRQEFWETETYGFHQ

SEQ ID NO: 137389 - protein, 209 aa, Glycine max
  Coding DNA Sequence Number=SeqID_20611
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=140-157; Score =15.0; E_value=0.0033; Accession=PF00098.13; Description=Zinc knuckle
MRNIPSYYERQVMDKLQMLRQGSLSVEEYRQQMELLLLGVGLREEEKTSIARFLSGLNMKVRDKVELLPYRDLDELVQLCIRVEQQLKRKSSSKSYGFHSRKDKAQGILGAAPLKPKEDKGKTIEKSTPKTSSQERTSNIKCFKCLGTCHIVSQCPTKKTMIMRGQGIYSSQEETTSSPSSNGSEDEVRGEESSEEVYPHEASNTFIGS

SEQ ID NO: 137390 - protein, 86 aa, Glycine max
  Coding DNA Sequence Number=SeqID_20612
MAPRKLSAKRSRKDAAAEGTSAAPEHDEYTDFLEEIARRRWTSLVTPMAKFDPDVVLEFYANAWPKEEGVRDIRSWMPSASFWETR

SEQ ID NO: 137391 - protein, 56 aa, Glycine max
  Coding DNA Sequence Number=SeqID_20613
MCQYRCLKLLCDHPNDHHDAAELVINEIMVIVSQMPFRRGHGGGRNEDEGKFLVPS

SEQ ID NO: 137392 - protein, 849 aa, Glycine max
  Coding DNA Sequence Number=SeqID_20614
  Gene Ontology: Mol. function=motor activity; Cellular component =myosin complex; Biological process=protein amino acid phosphorylation
  Homolog annotation: Hit_ID=UPI000034F472; Match level="QueryCoverage =100%, HitCoverage=55%, E-value=0.0, Identity=78%"; Hit description =XIC; motor/ protein binding
  Pfam annotation: Domain name=IQ; Domain location=673-693; Score=23.8; E_value=0.00062; Accession=PF00612.17; Description=IQ calmodulin -binding motif
  Pfam annotation: Domain name=IQ; Domain location=696-716; Score=19.0; E_value=0.018; Accession=PF00612.17; Description=IQ calmodulin -binding motif
  Pfam annotation: Domain name=IQ; Domain location=721-741; Score=25.8; E_value=0.00016; Accession=PF00612.17; Description=IQ calmodulin -binding motif
  Pfam annotation: Domain name=IQ; Domain location=744-764; Score=15.8; E_value=0.16; Accession=PF00612.17; Description=IQ calmodulin-binding motif
  Pfam annotation: Domain name=IQ; Domain location=769-789; Score=22.3; E_value=0.0017; Accession=PF00612.17; Description=IQ calmodulin -binding motif
  Pfam annotation: Domain name=IQ; Domain location=792-812; Score=23.1; E_value=0.001; Accession=PF00612.17; Description=IQ calmodulin -binding motif
  Pfam annotation: Domain name=Myosin_head; Domain location=8-657; Score=879.3; E_value=1.8e-261; Accession=PF00063.11; Description =Myosin head (motor domain)
  Pfam module annotation: Pfam domain module=IQ::IQ::IQ::IQ::IQ::IQ::Myo sin_head; Domain location=673-693::696-716::721-741::744-764::769 -789::792-812::8-657
MEAPPGGVDDMTKLSYLHEPGVLQNLKARYELNEIYTYTGNILIAINPFQRLPHIYGAHMMQQYKGAPFGELSPHVFAVADVAYRAMINEKKSNSILVSGESGAGKTETTKMLMQYLAFLGGRAGTEGRTVEQQVLESNPVLEAFGNAKTVRNNNSSRFGKFVEIQFDKSGRISGAAIRTYLLERSREIEKYKLGNPRSFHYLNQSKCYELADVSDAHEYLATRRAMDIVGISQKDQEAIFRVVASILHIGNIEFTKGKEVDSSVPKDDKSKFHLKTTAELLMCDADALEDALCKRVMITPEEVIKRSLDPQSAAISRDGLAKTIYSRLFDWLVDKINNSIGQDPNSKSLIGVLDIYGFESFKSNSLSCSAVLSNFALISQMRSCSNISTRQSLRTNYALQHVFKMEQEEYTKEQINWSYIEFVDNQDVLDLIEKKPGGIIALLDEACMFPKSTHETFANKLYQTFKNNKRFIKPKLSRTDFTIAHYAGEVLYQSDQFLDKNKDYVVPEHQDLLSASKCSFVSGLFPPLPEETSKSSKFSSIGSRFKLQLQSLMDTLNSTEPHYIRCVKPNNQLKPAIFENVNIMQQLRCGGVLEAIRISCAGYPTRRAFFEFINRFGILATEAMEANCDEKTGCQKILEKMGLQGYQIGKTKVFLRAGQMAELDARRAQVLSNAAKVIQRRIRTHQARKHYLALRKKSIYVQSRWRGRLACKLYEHLRREAAARKIQKNVRRYEARKAYKELHVSALTLQTAIRAIAARNKFRFRKQTKASIIIQAWWRCHKAAIYYKRLSRGAIVTQCRWRGRIARKELRKLKMAARETGALQEAKDKLEKRVEELTWRLQLEKGLR

SEQ ID NO: 137393 - protein, 87 aa, Glycine max
  Coding DNA Sequence Number=SeqID_20615
  Homolog annotation: Hit_ID=Q1SU59; Match level="QueryCoverage=55%, HitCoverage=9%, E-value=5e-12, Identity=63%"; Hit description=Myosin head, motor region; AAA ATPase; Myosin, N-terminal, SH3- like
  Pfam annotation: Domain name=Myosin_N; Domain location=17-59; Score =11.6; E_value=0.089; Accession=PF02736.9; Description=Myosin N -terminal SH3-like domain
MIPYLNLQGTPVNIIVGSHVWIEDPEVSWIDGQVLKINGTDAEIEDTNGKKEIMALTCQGFCENANELNKCRNMRQDDNSMVIHLLG

SEQ ID NO: 137394 - protein, 620 aa, Glycine max
  Coding DNA Sequence Number=SeqID_20616
  Gene Ontology: Mol. function=motor activity; Cellular component =myosin complex; Biological process=protein amino acid phosphorylation
  Homolog annotation: Hit_ID=UPI000034F472; Match level="QueryCoverage =99%, HitCoverage=38%, E-value=0.0, Identity=77%"; Hit description =XIC; motor/ protein binding
  Pfam annotation: Domain name=DIL; Domain location=438-545; Score =204.4; E_value=2.6e-58; Accession=PF01843.9; Description=DIL domain
ALLIKERENVKKVVEEAPPVIKETQVIVEDTQKIETLTAEVESLKQQFGNKKPMPLSGHSIGKNISYLNCCRYTSLKSEKQKADDFERKYNEAQVCSEERGKKLEDTEKKTRQLQESLTRLEEKITNLESENQVLRQQAVSMAPNKFLSGRSRSVVQRTESGHIVPEAKTTLPSQEMHSTSMHRREPSDGLDDKPQKSLNEKQQENQELLIRCIAQHLGYAGNRPIAACIIYKCLLHWRSFEVERTSVFDRIIQTIGHAIETQDNNDILAYWLSNASTLLLLLQRTLKASGAAGMAPQRRRSSSATLFGRMTQSFRGAPAGVNLSLINGNTSRGVDTLRQVEAKYPALLFKQQLTAYVEKIYGMIRDNLKKEISPLLGLCIQAPRTSRASLVKGSSRSVANTEAQRALIAHWQGIVKSLGNFLNTLKANHVPPFLVRKVFTQIFSFINVQLFNSLLLRRECCSFSNGEYVKAGLAELEHWCYKATDEYAGSAWDELKHIRQAIGFLVIHQKPKKTLDEISHDLCPVLSIQQLYRISTMYWDDKYGTHSVSSDVISNMRVLMTEDSNNAVSNSFLLDDDSSIPFSVDDISKSMEQIDIADIEPPPLIRENSGFSFLLPRPD

SEQ ID NO: 137395 - protein, 126 aa, Glycine max
  Coding DNA Sequence Number=SeqID_20617
MAFAHGLVKNNLWNNLAKTINFGLHHDVGRAPRGDGSEEAFHEERFKTIKGWSFHRERQVKLREDEYPDFQEEVTRRRWAPLVTPKAKFDPEIVMEFYAKAWPTKEGTPSSQILGPAIDLGGRPAV

SEQ ID NO: 137396 - protein, 39 aa, Glycine max
  Coding DNA Sequence Number=SeqID_20618
MVNTVPNVRQRETKILRDGYEQMLGLWSADHYPTSGSRR

SEQ ID NO: 137397 - protein, 497 aa, Glycine max
  Coding DNA Sequence Number=SeqID_20619
  Gene Ontology: Cellular component=cytosol
  Homolog annotation: Hit_ID=Q7V2V3; Match level="QueryCoverage=32%, HitCoverage=66%, E-value=2e-13, Identity=31%"; Hit description =TENA/THI-4 protein
  Pfam annotation: Domain name=TENA_THI-4; Domain location=1-179; Score= -33.9; E_value=0.033; Accession=PF03070.6; Description=TENATHI-4 family
YELAEECADDDDAKLGICELRKAVLEELKMHNSLVQEWGLDLAKEHGINSATVKYTEFLLATASGKIEGLKGPGKLATPFEKTKIAAYTLGAMTPCMRLYAVLGKKFQELLDSNESTHPYNKWIDNYSSDGFQATTLQTEDLLDKLSVSLTGEELDVIEKLYYQAMKLEIDFFSAQPLFQPTIVPLTKGHKPAEDHLIVFSDFDLTCTVVDSSAILAEIAIVTAPKSDQNQPEDQIVRMLSSDLRNTWGFLSKQYTEEYEQCIESIMPSDRLNNFDYKELSMALEQLSKFENTANNRVIESGVLKGISLEDIKRAGERLILQDGCTNFFQSIVKNENLNSNVHVLSYCWCGDLIRSAFSSADLNELNVHANEFTYEGSVSTGEIVKKVESPIDKVEAFRNILKNCNDDKKKLTVYIGDSVGDLLCLLEADVGIVIGSSSSLRSVGTQFGISFVPLYSGLVKKQKEYVEGSTSNWKGLSGILYTVSSWAEVHAFILGC

SEQ ID NO: 137398 - protein, 81 aa, Glycine max
  Coding DNA Sequence Number=SeqID_20620
MRRPIMVIRHCCNLPFDGRATRGSRVRLPKEEGARSRHQRLFEENIGKSKTCGLRTLIVKGLKVVFTHGEGISTPHVRHKG

SEQ ID NO: 137399 - protein, 252 aa, Glycine max
  Coding DNA Sequence Number=SeqID_20621
  Gene Ontology: Mol. function=protein translocase activity; Cellular component=integral to membrane; Biological process=protein transport
  Homolog annotation: Hit_ID=Q9XH46; Match level="QueryCoverage=55%, HitCoverage=72%, E-value=1e-19, Identity=43%"; Hit description=Tha4 protein
  Subcellular localization annotation: CTP_CleavageSite=42; ConfidenceScore=5.83e-01
MDLTLSPSSSSSSLVISRPSYSSSSSTLSFLATNSILSRKARISTRRSKALTCNALFGLGVPELVVIAGVAVLAFGPKNFPQTCTFLLCPSNMYIAATTLHQIAENFLEDPDALPMTMTHSIYVSTLNSKAAKEFESEIKKEPDSTEENPAAAEKSIAVSEQEEQETKVSGTKDSLSIGNNHGIDALLQNASARNIKVQHESNVLICKHYKEFEVLHMKKGEWTNLKDEDEGVEVSEVEAMEEVDKASINKW

SEQ ID NO: 137400 - protein, 121 aa, Glycine max
  Coding DNA Sequence Number=SeqID_20622
  Gene Ontology: Mol. function=calcium ion binding; Cellular component =plasma membrane; Biological process=G-protein coupled receptor protein signaling pathway
  Homolog annotation: Hit_ID=Q1W3B0; Match level="QueryCoverage=97%, HitCoverage=78%, E-value=7e-28, Identity=54%"; Hit description =Calmodulin
  Pfam annotation: Domain name=efhand; Domain location=20-48; Score =28.9; E_value=1.7e-05; Accession=PF00036.22; Description=EF hand
  Pfam annotation: Domain name=efhand; Domain location=58-86; Score =42.9; E_value=1.1e-09; Accession=PF00036.22; Description=EF hand
  Pfam annotation: Domain name=efhand; Domain location=94-121; Score =30.5; E_value=6.1e-06; Accession=PF00036.22; Description=EF hand
  Pfam module annotation: Pfam domain module=efhand::efhand::efhand; Domain location=20-48::58-86::94-121
MEELASALRTLNQNNPRKEELQIMMNEVDMNGSGTIEFGQFLNLMARKMKKQSEAEEELKEAFKLFDKDQDGYISPTELLSAMRNIGVKITEEELEHMIRLADLDGDGRVNYEEFMRMMTV

SEQ ID NO: 137401 - protein, 88 aa, Glycine max
  Coding DNA Sequence Number=SeqID_20623
MSNSLADFCILKRFVVASHLSRKLQSIKQVDCKLPPAPWIKCNTNDAARALEIFQHFIETLATIVAIQMAFGKGHRLSLVGLSVEVAL

SEQ ID NO: 137402 - protein, 1032 aa, Glycine max
  Coding DNA Sequence Number=SeqID_20624
  Gene Ontology: Mol. function=protein serine/threonine kinase activity; Cellular component=integral to membrane; Biological process=protein amino acid phosphorylation
  Homolog annotation: Hit_ID=Q1S227; Match level="QueryCoverage=98%, HitCoverage=99%, E-value=0.0, Identity=61%"; Hit description=Protein kinase; Actin-binding, actinin-type
  Pfam annotation: Domain name=LRRNT_2; Domain location=41-87; Score =39.6; E_value=1.1e-08; Accession=PF08263.3; Description=Leucine rich repeat N-terminal domain
  Pfam annotation: Domain name=LRR_1; Domain location=115-137; Score =9.9; E_value=4; Accession=PF00560.23; Description=Leucine Rich Repeat
  Pfam annotation: Domain name=LRR_1; Domain location=139-161; Score =9.4; E_value=5; Accession=PF00560.23; Description=Leucine Rich Repeat
  Pfam annotation: Domain name=LRR_1; Domain location=163-185; Score =8.5; E_value=7.4; Accession=PF00560.23; Description=Leucine Rich Repeat
  Pfam annotation: Domain name=LRR_1; Domain location=187-209; Score =5.8; E_value=24; Accession=PF00560.23; Description=Leucine Rich Repeat
  Pfam annotation: Domain name=LRR_1; Domain location=211-233; Score =14.6; E_value=0.36; Accession=PF00560.23; Description=Leucine Rich Repeat
  Pfam annotation: Domain name=LRR_1; Domain location=235-257; Score =14.6; E_value=0.36; Accession=PF00560.23; Description=Leucine Rich Repeat
  Pfam annotation: Domain name=LRR_1; Domain location=259-281; Score =5.6; E_value=26; Accession=PF00560.23; Description=Leucine Rich Repeat
  Pfam annotation: Domain name=LRR_1; Domain location=283-305; Score =14.8; E_value=0.32; Accession=PF00560.23; Description=Leucine Rich Repeat
  Pfam annotation: Domain name=LRR_1; Domain location=307-329; Score =18.3; E_value=0.028; Accession=PF00560.23; Description=Leucine Rich Repeat
  Pfam annotation: Domain name=LRR_1; Domain location=331-353; Score =10.6; E_value=2.9; Accession=PF00560.23; Description=Leucine Rich Repeat
  Pfam annotation: Domain name=LRR_1; Domain location=355-377; Score =9.8; E_value=4.1; Accession=PF00560.23; Description=Leucine Rich Repeat
  Pfam annotation: Domain name=LRR_1; Domain location=379-401; Score =12.4; E_value=1.4; Accession=PF00560.23; Description=Leucine Rich Repeat
  Pfam annotation: Domain name=LRR_1; Domain location=403-425; Score =15.7; E_value=0.16; Accession=PF00560.23; Description=Leucine Rich Repeat
  Pfam annotation: Domain name=LRR_1; Domain location=427-449; Score =12.0; E_value=1.6; Accession=PF00560.23; Description=Leucine Rich Repeat
  Pfam annotation: Domain name=LRR_1; Domain location=451-473; Score =6.1; E_value=21; Accession=PF00560.23; Description=Leucine Rich Repeat
  Pfam annotation: Domain name=LRR_1; Domain location=475-497; Score =8.0; E_value=8.9; Accession=PF00560.23; Description=Leucine Rich Repeat
  Pfam annotation: Domain name=LRR_1; Domain location=499-521; Score =9.4; E_value=4.9; Accession=PF00560.23; Description=Leucine Rich Repeat
  Pfam annotation: Domain name=LRR_1; Domain location=523-545; Score =16.0; E_value=0.14; Accession=PF00560.23; Description=Leucine Rich Repeat
  Pfam annotation: Domain name=LRR_1; Domain location=547-569; Score =16.0; E_value=0.14; Accession=PF00560.23; Description=Leucine Rich Repeat
  Pfam annotation: Domain name=LRR_1; Domain location=571-593; Score =16.9; E_value=0.071; Accession=PF00560.23; Description=Leucine Rich Repeat
  Pfam annotation: Domain name=LRR_1; Domain location=595-615; Score =10.5; E_value=3.1; Accession=PF00560.23; Description=Leucine Rich Repeat
  Pfam annotation: Domain name=LRR_1; Domain location=91-113; Score =9.0; E_value=5.8; Accession=PF00560.23; Description=Leucine Rich Repeat
  Pfam annotation: Domain name=Pkinase; Domain location=722-996; Score =150.1; E_value=5.9e-42; Accession=PF00069.15; Description=Protein kinase domain
  Pfam annotation: Domain name=Pkinase_Tyr; Domain location=722-996; Score=97.5; E_value=4e-26; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=41-87::115-137::139-161::163-185::187-209::211-233::235 -257::259-281::283-305::307-329::331-353::355-377::379-401::403 -425::427-449::451-473::...
  Pfam module annotation: Domain location=475-497::499-521::523 -545::547-569::571-593::595-615::91-113::722-996::722-996
MKNATRLRGTNAKKTTTKMQSHLLFFYYYIGLSLIFTKASADDELSTLLSIKSILIDPMKHLKDWQTPSNVTQPGSPHCNWTGVGCNSKGFVESLDLSNMNLSGRVSNRIQSLSSLSSFNIRCNNFASSLPKSLSNLTSLKSFDVSQNYFTGSFPTGLGRATGLRLINASSNEFSGFLPEDIGNATLLESLDFRGSYFMSPIPMSFKNLQKLKFLGLSGNNFTGRIPGYLGELISLETLIIGYNLFEGGIPAEFGNLTSLQYLDLAVGSLGGQIPAELGKLTKLTTIYLYHNNFTGKIPPQLGDITSLAFLDLSDNQISGKIPEELAKLENLKLLNLMANKLSGPVPEKLGELKNLQVLELWKNSLHGPLPHNLGQNSPLQWLDVSSNSLSGEIPPGLCTTGNLTKLILFNNSFTGFIPSGLANCLSLVRVRIQNNLISGTIPIGFGSLLGLQRLELATNNLTEKIPTDITLSTSLSFIDVSWNHLESSLPSDILSIPSLQTFIASHNNFGGNIPDEFQDCPSLSVLDLSNTHISGTIPESIASCQKLVNLNLRNNCLTGEIPKSITKMPTLSVLDLSNNSLTGRMPENFGNSPALEMLNLSYNKLEGPVPSNGMLVTINPNDLIGNEGLCGGILPPCSPSLAVTSHRRSSHIRHVIIGFVTGVSVILALGAVYFGGRCLYKRWHLYNNFFHDWFQSNEDWPWRLVAFQRISITSSDILACIKESNVIGMGGTGIVYKAEIHRPHVTLAVKKLWRSRTDIEDGNDALREVELLGRLRHRNIVRLLGYVHNERNVMMVYEYMPNGNLGTALHGEQSARLLVDWVSRYNIALGVAQGLNYLHHDCHPLVIHRDIKSNNILLDSNLEARIADFGLARMMIQKNETVSMVAGSYGYIAPEYGYTLKVDEKIDIYSYGVVLLELLTGKMPLDPSFEESIDIVEWIRKKKSNKALLEALDPAIASQCKHVQEEMLLVLRIALLCTAKLPKERPPMRDIVTMLGEAKPRRKSICHNGGQDSRSVEKPTIFTTSPIISLL

SEQ ID NO: 137403 - protein, 70 aa, Glycine max
  Coding DNA Sequence Number=SeqID_20625
MFPQVKCPDQVYSSFLIASFGHGSNNGANLDKSGVVLDFKRLMMIFFCRTNLKKEESIEWEGFYLSIWWT

SEQ ID NO: 137404 - protein, 351 aa, Glycine max
  Coding DNA Sequence Number=SeqID_20626
  Homolog annotation: Hit_ID=Q9ZU41; Match level="QueryCoverage=33%, HitCoverage=35%, E-value=6e-34, Identity=56%"; Hit description =Predicted by genscan and genefinder
  Pfam annotation: Domain name=DUF789; Domain location=29-207; Score =75.7; E_value=1e-21; Accession=PF05623.3; Description=Protein of unknown function (DUF789)
MILAWLLIVVLWRCLWQGNPVKKVTLNQLERQAVIVAVAIVMKEELRVFMVVGIILMLWMQAIILWKGSPKENLSWVHQVMRLRAAALLISDLARQFPELKTYWSCDLSPASWVSFAWYPIYRIPTGPTLQSLSACFLTFHSLSTALQSRDISKLSLPIFGLASHKFKVSLWDPDGVSECQKANSLLRAAENWLRLLRVNHPDYNYFMSHYAYNSRVAASARGRIEYIFILCDPFLSYVQSFGGSMIWKKVLKDIWIETDSMPAATFMNQGTHSTHPYLVFLNYERTLLQHSWNVKISHAMREANCVADCLASISHHAHQGLVFFYDPPLECKVFLCFDSIGTLYPRPVKH

SEQ ID NO: 137405 - protein, 82 aa, Glycine max
  Coding DNA Sequence Number=SeqID_20627
MSPKDFLEKDYLLSEESNVTGIQTHAYEKDYYSDKAKPNSRPTSMLDFIALDLSYSFPVIVELAQENLVVILFIEDLFSIIV

SEQ ID NO: 137406 - protein, 243 aa, Glycine max
  Coding DNA Sequence Number=SeqID_20628
  Gene Ontology: Mol. function=RNA-directed DNA polymerase activity; Biological process=RNA-dependent DNA replication
MTLLPEMEDKSGVDATREPREKLSRNTEVFYEKCRKSFSSKRVEYIWKHRNRIIFSHDTFNANKLLEDAVFLLWTWLRNLEKNFVIHYNHWSSNISIGVPQTVVDKLIKLQRRFLWGGGHDNKKIAWISWETHQGELWARVLEAKYGGWRGLAEEGRSNLESIWWRDLKRAVHHSHHGKVLQNGLKWKVEGGDKIKFWEDRWICQEESLAEKYSRLYMISSQQHQLIRQLGKHNDSGWEWNFN

SEQ ID NO: 137407 - protein, 48 aa, Glycine max
  Coding DNA Sequence Number=SeqID_20629
MPRSSMTTDCCICGNEAHVNLEVHPHSEYVQPTQRYMLEFQLRRGKMW

SEQ ID NO: 137408 - protein, 63 aa, Glycine max
  Coding DNA Sequence Number=SeqID_20630
MFVAEYAMKFEYILRFNAQDGDDACRSKRFKDGRLRLELQRFIVPLYITVFHLLVENNFICYR

SEQ ID NO: 137409 - protein, 92 aa, Glycine max
  Coding DNA Sequence Number=SeqID_20631
MMGHHCRKSHQNHHDHNRNHAHQQHYDINPYIHEFPIPRGIEKGVCPTLSYYYRFIRYITYKGPSLLKALDGKVQLHREKVIRSRSCHLLPS

SEQ ID NO: 137410 - protein, 197 aa, Glycine max
  Coding DNA Sequence Number=SeqID_20632
MAFDDRALKAYDELLNLSKCVRDRGGHCFVVLGGCLGRGETKASSVDSLPDGDRGVHSLSPITGKDHPLSLILGLALVALVLTLHGIEEGMTTSFVVGVALGILASFGGNNSLGNDLDFLKDNLDIVLFIIVSFTNNPSYMGVIGLFPSLMISVAFTKASNSLTNGVIGQGYLDSKNLGYYCLVALKLKIVKHSDEF

SEQ ID NO: 137411 - protein, 492 aa, Glycine max
  Coding DNA Sequence Number=SeqID_20633
  Gene Ontology: Mol. function=transporter activity; Cellular component= integral to membrane; Biological process=transport
  Homolog annotation: Hit_ID=Q9SL56; Match level="QueryCoverage=99%, HitCoverage=98%, E-value=0.0, Identity=67%"; Hit description =Putative membrane transporter
  Pfam annotation: Domain name=CitMHS; Domain location=29-459; Score= -143.6; E_value=0.096; Accession=PF03600.6; Description=Citrate transporter
  Pfam annotation: Domain name=MFS_1; Domain location=32-456; Score =138.7; E_value=1.6e-38; Accession=PF07690.6; Description=Major Facilitator Superfamily
  Pfam annotation: Domain name=Sugar_tr; Domain location=50-489; Score=- 126.1; E_value=0.0064; Accession=PF00083.14; Description=Sugar (and other) transporter
  Pfam module annotation: Pfam domain module=CitMHS::MFS_1::Sugar_tr; Domain location=29-459::32-456::50-489
  Subcellular localization annotation: CTP_CleavageSite=67; ConfidenceScore=5.24e-01
MQSKSLSLAPALTLFPGLKPPHKTLLFHQICVLVITFLAYASFHASRKPPSIVKSVLGPTVPSNGTQVSNLSSIDAGWPPFNGTRGTHRLGELDLAFLTSYSIGMYLAGHVGDRIDLRLFLVFGMMGSGLFTVLFGLGYWLDVHVLGFFVGVQIVCGVFQSIGWPCVVAVVGNWLGESKRGLIMGVWNSHTSVGNIIGSVVASGALEFGWGWSFVVPGILIILVGILVFLFLVVNPEDMGFVHPGMDVEMSVEMDSAENQQKVEAEEAKLIESDNSESSSAIGFLEAWKLPGVAPFAFCLFFSKLVAYTFLYWLPFYIRHTAVAGVHMSHKTAGLLSTIFDIGGVLGGITAGFISDLIEARAITSILFLFLSIPALALYRIFGSLSILINIILMFLSGFLVNGPYSLITTAVAADLGTQSLNYRNSRALATVTAIIDGTGSVGAALGPLLAGYISTRGWNSVFFMLILSIFFAGLFLIRIARTEIREKLSGK

SEQ ID NO: 137412 - protein, 63 aa, Glycine max
  Coding DNA Sequence Number=SeqID_20634
MCTLKQLKIKAPINNITKEHPSHYHRPSSSGYPETYYHDIYPATAVTDSPQPIPNKNDLSSHC

SEQ ID NO: 137413 - protein, 103 aa, Glycine max
  Coding DNA Sequence Number=SeqID_20635
MDGQDFIDHVTKLHVAHKERRIRIEEERVSTQAAKEQAVIAQVSKVALADEVIQQEKEHASNVVAALAPTVTIPALLVLVQQPPPNEPTPPPPTQPPPDPQVQ

SEQ ID NO: 137414 - protein, 76 aa, Glycine max
  Coding DNA Sequence Number=SeqID_20636
  Subcellular localization annotation: CTP_CleavageSite=28; ConfidenceScore=5.31e-01
MWDKGTKTTNSNMSLLALSFKGNSQGTSSSLSDKVHQVEWKSFSTLILFLDLNLMQRDKESVLSEALAVLAADLVK

SEQ ID NO: 137415 - protein, 127 aa, Glycine max
  Coding DNA Sequence Number=SeqID_20637
  Subcellular localization annotation: CTP_CleavageSite=40; ConfidenceScore=5.08e-01
MSSPPYPCFVFSKPNKAYLSRENATKRQRGARKRTGEEVNRQEREEGFMLCGGDGECVDFDDVGIGIGIGSNSNVDDSGLVHSASGVDVDDGSNGDIVGGNDANSDNIDDDNDNDGISCSGGRGGGG

SEQ ID NO: 137416 - protein, 160 aa, Glycine max
  Coding DNA Sequence Number=SeqID_20638
MMLELEPNSDEESEQWENILEKCVRSLSARRSNGQRGVPDSDELHHRHTDVDVLAGPGKGEKHTVEDDKGLLEVAKDGEDQGCGGRACIERHHGPQQRAQQQGRQGGAPPRPKGCRGTGQGEALDELASFEGGELEGVRRVVVENEKASIKGKLKHNIKT

SEQ ID NO: 137417 - protein, 76 aa, Glycine max
  Coding DNA Sequence Number=SeqID_20639
MLRLNEKVKKTMFQAWRSKEEKVWTSEEDKVTMGVLKNWEVQEANMETQCDVILTRSRSLDTGYGDLNDATSSEGR

SEQ ID NO: 137418 - protein, 123 aa, Glycine max
  Coding DNA Sequence Number=SeqID_20640
MDEHQQNRKELTNIIMKINKESDEMFNTVHVIDQPFGEVSKSFAIRWKDELEPTWLLLHSNGNMHSVTYNQDFVSPTLLAGCMELREFYGLIGNHQVTLIHYGQSVFLLTIFKSSSEPKAFPK

SEQ ID NO: 137419 - protein, 1072 aa, Glycine max
  Coding DNA Sequence Number=SeqID_20641
  Gene Ontology: Mol. function=nucleic acid binding; Cellular component= intracellular; Biological process=DNA integration
  Homolog annotation: Hit_ID=Q1SKN1; Match level="QueryCoverage=96%, HitCoverage=76%, E-value=0.0, Identity=35%"; Hit description =Integrase, catalytic region
  Pfam annotation: Domain name=rve; Domain location=552-713; Score =183.7; E_value=4.5e-52; Accession=PF00665.16; Description=Integrase core domain
  Pfam annotation: Domain name=zf-CCHC; Domain location=277-294; Score =11.1; E_value=0.015; Accession=PF00098.13; Description=Zinc knuckle
  Pfam annotation: Domain name=zf-CCHC; Domain location=297-314; Score =3.8; E_value=0.23; Accession=PF00098.13; Description=Zinc knuckle
  Pfam module annotation: Pfam domain module=RVT_2::Retrotrans _gag::rve::zf-CCHC::zf-CCHC; Domain location=918-1072::107-214::552 -713::277-294::297-314
MASEHDLENEIPSKNSPQKQPNSSSNNSNKNSSNMDSSNPYYIHPSDHPGHLLVPIKLNGTNYPSWSISMIHALTAKNKIGFINGSIKAPSAVDQSAEHALWNRCNSMILSWLTHSVEPDLAKGVIHAKTAHQVWEDFKDQFSQKNAPAIYRIQKSLASISQGTMAASTCFTKIKGLWDELETYRTLPTCNQMKAHDEQREEDRLMQFLMGLNDTYRTVRTNILMMSPLPNVRQAYSLVIQDETQRQMTSETTENFSIAAAIHSHPDNLSNKFVKDKHCEHCNRDGHTISNCRTLKFYCDFCNKNGHTEDRCRIKNGTYNTGTQSNKHIQSQQRQQGPRSTAPRTFSAANAADSSKNALELSAEQLQQLARALNMMSPNNTSGNSNAHANAAGLSLFSNASINYVFTKPWILDSGATDHITSDSTFLSETKFPSIPSVNLPTGSSAPITSIGDMSFNSNITLKNDLATGKTIGSGEQCGGLYYMSPLQKIPVSHQVSQPSNIWHMRLGHPSTSRLKLCSPLLSPNNISFENNCNVCPMAKQTRFPFPLSTISTHAPFDLLHCDIWGPHKVPTHSGARFFLTIVDDFTRCTWVFLMRYKSDSQNILKSFINFAYTQFQATVKEIRVDNGSEFMSMREFFQSHGIEYQRTCVYTPQQNGVVERKHRHILVVARALLFHSHLPLEFWGECVLTAVYLINRLPSPLLSNKSPFELLYNKPPSFDHLRVFGCLCYATIVQPTHKFDPRAKRGIFVGYPTGQKGYKIYDPETKTFFVSRDVKFCETNFPSIPNTYEPNLTSSHPSYEAIDDWPSPTPSHHQSQQTGIPSAHEPNYPSHLTTETSSAASPIVEPTLPTSHTSNTPTPSIPQVRQSLRDKNPPIWHKDYHMSTQVNKSPSEPTSGSAHTEPQSYDQAVHDPHWQDAMNAELEALEQNNTWSLVPLPSGHKPIGCKWVYKIKYKSDGTIERYKARLVAKGYTQVEGIDYQETFSPTAKVTTLRCLLTVAAARNWFIHQLDVQSAFLHGDLHELVYMEPPPGLRRQGENVVCRLNKSLYGLKQASRNWFSTFSEAIQKAGYQ

SEQ ID NO: 137420 - protein, 66 aa, Glycine max
  Coding DNA Sequence Number=SeqID_20642
MGCYNKKSILPCYSSWQVDDAILESRRQQVGVVVKANRNVGKFLVRSGLLDTGYGELDDATSGEER

SEQ ID NO: 137421 - protein, 64 aa, Glycine max
  Coding DNA Sequence Number=SeqID_20643
IAPARHPVNPEKSNRVLGFPALITSLCQFYGVPVTPNKVIRPRINRAFIKKYYAPKQAQGETPQ

SEQ ID NO: 137422 - protein, 115 aa, Glycine max
  Coding DNA Sequence Number=SeqID_20644
MSLSYCHKHQPMKHCAIASDFRQMVARINIEIILMDEKANKIFAPIKNVDPGKWNDVVKVVEKNLDSPTKHTFKLNFVNFTKVKKQDFPMIPEMVYDFILLDDVLTGNVNPDYLM

SEQ ID NO: 137423 - protein, 76 aa, Glycine max
  Coding DNA Sequence Number=SeqID_20645
  Gene Ontology: Mol. function=N-acetyltransferase activity; Biological process=metabolic process
  Homolog annotation: Hit_ID=Q2G451; Match level="QueryCoverage=100%, HitCoverage=26%, E-value=5e-15, Identity=46%"; Hit description=GCN5 -related N-acetyltransferase
MTLADAEAGYRLTQQLGWAHRREDWQQLIALGEGVVVEAQGDYLGGAIGWRWGPDAATIGLVIVSEQARGRGIGRQ

SEQ ID NO: 137424 - protein, 371 aa, Glycine max
  Coding DNA Sequence Number=SeqID_20646
  Gene Ontology: Mol. function=transcription factor activity; Cellular component=membrane; Biological process=regulation of transcription, DNA-dependent
  Homolog annotation: Hit_ID=Q47083; Match level="QueryCoverage=85%, HitCoverage=100%, E-value=1e-131, Identity=73%"; Hit description=HTH- type transcriptional regulator cbl
  Pfam annotation: Domain name=DUF1601; Domain location=148-190; Score =6.6; E_value=2; Accession=PF07671.2; Description=Protein of unknown function (DUF1601)
  Pfam annotation: Domain name=DUF1601; Domain location=37-78; Score =10.6; E_value=0.56; Accession=PF07671.2; Description=Protein of unknown function (DUF1601)
  Pfam annotation: Domain name=HTH_1; Domain location=55-116; Score =65.3; E_value=1.9e-16; Accession=PF00126.17; Description=Bacterial regulatory helix-turn-helix protein, lysR family
  Pfam annotation: Domain name=LysR_substrate; Domain location=140-348; Score=167.1; E_value=4.4e-47; Accession=PF03466.10; Description=LysR substrate binding domain
  Pfam module annotation: Pfam domain module=DUF1601::DUF1601::HTH _1::LysR_substrate; Domain location=148-190::37-78::55-116::140-348
MGEGRGEGGKSHPSPTPTLITIPHNTPFFIICCNHTNFITWTKQGQETGEKGVNFQQLKIIREAARCEFNLTEVANTLFTSQSGVSRHIRDLEDELGVEIFIRRGKRLLGMTEPGKALLTIAERILDEAGKVRRLADVFTNETSGVLTIATTHTQARYSLPRVIKAFRQLYPNVRLELNQGSPQEIVAMLLAGEADVGIASEQLVNNTSLAAFPWFSWHHSLLVPHDHELLANQPVTLVSLSRHPLITYRQGITGRSRVDRAFQAAGLRPDIVLSAQDSDVVKTYVELGLGVGILADQACDIYDGEDLVKIDAHHLFDANTVWLGLKRGQLQRNYVWQFLELCNANLSLEEIKRQALSYETDDEPAIDFQI

SEQ ID NO: 137425 - protein, 69 aa, Glycine max
  Coding DNA Sequence Number=SeqID_20647
MAFQKEYVRPPWELSQPTIWREGEIKETVKALDLERSQATFVDRKLDYMLILSWFHLFIFNLIKKGLVR

SEQ ID NO: 137426 - protein, 183 aa, Glycine max
  Coding DNA Sequence Number=SeqID_20648
  Gene Ontology: Mol. function=structural constituent of ribosome; Cellular component=ribonucleoprotein complex; Biological process =translation
  Homolog annotation: Hit_ID=Q9BBQ0; Match level="QueryCoverage=60%, HitCoverage=91%, E-value=3e-53, Identity=94%"; Hit description =Chloroplast 50S ribosomal protein L14
  Pfam annotation: Domain name=Ribosomal_L14; Domain location=62-183; Score=221.2; E_value=2.3e-63; Accession=PF00238.10; Description =Ribosomal protein L14pL23e
  Pfam annotation: Domain name=Ribosomal_L16; Domain location=1-113; Score=108.1; E_value=2.5e-29; Accession=PF00252.8; Description =Ribosomal protein L16
  Pfam module annotation: Pfam domain module=Ribosomal_L14::Ribosomal _L16; Domain location=62-183::1-113
MKGISYRGNHICFGRYALQALEPAWITSRQIEAGRRAMSRNVRRGGQIWVRIFPDKPVTVRPTETRMGSGKADNSGARELMCIRILGASNRRYAYIGDIVVAVIKQAVPNTNLERSEVIRAVIVRTCKELKRSNGIIIQYDDNAAVVIDQEGNPKGTRIFCAIARELRQLNFTKIVSLAPEVL

SEQ ID NO: 137427 - protein, 59 aa, Glycine max
  Coding DNA Sequence Number=SeqID_20649
  Subcellular localization annotation: CTP_CleavageSite=50; ConfidenceScore=5.56e-01
MVQSFWYLRTLTKLVKKIVSVKKIKPRRFRNASVSDFVKMLYRSSSFFVRSSSFFGLQP

SEQ ID NO: 137428 - protein, 141 aa, Glycine max
  Coding DNA Sequence Number=SeqID_20650
MLSFSRMQSHGFIPPLELEVSPSASYVRRKGGCVDPSRQGPNTALSHKRWLYLDDNPPRLVTFSRVYEGSITVHNVPLGNDQVKVGVEEVQDVYVRVLVSPKKGPERPAKHVHKSKPDDNPIYQMSLMIPQLFLKPMQVYE

SEQ ID NO: 137429 - protein, 62 aa, Glycine max
  Coding DNA Sequence Number=SeqID_20651
MTRCPWMTKGAEDDVSLCASTGSFAPWLMKGADNHTVTIAIGGAVDKSGAFAPTFPQFVMRN

SEQ ID NO: 137430 - protein, 148 aa, Glycine max
  Coding DNA Sequence Number=SeqID_20652
  Subcellular localization annotation: CTP_CleavageSite=49; ConfidenceScore=5.06e-01
GSRPQDTQWTWRSPTGPWGFQLWSRASLSPKGCPSPPTRSCHRDIGIAPARHLVDPEKSNRVLGFPALIMSLCQFYGVPVAPSWVNRPLLIGLSSRSTATPGRHPNTGMGTSRHWFRDQQITIPRPAQDIKEALLGGNLVSFKFLLVI

SEQ ID NO: 137431 - protein, 260 aa, Glycine max
  Coding DNA Sequence Number=SeqID_20653
  Gene Ontology: Mol. function=metal ion binding; Biological process =metal ion transport
  Pfam annotation: Domain name=HMA; Domain location=24-84; Score=44.1; E_value=4.7e-10; Accession=PF00403.16; Description=Heavy-metal -associated domain
MARESQHYLQEWLIHQMQAPRVTQIQVRVDCNGCVQKIKKALNGIHGIHDLRVDLLRQKLTIIGWADPEQVVKAIKKTKKNAIICSSFELPSPSKPTEPEPKGNANAPAPDATQPPPTQAPPPQQPPPEATTSHIPTWHNTTRQWQNNTGTEELEQVHVTPHHLPNYVNRFSSGHKHVEHWYRYHNGPIFLKEPSRPMYVTHSYNTHVPSSYVTEYEYVRSPSRYTHYNCIEHYSGDYQNNNVNIASMFSDDNPNACCIV

SEQ ID NO: 137432 - protein, 437 aa, Glycine max
  Coding DNA Sequence Number=SeqID_20654
  Gene Ontology: Mol. function=nucleic acid binding; Biological process= DNA integration
  Homolog annotation: Hit_ID=Q1S4N1; Match level="QueryCoverage=99%, HitCoverage=62%, E-value=5e-37, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKVLNLSREFEMQRMKETKTIKAYVDRLLSIANKVQLLGNDFSDERIVQKFMVVVLEKYELEISVLEEAKDLSTITLGELENVEEQEEEQLFVATCFSTSNISSDSWLIDNGCTNHMTNDQKLFKELDKTIVSKVKIGNGDFILVMGKWIVAIESLVGLKHISDVLYVPDIDQNLLSLAQLVEKGFKVIFEDNWCLIKDVKDKDVCRVKMKAKSYALNLMEEEQITFSSTTTYLIYNTKDLDISTLLDYYTCRNMPWLKETNLIRRQNLEFSLDTMTLPKLTKIFNHKKEKILVSRDVKFMEDQQWSWEKPISKQLPETPQFFDDHVDDIPIRSTRPLSKIYQRCNVAVLEPPEFEEAEKDDKGYAQVFGVDFSETFASVAHLNTIKMLLALIAHKGWKVYHLDVKSAFLNGYLQDEIYVDQPKGFKSKERKRKFTS

SEQ ID NO: 137433 - protein, 293 aa, Glycine max
  Coding DNA Sequence Number=SeqID_20655
  Gene Ontology: Mol. function=polygalacturonase activity; Cellular component=cellulose and pectin-containing cell wall; Biological process=carbohydrate metabolic process
  Homolog annotation: Hit_ID=Q2XTD7; Match level="QueryCoverage=95%, HitCoverage=59%, E-value=8e-99, Identity=59%"; Hit description =Polygalacturonase-like protein-like
  Pfam annotation: Domain name=Glyco_hydro_28; Domain location=1-271; Score=-73.8; E_value=1.7e-05; Accession=PF00295.8; Description =Glycosyl hydrolases family 28
MGFAWWELFSSHSLNYSRPHLIELVASDHVVVSNLTFLNAPAYSIHPVYCSNVHIHNVSISAPPESPNTVGIVPDSSDHVCIEDCVIATGYDAISLKSGWDEYGIAYGRPTENVHIRRVHLQASSGSTIAFGSDMSGGISNILVENVHLYNSKSGIEFRTMRGRGGYMKEIIISDIEMENIYTAIAATGYCGSHPDDKFDPNALPLLDHIILQDMIGTNITIAGSFAGLQESPFTNICLSNITLSTNSVSSIPWECSNVSGFSDYVLPKPCPDLETLSNCLSLLIIKGKTAVM

SEQ ID NO: 137434 - protein, 131 aa, Glycine max
  Coding DNA Sequence Number=SeqID_20656
  Subcellular localization annotation: CTP_CleavageSite=38; ConfidenceScore=5.32e-01
MDDLTINFRGARKVRARPTYFPSSSAPPVPPTSATPTPAAHDSQRFEAMLQKQFIEKVSWPGTVPSAVREGEGPSAQVPQQVQDASSEATIPGAFDFSGAGIEMRPYEAVLPKPIVPVIHETVEAGESQFR

SEQ ID NO: 137435 - protein, 374 aa, Glycine max
  Coding DNA Sequence Number=SeqID_20657
  Gene Ontology: Mol. function=nucleic acid binding; Cellular component= nuclear heterochromatin; Biological process=chromosome organization and biogenesis (sensu Eukaryota)
  Homolog annotation: Hit_ID=Q337N7; Match level="QueryCoverage=99%, HitCoverage=25%, E-value=1e-125, Identity=62%"; Hit description=SNF2 domain-containing protein, putative, expressed
  Pfam annotation: Domain name=Helicase_C; Domain location=297-372; Score=46.7; E_value=7.9e-11; Accession=PF00271.21; Description =Helicase conserved C-terminal domain
  Pfam annotation: Domain name=SNF2_N; Domain location=1-173; Score= -72.9; E_value=0.00032; Accession=PF00176.13; Description=SNF2 family N-terminal domain
  Pfam module annotation: Pfam domain module=Helicase_C::SNF2_N; Domain location=297-372::1-173
DGPDILVCDEAHMIKNTKADVTQALKQVKCQRRIALTGSPLQNNLMEYYCVFLEAAMNFGTGKTFFSLIVLIFTHTNSTLIDVKIMNQRSHILYEQLKGFVQRMDMNVVKKDLPPKTVFVITVKLSPLQRKLYKRFLDVHGFTTQVHPEMLRKRCFFAGYQALARIWNHPGILQLTKEVKDYVKHEDAVENFLVDDSYSDENSDYNVLAGEKMRYGNDLLQRKDDNGFFLKGWWNDLLHGKIYKEIDHSGKMVLLMEILTMSSDVGDKVLVFSQSIPTLDLIELYLSRIPRRGKQGKFWKKGKDWYRLDGRTESSERQKLVERFNEPLNKRVKCTLISTRAGSLGINLHAANRVVIVDGSWNPTYDLQAIYRSW

SEQ ID NO: 137436 - protein, 107 aa, Glycine max
  Coding DNA Sequence Number=SeqID_20658
  Gene Ontology: Mol. function=hydrolase activity, acting on glycosyl bonds; Biological process=carbohydrate metabolic process
  Homolog annotation: Hit_ID=Q9LRY8; Match level="QueryCoverage=98%, HitCoverage=22%, E-value=4e-36, Identity=73%"; Hit description =Polygalacturonase-like protein
MVAFLLLLALSNEVRVNGDGSGRQCEINPALKPRPHTVSILEFGAVGDGKTLNTMAFQNAIFYLKSFADKGGAQLYVPPGTWLTQSFNLTSHLTLFLEKGAVILGSQ

SEQ ID NO: 137437 - protein, 254 aa, Glycine max
  Coding DNA Sequence Number=SeqID_20659
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=34%, E-value=1e-127, Identity=87%"; Hit description =Photosystem I P700 chlorophyll a apoprotein A1
  Pfam annotation: Domain name=PsaA_PsaB; Domain location=1-253; Score=- 66.9; E_value=2.7e-05; Accession=PF00223.9; Description=Photosystem I psaApsaB protein
MYFHGARFSNYEAWLSDPTHIRPSAQVVWPIVGQEILNGDVGGGFRGIQITSGFFQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTARVIKVYMRS

SEQ ID NO: 137438 - protein, 905 aa, Glycine max
  Coding DNA Sequence Number=SeqID_20660
  Gene Ontology: Mol. function=nucleic acid binding; Cellular component= beta-galactosidase complex; Biological process=DNA integration
  Homolog annotation: Hit_ID=Q1SRN1; Match level="QueryCoverage=88%, HitCoverage=78%, E-value=1e-152, Identity=44%"; Hit description =Integrase, catalytic region
  Pfam annotation: Domain name=rve; Domain location=145-295; Score=4.7; E_value=0.0024; Accession=PF00665.16; Description=Integrase core domain
  Pfam module annotation: Pfam domain module=RVT_2::rve; Domain location=482-715::145-295
MIEADPLITEEEVACLAMGIEEAEIMVTMITETMEIMRTRIMEMLQIMEILIGIKYSVKFSTSLATVQLIAITGLIQIMKLSGIIRISLGISTETTLIKGLTLRLRTVTQSQQNAQTPQAYLANTNPTQQSQNSYIDSGATHHVTASPQNLMNEIPTSGNELVFLGNGQGLPIISTSSTVFNPPFASNVKLSLYLVVPLVDGSILLRGSLSQDGLYVFSNLLSSIHHRLICPHTHHQKGVVERKHRHIVEMGLTLMSQASMPLSYWDHAFHTAVYLINRLPSAYHENTIPYEMIFNKYPDYSFLKVFGCPVLVLFCGIHLIIKDINVLIQRARFFLSRDVIFNESSFPFSVAKPHDSSPPSSVPSQLLALGVLPIPTAHPNPPSHSIGSIESLGSLSQPVELNSPQLVPTEQAASSTPVNDESSPSTALSSPPPSQPPNTHPMQTRSKSGIVCPRLHPTLLLTTAEPTSVKHALSSPEWKEAMQQEYNALMANNTWSPVPLPSGRKAIGCKWVFRVKQNPDGSILKYKARLVAKGFNQIPGQDYSETFSPVMKPVTIRIMLTVALTHHWSIQQIDVNNAFLNGDLEEEVYMTQPHGFAGSDKSVVCKLKKAIYGLKQTPRAWYERLTKTLLTFGFVQSKCDPSLLVFKTVSDCLYLLIYVDDIIITGSSSVLIQKLITKLHAVFALKQLAKYIHDLLEKVKMVDAKPILTPLPSDLKLTKHGTTKIVSVPVADATLYQSVVGALQYITVTRPELSYSVNKVCQFMSEPMEEHWKAVKCILRYLKGTIDYGLSLKSAPQGEPYTLEAFCDADWGMDMVDRRSISGTIALSHNPVLHSRTKHMELDIFFVREKVLDKSLLACLMEACLWGFYGGWIFELQWGPLMVIFHHGDAAEDKGKEVRGGAIH

SEQ ID NO: 137439 - protein, 159 aa, Glycine max
  Coding DNA Sequence Number=SeqID_20661
  Gene Ontology: Mol. function=helicase activity
  Homolog annotation: Hit_ID=O04048; Match level="QueryCoverage=65%, HitCoverage=90%, E-value=2e-24, Identity=60%"; Hit description =Putative helicase
MGSKIYPKVHENPRAFFSSSSPSLSESSIQYPWEVGLHHCCQAIFSGFEKKPVFAYRLLAHGTMEEKIYKRQVTKEGLAARVVDRQQVHRTISKEEMLHLFELGDDDNPETLADLSQENEHQDNPILVGHSLKHTAPHSNGSSYSDKLMESLLSKHHPR

SEQ ID NO: 137440 - protein, 132 aa, Glycine max
  Coding DNA Sequence Number=SeqID_20662
  Gene Ontology: Mol. function=nucleic acid binding; Biological process= DNA integration
  Homolog annotation: Hit_ID=Q1S7C5; Match level="QueryCoverage=94%, HitCoverage=13%, E-value=5e-19, Identity=41%"; Hit description =Integrase, catalytic region
MQTWIKKIQLMQHGNIKTSHYLFGFSRPFLRQFCQKLLAVFMHIKYGERYIITFMLKQKQNPDIFARNLGIAEKEQIDVILEGLPSEYESLVTAISSKIDQFEFEIQYLLLAQEQRLEKLRENAIAPALNLT

SEQ ID NO: 137441 - protein, 77 aa, Glycine max
  Coding DNA Sequence Number=SeqID_20663
MPIIMSMKESWYLDQERGYTDTSPMVLQEGEQSEDSSANEFYQNAELDSAQLNLGISQRPKRIIKPPERYGFEDMAA

SEQ ID NO: 137442 - protein, 559 aa, Glycine max
  Coding DNA Sequence Number=SeqID_20664
  Gene Ontology: Mol. function=binding; Cellular component =intracellular; Biological process=RNA processing
  Homolog annotation: Hit_ID=Q10RX5; Match level="QueryCoverage=93%, HitCoverage=93%, E-value=0.0, Identity=58%"; Hit description=Pre -mRNA processing protein PRP39, putative, expressed
  Pfam annotation: Domain name=DUF946; Domain location=18-557; Score =1266.6; E_value=0; Accession=PF06101.2; Description=Plant protein of unknown function (DUF946)
MFGCKSLCWDSVPEFTDPDPLPFSLPSPLPQWPQGGSFACGRICLGEIEVIKVNKFEKVWRCTSLNGKSLGFTFYRPLEIPEGFFCLGHYCQSNDQPLRGYVLVARDTSSDASTLESPALEKPLNYSLIWSLDSHDECVYFWLPNPPTGYKAMGIVVTSSPNEPEVEEVRCVRDDLTESCETSDLLLTVKSKYSKDSFQVWNTQPCDRGMLARGVAVGAFFCGSTSVDPEQVVDIACLKNLDSSLHAMPNQNQIHALIQHYGPTVYFHPDEKYLPSSVQWFFKNGAVLHAAGNKKGIAIDYQGSNLPSGGTNDGAFWIDLPTDADARNNLKKGNIESAELYVHVKPALGGAYTDIVMWVFCPFNGPATLKVALMNIEMNKIGEHIGDWEHFTLRISNFTGELWSVYFSQHSGGGWVNAFDLEFIKGNKPIVYSSKDGHASFPHPGTYLQGSSKLGIGVRNDAAPSKFIVDSSIKYQIVAAEYLGDGVIAEPCWLQYMREWGPTIVYDSRSEIEKIINLLPLFVRFSVENLFELFPTELYGEEGPTGPKEKDNWLGDEYC

SEQ ID NO: 137443 - protein, 482 aa, Glycine max
  Coding DNA Sequence Number=SeqID_20665
  Gene Ontology: Mol. function=inositol or phosphatidylinositol phosphatase activity; Cellular component=intracellular; Biological process=abscisic acid mediated signaling
  Homolog annotation: Hit_ID=Q1SU89; Match level="QueryCoverage=98%, HitCoverage=84%, E-value=1e-165, Identity=64%"; Hit description =Inositol polyphosphate related phosphatase
  Pfam annotation: Domain name=Exo_endo_phos; Domain location=55-419; Score=143.7; E_value=5.1e-40; Accession=PF03372.13; Description =EndonucleaseExonucleasephosphatase family
MWDSAATAKERRKSCSDQDRYVDVPDDLSEGWMMDSTSGMKKKSAPGTGGLELRMFVGTWNVGGKSPNEGLNLRNWLTCPSPADIYVIGFQEIVPLNAGNVLGPEDSGPAAKWLALIREALNTNKCDHEMSHYYTSKKCRQNFSEFLSLDEELDNNGENYPKSLRRYCLAASKQMVGIFLSVWVRADLCNHVTNLKVSSVGRGIMGYLGNKGSTSISMTLYNTTFCFVCTHLASGEKFGDELRRNLDVSEILKKTKFCHSFKSLVHPLSPESILEHDNIIWLGDLNYRLAAGYDDTHELLKKNNWQALLEKDQFFLRMLLRPISLLTQCCVDSAWQLRIEQKAGRVFNGWNEGNIYFAPTYKYLTNSDHYVAQSSQSKEKRRTPAWCDRILWKGEGLNQMWYVRGESRFSDHRPVYSLFSVQVDMKSKNIAPSTATLPICCPLKPLTNSSLSSTCCATKVQAEEQLLLLTRAQSCIDTIPRF

SEQ ID NO: 137444 - protein, 708 aa, Glycine max
  Coding DNA Sequence Number=SeqID_20666
  Gene Ontology: Mol. function=histone-lysine N-methyltransferase activity; Cellular component=nucleus; Biological process=chromatin modification
  Homolog annotation: Hit_ID=UPI000034F02E; Match level="QueryCoverage =41%, HitCoverage=63%, E-value=1e-110, Identity=64%"; Hit description= histone-lysine N-methyltransferase/ zinc ion binding
  Pfam annotation: Domain name=Pre-SET; Domain location=418-566; Score =27.9; E_value=1.2e-06; Accession=PF05033.6; Description=Pre-SET motif
  Pfam annotation: Domain name=SET; Domain location=568-708; Score =86.1; E_value=1.1e-22; Accession=PF00856.18; Description=SET domain
  Pfam module annotation: Pfam domain module=Pre-SET::SET; Domain location=418-566::568-708
MAPHPRVIKAYNAMRSLGISDEEVKPVLKNLLQLYDRNWELIEEDNYRTLIDAYFELKEAKSVEWCNVELHPPVRGAVVAAYHAVEVLAGTEGLTMPYVVVKYDGVCHRVRQTEGKRKAPISYLNGRKPKQELHLVDGDDQVSSTDNSSQGLSVEDSEITPNAFKQKIIKSSQTSIVHMKPTSSSQALQRMSSEVERISTLPCMPARDRKLHRGKASAAGHCEDPIDEPSNPRVQRKNISNDHQQKELMIPRTEKLKLHLGPVSTSYNGSANASNGNCCAKSLSALYQNVPKKDATSACNNSKRTQKGSIDIASSPLGEIKISLNCEAALGQPNFRIPDLDAIMKSIEEKYLKAHKIVEPQSSMVKLLDDLCGIYLKLGLSLNRNGSTPKSANSRNVACLPLQAVTEDDKNSFHFLDDITKGSENVKISLLDETGSEDVPQFNYIPYNVIYQDANVNISLARIADEGCCADCAGDCLSLSLPCACSQETGGEFAYTPRGLLKEIFLKDCMSMKLEPLDHHFVYCQECPVERSRNDIMAEPCKGHLVRKFIKECWRKCGCDMQCGNRVVQRGLRCKLQVFLTREGKGWGIRTLEDLPKGCFVCEYAGEILTNTELYERIMQKSGNDRHTYPVTLDADWGSEGVLKDEEALCLDATYNGNVARCSDANLIDIPVEVETPDRHYYHLALFTNRNVNAYEELTWADNPNFAD

SEQ ID NO: 137445 - protein, 295 aa, Glycine max
  Coding DNA Sequence Number=SeqID_20667
  Gene Ontology: Mol. function=receptor activity
  Homolog annotation: Hit_ID=O22784; Match level="QueryCoverage=75%, HitCoverage=70%, E-value=1e-40, Identity=39%"; Hit description =Expressed protein
  Pfam annotation: Domain name=DUF26; Domain location=197-251; Score =30.7; E_value=8.3e-07; Accession=PF01657.8; Description=Domain of unknown function DUF26
  Pfam annotation: Domain name=DUF26; Domain location=87-141; Score =22.6; E_value=8.9e-06; Accession=PF01657.8; Description=Domain of unknown function DUF26
  Pfam module annotation: Pfam domain module=DUF26::DUF26; Domain location=197-251::87-141
  Subcellular localization annotation: CTP_CleavageSite=82; ConfidenceScore=5.61e-01
MSIAHSNVVFPNVPIPQSSSVSLSCSSKTVSDYSILVYKTCASQTFNDQLTKTYSQTLNSLLQQLIAQSSQQKFFKNTEAVSDDAAISGLFQCRDDIGIKDCFNCVNLLHQMSNTLCSDSMPTRVQLDGCYIHYETEELPETNGESKSYSNFLLHKECGEPVVDYIKFKEFMDEAFVNLESGIPNSNGFYTMNYKSVKLMAQCEGDSNICDCSNCVSDAVQVAKEECGTSLSAQIYLDKCFISYYGIPGNSVPGARRNNNTEKLAAIIVGGAAALFLGFAFLSLLKSWFRKDDYE

SEQ ID NO: 137446 - protein, 603 aa, Glycine max
  Coding DNA Sequence Number=SeqID_20668
  Gene Ontology: Mol. function=calcium ion binding; Cellular component =mitochondrion; Biological process=metabolic process
  Homolog annotation: Hit_ID=Q9LSH1; Match level="QueryCoverage=36%, HitCoverage=38%, E-value=1e-85, Identity=69%"; Hit description =Dihydroxyacetone/glycerone kinase-like protein
  Pfam annotation: Domain name=Dak1; Domain location=392-601; Score =184.2; E_value=3.2e-52; Accession=PF02733.7; Description=Dak1 domain
  Pfam annotation: Domain name=PPR; Domain location=117-151; Score =35.2; E_value=2.3e-07; Accession=PF01535.11; Description=PPR repeat
  Pfam annotation: Domain name=PPR; Domain location=15-49; Score=46.4; E_value=9.4e-11; Accession=PF01535.11; Description=PPR repeat
  Pfam annotation: Domain name=PPR; Domain location=152-186; Score =36.5; E_value=9.1e-08; Accession=PF01535.11; Description=PPR repeat
  Pfam annotation: Domain name=PPR; Domain location=187-221; Score =36.9; E_value=6.9e-08; Accession=PF01535.11; Description=PPR repeat
  Pfam annotation: Domain name=PPR; Domain location=222-256; Score =50.3; E_value=6.3e-12; Accession=PF01535.11; Description=PPR repeat
  Pfam annotation: Domain name=PPR; Domain location=257-291; Score =43.9; E_value=5.6e-10; Accession=PF01535.11; Description=PPR repeat
  Pfam annotation: Domain name=PPR; Domain location=292-326; Score =46.4; E_value=9.7e-11; Accession=PF01535.11; Description=PPR repeat
  Pfam annotation: Domain name=PPR; Domain location=327-361; Score =23.5; E_value=0.00078; Accession=PF01535.11; Description=PPR repeat
  Pfam annotation: Domain name=PPR; Domain location=82-116; Score=49.8; E_value=9.4e-12; Accession=PF01535.11; Description=PPR repeat
  Pfam module annotation: Pfam domain module=Dak1::PPR::PPR::PPR::PPR::P PR::PPR::PPR::PPR::PPR; Domain location=392-601::117-151::15-49::152 -186::187-221::222-256::257-291::292-326::327-361::82-116
MVEEMISKGIYVDLYVFSVLIDGLCKKGMVGEAREVFDEMIKRGCGVSVVACSSLMVGYCLKNEVDEARRLFDAVVGRPDVWSYNVLINGYCKVRRLDDAMKLFYEMWGKNVVPNLVTYNLLVDCVCKCGRVAIAWKVVKTMCESGLAPDVVTYSILLDGLCKEQHLDLAVVLFNQLIKRGVALDVWSYSILIDGCCKNQRIGEAMNFLKEMHLRNLVPHIVTYTSLIDGLCKSGRLSSAWRLLNEMHNNGPPPDVVAYSTLLHALCKSEHFDQAILLFNQMIRRGLAPDVWSYTILINGLCKSERIDEAVNLFKDMHLKNLVPDTITYISLVDALCRSGRFSYVWQLVNEMHGNAPPLDVINYIDALCRNQHLDSKCLASAYYVVTEFIEGLVETYPGLQYLDGFPQVKVVLRADVSAATYDKVAIISGGGIGHEPAHAGFVGEGMLTAAICGDIFSSPPVDTILAGIRAVTGPKGCLLVVKNYTGDRLNFGLAAKIAKSEGYKGMSSWLTVIIGDDCALPPPRGIAGRRGLAGTILVHKVAGAAAAAGLSLDDVAAEAKHASEIVGTMGVALTHGEPGAAVANIQPVNVVASHVQQQILST

SEQ ID NO: 137447 - protein, 78 aa, Glycine max
  Coding DNA Sequence Number=SeqID_20669
  Subcellular localization annotation: CTP_CleavageSite=47; ConfidenceScore=5.14e-01
MWPVWCFAAKLLSTPTARKTTLSLRLDSKKQAKTRVSLGNKSVCDMCCGAVKEGVKHGCGDDGGGGGFGGGGGCGDGR

SEQ ID NO: 137448 - protein, 108 aa, Glycine max
  Coding DNA Sequence Number=SeqID_20670
MSKESEYEVSLPVALSSFFNARSALVLQRSIPTANHFLLQLCWVTCSKRESCQMWKFILLYLTDIAKRGSFCSSPPSSYSLSNHGRGIVEFFSLEDEVPILLPRSPYP

SEQ ID NO: 137449 - protein, 121 aa, Glycine max
  Coding DNA Sequence Number=SeqID_20671
  Homolog annotation: Hit_ID=Q1T0B9; Match level="QueryCoverage=59%, HitCoverage=15%, E-value=7e-09, Identity=43%"; Hit description=IMP dehydrogenase/GMP reductase
  Subcellular localization annotation: CTP_CleavageSite=64; ConfidenceScore=5.14e-01
MPLMRVLTVTTSYGRPRLRSFPKTEKARATLPTWQKQLMRMVRVTWQGATLLARDSVWAQRKIAAGKRFAFAREARILLRARGARGGGREWRRRVKEDSRRNALFIFRSDAASSRDSVGVG

SEQ ID NO: 137450 - protein, 80 aa, Glycine max
  Coding DNA Sequence Number=SeqID_20672
METWAMASLAMAALRRARLVAREGAGSASAIRERIITTNKLVECYNKLKKILQALGAFAQLELKRSPAIRWASYSLFLAC

SEQ ID NO: 137451 - protein, 63 aa, Glycine max
  Coding DNA Sequence Number=SeqID_20673
MGFGGREEKMLSSWRGVLTLTLVLLTPMCENMFDRLGIPFGLIWKPLKVKTPFSKLCKVVELK

SEQ ID NO: 137452 - protein, 712 aa, Glycine max
  Coding DNA Sequence Number=SeqID_20674
  Gene Ontology: Mol. function=RNA-directed DNA polymerase activity; Cellular component=chromatin; Biological process=chromatin assembly or disassembly
MAELMNLREKGTISEYHEQFDAIMTRLDLPVDYSLSCFLGGLKTEVQMMVRMFQPQSMMKAYNLAKLYEFAILQGTTTTLPSKNKPVVPIKSLLGPKPPTVTEPESMKTKPRFTKNLTPAFMSERRAKGLCYFCDETFSVEHSLTHKKLQIHLMEVDDIEEDTIEIENHTGGAATQFEEAQISVNALTGVPTFITMCVTGRYNGTKVQISSVVRNFTWVIQHTTFTLDVMLIPLGCCDIVLGSNPSSCKSIKSPTLDKIVNNSVHLSMIQVGMEGGVLQALTTHATKDIIDKIIHEMLDSGIIQTSNNPYASPVVLVGKKDVTWRLCVDYRDLNKNTIKDRFPIPLVEDLINELHDSTIFSKIDLRAGYHQVKMHTAYIYKTTFRNHNGHFEYLVMPFGLTNAHATFQNLMNTVFQEFLRKFLLVFFYDILIYCQSLDEHLPHLHKYLGHVIFAEGVSTDPAKIVAVQNWPMPATLKQLRGFLDLACYYRRFVRNCGTMARALTEMLKKDKFQWTPAAKIVFQQLKESLTSAPVLAMPDFTQIFVIEVYASGQGIGGHSGRIATCKRIQAILYWKGLTLDVKQFVQQCATQQCKYDHAAYLGFLQPLPILDHVWQHISMNFIEGLPLSNGKQAIFVVVDRLSKAAHFIPLSNPYTASTVAQAFIDHVFKLHGFPSSITSDKDSIFLNKFWQELMAFQGDVEGFKISSPKSAK

SEQ ID NO: 137453 - protein, 144 aa, Glycine max
  Coding DNA Sequence Number=SeqID_20675
MSSSPLWSTLYIISNVGIVLFLMEILEGDDVVEAVKVDSVADTDDEGDGVGDIGVIDDDGGVCESRKQNWRELICKWSEEKVRVHGIKGVQRGSQFEGKIYQGSNAKASGGGDANSGGSDDLMVIVVMMVVVVAAMLVAMTMTE

SEQ ID NO: 137454 - protein, 109 aa, Glycine max
  Coding DNA Sequence Number=SeqID_20676
MGCLMLMSDGDDAELSSKLRAILGNYQQQGFEVMYDENAEEVKELGGGEVQREGVDKVMQAPLELVGLGSSSSMDSFASWKINGSGMEKEEREETPLQGEDESRRSLPP

SEQ ID NO: 137455 - protein, 521 aa, Glycine max
  Coding DNA Sequence Number=SeqID_20677
  Gene Ontology: Mol. function=oxidoreductase activity; Cellular component=intrinsic to endoplasmic reticulum membrane; Biological process=electron transport
  Homolog annotation: Hit_ID=Q69NJ7; Match level="QueryCoverage=98%, HitCoverage=99%, E-value=1e-156, Identity=50%"; Hit description =Flavin containing monooxygenase 3-like
  Pfam annotation: Domain name=FMO-like; Domain location=2-511; Score= -321.7; E_value=5.1e-09; Accession=PF00743.9; Description=Flavin -binding monooxygenase-like
MERRVVIIGAGISGLVACKYVIEFGFNPIVFEVDDGVGGLWRHTMESTKLQNNKQMFQFMDFPWPPSVKEDNPSHKQVLDYVNSYAEHFSLIPYIRFNSKVIDIDYVGGESSEEMKSWELWGGNGRPFCSKGTWHIAVQHTKNLSIEVHEAEFVVLCIGKYSGFPNIPEFPPGKGPEVFNGKVMHSMDYSNLDNDTAAELVKGKRVTIIGSLKSGLDLAAECANVNGMKHPCTIIQRTAHWFLPDFNFWGIIAGFLYFNRFAELLVHKPGESFLLGLVATLLSPLRWGISRLVETTLKWKLPLKKYGMVPNHSFLEDLSTCLFGVYPDNFFDKLKEGSILIKESQSFGFCKEGVIIDGEAKPLESDIVFFATGYKGDQKIKNIFKSPVFQKYIIGHATSTVPLYRQIIHPRIPQLAIIGYAEGPSNIFASEMKSLWLAHFLDGNIELPSIREMEKDVKLWEDNLKLYGGRYYWKICIAHCAIWYHDQLCKDMKHNPRRKKGLFSELFEPYGHTDYASLTRK

SEQ ID NO: 137456 - protein, 55 aa, Glycine max
  Coding DNA Sequence Number=SeqID_20678
MEIKGNIRVLAMVLRRDRESMDLHIMLDAHCYLHAGNFEDMVESFAGINSRPADL

SEQ ID NO: 137457 - protein, 314 aa, Glycine max
  Coding DNA Sequence Number=SeqID_20679
  Gene Ontology: Mol. function=DNA binding; Cellular component=beta -galactosidase complex; Biological process=DNA integration
  Homolog annotation: Hit_ID=Q1S1E0; Match level="QueryCoverage=99%, HitCoverage=31%, E-value=1e-91, Identity=47%"; Hit description =Integrase, catalytic region
MSISVNTEPNSYAEASKFDCWIKAMQIKYKADDTVERYKACLVAKGYTQLEGLDFLDTFSPVAKLTTVRLLLALAALHNWHLRQLDVNNAFLHGDLDEEVYMTLPPGLDSSADHSLFLHFHNSDITAVLVYVDDIILAGNNLDTIAYITKLLDQAFSIKDLGTLKFFLGLEVAQTSHGIHLSQRKYVLDILSNSGMLASRPVSTPMNYSTRLTASMGTPLSETSASSYRRLIGRLIYLTNTRPDITHAVQQLSQYMAHPTSAHSQAAFRILRYLKGSPGSGIFLATHGTLQLKAFSDSDWAGCRDTQRSIIGFS

SEQ ID NO: 137458 - protein, 70 aa, Glycine max
  Coding DNA Sequence Number=SeqID_20680
MAKTGFSRRGPPILGDNNFKILEDNGRKRKMCTSRGNILERVSDHSKERSKQLATRLLGREYCLTCWWRS

SEQ ID NO: 137459 - protein, 91 aa, Glycine max
  Coding DNA Sequence Number=SeqID_20681
MSPPPLETSQSLKISSKAQQAPAILAQPEGEDGALSELAFTQHLYTTHSSSRIVHALSHQLGRLADDALSQKMSGLASSGNLHFTNLAYLT

SEQ ID NO: 137460 - protein, 392 aa, Glycine max
  Coding DNA Sequence Number=SeqID_20682
  Subcellular localization annotation: CTP_CleavageSite=56; ConfidenceScore=5.45e-01
LLSLGTDVWGANTFPVRKYNSRAFHLKVRRSRLFRFFRRFPQINVGGDSARIPFVEHASRESRVALPPKETKVVICTLCQLGASEPVDTQRLTPSSVPLSSRDDDSDDRRRYLSETNIVICTLFQPWETEPVDTQRLMSSSAPLSSRDGESDDMQRYLSETNVVICTLCQPGASELVDTHRLMYSSTYLSSRDGGRRRYPSGYPYKMISVNPDPRSQVVGRDTQVVICINTLLLSVKLKVWDGESDDSRRYPSDYPYKMIYVNPDPRSQEAGGDTQVVIQTNVVIFTLCQPWASEPVDTQRLTSSSAPLSSRDGDSDDRRRYLSDLKSGSIQRLTSSSAPFVNHGQASPLTRASEPVDSQRLTSSSTPFSSRDSGNAPSGYLYKQTSVNPDP

SEQ ID NO: 137461 - protein, 60 aa, Glycine max
  Coding DNA Sequence Number=SeqID_20683
MVLSLPNAISSQKIVAMHQYTSTDTADLVNQITHLGYTQCPKTHLWQQNSSAYSTFTNGI

SEQ ID NO: 137462 - protein, 132 aa, Glycine max
  Coding DNA Sequence Number=SeqID_20684
MRSWVRGQWIPFDADALSQFLGDPLVLEEGHQCEFSQRRNRADGFDEEAIAQLLCTPGQDFARTAAGRRVRIMRTSMTTLTQTWMTLLLNNVLPSDHNSDLPLPKCQLVYAILTRMSVHEAQVIADAIYLFA

SEQ ID NO: 137463 - protein, 630 aa, Glycine max
  Coding DNA Sequence Number=SeqID_20685
  Gene Ontology: Mol. function=protein serine/threonine kinase activity; Cellular component=cytoplasm; Biological process=protein amino acid phosphorylation
  Homolog annotation: Hit_ID=Q9XFS5; Match level="QueryCoverage=68%, HitCoverage=76%, E-value=1e-152, Identity=62%"; Hit description=MAP kinase
  Pfam annotation: Domain name=Pkinase; Domain location=38-308; Score =178.1; E_value=2.2e-50; Accession=PF00069.15; Description=Protein kinase domain
  Pfam annotation: Domain name=Pkinase_Tyr; Domain location=39-313; Score=15.6; E_value=2e-13; Accession=PF07714.7; Description=Protein tyrosine kinase
  Pfam module annotation: Pfam domain module=Pkinase::Pkinase_Tyr; Domain location=38-308::39-313
MELPDTISTAMYKGRFCTSSGVKSQLGYVETDPSGRYGRFRDVLGKGAMKTVYRAFDELLGIEVAWNQVKLGDAFHSPEQLQRLYSEVHLLKHLNHDSMMIFYGSWIDVSNRTFNFVTELFTSGTLREYRQKYKRVDIRAVKNWARQILSGLEYLHSHNPPVIHRDLKCDNIFVNGHQGRVKIGDLGLAAILKSSQHAHSVIGNTSCSILAVKISTPEFMAPELYEEKYNELIDIYSFGMCMIEMLTFEFPYSECANPAQIYKKVTSGKLPEAFYKIENLEAQEFVGKCLTNVSERPSAKELLLDPFLAMEQLEIPLPPSIPALFTNKSFKLNCPAPIPSDHRDQTKNADMTISGSINEENNTVFLKVRISDITGHTRHVFFPFDTLKDTAIQVAMEMVQELEISHLEPLEIAVRIDHEVSALVPTWRDRVKCHHQRQYSFNYEEDEDVNNHHPFFLSSSPSSPRGSGHMSASNSFKTRVRGNHYPFTQEWPQDDPFMVNDDASPQASLNSFKCSSFQFLDPGQEDEHAPTDATERTKKCTPLSYRTEEPEPNYTKPFNYCPPRMDSCSCGCSRFGSSHAYPRLTRIRSCPHERRSQQQLLQRSMMLEEMYKYKRRFFNNVGAVENLVSR

SEQ ID NO: 137464 - protein, 105 aa, Glycine max
  Coding DNA Sequence Number=SeqID_20686
MEHCIFYVQTERGPLSFDAGPENIVVTVGKQLEGWSHGVFKCVPGEMIFMPSFQSSPASFSIELATLAPTIADKLPSFSVQNLEYTYSNSSPLSFVSSSLGTDRS

SEQ ID NO: 137465 - protein, 101 aa, Glycine max
  Coding DNA Sequence Number=SeqID_20687
MVIFLYIALVREEKLECLTQEIKGIILFQVGREKFLIPWLLVVNRKSTEVPMIEVDLRYSGNDLHGVTAKVVDMPHHCMLFFSNHIFKNIKFYTYRLVTGL

SEQ ID NO: 137466 - protein, 61 aa, Glycine max
  Coding DNA Sequence Number=SeqID_20688
  Subcellular localization annotation: CTP_CleavageSite=49; ConfidenceScore=5.10e-01
MAHKPRQDFSVSKPRHFSDSSLSPSRCHFLLLHSPLKLQAKLQPLAIISAPNRERRAFPES

SEQ ID NO: 137467 - protein, 68 aa, Glycine max
  Coding DNA Sequence Number=SeqID_20689
MSGFTRNSPQISASPHQLDLAPYASEPYNAQWNAPGLLRDKHTLRSSRILGEMEVVFVIGSAVDRLCG

SEQ ID NO: 137468 - protein, 455 aa, Glycine max
  Coding DNA Sequence Number=SeqID_20690
  Homolog annotation: Hit_ID=Q9LUA7; Match level="QueryCoverage=45%, HitCoverage=65%, E-value=5e-18, Identity=30%"; Hit description =Arabidopsis thaliana genomic DNA, chromosome 5, P1 clone:MIF21
  Pfam annotation: Domain name=DUF868; Domain location=142-454; Score =78.1; E_value=2.7e-20; Accession=PF05910.3; Description=Plant protein of unknown function (DUF868)
  Pfam annotation: Domain name=efhand; Domain location=24-52; Score =17.3; E_value=0.054; Accession=PF00036.22; Description=EF hand
  Pfam annotation: Domain name=efhand; Domain location=64-92; Score =28.3; E_value=2.8e-05; Accession=PF00036.22; Description=EF hand
  Pfam module annotation: Pfam domain module=DUF868::efhand::efhand; Domain location=142-454::24-52::64-92
MSVAVVNSFTITEFVNDKAKFDGFVNEWFARIDENGDGKLSRDKIRGRLGMLLPFGSELQPQQENEEIFKRFDEDGNGALDLKEFKALMTEIMNAAARSIGGSPVIVLLGKDSLLMKAVQHELATRSSHSYQPNTPSSSSTTQVPQNLVTCIYQTQLCNSSTHLTLTWSRTLLSHSLTIYAPHTFSITIPLNPSTFSFFRTRPGSKSIYLTRPNKRSQKIKLHWDFSEAIFSTRNSAEPESRFYLAVCCNGRVEFFLGDLVLVLPMQLSPHQPSDQALVSRREHVFGSTSYESRGEFVGSKREIEIELFSGEELRVKVDGQVCLVVKRLTWKFRGNEKIFIDGVEVEFFWDVLNWVFNSENGNGNNGYGVFVFQVGDGGAVWPEMVGPEKKLMKKRLVGPTMVPSVVTTSPSSSSVLQWTEESSDGGRSSCSSSTRSCGSSNGGFSLLLYAWRRD

SEQ ID NO: 137469 - protein, 159 aa, Glycine max
  Coding DNA Sequence Number=SeqID_20691
MNRESETPQILKIAMSGVTELLRLFSPSSNQTRLEKHRDEFPASSVDDVLRIIQSDHHNAYFLTGNFTSSIYAENCIFEDPTIKFRGRELYARNLKLLVPFFDCGSIILQKIDKMMEISLFSGSWESGAINNLISTNSFMNGATPPQPKEGLSTQAEGT

SEQ ID NO: 137470 - protein, 82 aa, Glycine max
  Coding DNA Sequence Number=SeqID_20692
MLKSSLSEPDSLSEANPLSVEESSPSAKKNPREYKSESNTLSAQPARPVKLLSLLALSASTFAQRPFTNSQSTRHYSLSVPS

SEQ ID NO: 137471 - protein, 161 aa, Glycine max
  Coding DNA Sequence Number=SeqID_20693
  Gene Ontology: Mol. function=nucleic acid binding; Cellular component= intracellular; Biological process=regulation of transcription
  Homolog annotation: Hit_ID=Q1SU87; Match level="QueryCoverage=73%, HitCoverage=70%, E-value=6e-47, Identity=78%"; Hit description=Zinc finger, C2H2-type
  Pfam annotation: Domain name=zf-C2H2; Domain location=50-72; Score =18.7; E_value=0.021; Accession=PF00096.16; Description=Zinc finger, C2H2 type
  Pfam annotation: Domain name=zf-C2H2; Domain location=98-120; Score =19.7; E_value=0.01; Accession=PF00096.16; Description=Zinc finger, C2H2 type
  Pfam module annotation: Pfam domain module=zf-C2H2::zf-C2H2; Domain location=50-72::98-120
  Subcellular localization annotation: CTP_CleavageSite=35; ConfidenceScore=5.06e-01
METTQNVLTWEKDTSKFRGTFMFRVVQRGRELKSRKSNKTQQKSFGSVEFECKTCNRKFSSFQALGGHRASHKRQKLEGEELKEQAKSLSLWNKPKMHECSICGLEFSLGQALGGHMRKHRASLNEGFPIIPSIDQVIAKIPVLKRSNSTRVMCLDLELHL

SEQ ID NO: 137472 - protein, 167 aa, Glycine max
  Coding DNA Sequence Number=SeqID_20694
MTCDNRSNFVGTTHRHADDLHSLSATHPFCCVFVVSDHSSLVKLRRPHLAPLPVAIARSVVRSSPFLSIIFLIFFPDLRLAPPRSEIRSSLGVLLFRLVLVGNSIDVVTARSRPAPRCRLHTIASGTAFPLFVVENLAGKMSLLPRRKCSNEGRIQLSREEPGGGGR

SEQ ID NO: 137473 - protein, 777 aa, Glycine max
  Coding DNA Sequence Number=SeqID_20695
  Gene Ontology: Mol. function=exonuclease activity; Cellular component= intracellular; Biological process=regulation of transcription, DNA -dependent
  Homolog annotation: Hit_ID=Q9FQ04; Match level="QueryCoverage=98%, HitCoverage=77%, E-value=0.0, Identity=66%"; Hit description=XRN4
  Pfam annotation: Domain name=XRN_N; Domain location=1-256; Score =595.5; E_value=4.7e-176; Accession=PF03159.8; Description=XRN 5'-3' exonuclease N-terminus
  Pfam annotation: Domain name=zf-CCHC; Domain location=263-280; Score =30.3; E_value=6.8e-06; Accession=PF00098.13; Description=Zinc knuckle
  Pfam module annotation: Pfam domain module=XRN_N::zf-CCHC; Domain location=1-256::263-280
MGVPAFYRWLADRYPLSIADVVEEDPAVGDDGVPFPIDASKPNPNGMEFDNLYLDMNGIIHPCFHPDGKPAPATYDDVFKSIFDYLDHLYTLVRPRKLLYLAIDGVAPRAKMNQQRSRRFRAAKDAAEAEAEEERLRKEFQSEGKVLSSKDKPETSDSNVITPGTQFMVALSVSLQYYIQTRLNHNPSWRNTKVILSDSNAPGEGEHKIMEYIRLQRNLPGFNPNTRHCLYGLDADLIMLSLATHEVHFSILREVVTLPGQQDKCFLCGQAGHFAADCQAEDFDTPDDSPIHKKKYQFLNIWVLREYLQFELEIPNPPFEIDFERVVDDFVFLCFFVGNDFLPHMPTLEIREGAINLLMHIYRKEFTAIGGYLTDAGEVFLDRVQRFIQFVTVHEDQIFQKRVRIQLAAENNEEMRARARGEMPGEPRASLLDKFLEHVLESTIIAFLNCQSNSSGVPKHTLRVKLGEPGYKERYYVEKFGVSNLEEIDKIKKDIVLKYVEGLCWVCRYYYQGVCSWKWYYPYHYAPFASDFKDLPDLEINFFPGEPFKPFDQLMGTLPASSSSALPKKYRDLMSDPSSPIFHFYPADFEIDMNGKRFAWQGVAKLPFIDEKKLLAATRRIEDTLTEEEQLRNSVMLDLLYVNRAHNLAAHILSYYHVCSQLPPHERCVQPIDTNASGGMNGYLWLCERNVFSSVISSPISGLQDIEYNQVLNITFLNPRRHDHIPKPPDGVVIPKKVLKAIDIKPFPVLWHEDNIGQRQQARESMRTEPNNGIATK

SEQ ID NO: 137474 - protein, 80 aa, Glycine max
  Coding DNA Sequence Number=SeqID_20696
MSLSICGKVRGEGAAADGGLLGVADAHGDDNSRVPQQIREKWGFERENIELGNELGRWGHNGSDFHQRRRRVEKGKKVLS

SEQ ID NO: 137475 - protein, 303 aa, Glycine max
  Coding DNA Sequence Number=SeqID_20697
  Gene Ontology: Mol. function=diaminopimelate epimerase activity; Biological process=lysine biosynthetic process via diaminopimelate
  Homolog annotation: Hit_ID=Q9LFG2; Match level="QueryCoverage=75%, HitCoverage=62%, E-value=7e-88, Identity=67%"; Hit description =Diaminopimelate epimerase-like protein
  Pfam annotation: Domain name=DAP_epimerase; Domain location=62-184; Score=161.5; E_value=2.2e-45; Accession=PF01678.10; Description =Diaminopimelate epimerase
  Subcellular localization annotation: CTP_CleavageSite=35; ConfidenceScore=5.78e-01
RRTLASVNSLSPRSTRSTLPTPQRTFKYPNSRLVVSSMSTETAVKTSSASFLNRKESGFLHFAKYHGLGNDFVLIDNRDSSEPKISAEKAVQLCDRNFGVGADGVIFVLPGISGTDYTMRIFNSDGSEPEMCGNGVRCFAKFVSQLENLHGRHSFTIHTGAGLIIPEVLEDGNVRVDMGEPILKASDVPTKLHANKDNAVVKSELVVDGVIWHVTCVSMGNPHCVTFSREGSQRGAGATLACGTGACATVVAAVLEGRAGRRRVATIALLGHFCTDDSKVPQKFLKYPQLSLRFFGVLTMFLG

SEQ ID NO: 137476 - protein, 75 aa, Glycine max
  Coding DNA Sequence Number=SeqID_20698
MGNHRHFLPPYGLYASSTAIVRNLFSLSSPAGITRENNTNKKLVYGAKAEAAIAIGFDDIIADALKDTVFMRSST

SEQ ID NO: 137477 - protein, 340 aa, Glycine max
  Coding DNA Sequence Number=SeqID_20699
  Pfam annotation: Domain name=DUF1635; Domain location=47-293; Score =60.2; E_value=6.9e-15; Accession=PF07795.2; Description=Protein of unknown function (DUF1635)
  Subcellular localization annotation: CTP_CleavageSite=39; ConfidenceScore=5.41e-01
MGDTARGSSQKQLVLNPKSSSHFPNSDTANPLFGCVFASLNMITENKSNEDINHRLVCAKLELIAAKMEANAKIKKYEETVKHLYKLLKKVCQERDEARDQLQLIRNFQASTPAETSSTVPQVDHHACLQYKTKPSLNSTKVSYSSSKVFSNHPCDLSLSSLLPNEKHSSTRIAEPSNLTLPKQPNHMKADIGASRDNNNNMVDGASLVFDKLVCGKPLPQKGRLLQSVTEAGPLLQTLLVAPAPQWQNPPSLSSSGLTLGTQDNSSSTTNTDDKASVNPNGFIPTSLSLAFPGNSHGPSQMSSASGFGLALKNEQVSYEDMDSNMMHNHALTGKKRKLL

SEQ ID NO: 137478 - protein, 122 aa, Glycine max
  Coding DNA Sequence Number=SeqID_20700
MVGSETPNWGENSQFETLVWDRMRSELKQRGGEGGGWREKETEKEQSLTVVNRMENVANPWLGVGNVASGYQGRSCGDVMVFGHDGGWADEGHTLANLELGTEMVAYDLGAVVMGWMGVRIR

SEQ ID NO: 137479 - protein, 325 aa, Glycine max
  Coding DNA Sequence Number=SeqID_20701
  Gene Ontology: Mol. function=protein serine/threonine kinase activity; Cellular component=nucleus; Biological process=protein amino acid phosphorylation
  Homolog annotation: Hit_ID=P51566; Match level="QueryCoverage=94%, HitCoverage=45%, E-value=2e-89, Identity=85%"; Hit description =Serine/threonine-protein kinase AFC1
  Pfam annotation: Domain name=Pkinase; Domain location=1-313; Score= -45.4; E_value=7.4e-06; Accession=PF00069.15; Description=Protein kinase domain
MVSTVMHDLCLIHTDLKPENILLISSEFIKVPDYKFLSRNTKDGSYFKNLPKSSAIKLIDFGSTSFEHQDHSYVVSTRHYRAPEVILGLGWNYPCDLWSVGCILVELCSGEALFQTHENLEHLAMMERVLGPLPPHMVVRADRRAEKYFKRGTRLSWPDSSTSRESMRAVWKLPRLPFYVLLIFFFHLLATVCNGHFLLHALWPLYFRKENHVDIACDRCITGWIDQMHVKVFDLVIMLELDLQFCSINMTEPEMIFNAIPYLYNFSNIPLQNLIMQHVDHSAGDLIDLLQGLLRYDPSERLKAKEALRHPFFFTRDTKRYGYPL

SEQ ID NO: 137480 - protein, 124 aa, Glycine max
  Coding DNA Sequence Number=SeqID_20702
MGIRCGAEMDIVSLVSHLNSQHMLAFVLDIRCVKIYYLISISIEYWVHPIEDLLVLPPPLNNSDSYFLEANLGEIAYKILVENCRSLELAMRGSKVCVGANVVLVIDFGGSKQGEGNTETQSKA

SEQ ID NO: 137481 - protein, 95 aa, Glycine max
  Coding DNA Sequence Number=SeqID_20703
MTMQVVSRRGERKEGEEEALMEGNLNDDEGKWGGGKERKEREEDKGVGNGEGWRNLGRESMGKALEEGEVSVNIDLGTYCNTHKEEEEEEEEALG

SEQ ID NO: 137482 - protein, 94 aa, Glycine max
  Coding DNA Sequence Number=SeqID_20704
MTHVHACDVRSLEGVREGEQGVLRGIHEEQSRESFGERDKAKDPERGFRFFRRTSLDFRRNKINQVNAGKDANDGWERTSEARETKTNTDLQGV

SEQ ID NO: 137483 - protein, 131 aa, Glycine max
  Coding DNA Sequence Number=SeqID_20705
  Gene Ontology: Mol. function=binding; Cellular component=membrane; Biological process=photosynthesis, light reaction
  Homolog annotation: Hit_ID=Q9ZUS6; Match level="QueryCoverage=96%, HitCoverage=38%, E-value=1e-43, Identity=63%"; Hit description =Chloroplast lumen common protein family
  Pfam annotation: Domain name=TPR_1; Domain location=34-67; Score =10.0; E_value=0.35; Accession=PF00515.18; Description=Tetratricopepti de repeat
  Pfam annotation: Domain name=TPR_1; Domain location=68-101; Score =4.6; E_value=1.5; Accession=PF00515.18; Description=Tetratricopeptide repeat
  Pfam annotation: Domain name=TPR_2; Domain location=34-67; Score =18.8; E_value=0.019; Accession=PF07719.7; Description=Tetratricopepti de repeat
  Pfam annotation: Domain name=TPR_2; Domain location=68-101; Score =14.5; E_value=0.4; Accession=PF07719.7; Description=Tetratricopeptide repeat
  Pfam module annotation: Pfam domain module=TPR_1::TPR_1::TPR_2::TPR _2; Domain location=34-67::68-101::34-67::68-101
MATAQSNEPLKSLLKRVEEAIEVCKKQKKDSDVRDFRLLIAQIKVMEGDYTEALKAYQELVKEEPRDFRPYLCQGIIYTLLRKKDEADKQFNKFRRLVPKDHPYKDYFEDNMFATKFFSQKLEREGAGARG

SEQ ID NO: 137484 - protein, 838 aa, Glycine max
  Coding DNA Sequence Number=SeqID_20706
  Homolog annotation: Hit_ID=Q10N70; Match level="QueryCoverage=99%, HitCoverage=88%, E-value=2e-28, Identity=28%"; Hit description =Expressed protein
MKKLLAEELSQETEPKRRAPGVIGKLMGLDGFPLQLPTYKHHKGVSENNTKGTTQAVKTRSSGTLSGGRLSRRNSKHQQEFKDVFEVSEIPKIDSCRYSLQGSVGLKITNAGMSFVEQKLMDAKRRATYQDLQSSQDSHDTLEILDSNHDLQQKYFKRPDSLFKRHLDDLQAAPSQSHFGHVEGTKLSNIVNCEHNDFSRKPDKEMKWLNYNRSNQKHDDGYSCHFVRRHAIHSSPKSSRNQFKGKNVPNAVPTRIVVLKPNLEKVQSPTKIGSSPCSPYAFLSQCGKHAEFSDIRFRETGLNQRKNLTANAWHSKQNSLESREIAKEITSQMKNNLNIGSMIFSSSRFRGYTWDDSSCSLSGNQSPDESEVTPATLEKSFEICNTISPSSCFSESFVSREAKKRLSERWKMSLKFQQGNSISRSGTLAEMLAIPNKEMKASKFDSISCGEGSHDKISSNGKPAGWVEPLGVSSKDGYIGSLPRSKSLPASSTTFGSPRTILHHEALCDDRFMMPKEASKQEKKKVVKLLDQRPCTNTKRSKSGHKKCSPYLNTIQNKVKINLEENLPKQEVLIAESLAEILRDTSAVTEEVVGVTNENAVGSSESSIKVLPNPDPTMGAWDYPKVLVVWFSQGLRMQLQLLKLESEDFVEEPVLIQSDEDGMEASTGISEDSGLLQTTDSWESSYTIDVLYESGIDRAQPDAFLEVGDSREYPVSLSVFDELEKRYSDWTNCSRSERRLLFDRINLGIISIYEQFTSVQPWVSSTTSLNLCSKLIKNGLQDCLNMMLGSQGKAKYTAMGKVLVSELQWLSLRDDIDGIGREVESLLLDDLVAEIAVT

SEQ ID NO: 137485 - protein, 108 aa, Glycine max
  Coding DNA Sequence Number=SeqID_20707
MQEVALLENKNDFSKAKTNTFNKNKGNFFDQIKPRWAKTNYFRPFVSDPSNYTHFHTAPPHFASCTSLHYGKPQEAKYGGAGSSSLTFVMASLVNLQFHGPTHKIVPI

SEQ ID NO: 137486 - protein, 94 aa, Glycine max
  Coding DNA Sequence Number=SeqID_20708
MARKVARNMRSSRQRKETYNDHHSRVASLSSVYLDIPLNDKKWFTEAWVRRLKNLAWFDRVEDDPLWDFGADITPKYMGDDMILLLGLTDAKAE

SEQ ID NO: 137487 - protein, 281 aa, Glycine max
  Coding DNA Sequence Number=SeqID_20709
MESSLRTGHRLAWVQCWGISLLAWETTYIQKILAAIGDMVEVDDDVDKVRKVDRAKVMEECSQSTETCHCRRRSALWSSDEIESDESCCGTPVSGTRYASYRDDEAQVITLPTNMADPRRTSFVTNAGRDDHGTAALLSGLMTQNRPLGNHINPRTQHHSPTRGRTATIADQDDEQVARHGLVAKKTNPVQERCKKNGVQVVGSDDSFEEESFVHKMGNIAAGKEDDVAGAQAFSGEKTRDLQLDGGEGNSGLGFPVHTPPKAKGHFSTSPQIKKNALSSD

SEQ ID NO: 137488 - protein, 157 aa, Glycine max
  Coding DNA Sequence Number=SeqID_20710
EDWGKGGDRGTGRRSDSDVELDVGPPELVSEGDHALGEEVGEEGFEPVLGIVVNVDEKAKMPFILSYKKRTVIRPYESLFILHFHTLFLLLPLFFFFQTASSPSFPHVVVGCPWLLVAAFLLVGAGASSYCGGFVLLIAFEVNGYSSSCGASSSLLW

SEQ ID NO: 137489 - protein, 56 aa, Glycine max
  Coding DNA Sequence Number=SeqID_20711
MRILDGHTPETGMDNSKATIEQIGGTRRTYHPSISHDFSEDVTEKELWYHFKKWGD

SEQ ID NO: 137490 - protein, 108 aa, Glycine max
  Coding DNA Sequence Number=SeqID_20712
  Homolog annotation: Hit_ID=Q1SMF0; Match level="QueryCoverage=74%, HitCoverage=15%, E-value=6e-08, Identity=38%"; Hit description =Tetratricopeptide-like helical
MVEDQWMYEGIMPEEVGMDENEEEYGVFDKREDVLWWARSVACENGFVAMIVRSDINTGSRGRTSFVLIGCERSDEYRCRKKEFVRRDTGTRKYGCPFKLRGKPVVGG

SEQ ID NO: 137491 - protein, 90 aa, Glycine max
  Coding DNA Sequence Number=SeqID_20713
MGFEKWARPKMHNKKPGQGDPTQPAIMQQGWKTLVASHKEQRGQYENPHEGWHAACGTIGAKSSGASPSQGQWRHDNDGSRSFTVVQTNK

SEQ ID NO: 137492 - protein, 296 aa, Glycine max
  Coding DNA Sequence Number=SeqID_20714
MDKTKTMGVKNPSYSSTLESETSHSPPPKNQDNGKSKGIEVSSKFDLEATMTITPYRAKSIMIVSPRKRCSKKEGKLGKNRKSDKRLTEKFDNSWDNKKQQLPIEGHLNETKILISKQLLADLLVVPIYSSRLYDDCFDIMGLKKIKIMNKFLEDKDDDFNSTTLTSFGRIAHWISMHSVLPRAHFKKMNLRMMRFYLGGKECYSSKAEPLTWYEESRTRDPYPFSLISSKVKRDHFEEAQNEEQKELSPQHAKEESEEDPSKKPLDYGSFRETSEQFLRKRRRMRKTIISIRIRC

SEQ ID NO: 137493 - protein, 103 aa, Glycine max
  Coding DNA Sequence Number=SeqID_20715
MSPLPSKDNQVHRHAETIKSSLPSRDIQVRWHEETINVIHFRCFQRLSESFVETSNVSFTLQDFKVSLNGLSLVAGQMPLGPPGQVELAWVSKLLKEEASSLP

SEQ ID NO: 137494 - protein, 71 aa, Glycine max
  Coding DNA Sequence Number=SeqID_20716
MAKKWRFGSKGLRKVGHDDCNPGKVGNRDYTLSKGIKGVRMKIHKIQVPKSFEGFCCEKTGKELSEKRKPS

SEQ ID NO: 137495 - protein, 262 aa, Glycine max
  Coding DNA Sequence Number=SeqID_20717
  Gene Ontology: Mol. function=protein binding; Cellular component =cytoplasm; Biological process=apoptosis
  Homolog annotation: Hit_ID=Q9LGR1; Match level="QueryCoverage=99%, HitCoverage=98%, E-value=5e-83, Identity=58%"; Hit description =Putative phosducin-like 3
  Pfam annotation: Domain name=Phosducin; Domain location=11-239; Score= -83.7; E_value=0.00013; Accession=PF02114.7; Description=Phosducin
MGDYHFVYKDLEGASTQWDDIQRKLGNLPPKAPAFKPPPFTPDASDDQPKDKTWIDSKTSEELEDLEDDLDDDRFLQEYRVSIKWVGFVFAQGGGGWIKKKRLAEMQEAAKVLRFGSVILISGSDFVREVSQAPSDVWVVVILYKEGIPECGLLMQSIEELAVRYPSTKFVKIISTDCIPNYPDRNLPTLLVYNNGAVKGNYVGLHSFGRRCTPEGVALVLCQSDPVLNDGHNGNEAIIEGVRKRFIEKVVADHEEGDDDYS

SEQ ID NO: 137496 - protein, 127 aa, Glycine max
  Coding DNA Sequence Number=SeqID_20718
MQFTTPFHNDRNIIVVPSFYHQQWAPEYPDFVYIRYDGTTYQIRLRQHLDKIYFADRLNQFRKDLVIYESVTINFLACDNKSIFDLHFSLSLEHQTCGRPWPSIKPYTPMPHPIRALCPDVLQHMVP

SEQ ID NO: 137497 - protein, 47 aa, Glycine max
  Coding DNA Sequence Number=SeqID_20719
MDRRKRKPKYLVKKESHNFGNLDDDESELIVVPVEVEDESKLMVAVV

SEQ ID NO: 137498 - protein, 104 aa, Glycine max
  Coding DNA Sequence Number=SeqID_20720
MARAPDNIKSINGSKEALKLAIRITDLWFVGTPNRSEQAEMVIIDSHEGDIDLNVSPLALDKLLGYVLAFKIKVQPKFNNVVVLRYSNDLDLINVVVDMLPDAE

SEQ ID NO: 137499 - protein, 148 aa, Glycine max
  Coding DNA Sequence Number=SeqID_20721
MAPKKLPTKRSKKHATREGSSAAPQVEVDFDGHRERLVQLRDEDYVEFQEEIAQRQWTQLVSPMAKYDPEIIMEFYANAWPTEEGFKDKHSWVRDPMRMPLTSFWGVHRSWKKASAVSLARGGAKPQASTRRLLASCYAFRGRTLPGA

SEQ ID NO: 137500 - protein, 205 aa, Glycine max
  Coding DNA Sequence Number=SeqID_20722
  Gene Ontology: Mol. function=structural constituent of ribosome; Cellular component=ribonucleoprotein complex; Biological process =translation
  Homolog annotation: Hit_ID=Q7EYE3; Match level="QueryCoverage=75%, HitCoverage=66%, E-value=3e-59, Identity=72%"; Hit description =Putative ribosomal protein I
  Pfam annotation: Domain name=Ribosomal_L13; Domain location=28-158; Score=101.7; E_value=2.2e-27; Accession=PF00572.8; Description =Ribosomal protein L13
MKMVTAFTGNMKKAAAGLRRINLDGLRWRVFDAKGQVLGRLASQIATVVQGKDKPTYTPNRDDGDMCIVLNAKDICVTGRKLTDKVYYWHTGQYYPVYFDIRSLTLKDQMAKDPTEVIRKAVLRMLPRNKLRDDRDRKLRIFPGSEHPFVDRPLEPYVMPPRSVREMRPRARRAMIRAQKKAEQQQQKADGMKKGKNGEAQEESA

SEQ ID NO: 137501 - protein, 45 aa, Glycine max
  Coding DNA Sequence Number=SeqID_20723
MPKEPVATQMSSLKELCDYAKCEEEGVLRVHYHGFRKQYSSGFGE

SEQ ID NO: 137502 - protein, 138 aa, Glycine max
  Coding DNA Sequence Number=SeqID_20724
MACEHRWIFNLHFTPPLEQQACGRSLLAARMHVWTLELTQSLLGDPKPLVLPPLATIHLPSCGFHMTILRRFDPPLQWPVLPVDLGFHDKCVAQPWYRFLAEGDFVHGDELSFYYRPFDDIWEVVIRKQRNWGDSDSD

SEQ ID NO: 137503 - protein, 434 aa, Glycine max
  Coding DNA Sequence Number=SeqID_20725
  Homolog annotation: Hit_ID=Q6K5F5; Match level="QueryCoverage=70%, HitCoverage=98%, E-value=7e-85, Identity=44%"; Hit description =Mitochondrial transcription termination factor-like protein
  Pfam annotation: Domain name=mTERF; Domain location=153-422; Score =90.1; E_value=6.8e-24; Accession=PF02536.5; Description=mTERF
MKNNGTDGSLNLEVVSPTLLVAEKEEAKAVLTLFLKKQGLSNAIATRTSKKSDHFIDHLVSRLHSKHKSWYLAGRELTTLEIRDTLIPYLESLFEEHGDILVNVVENYPNPPGKDKSAVPIPPSNPVSDSKKLKAVSRVSETDPDGGNLRPHIVYLMDLGMDIEQIRSITRRFPSFAYYSLEGKIKPVVEFFLELGVPKENILTILTKRPQLCGISLSENLKPTMKFFESLGVDKNQWPKVIYRFPALLTYSRPKVMESIDFLLELGLSEESIGKILTRCPNIVSYSVEDNLRPTAKYFHSLGVEVGVLLFRCPQNFGLSIENNLKPATEFFLERGYTLEEIGTMISRYGALYTFSLTENLIPKWDFFLTTGYPKSELVKFPQYFGYNLEERVKPRFTIMKKYGVKLLLNQVLSLSSSNFDEALKKKMKKMQVS

SEQ ID NO: 137504 - protein, 199 aa, Glycine max
  Coding DNA Sequence Number=SeqID_20726
MAVNHSLGGGRHSDELSFLYAICGSRGGFLGNIISNFGSGHGYEPGMGLDWNGDGVASLVEFKKSHGRFKLGYKPICRCEEKCPRKDGVGWMCEGRVAMVHDKVPQETSNWVRSCPPEFELGNWQIVEQPRISVANTIFVAIKRYKFDNESCEGTNTEDPDVDFEQIVNQAKDEEDEDRGLPPELKRMVEQEDREVKPH

SEQ ID NO: 137505 - protein, 158 aa, Glycine max
  Coding DNA Sequence Number=SeqID_20727
  Gene Ontology: Mol. function=endonuclease activity
  Homolog annotation: Hit_ID=Q1SQF7; Match level="QueryCoverage=64%, HitCoverage=44%, E-value=1e-14, Identity=40%"; Hit description =Endonuclease/exonuclease/phosphatase
MSFLSWNYRELGNPYVIPILHDLVQTEHLDFIFLSRTLVGSGRMEEIRNQLSFDSCFAIDPIGRSGGLAKLRRNPFDWQLINFSSNFISVKVHREGKPVWCLTGFYAIEEKLDLALATTRYGAMGKVNSKSNLEQKLMMYMLKWASAHVERRAGNNSV

SEQ ID NO: 137506 - protein, 82 aa, Glycine max
  Coding DNA Sequence Number=SeqID_20728
MREKERVLGGGEGKMKLRGRESTETIVSLKPDLTCKEVPTEGCKGYRMREENDLLAGLLLVFYNCLEIKEVRLFEPETDEKY

SEQ ID NO: 137507 - protein, 32 aa, Glycine max
  Coding DNA Sequence Number=SeqID_20729
MARKPRQNFSVSKPKGKVGPSSSTQMETCGIA

SEQ ID NO: 137508 - protein, 94 aa, Glycine max
  Coding DNA Sequence Number=SeqID_20730
MTVATLFGKLREYELELGRLKDEEEVNKNNKGLALKTRTSLKSHLKGVVYRLDGSTKESHFTYSNVVLLLPQTKVSDHHRYQSYGTKIARMSLL

SEQ ID NO: 137509 - protein, 138 aa, Glycine max
  Coding DNA Sequence Number=SeqID_20731
MEEVAIVVNYDGDVVSTSKEVLFECPNSPKFIKISEEMSFVALRKVVIDVIEGGRRLFEGFGCVEFGCMELKDNNQVWKMFFIFLQISSKGLIELYSVVGRSPEKILVLLCKPRKPRLAKVIIALMCGLTTRTSSNED

SEQ ID NO: 137510 - protein, 684 aa, Glycine max
  Coding DNA Sequence Number=SeqID_20732
  Gene Ontology: Mol. function=protein kinase activity; Cellular component=mitochondrion; Biological process=protein amino acid phosphorylation
  Homolog annotation: Hit_ID=Q1SNH1; Match level="QueryCoverage=99%, HitCoverage=95%, E-value=0.0, Identity=71%"; Hit description=Protein kinase
  Pfam annotation: Domain name=LRR_1; Domain location=111-133; Score =6.5; E_value=17; Accession=PF00560.23; Description=Leucine Rich Repeat
  Pfam annotation: Domain name=LRR_1; Domain location=135-156; Score =16.8; E_value=0.079; Accession=PF00560.23; Description=Leucine Rich Repeat
  Pfam annotation: Domain name=LRR_1; Domain location=158-177; Score =5.6; E_value=25; Accession=PF00560.23; Description=Leucine Rich Repeat
  Pfam annotation: Domain name=LRR_1; Domain location=179-201; Score =12.1; E_value=1.5; Accession=PF00560.23; Description=Leucine Rich Repeat
  Pfam annotation: Domain name=LRR_1; Domain location=203-226; Score =14.7; E_value=0.34; Accession=PF00560.23; Description=Leucine Rich Repeat
  Pfam annotation: Domain name=LRR_1; Domain location=227-246; Score =7.6; E_value=11; Accession=PF00560.23; Description=Leucine Rich Repeat
  Pfam annotation: Domain name=LRR_1; Domain location=251-270; Score =5.3; E_value=29; Accession=PF00560.23; Description=Leucine Rich Repeat
  Pfam annotation: Domain name=LRR_1; Domain location=39-61; Score=5.1; E_value=32; Accession=PF00560.23; Description=Leucine Rich Repeat
  Pfam annotation: Domain name=LRR_1; Domain location=63-85; Score =14.5; E_value=0.38; Accession=PF00560.23; Description=Leucine Rich Repeat
  Pfam annotation: Domain name=LRR_1; Domain location=87-109; Score =7.7; E_value=11; Accession=PF00560.23; Description=Leucine Rich Repeat
  Pfam annotation: Domain name=Pkinase; Domain location=402-667; Score=- 9.4; E_value=5.3e-08; Accession=PF00069.15; Description=Protein kinase domain
  Pfam annotation: Domain name=Pkinase_Tyr; Domain location=402-667; Score=-55.5; E_value=4.6e-09; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=111-133::135-156::158-177::179-201::203-226::227 -246::251-270::39-61:...
  Pfam module annotation: Domain location=:63-85::87-109::402-667::402 -667
  Subcellular localization annotation: CTP_CleavageSite=36; ConfidenceScore=5.25e-01
MGEKSEKPPMFNGFADPNQTLSMNFSIDSFFTTLTRLTSLRVLSLVSLGIWGPLPDKIHRFSSLQVLDLSSNFIFGAIPQKLSTMVKLHALTLDDNYFNTTMPDWFDSLSNLNILSVKSNGLKGSFPSSLCKIKTLEVISLSHNELSGELPDLGSLTGLHVLDLRENHLESELPLFPKSVVTVLLSNNSFSGDIPKQFGELDQLQHLDLSSNHLSKTPPSTLFSSPKISYLNLANNVLSGALQDKLSCGGKLGFVDISSNKLSGGLPSCLANTTDGRVVRYAGNCLSLNSQNQNSGSYCRESSSGWKNLKKWKVAAAMAIIVGLVLVVLVSGVFLWKKYHSRKKTGQEVLLKIVHDNSTTGVPSEILANARFISQTVKLGTQTTSTCRHFSIEELKEATKNFDLSTYIGQGSIGKLFKGKLENGSYVAIRSLALSKKCSIQNLRAKLDLLSKLQHPNLVSLLGHCIDGGGQDDPNSHKLHLVYEYVPNGNYRTHLSEFSVDKALKWSDRLTILIGIAKAVHFLHTGVIPGCFSNQLKTKNVLLDEHRIPKLSDYGMSIITEEIENFEAKGEKPKPCPRTKADDDVYNFGFILFESLVGPIACDKGETFFLNEKASFGSQDGRRKIVDPIVLTTCSQESLSIAISITTKCISPESSFRPSFEDVLWNLQYAAQVQATTDADHKSD

SEQ ID NO: 137511 - protein, 256 aa, Glycine max
  Coding DNA Sequence Number=SeqID_20733
MIHRSVTCPPAFARFILDPRRIRREVYFDVICNASDCQLLDEFYTTTLYSTSWLIRTFHQSEPSIGSMTVPINQHETFQRSLSSLMWFLEKFPEGHPSHNYYFKPNMFNYGVLNLIFAQPLDPPLSGVIHRGVRCSPASAQIVLKPHCTRRDICSSTICNTPNYRLLNESLTTTLHTVTLHSTSLLIRTFHQSELSIGLSLTITNTKLEARNSMIQCIDLSQELNLCLFKIHFKEQALFFLPLRLIHYFISHNHAM

SEQ ID NO: 137512 - protein, 109 aa, Glycine max
  Coding DNA Sequence Number=SeqID_20734
MTKHAEKSCVDLWGQSLILKCHNVRAIKKLTVKGVIFMHSKVLRMMVKKVVLEYLSRVKNSKDSLKLIYMMKNAPSKYLVLTKNKATKPHIEDSTSLTQKIPNIRMKLY

SEQ ID NO: 137513 - protein, 98 aa, Glycine max
  Coding DNA Sequence Number=SeqID_20735
MARGVTSNSLTFESFSLAINLAYIKKNSWNLDDPTVSFPGTLPTTFGPSTQSTDLMMAMLQSIHQGQYMVMQSLHSLAQHQPIMSMEQFSLQVAWPRV

SEQ ID NO: 137514 - protein, 95 aa, Glycine max
  Coding DNA Sequence Number=SeqID_20736
MARSFSTRENVCNPNTLRCWPFLSQEEVLAAIGWPTTFGDQASEGQRSSEATNGVGDGVEDVVDAGGFKEGTDVGTTTATVVVNDEAGAKEESAP

SEQ ID NO: 137515 - protein, 808 aa, Glycine max
  Coding DNA Sequence Number=SeqID_20737
  Gene Ontology: Mol. function=protein binding
  Homolog annotation: Hit_ID=Q5N8Y4; Match level="QueryCoverage=76%, HitCoverage=39%, E-value=3e-71, Identity=54%"; Hit description=SF21 -like protein
MAFLVQISTLQILNPGCVDVTGAYSAQKTELNISLTAVGLLWTMTDFIAKGLLNGPFEEKEAGVGSTVKQIDSKKMEDQTRISNNVRDQASVDGVDFEKLLFSVFSLLQNLGADERPEVRNSAVRTLFQTLGTHGQKLSKSMWEDCLWNYVFPTLDRASHMAATSSKDEWQGKELGTRGGKAVHMLIHHSSDLLKNYIWKLQTNNIGDTEKHKGQYIWEIDGASASRIKTGPVHKIRPDKRSGPKLNGLCEPDGDGKCGWTCRHMPGKHRQEGDPDPVGDRRSCTNDWRRSQKIHRNAETGHGKKGDELKGPPRIIGHQWGTIFIIPMSGSRYHVKIGENKEKLSKNCLSNRNTAQKQWDETLVLVLGGIARILRLFFPFFTSLSNFWSGWESLLQFVENSILNGSKEVALAAINCLQTTVNSHSSKGHMPMPYLISVIDVYELVLRKPSSYRGNAADKVMQEILHGLGELYVQAQGLFNDVAYTQLIAIIDLAVKQAMLTNDNFEMEFGNVPPVLRTILEILPLLRPTEHISSMWPVLLREFLQYLPRQDSYLQNEDDSQVNYDAPNGATPISPNKIAVSPGSGSTAAITAIPSYIFAEKLVPVLVDLFLRAPTVEKYIIYPEIIQSLGRCMTTRRDNPDSALWRLAVEAFNHVLIDYVTKLINGGPDSTISKPVRTRIWKEIADVYEIFLVGYCGRALPSNSLSAVVLEADESLEMSILNILGDTILKLPVDTPLDICMLLLASLSLTRLIRLHEENDILDLPARSKNIYAANSFQVTVRPPITKVYNGKGDKRTMEPTHLGNGGS

SEQ ID NO: 137516 - protein, 209 aa, Glycine max
  Coding DNA Sequence Number=SeqID_20738
MTRSEVSKISITVLMTRCEYILSRFLTDENGLGDCPLPKARLDEIIYVLQELAHLVIHPDAAPILPLHPLLRTGLAEEKEKHDNRPHLFVLLPSLCELVTSRELRIRELVQVLLRLVTKECLWKSSAWQTTLEPPIGDFHSLLFSVACHKLWSTILSQLHQISPTQYNGAADRIVWFSQPDILKAGTAKKRKKSVKMVQCMYNILLIVD

SEQ ID NO: 137517 - protein, 477 aa, Glycine max
  Coding DNA Sequence Number=SeqID_20739
  Gene Ontology: Mol. function=transferase activity; Cellular component= membrane; Biological process=protein metabolic process
  Homolog annotation: Hit_ID=Q9FNI7; Match level="QueryCoverage=95%, HitCoverage=85%, E-value=0.0, Identity=75%"; Hit description =Glucosyltransferase-like protein
  Pfam annotation: Domain name=Glycos_transf_2; Domain location=100 -273; Score=31.0; E_value=3.1e-06; Accession=PF00535.16; Description =Glycosyl transferase
MDRFSSSTILPEAFQGAKDDFTMQLALVWNQIKAPLIVPLLRLAVFLCLIMSVMMFIERVYMGIVITLVKLFGRKPEKRYKWEPMKDDIELGNSCYPMVLVQVPMYNEREVYQLSIGAACGLSWPSDRIIIQVLDDSTDPTIKELVQLECQRWASKGVNIKYEVRDNRNGYKAGALKEGMKRSYVKQCDCVAIFDADFQPEPDFLWRTVPFLVHNPELALIQARWKFVNADECLMTRMQEMSLDYHFTVEQEVGSSTYAFFGFNAGVWRISALNEAGGWKDRTTVEDMDLAVRASLKGWKFLYLSDLKVKNELPSTFKAYRYQQHRWSCGPANLFRKMVMEIINNKKVSLWKKIHVIYSFFFVRKVVAHINTFVFYCIVLPATVLVPEVVVPKWGAVYIPSIITILNAVGTPRSLHLMVFWILFENVMSLHRTKATIIGLLEASRVNEWVVTEKLGDALKTKAGGKAPKKPRFRIGD

SEQ ID NO: 137518 - protein, 828 aa, Glycine max
  Coding DNA Sequence Number=SeqID_20740
  Gene Ontology: Mol. function=protein serine/threonine kinase activity; Cellular component=membrane; Biological process=protein amino acid phosphorylation
  Homolog annotation: Hit_ID=Q93YG8; Match level="QueryCoverage=87%, HitCoverage=74%, E-value=0.0, Identity=50%"; Hit description=TCTR2 protein
  Pfam annotation: Domain name=Pkinase; Domain location=691-826; Score=- 95.4; E_value=0.0071; Accession=PF00069.15; Description=Protein kinase domain
  Pfam annotation: Domain name=Pkinase_Tyr; Domain location=691-827; Score=-105.0; E_value=5e-06; Accession=PF07714.7; Description =Protein tyrosine kinase
  Pfam module annotation: Pfam domain module=Pkinase::Pkinase_Tyr; Domain location=691-826::691-827
MSERVKKEKQTGDKRERMKNIFKKLHIGSSHDPHRSNEPSPPVPSPSCATDQSQSSAATPPSPSSASPSPSPSTLVVTPSCGGGGASPVVNRQDFFSSEEEFQVQLALAISASNSEFREDPEKDQIHAATLLSLGGHRIDSTRNKDDVAEALSRQYWEYNVLDYEEKVVDGFYDVYGPYNDSVMQGKMPSRTDLEANPGGSELVIVNQTIDPALEELIQIAQCIALDCPVSSLVQRLAELVTSHMGGPVKDAGIMLARWTETRAELRTSLHTIVLPLGSLNIGLSRHRALLFKVLADNINMPCRLLKGSHYTGVEDDAVNIIKLEGEREFLVDLMAAPGTLIPADILSTKDSAFKSYNPKILPSLPSTKDNEFSYSRPIQPFHGEGSSQNSVIKDYSLPWNGKPYFEKSEPSNLGLSRESGTGPSKIPNKGTPNQLDNLPALSGASLYKGTLGMNTVGDGTRLNVNVVPYTNISPNDSRNLFADLNPFQIKGMGKAPVHNKPVENKPPELKSTKNNTVSGRPPVPLMWKNRPAYNEDPRKTNHNPNDYNPPLFVSNGSSTSENIDLSSSKPLYNSNINNDVNAQTLAQVTGSVSPPTVPKLNQIEDLNADFNQGGLEDSQYVMVEAVREPENVEIRHHDQRKCTYDRFMGSNLKLKDPESPSSSIDSITNRIDPILDDVDVGECEIPWEDLVLGERIGIGSYGEVYHADWNGTEVAVKKFLDQDFSGAALSEFKREVRIMRRLRHPNIVLFMGAVTRPPNLSIISEYLPRCLTSVTNVPFCRGSLYRILHRSNYQIDEKRRIKMALDVVILFAYSLLSHNITKECHKK

SEQ ID NO: 137519 - protein, 47 aa, Glycine max
  Coding DNA Sequence Number=SeqID_20741
EVPDYGKLNPLLDLPCRYLIGNWSDSKVLDSKGLSCCAITRNRGTRT

SEQ ID NO: 137520 - protein, 747 aa, Glycine max
  Coding DNA Sequence Number=SeqID_20742
  Gene Ontology: Mol. function=calcium ion binding; Cellular component =mitochondrion; Biological process=protein amino acid phosphorylation
  Homolog annotation: Hit_ID=Q6Z277; Match level="QueryCoverage=87%, HitCoverage=82%, E-value=2e-99, Identity=28%"; Hit description =Putative fertility restorer homologue
  Pfam annotation: Domain name=PPR; Domain location=109-143; Score =16.5; E_value=0.082; Accession=PF01535.11; Description=PPR repeat
  Pfam annotation: Domain name=PPR; Domain location=144-178; Score=4.4; E_value=2.2; Accession=PF01535.11; Description=PPR repeat
  Pfam annotation: Domain name=PPR; Domain location=179-213; Score =20.0; E_value=0.0083; Accession=PF01535.11; Description=PPR repeat
  Pfam annotation: Domain name=PPR; Domain location=214-248; Score =31.9; E_value=2.2e-06; Accession=PF01535.11; Description=PPR repeat
  Pfam annotation: Domain name=PPR; Domain location=249-283; Score =49.0; E_value=1.6e-11; Accession=PF01535.11; Description=PPR repeat
  Pfam annotation: Domain name=PPR; Domain location=284-318; Score =43.3; E_value=8.2e-10; Accession=PF01535.11; Description=PPR repeat
  Pfam annotation: Domain name=PPR; Domain location=347-381; Score =29.3; E_value=1.3e-05; Accession=PF01535.11; Description=PPR repeat
  Pfam annotation: Domain name=PPR; Domain location=401-435; Score =39.2; E_value=1.5e-08; Accession=PF01535.11; Description=PPR repeat
  Pfam annotation: Domain name=PPR; Domain location=436-470; Score =45.8; E_value=1.4e-10; Accession=PF01535.11; Description=PPR repeat
  Pfam annotation: Domain name=PPR; Domain location=471-505; Score =30.6; E_value=5.4e-06; Accession=PF01535.11; Description=PPR repeat
  Pfam annotation: Domain name=PPR; Domain location=506-540; Score =21.6; E_value=0.0027; Accession=PF01535.11; Description=PPR repeat
  Pfam annotation: Domain name=PPR; Domain location=541-575; Score =51.6; E_value=2.5e-12; Accession=PF01535.11; Description=PPR repeat
  Pfam annotation: Domain name=PPR; Domain location=576-610; Score =37.8; E_value=3.6e-08; Accession=PF01535.11; Description=PPR repeat
  Pfam annotation: Domain name=PPR; Domain location=611-644; Score =15.1; E_value=0.12; Accession=PF01535.11; Description=PPR repeat
  Pfam annotation: Domain name=PPR; Domain location=645-679; Score =25.5; E_value=0.00018; Accession=PF01535.11; Description=PPR repeat
  Pfam annotation: Domain name=PPR; Domain location=680-714; Score =32.4; E_value=1.6e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =109-143::144-178::179-213::214-248::249-283::284-318::347-381::401 -435::436-470::...
  Pfam module annotation: Domain location=471-505::506-540::541 -575::576-610::611-644::645-679::680-714
  Subcellular localization annotation: CTP_CleavageSite=17; ConfidenceScore=5.12e-01
MKNSSSSNVNYIAEGVLARHTMGFGARSALRLRPNSHFNNSICFFCSQSLTLCESDPQYQNRLQKVQKLETLLNRGRTVTARRFLRSLLLTKTAFSSLSELHAHVSKPLFSDTLLWLCSVSKMLDEATDLYSSMRKDGFIPSTRSVNRLLRTLVDSRHFEKTLPVFADVVDSGIRPDAVTYGKAVQAAVMLKDLDKGFELMKSMEKDGMGPSVFAYNLILGGLCKVRRIKDARKLFDKTIQRNVVPNTVTYNTLIDGYCKVGDIEEAFGFKERMREQNVECNLVTYNSLLNGLCGSGRVEDAKEVLLEMEDSGFLPGGFLSFVFDDHSNVAGDDSLFDGKEIRIDEQTYCILLNGLCRVGRIEKAEEVLAKLVENGVTSSKISYNILVNAYCQEGLEPNRITFNTLISKFCETGEVDQAETWVRRMVEKGVSPTVETYNLLINGYGQRGHFVRCFEFLDEMDKAGIKPNVISHGSLINCLCKDRKLIDAEIVLADMIGRGVSPNAERYNMLIEASCSLSKLKDAFRFFDEMIQSGIDATLVTHNTLINGLGRNGRVKEAEDLFLQMAGKGCNPDVITYHSLISGYAKSVNTQKCLEWYDKMKMLGIKPTVGTFHPLICACRKEGVVKMEKMFQEMLQMDLVPDQFVYNEMIYSYAEDGNVPKAMSLHQQMVDQGVDSDKVTYNCLILAYLRDRRVSETKHLVDDMKAKGLVPKVDTYNILYVLPANFRAKRGGNAARGSNCILRIEQ

SEQ ID NO: 137521 - protein, 32 aa, Glycine max
  Coding DNA Sequence Number=SeqID_20743
MDGILISSVVLLADSRFTRPDMGFTQQTQFRA

SEQ ID NO: 137522 - protein, 569 aa, Glycine max
  Coding DNA Sequence Number=SeqID_20744
  Gene Ontology: Mol. function=RNA-directed DNA polymerase activity; Cellular component=nucleus; Biological process=RNA-dependent DNA replication
  Homolog annotation: Hit_ID=Q1SYP9; Match level="QueryCoverage=98%, HitCoverage=66%, E-value=7e-92, Identity=31%"; Hit description=Myb, DNA-binding
MLDKLSPKGLGGLCTQRKIKKLKEAMKVWNRVQYGDTFNKVQRIETDLNRLEDVSINRQLTSQEFMTRKKLQEELWAAALSHESLMRQKVDHPLRVKEEVRRFFSNRFSEPEQCRPVLNGVRFCGIGQHQNDMLVGVFNEEEIRAAFWEVLKSDISRFLAEFHANGIFPRGNNASFIALIPKLKDPRNLNEYRPISLIGCVYKIVAKLLTNRLKKVMSDIIDERQSTFISGRHLLHSVLIANEAVKEANRRPKPFLVFKVDYERAYDSVSWAFRSYMMKRLGFCPKWICWIEGCLKSASVSVLVNDSPTNEFIPHRGLRQGELLAPLLFNIVAEGLTDLMREALDKSLFNSFLVGKKHTPVNILQYADDTIFFGEATMQNVKTIKSILRSFKLVSGLKLNFAKSSFGTIGKPEQWGIEAAKYLNCRILFLPFTYLGLPIGDNPRRSELWDPLIRKGSEHRKIAWVNWKTVCQPKDKGGLGIKDLRTFNSALMGKWRWDVFYKQEEPWAKIINSKYGGWRALEEGTRGNHESTWWKDLVSIQQQQQNIVIKRETVWKVGGGDKFRFWKDP

SEQ ID NO: 137523 - protein, 529 aa, Glycine max
  Coding DNA Sequence Number=SeqID_20745
  Gene Ontology: Mol. function=threonine-tRNA ligase activity; Cellular component=soluble fraction; Biological process=tRNA aminoacylation for protein translation
  Homolog annotation: Hit_ID=Q6ER90; Match level="QueryCoverage=80%, HitCoverage=63%, E-value=0.0, Identity=84%"; Hit description =Putative threonyl-tRNA synthetase
  Pfam annotation: Domain name=tRNA-synt_2b; Domain location=287-453; Score=212.7; E_value=8.7e-61; Accession=PF00587.15; Description=tRNA synthetase class II core domain (G, H, P, S and T)
  Pfam annotation: Domain name=tRNA_SAD; Domain location=180-232; Score= 92.7; E_value=1.1e-24; Accession=PF07973.4; Description=Threonyl and Alanyl tRNA synthetase s
  Pfam module annotation: Pfam domain module=tRNA-synt_2b::tRNA_SAD; Domain location=287-453::180-232
  Subcellular localization annotation: CTP_CleavageSite=92; ConfidenceScore=5.90e-01
MATFAVATTLSTSSIAPLNARRGFGFGFGSFLSPTTKPKRPSITTTLAVATDSSVCFNPNPNPNPNPNQLVLPSNESSEMLLRIRHTSAHVMAMAVQKLYPDAKVTIGPWIENGFYYDFDMEPLTDKDLKRIKKEMDRIIGKNLPLVREEVSRGEAHRRISALNEPYKLEILESIKDDPITIYHIGDEWWDLCAGPHVDSTGHINKKAVELESIAGAYWRGDERKPMLQRIYGTAWENEEQLKAYLHFKEEAKRRDHRRLGQDLDLFSIQDDAGGGLVFWHPKGAMVRHIIEDFWKKIHMKRGYDLLYTPHVAKADLWKISGHLDFYKENMYDQMSVEDELYQLRPMNCPYHILVYKSKLHSYRDFPIRVAELGTVYRYELSGSLHGLFRVRGFTQDDAHIFCLDDQIKDEIRGVLDLTEEILLQFGFEKYEVNLSTRPEKAVGDDDIWEKATSALEDALDDKGWTYQIDDGGGAFYGPKVDIKIEDALGRNGQEYILASPGMVAPAAHLELGTFGLYIVHSLSPKNLP

SEQ ID NO: 137524 - protein, 270 aa, Glycine max
  Coding DNA Sequence Number=SeqID_20746
  Gene Ontology: Mol. function=nucleic acid binding; Cellular component= intracellular
  Homolog annotation: Hit_ID=Q2PER8; Match level="QueryCoverage=90%, HitCoverage=98%, E-value=2e-23, Identity=45%"; Hit description =Putative histone deacetylase
MPPVPLCSNCLFTSYLGLGVWKLNEGVEVKNGESLKVDPGDDKIIHLSNACMGDVTKDIGGGPVALYVKFDIDEDIPVSAVNGKPEVGVKPDANEAKQKKIADPRKRDANGEDDDSSESDSDDDSSEDKCPEAPCYVKVWVRVIPTANGDIESSEGDDDSDDDEEEEGDDESDEETAKKIEASNKRGIESSKKTPVPVKKTKFVTPQKTDSKNVVHAATPHPSKQAGKATANNKLQSPKSGGDYSCKPCNRLFKTEDALSSHNKAKHSAK

SEQ ID NO: 137525 - protein, 757 aa, Glycine max
  Coding DNA Sequence Number=SeqID_20747
  Gene Ontology: Mol. function=protein serine/threonine kinase activity; Cellular component=membrane; Biological process=protein amino acid phosphorylation
  Homolog annotation: Hit_ID=Q93XL9; Match level="QueryCoverage=95%, HitCoverage=92%, E-value=0.0, Identity=59%"; Hit description=CTR1 -like protein kinase
  Pfam annotation: Domain name=Pkinase; Domain location=497-751; Score =157.4; E_value=3.6e-44; Accession=PF00069.15; Description=Protein kinase domain
  Pfam annotation: Domain name=Pkinase_Tyr; Domain location=497-753; Score=141.3; E_value=2.6e-39; Accession=PF07714.7; Description =Protein tyrosine kinase
  Pfam module annotation: Pfam domain module=Pkinase::Pkinase_Tyr; Domain location=497-751::497-753
MEMPARRSGNYTLLSQTPDDNLTAPLFGCSSGDGQINSSKFERVSDWDSGVEHRQGNRIGNLHSSFGMQRQSSEGSFGESSLSGEFYAPTLSAIAANEIDGFRGTFAGNSAARSGGSSGKSWAQQTEESYQLQLALALRLSSEATCADDPNFLDPVPDESALRSLSSFSAEAVSHRFWENGRIPSLETLKSINPSDSSLEVVFVDRRNDPSLRELQNKVQDISCCCIATTDVVDQLAKLVCNCMGGSASVWEDDLFPIWRERINDLRDCLGSVVVPIGSLSTGLCRHRAVLADTIDLPCRIAKGCKYCSRDDASSCLVRFGLDREYMVDLIGKPGCLCEPDSLVNGPSSISFSSPLCFPRHKPAEPTIDFRSLAKQYFSDCMSAELVFDSSSAEQYERQYRDRNPGSIPNDNNRSSLVPLHPQPYRSSAHDRGYETFKSGKPPQNAVEPTMTSRDSLPLKHNRPGHRDTQTRLLIPSKPTREFSLDMEDLDISWTDLVLKGRIGSGSFGTVHHAEWNGSEVAVKILMEQDFKGERFKEFLREVAIMKGLRHPNIVLLMGAVTKPPNLSIVTEYLSRGSLYRLLHKPGATEMLDERRRLSMAYDVAKGMNYLHKRNPPIVHRDLKSPNLLVDKKYTVKVDQIQSQQEPKALQVYQMRNTVGDFGLSRLKANTFLSSKSAAGTPEWMAPEVLRDEPSNEKSDVYSFGVILWEIATLQQPWSNLNPPQKSENDCKRCILVEACIVLANDNKMSLEFYSVS

SEQ ID NO: 137526 - protein, 1021 aa, Glycine max
  Coding DNA Sequence Number=SeqID_20748
  Gene Ontology: Mol. function=nucleic acid binding; Cellular component= intracellular
  Homolog annotation: Hit_ID=Q6ZAQ9; Match level="QueryCoverage=94%, HitCoverage=97%, E-value=2e-35, Identity=39%"; Hit description =Putative S-locus protein 4
  Pfam annotation: Domain name=DUF618; Domain location=143-203; Score =8.2; E_value=0.00087; Accession=PF04818.4; Description=Protein of unknown function, DUF618
  Pfam annotation: Domain name=zf-C2H2; Domain location=873-895; Score =17.5; E_value=0.048; Accession=PF00096.16; Description=Zinc finger, C2H2 type
  Pfam module annotation: Pfam domain module=DUF618::zf-C2H2; Domain location=143-203::873-895
MERSLDRSREPGPKKPRLIEELSARQLPLRPAAVTTLPSTRFRAYDRDSGGGGGYQPQPPPHQELVIQYKTALAELTFNSKPIITNLTIIAGENLSAAKAIAATVCANIIEGIENPAVSLVFICQGNLISLMASLYYGKKVPSDQKLPSLYLLDSIVKNIGRDYIKYFASRLPEVFCKAYRQVDPCVHSSMKHLFGTWKGVFPPQSLQMIEKELGFAPAVNSSASVSATVRSDLQSQRPPHSIHVNPKYLERQRLQQSSRSKGVVNDMTEAVLNSNEDLERPDRALSAARPWLDPRINMLNNQHTHRDAFNDSVPEKSMDGSSYGGSEYSSVISSNLGSGAGRTGSKLIDLGHDRTWFKTDGGDADTTSGQRNGFNLKHSFSNHEAPKSMNLDAHCQPRQSITNKQNDVMSCNWKTSEEEEFMWDEIDNGLIDHGPNVSKTLSTDTWMADVENLEGEDHLQITRPFGAKVNREISTVKNQLPGLGGHPPSSWQLQNLKPGYSEGFVSSHSALPANASSLTVKKGNQSFMSNSVVGRVKFVGQQFDSGETESPSWQSPLRQQSPSLPGTVHHPHSMQNFADQELPQNLKTSQFLGGPITQHIRDHSLTLRPIVQVGNLRRSQEKDMQGPLSSMTSFRPKLQQKQLDPSQSKVSLTRETSAQLTTNNLSAAPVKSGVIPKKSITCDPDPRKHPSQTGVQPTQSGRPTTLDPLHNDSSTLPKNTQGKAGQPPQRLSTQPPASSNISSSSAPTLNTAKNNKLNPISNLLSSLVAKGLISAETESPTMVPSEVPKGSKDQTEIITTSCSLPVTSISGSAAVPVSSSGDEVDSATKTSLASPQSTSTEIRNLVGFDFRPNVIREFHPSVIRELWDDFPHNCKVCGIKLKQEELFNRHLEWHATREHGPIKASRSWYAESSDWIAGKAEYSSESGFNDSVDVHEQKTDSSQLDTMVLADENQCLCVLCGELFEDAYCHERNEWMFKGAVYMNYSDVNCEMESRNVGPIIHAKCLSENSIVTNLVRPII

SEQ ID NO: 137527 - protein, 125 aa, Glycine max
  Coding DNA Sequence Number=SeqID_20749
  Homolog annotation: Hit_ID=Q9LZR6; Match level="QueryCoverage=25%, HitCoverage=6%, E-value=4e-07, Identity=71%"; Hit description=Heat shock transcription factor-like protein
MIGSSDGSSTRSNVLEKSAGTGFPCKHSSGRGKLFTVSKSGLEEGNWEEDMVENASKEEKVKRVTAMLDQNERVVGNTTGPSDTFSRLFGSNLSTIITENCSHSFPSVATSTANIGWTHITLMAH

SEQ ID NO: 137528 - protein, 98 aa, Glycine max
  Coding DNA Sequence Number=SeqID_20750
MAMGRGGVGFCLPHPRPRLPISLSAPAPKTDGGVYLHLITVPDRGRWDGFGYGFEAGIENLIPDPESEFDYRRKPDPDLGQLRFYPSKLGWIWAHYHA

SEQ ID NO: 137529 - protein, 152 aa, Glycine max
  Coding DNA Sequence Number=SeqID_20751
MERSLDRSREPGPKKPRLIEELNARQLPQRPTAVTTLPSTRFRAYGRDSEISDLGRGGGGGYQPQPPPHQELVTQYKTALAELTFNSKPIITNLTIIAGENLSAAKAIAAAVYDNILEKEQSELISLTSEEWCYCLPCYTLMNWVSVVPRWK

SEQ ID NO: 137530 - protein, 38 aa, Glycine max
  Coding DNA Sequence Number=SeqID_20752
MVAEESKPPHHEPLQNLKIIVNHTHHEPPQTAPTSKPQ

SEQ ID NO: 137531 - protein, 144 aa, Glycine max
  Coding DNA Sequence Number=SeqID_20753
  Gene Ontology: Mol. function=nucleic acid binding; Cellular component= signal recognition particle, endoplasmic reticulum targeting; Biological process=SRP-dependent cotranslational protein targeting to membrane
  Pfam annotation: Domain name=zf-CCHC; Domain location=110-127; Score =22.8; E_value=0.00017; Accession=PF00098.13; Description=Zinc knuckle
MELLLLRAGLREEERTSIARFLSGLNMEVRDKVELLPYKDLDDLVQLCIRVEQQLKRKPTSKSYDSHSYPKKDQGQGTLGAAPSKPEDDKGKTTEKQPPKASMQEKTSSIKCFKCLGRGHITSQCPTKKTMIMRGQDIYSSQDE

SEQ ID NO: 137532 - protein, 113 aa, Glycine max
  Coding DNA Sequence Number=SeqID_20754
  Subcellular localization annotation: CTP_CleavageSite=94; ConfidenceScore=5.90e-01
MGKIVLALKKIISSSGRRFFRKSSRRRFFRKLFGRTFFRKNNLCSTGRTFFRKLSERTFFRKLSGRRFFRKNKLLFFRKKVLPDEQFVLPKEPSSGEVTGRTSSGNLYRRRFF

SEQ ID NO: 137533 - protein, 97 aa, Glycine max
  Coding DNA Sequence Number=SeqID_20755
MRENVMLTSLQLVELVEMLKQQKTMLEEHPKLIVNLRTKKDDAQNEHLNVIEDEGNQDYHTNELLLRLQQSEEKLEESQETARNGAIDVGRHVSMLR

SEQ ID NO: 137534 - protein, 262 aa, Glycine max
  Coding DNA Sequence Number=SeqID_20756
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9SNC1; Match level="QueryCoverage=95%, HitCoverage=93%, E-value=1e-44, Identity=38%"; Hit description =Glucosidase-like protein
  Pfam annotation: Domain name=Glyco_hydro_17; Domain location=28-257; Score=17.6; E_value=6.2e-12; Accession=PF00332.9; Description =Glycosyl hydrolases family 17
MAEIEPCPFLLLALFSCTLFNASSTAKIGVNYGTVADNLPPPSTVAAFLISQTTIDRVKLFDANPAILRAFAGTGISVTVTVPNADIPSLSTLPAAQAWLSANLLPFLPATSDKTLISHILPTMKSLHEALTISNLTTIQSHLRANFKLPPRNEIPFHDKPVPVLRILPDPRPSPKPNGGVLDHLTGFNYSNMFDAQMDAVFSAMKRLGFADVELIVAKRVGPLWVTRINRNLKPTVSERNSGLFKPDLTPVYHVAVYTAKQ

SEQ ID NO: 137535 - protein, 99 aa, Glycine max
  Coding DNA Sequence Number=SeqID_20757
MEDEALIDYKSEGVEGRIKCENGCSDESFADLIKKKVGESSSNSEILLSEMTELDEKGGEKSSSFEVMTELDGQSQGSAEVSSSSTSMVCQVQEMPTSE

SEQ ID NO: 137536 - protein, 87 aa, Glycine max
  Coding DNA Sequence Number=SeqID_20758
MGAVRWCNSAVWHDGRQDEENGRENKDEREEKWLRFYRVYTKSVESSRVILGQMHGQSNNQIGPIMPPSPGWTGPTGRARLVFSTMV

SEQ ID NO: 137537 - protein, 71 aa, Glycine max
  Coding DNA Sequence Number=SeqID_20759
  Pfam annotation: Domain name=zf-C2HC_plant; Domain location=2-39; Score=21.4; E_value=0.00012; Accession=PF07567.3; Description =Protein of unknown function, DUF1544
MCIYCDKRVKGGGTNRFKAHLARQKGQEEAYKKVPTDVQHEMKCVEIIGEVYCSGVGELAHDDDHAVDGEL

SEQ ID NO: 137538 - protein, 196 aa, Glycine max
  Coding DNA Sequence Number=SeqID_20760
MEIEWRRRKGDWRHSFKEKISQEQAHHHRKLWIRELEEGSHLAHWPKIYPKAHETLGPSPASLAQSSWSLLSNALGGKIASLCYLRNDNNRDTGHYGSGDGGGGGIDADGGGSDDVVVVEMLVVATNGGDVGGGSNGSGGGGGGSKWWWLHEEGGVVGSDGSGDNDDVDDIDGCRGGSNSNGDGDEFNFIFAKHVY

SEQ ID NO: 137539 - protein, 79 aa, Glycine max
  Coding DNA Sequence Number=SeqID_20761
MCEDYLKVNKLTEVIYTIGICEIIFLEREKGIEQRQYKWRLQSLLYLSDVWELYQSSRRKNWRNLRKSLEMPLSMLEDM

SEQ ID NO: 137540 - protein, 54 aa, Glycine max
  Coding DNA Sequence Number=SeqID_20762
  Homolog annotation: Hit_ID=Q9ZQR0; Match level="QueryCoverage=98%, HitCoverage=5%, E-value=2e-09, Identity=43%"; Hit description =Putative helicase
MENEIVEFHMGHVPYDFAPMYRVLGHLHVKMGIDYLGVKIAIAGCEEVLAFEIQ

SEQ ID NO: 137541 - protein, 178 aa, Glycine max
  Coding DNA Sequence Number=SeqID_20763
  Gene Ontology: Mol. function=helicase activity
  Homolog annotation: Hit_ID=Q1SRJ5; Match level="QueryCoverage=65%, HitCoverage=14%, E-value=5e-19, Identity=47%"; Hit description =Probable helicase [imported]-Arabidopsis thaliana-related
MTENLLLKDYISIFQANSVVDEDHDDIDDVLSKPSISDSKFISWMNTNQNSVEGRSLTYAEFVFKFVYSKKKRCWQLRKKGYTIGRLLWVPPITGELFYLRMMLTICKGPTSFEDLRTIALQLSDNSLKNLVLLEIEQLLQTNQRSLRDYPSMSYPKDANCPTYLDNSLILTELNYNN

SEQ ID NO: 137542 - protein, 156 aa, Glycine max
  Coding DNA Sequence Number=SeqID_20764
MTYTCNLGTRMGVYSDFLLYVMLEGSWLVAYFIDAFDLAGSKGRGGSGNISALLSGVPWDVNMQLLQVTSGMTFSSKTIGGNLNSKVKFVVMKGSTLMKPTASLLAKQNQPHPIVSSRLLEVNLPPCLAGSMEVGDVKQQVNFVHKAPKKLQDIYD

SEQ ID NO: 137543 - protein, 119 aa, Glycine max
  Coding DNA Sequence Number=SeqID_20765
MASTMGLVEDVSEVRNFDKDILMLPMKVSDTIDETTTTNTTLPVEPKKIPVLKEKIPLPPITLPSYMLVEEEVGAFFSCYIHESDMTNRLSWLPISNIPKPKHCLVTLSTVWLDVTPPP

SEQ ID NO: 137544 - protein, 81 aa, Glycine max
  Coding DNA Sequence Number=SeqID_20766
MQHSRRNATRTKDIRWSYWWIALTRTIWQHRNKVVFDNQTFNASKLMDEALLLVWSGLKAMEKDFDTHFNQWSSNLTDAFV

SEQ ID NO: 137545 - protein, 104 aa, Glycine max
  Coding DNA Sequence Number=SeqID_20767
  Gene Ontology: Cellular component=intracellular; Biological process =signal transduction
  Homolog annotation: Hit_ID=O82458; Match level="QueryCoverage=84%, HitCoverage=18%, E-value=6e-32, Identity=75%"; Hit description=Rac GTPase activating protein 1
  Pfam annotation: Domain name=RhoGAP; Domain location=1-85; Score= -29.7; E_value=0.0011; Accession=PF00620.17; Description=RhoGAP domain
MAWFRELPTGVLDPLSLEQVMQSQSEEECAQLMRLLPPTEATLLDWAINLMANVAQMENLNNMNARNIAMVFAPNMTQSSTLSSNFCYSIHTSQIHLIGYNINE

SEQ ID NO: 137546 - protein, 62 aa, Glycine max
  Coding DNA Sequence Number=SeqID_20768
MVLLVKIIKGQAISTRAYSIACSVSVLSMYVEHDLDGNEDVSQRQHVQVSGFYFAYLSNNSN

SEQ ID NO: 137547 - protein, 60 aa, Glycine max
  Coding DNA Sequence Number=SeqID_20769
MLSGGGVYKVVGIFGVPYYATTKILLADKEQKGKKRTRKSFPSKSPGKASTETPAKCHML

SEQ ID NO: 137548 - protein, 271 aa, Glycine max
  Coding DNA Sequence Number=SeqID_20770
  Gene Ontology: Biological process=cell cycle
  Homolog annotation: Hit_ID=Q2QVB9; Match level="QueryCoverage=99%, HitCoverage=28%, E-value=2e-58, Identity=46%"; Hit description =Expressed protein
MEQCVARLDVAMFNAILRESADDIPTDPVSDAISDPNVLPIPPGKSSFGAGAQLKTVIGTWSRWLTDLFGMDDVDSIEDKADPDHNEERENTFFKSFSILNALSDLLMLPKDMLLSASIRNEVCPMFNATLIKKILDNFVPDELCPDPVPSNVFEALNSENEMEDGKEYVNNFPCIAAPIAYSPPPATSIASIVGEIGSKSQLRRNKSSVVRKSHTSDDELDELKSPLSSIFFSVSSSPKVLTKSSLKFKEIRNQSPVRYELLRDVWMKSD

SEQ ID NO: 137549 - protein, 211 aa, Glycine max
  Coding DNA Sequence Number=SeqID_20771
MIYVGGEHFNDSCHLYSMENSWWEQELHPYNQYEEKKRLSNLENVLMQFMETSEANFKANQHAIQNLEIQVGKLAKEVAKIPFLVTREEKFEEVKAHEESLVEEHDSRERDEQKEEKSKERTQQQWKKCSQVEIQQQERILQVNTPPHQLIGKEERHVEFNKSLSVILSLNTNTSLAMVWKAFPRYMSFMESLSKGRKCKEDVFYVTFMSP

SEQ ID NO: 137550 - protein, 36 aa, Glycine max
  Coding DNA Sequence Number=SeqID_20772
MARLVRISDFWLSASLLAQCRGLQAPTVVALSGLLA

SEQ ID NO: 137551 - protein, 78 aa, Glycine max
  Coding DNA Sequence Number=SeqID_20773
MRCLRVSSDLASLDDKGRNNHEVSPCAIRLDCLWIAKDFESSKGEDFLKARTLSPLKARNLSLLKQRTLSPMKQANGH

SEQ ID NO: 137552 - protein, 225 aa, Glycine max
  Coding DNA Sequence Number=SeqID_20774
  Gene Ontology: Mol. function=RNA-directed DNA polymerase activity; Cellular component=intracellular; Biological process=RNA-dependent DNA replication
  Homolog annotation: Hit_ID=Q8H6Q8; Match level="QueryCoverage=80%, HitCoverage=52%, E-value=8e-49, Identity=58%"; Hit description=CTV.20
MDVMSFGLKNASSELQKIMNDIFNPYSKFSIVYIDDVLIFPQTIDQHFKHLHIFINIIKQNGLAISQTKINLFQTKIRFLGHNIHQGTIIPIDRSIEFANKFPNQILDKTQLQRFLGCLNYVGEFVSYLNNIVKPLHDRSRKNPPPWTDIHTQVVKDIKLKSISRALQTLYLTILPANSYRKIVNASLRGGRGSEKGFKLALSEPSPKRVSPSKTGLSTQSVLST

SEQ ID NO: 137553 - protein, 158 aa, Glycine max
  Coding DNA Sequence Number=SeqID_20775
MSHVAFVNFALRATSVRVYVDCALWSEFTLFDSCKTENVCVNSSTKIKKKTWMCMLRMQCIVFIAIVVKLDMSVKDANMDCDVVEVQQNVSNLAEDTVKKNWMQCIVCIAIVKLDMSVKAVNRDCDVVEVKQNMSNLAEDIVKRVGGYDVFVQLIKVK

SEQ ID NO: 137554 - protein, 322 aa, Glycine max
  Coding DNA Sequence Number=SeqID_20776
  Gene Ontology: Mol. function=oxidoreductase activity; Cellular component=membrane; Biological process=electron transport
  Homolog annotation: Hit_ID=Q2LAK6; Match level="QueryCoverage=80%, HitCoverage=56%, E-value=1e-134, Identity=93%"; Hit description =Cytochrome P450 monooxygenase CYP72A68
  Pfam annotation: Domain name=p450; Domain location=1-258; Score= -78.0; E_value=2e-07; Accession=PF00067.12; Description=Cytochrome P450
MMEIDRDIKASLMDIINKRDKALKAGEATKNNLLDILLESNHKEIEEQGNNKNVGMNLEEVIEECKLFYFAGQDTTSVLLVWTMILLSRYPDWQARAREEVSQVFGNQKPTFDGLNQLKIVTMILYEVLRLYPPGVGVPRKVIKDVKLGNLSFPDGVEIFISTILVHHDSELWGDDAKEFKPERFSEGVLKATNGRFSFFPFGGGPRICIAQNFALLEAKIALSMILQCFSFELSPTYTHAPTLVMTIQPQYGAPVILHKDMTKSKGKDPLEGLGGPMTRARARKAKEAFQQVLSILFEYKPKFQGEESKVVSCIMAQMEED

SEQ ID NO: 137555 - protein, 150 aa, Glycine max
  Coding DNA Sequence Number=SeqID_20777
  Gene Ontology: Mol. function=oxidoreductase activity; Cellular component=membrane; Biological process=electron transport
  Homolog annotation: Hit_ID=Q2LAK6; Match level="QueryCoverage=63%, HitCoverage=23%, E-value=3e-47, Identity=86%"; Hit description =Cytochrome P450 monooxygenase CYP72A68
MEAAWVNILMLILILTLIWAWKKLNSLWLTPKRLEKILREQGLRGSPYRFKVGDTKETLKMQMQAMSKPMNLFSNDIGPRKNSFIWNGQKPRVTLTDPELIKDVFNKIYDFGKPNMGPNIRSLIPGLAMHEGEKWSMHRKIINPAFNLEK

SEQ ID NO: 137556 - protein, 99 aa, Glycine max
  Coding DNA Sequence Number=SeqID_20778
  Gene Ontology: Mol. function=secologanin synthase activity; Cellular component=integral to membrane; Biological process=alkaloid metabolic process
  Homolog annotation: Hit_ID=Q05047; Match level="QueryCoverage=62%, HitCoverage=11%, E-value=2e-14, Identity=58%"; Hit description =Cytochrome P450 72A1
MEAAWVNILMLILILALIWVWKKFNSLWLTPKRLEKILREQGLRGSPYRFKVGDTKETLKMQMQAMSKPMNLFSNDIGPQRKVRKNEIGRIYRNIREIE

SEQ ID NO: 137557 - protein, 33 aa, Glycine max
  Coding DNA Sequence Number=SeqID_20779
ALYPGSWEHKEWSMFFEGDDTSRNHQERYDYLG

SEQ ID NO: 137558 - protein, 91 aa, Glycine max
  Coding DNA Sequence Number=SeqID_20780
MGVVKYMTMDELKRLGIPSEMLKFFNHSSFPHKGHPTSNNISNQYHHKYQHHHISIKVINNNINSKLHSVCTYFFHVWDSHSPGLQTTQVK

SEQ ID NO: 137559 - protein, 97 aa, Glycine max
  Coding DNA Sequence Number=SeqID_20781
  Gene Ontology: Mol. function=hydrolase activity, hydrolyzing O -glycosyl compounds; Cellular component=membrane; Biological process =carbohydrate metabolic process
  Homolog annotation: Hit_ID=Q5NA70; Match level="QueryCoverage=89%, HitCoverage=72%, E-value=6e-30, Identity=63%"; Hit description =Putative beta-1,3-glucanase
  Pfam annotation: Domain name=X8; Domain location=13-96; Score=128.0; E_value=2.6e-35; Accession=PF07983.3; Description=X8 domain
MANGQGVMESQKTWCVAKPSSDQATLLANLNYACSQVDCRILQKGCPCSYPDNLMNHASIAMNLYYQSRGKNHWNCDFRASGLVVVTDPSYGNCIYA

SEQ ID NO: 137560 - protein, 53 aa, Glycine max
  Coding DNA Sequence Number=SeqID_20782
MEERIEGLFSTESLRWILRILLRLKRSSRCGGSATKQQWFCGGHRWSWVEEEG

SEQ ID NO: 137561 - protein, 66 aa, Glycine max
  Coding DNA Sequence Number=SeqID_20783
  Gene Ontology: Mol. function=protein serine/threonine kinase activity; Biological process=protein amino acid phosphorylation
VKAVVRDKKEELVLDNSLGNCSMKEVNKVFNIAMMCLEPDPLKRPTMAEVVTLLEQTEPDKLITAS

SEQ ID NO: 137562 - protein, 87 aa, Glycine max
  Coding DNA Sequence Number=SeqID_20784
  Gene Ontology: Mol. function=isomerase activity
  Homolog annotation: Hit_ID=Q53B73; Match level="QueryCoverage=72%, HitCoverage=22%, E-value=2e-22, Identity=85%"; Hit description =Putative chalcone isomerase 3
MVTKNEEDEAACARKWGCLLLLLCEEKCIGVADKSEKEWSLLNGSVEFEILLRTTILVEFVDGEKYSDVEAATAPSILRTRIVYAQQ

SEQ ID NO: 137563 - protein, 228 aa, Glycine max
  Coding DNA Sequence Number=SeqID_20785
  Gene Ontology: Mol. function=isomerase activity; Biological process =protein modification process
  Homolog annotation: Hit_ID=Q53B73; Match level="QueryCoverage=90%, HitCoverage=73%, E-value=1e-102, Identity=92%"; Hit description =Putative chalcone isomerase 3
  Pfam annotation: Domain name=Chalcone; Domain location=20-228; Score =28.7; E_value=6.2e-07; Accession=PF02431.6; Description=Chalcone -flavanone isomerase
MVAKLSQSNFNLKLLAAANAEYVEEPATNVKFQTSLNFPGCSNSLTLFGTGYREKVFAIIGVKVYAAGLYLDQSVTQELNAWKGQSKDAIQGNSSLFETIFQSSFEKSLQIVLVRDVDGKTFWDALSDAISPRIPQPTTTDETALTTFRGVFLDRPLKKGAIIILTWLTPPDCLFQVSVSSNGFPSTVDATIESANVASALFNVFLGDSPVSPSLKASVAEGLSKVLK

SEQ ID NO: 137564 - protein, 299 aa, Glycine max
  Coding DNA Sequence Number=SeqID_20786
  Gene Ontology: Cellular component=membrane
  Homolog annotation: Hit_ID=Q6ZGZ0; Match level="QueryCoverage=92%, HitCoverage=77%, E-value=5e-69, Identity=47%"; Hit description =Putative purine permease
  Pfam annotation: Domain name=TPT; Domain location=132-281; Score =150.7; E_value=4e-42; Accession=PF03151.7; Description=Triose -phosphate Transporter family
MGQSGAVLLGRFSFDQGGESIWMSTLVQTVAFPIVFFSLFFPHPKYNSGTTDLTMHSSTHTLIMVYFLLGILLAGDNLIDTIGLLLYLPVPTYSLICASQLAFNAIFSILINAEKLTHDNTKNATKNKHMVGIWCTLGASAGYALLLCLMQLSLERVLKRETFSVVLEMQIWTSLVASCVCIVGLFSSGEGKGLEDEMRRFKAGREVYMLTLVGTALAWQICSVGVVRLIYLVSTLFSNVMSMLSLPLVPVAAVLLYHEQMEGVKIVAMLLAILGLMQCVKMEAMFIFRSSHGNQKLKI

SEQ ID NO: 137565 - protein, 264 aa, Glycine max
  Coding DNA Sequence Number=SeqID_20787
  Gene Ontology: Mol. function=binding; Cellular component =intracellular; Biological process=RNA processing
  Homolog annotation: Hit_ID=Q8GTX9; Match level="QueryCoverage=72%, HitCoverage=68%, E-value=3e-84, Identity=60%"; Hit description=Cell cycle control crn (Crooked neck) protein-like
  Pfam annotation: Domain name=HAT; Domain location=105-137; Score =23.4; E_value=0.00083; Accession=PF02184.7; Description=HAT (Half-A -TPR) repeat
  Pfam annotation: Domain name=HAT; Domain location=139-171; Score =12.4; E_value=0.18; Accession=PF02184.7; Description=HAT (Half-A -TPR) repeat
  Pfam annotation: Domain name=HAT; Domain location=71-103; Score=4.0; E_value=5.6; Accession=PF02184.7; Description=HAT (Half-A-TPR) repeat
  Pfam annotation: Domain name=TPR_2; Domain location=125-158; Score =7.9; E_value=4; Accession=PF07719.7; Description=Tetratricopeptide repeat
  Pfam annotation: Domain name=TPR_2; Domain location=91-124; Score =18.9; E_value=0.019; Accession=PF07719.7; Description=Tetratricopepti de repeat
  Pfam module annotation: Pfam domain module=HAT::HAT::HAT::TPR_2::TPR _2; Domain location=105-137::139-171::71-103::125-158::91-124
MSSSKDADPSLGYLTRKDTEVKLPRPTRVKNKTPAPIQITAEQILREARERQEAEIRPPKQKITDPTELGEYRLRKRKEFEDLIRRVRWNIGVWIKYAQWEESQKDFKRARSVWERALEVDYKNHTLWLKYAEVEMKNKFINHARNVWDRAVTLLPRVDQLWYKYIHMEEMLGNVAGARQVFERWMKWTPDQLSPLLLYLLLHLHGGKSPLKLKDLASIEASQASFHQEPLGTLFDVASHRCNAHKMKRFHLVISKEASIAQNI

SEQ ID NO: 137566 - protein, 157 aa, Glycine max
  Coding DNA Sequence Number=SeqID_20788
  Gene Ontology: Mol. function=acyltransferase activity; Cellular component=integral to membrane
  Homolog annotation: Hit_ID=Q9LZ72; Match level="QueryCoverage=95%, HitCoverage=33%, E-value=4e-35, Identity=52%"; Hit description=3 -ketoacyl-CoA synthase 21
  Pfam annotation: Domain name=FAE1_CUT1_RppA; Domain location=1-156; Score=-56.2; E_value=1.3e-12; Accession=PF08392.2; Description =FAE1Type III polyketide synthase-lik
MCKHHPPKHELGFGYRFLVKSITKCGIGRNIYTPRNIMAGREAFCTIEDSLKEMDDIMFNTFDILFNNNTAFFSPSHIDILVVNEPMFASVPFFTSRIINRYKLRQNIMAFNLSGMECSGSVIAISLVQQLFRTDKNSFAIVVSTEGALWYFVMHFS

SEQ ID NO: 137567 - protein, 70 aa, Glycine max
  Coding DNA Sequence Number=SeqID_20789
MLELSRPPWRMSGKLKSDMEKPVRNDPWNFDQRILILKDLNPQESPKNIDLRWCHFWLQGEDIPPECRTN

SEQ ID NO: 137568 - protein, 107 aa, Glycine max
  Coding DNA Sequence Number=SeqID_20790
  Gene Ontology: Biological process=cell adhesion
  Homolog annotation: Hit_ID=Q1S8R9; Match level="QueryCoverage=62%, HitCoverage=15%, E-value=2e-13, Identity=55%"; Hit description=Beta -Ig-H3/fasciclin
MPFAKSAFEIKVIKIEVKENCENKGKEIGLARHKICNLNPNRMASLQHQQSSSDRKLLEIHDGWLMVRHEVEPNIGDVRVQTREDGEIIDNEHNHVVQHHEFRVLHH

SEQ ID NO: 137569 - protein, 185 aa, Glycine max
  Coding DNA Sequence Number=SeqID_20791
  Gene Ontology: Mol. function=RNA-directed DNA polymerase activity; Cellular component=chromatin; Biological process=RNA-dependent DNA replication
MRIIKEGLQGERWAVNENIIKEHCHEFVKEGLQEVIHGGLERGGGIVEPKWHDFEFIMTPMCVKHSLRDISFCHSYLMESLMQIQFGELGSTTKFIKQFIDSWHWKMHITSWPPASQAHSSSNRGSVWWELVRFPKNITEKRRRRSIRVGLKCLEGVVKRKTSGLDQGCGKYETRLKCCVEAWVS

SEQ ID NO: 137570 - protein, 213 aa, Glycine max
  Coding DNA Sequence Number=SeqID_20792
MSEIVEVQEQMKADMEAMKEQIATMVEAMMSMKRMMEVNAAMGKEAKHEEVRAVPILCKFKTSIPSHHMPCLPTIHHPVLHTLPIRMSITPLPYSLRDNNPNMIMHMYLNPWGAREESQDHALADFEPYPGHAIEGQAFGGGDYAFADMAELCLVPDVVIPPKLKVLDFDKYKGTTCPMNHLKMYSRKMGAYSKNEKLLMHFFQESLTEAAIT

SEQ ID NO: 137571 - protein, 59 aa, Glycine max
  Coding DNA Sequence Number=SeqID_20793
MSVKNLIGLPEVHDKIEYTLDQHRLQGTFKPSVFTPKAYTPKSSSGPLLTDSGPTQKTF

SEQ ID NO: 137572 - protein, 239 aa, Glycine max
  Coding DNA Sequence Number=SeqID_20794
  Gene Ontology: Mol. function=ribonuclease H activity; Cellular component=intracellular; Biological process=DNA integration
  Homolog annotation: Hit_ID=Q1S8I9; Match level="QueryCoverage=87%, HitCoverage=42%, E-value=1e-82, Identity=69%"; Hit description =Probable integrase-common tobacco
  Pfam annotation: Domain name=rve; Domain location=19-175; Score=50.7; E_value=4.8e-12; Accession=PF00665.16; Description=Integrase core domain
MRTYSRDEKLLMHFFQDSGTNITLKWLSTDVIRAIEPKVSNGHRFILVTIDYFIKWVEATSYTSVTRSVVVRFIKKEIIYRYRLPRNIITDIATNLNNKMMKEMYEDFKIQHHNSTPYRPKMNGAVEAASKNIKKIVQKMIVSYKDWHEMLPFTLHGYQTSIHTSTRATPFSMVYGMEVVLPFEVEVPSLRILVESGLKELEWAQTRFDQLNLIEGKRLAAMSHERLYQRRVKNAFDKK

SEQ ID NO: 137573 - protein, 114 aa, Glycine max
  Coding DNA Sequence Number=SeqID_20795
  Homolog annotation: Hit_ID=Q2R300; Match level="QueryCoverage=63%, HitCoverage=7%, E-value=6e-13, Identity=47%"; Hit description =Importin, putative, expressed
  Subcellular localization annotation: CTP_CleavageSite=47; ConfidenceScore=5.38e-01
MAFPWPNVDPDISLSLKQNPASYTQVLNASSRGLHRMRTVFSYLPISMATEPAADDLILSLLRVFWPILEKLFGSEHMENGNLSVAACRALSLAVRSSSLPTWTHLLTVHRFPL

SEQ ID NO: 137574 - protein, 96 aa, Glycine max
  Coding DNA Sequence Number=SeqID_20796
  Gene Ontology: Mol. function=protein serine/threonine kinase activity; Biological process=protein amino acid phosphorylation
  Homolog annotation: Hit_ID=Q5NDD1; Match level="QueryCoverage=65%, HitCoverage=19%, E-value=1e-14, Identity=61%"; Hit description =Putative serine-threonine protein kinase
MTGEMRGSFELLGEVGSGRVVGSLLDEVDVGEATFPELAHDAKAVLVDPNITSAVQSRKEPIQRILGDEASAPAQQERESEKVTLPNERMRAREKV

SEQ ID NO: 137575 - protein, 106 aa, Glycine max
  Coding DNA Sequence Number=SeqID_20797
  Homolog annotation: Hit_ID=Q69IM0; Match level="QueryCoverage=40%, HitCoverage=6%, E-value=1e-10, Identity=74%"; Hit description =Putative translation initiation factor IF-2
MLTLFNNGFSVEALMELLKSGMYLAKIGLDNLEEALLLQADMMDLKARIHGPAQAYVMEARLDEGRVEVVQGDARNVLCICIGFGKPRLQSYQKLPNLSGDISIMY

SEQ ID NO: 137576 - protein, 134 aa, Glycine max
  Coding DNA Sequence Number=SeqID_20798
MAREWKPVFKMLIQWKSVFEEDHFVGDGRFGVSSYPMPGYMRVPITFPSSPSHSSSLAAFVADIAMMVEEIFAQSIVREYILPSPDNKIPLSTYRSYNLDYVDDIGDEEEDRSKDVSNVREILEIKEDPLEDSS

SEQ ID NO: 137577 - protein, 64 aa, Glycine max
  Coding DNA Sequence Number=SeqID_20799
  Homolog annotation: Hit_ID=Q2VZZ8; Match level="QueryCoverage=75%, HitCoverage=16%, E-value=2e-07, Identity=38%"; Hit description=Gamma- glutamylcysteine synthetase
MEGDNIIGLKNEMGIGFLELGFQPKWRLEDVPGVPKVNLEFSSEADMINKMCASIALQPVSEVC

SEQ ID NO: 137578 - protein, 106 aa, Glycine max
  Coding DNA Sequence Number=SeqID_20800
METKQPNLDPKQDHAKDVMPTMEWTLLIEVEIELKATTNGSFELEGLRAYALETPINAIIVRSDGKRVPKLVIKRGVTIGTSGMEVRTKMVLEDQKWRELVIPQQG

SEQ ID NO: 137579 - protein, 92 aa, Glycine max
  Coding DNA Sequence Number=SeqID_20801
MNTTQQGNKSPEEFAEQVVKEADEYNGFNLVLADICTSSMVYVFNRPNQDHLSLAQVVVTPGIHVLTNAALDAPWPKVEKYHKKEFVHLSFL

SEQ ID NO: 137580 - protein, 98 aa, Glycine max
  Coding DNA Sequence Number=SeqID_20802
  Homolog annotation: Hit_ID=Q9FY74; Match level="QueryCoverage=42%, HitCoverage=4%, E-value=7e-14, Identity=76%"; Hit description =Calmodulin-binding transcription activator 1
MLHRREPVQSYEVELDSTKFHQLKPQQEPPLPQTYRTSYILPPQLDILKMFQQSTPIFKPEWQIEKVGKNEEEIKAQPNVALSALLALSEQHEKQQTS

SEQ ID NO: 137581 - protein, 127 aa, Glycine max
  Coding DNA Sequence Number=SeqID_20803
  Pfam annotation: Domain name=Transposase_23; Domain location=37-107; Score=10.0; E_value=9.2e-05; Accession=PF03017.5; Description =TNP1ENSPM transposase
MQSQGLALPPEPEVGPSTARVSTKESFVDPSGNDPETGDSDKCGLYIKENPPRLIVLGRVYEGSTTVHNIPLLHDQVKVGVEEVKDADAPVPVPTDEVNLVGQALNTFLAWLTHLVKRLSEHVFCFH

SEQ ID NO: 137582 - protein, 152 aa, Glycine max
  Coding DNA Sequence Number=SeqID_20804
  Gene Ontology: Mol. function=hydrolase activity; Biological process =metabolic process
  Homolog annotation: Hit_ID=Q9SJM7; Match level="QueryCoverage=66%, HitCoverage=34%, E-value=6e-34, Identity=65%"; Hit description =Expressed protein
MEVGTCMQKVQCEIAGHENIPVAQGSPEPLKGGMPCVADFVHGKDGLGNTFLPSPKGEKIEKSASEFLVEKVSEYPSEAINGDSTFASKVKRIVILGGAFFALGNVNPAAEANDDLIVKESETVVLLEHVWVYVKKERVLGEEKWRTNLGGK

SEQ ID NO: 137583 - protein, 141 aa, Glycine max
  Coding DNA Sequence Number=SeqID_20805
  Gene Ontology: Mol. function=protein serine/threonine kinase activity; Cellular component=anchored to membrane; Biological process=protein amino acid phosphorylation
  Homolog annotation: Hit_ID=Q8GYY3; Match level="QueryCoverage=71%, HitCoverage=44%, E-value=3e-15, Identity=46%"; Hit description =Putative thaumatin
MEMPHSQPVTSSLEQENLTLSPHQPHGKAKSGAALVVPSTQPLEVSHVLLVIVALAIWNAAKKTNRHRVDSMCIVPVGILGSGYSSTGCLKELNMLCPPELALEVVGKKFLVLLGLFIDLRASVLTSFDLRSGVATRSGGS

SEQ ID NO: 137584 - protein, 580 aa, Glycine max
  Coding DNA Sequence Number=SeqID_20806
  Gene Ontology: Mol. function=protein serine/threonine kinase activity; Cellular component=membrane; Biological process=protein amino acid phosphorylation
  Homolog annotation: Hit_ID=Q1S5I7; Match level="QueryCoverage=99%, HitCoverage=85%, E-value=1e-165, Identity=52%"; Hit description =Protein kinase
  Pfam annotation: Domain name=DUF26; Domain location=114-168; Score =48.6; E_value=2.1e-11; Accession=PF01657.8; Description=Domain of unknown function DUF26
  Pfam annotation: Domain name=DUF26; Domain location=2-56; Score=80.2; E_value=6.6e-21; Accession=PF01657.8; Description=Domain of unknown function DUF26
  Pfam annotation: Domain name=Pkinase; Domain location=262-533; Score =147.6; E_value=3.4e-41; Accession=PF00069.15; Description=Protein kinase domain
  Pfam annotation: Domain name=Pkinase_Tyr; Domain location=262-533; Score=149.5; E_value=8.8e-42; Accession=PF07714.7; Description =Protein tyrosine kinase
  Pfam module annotation: Pfam domain module=DUF26::DUF26::Pkinase::Pkin ase_Tyr; Domain location=114-168::2-56::262-533::262-533
MVYGLYLCRGDVNTSLCHSCVQNSSILLKQHCPNTASAILWYPFCLLRYSNQNFFGNLTLTPRIPMFDATQNFTSAGEFDSDARVLMNGLIQMGSEEPLMFGTHMFNINGTQRRYGWVQCSRDITTEECRTCLSNMLEDVENCCEEKKVWRVFSPSCIVMYETQPFFLNGTSEPTPQQDEDGDNRRWLIIVIISVSGVVVVALLSISTYYFWCLKWKKDKQAIQEDGLNSMFSQDQTDKEESMNADLPMMPLSTILKSTNNFSDEHKLGKGGFGPVYKGVLPDGRQIAVKRLSKTSVQGVEEFKNEVILIAKLQHRNLVRLLACCIEQNEKLLVYEFMPNSSLDFHLFDMEKGEHLEWKNRLNIINGIAKGLLYLHEDSRLRVIHRDLKASNILLDHEMNPKISDFGLARTFGGDQKQANTIRVVGTYGYMAPEYAMEGLFSVKSDVFSFGVLLLEIISGKRSSKFYLSDQGQSLLIYAWNLWCERKGLELMDPIIEKSCVRSEVLKCMHIGLLCVQEDAADRPKMSSVVHMLASDTVSLSVPTRPAFSVGRAVTERECSSNTSMHYSVNEATVSEVIPR

SEQ ID NO: 137585 - protein, 72 aa, Glycine max
  Coding DNA Sequence Number=SeqID_20807
METLCEVHFGEPGGVMEVVQEVRGEFGGRGVSGEAGKWAIGIGLNRTEGGSGGLVGTLEDGTEIAVKRLSKT

SEQ ID NO: 137586 - protein, 416 aa, Glycine max
  Coding DNA Sequence Number=SeqID_20808
  Gene Ontology: Mol. function=RNA-directed DNA polymerase activity; Cellular component=chromatin; Biological process=chromatin assembly or disassembly
MCPKKRVHNHLKQRRGIAKPERHDLKLIMAMVSSEEIEFGKPVCTTQFIKELINCQNGKMVLDGYRVEGAIICTKLPCVIALLNQKNRRGKWAGIGMNIDRFSCGNEVDIVIGWARWRTGMKFGFKEDGMKAGVHVSLQFNKVALSNEFHGQIVVVQHALNGHCNILTKEIALELVIVAHHDPLIWVGAGSVVPHGSAGWVQKGNFWRNIIIFIRNQKEGSKSTTMATMELLITGAMVEEGVVLLKWQVAVQGKMMNGHAVTYEGQGTFPPAGMPTPRPELTSKVVGLGPCHVSHRSVPRQNNSKGIAVEATRWWGHHIRKGQSEPEELVKRLARRGRVILEELINFEDPPKRFIPIKLWGFKFHTRGMRGNWVLWWGGRGERRAMASSILSMLDFERVELAIEDNKSTNVRSTNS

SEQ ID NO: 137587 - protein, 149 aa, Glycine max
  Coding DNA Sequence Number=SeqID_20809
  Gene Ontology: Mol. function=chromatin binding; Cellular component =chromatin; Biological process=chromatin assembly or disassembly
  Homolog annotation: Hit_ID=Q1SAV4; Match level="QueryCoverage=57%, HitCoverage=21%, E-value=1e-15, Identity=52%"; Hit description =Integrase, catalytic region
  Pfam annotation: Domain name=Chromo; Domain location=62-113; Score =17.4; E_value=0.0086; Accession=PF00385.14; Description='chromo' (CHRromatin Organisation MOdifier
MACLEAWFLTETLFSSADFGRKWSHNTSKHSGLGLSPYEVTFDIAITPLPLPAKSIDNQPVLTPLVILSTRWQSFDTEPKLQVLVQWEGLTPDDTSWEDWELLKSDCHLENKVFFHAEGNDRKKNLQGKNTNLRPKRITTPPKYLQDFV

SEQ ID NO: 137588 - protein, 100 aa, Glycine max
  Coding DNA Sequence Number=SeqID_20810
  Gene Ontology: Mol. function=methionyl aminopeptidase activity; Cellular component=cytoplasm; Biological process=proteolysis
  Homolog annotation: Hit_ID=Q0ZPT7; Match level="QueryCoverage=62%, HitCoverage=13%, E-value=4e-27, Identity=85%"; Hit description =Methionine aminopeptidase 2
MEEEMKSGKWRVATHWTPNSGDKTILQYDDVMKLDFGTHVDGYIVDCAFTMAFNPMFDPLLEASCEATNMGIKEEELTGEEHKSRPKRITTPLKYLQDFV

SEQ ID NO: 137589 - protein, 298 aa, Glycine max
  Coding DNA Sequence Number=SeqID_20811
  Gene Ontology: Mol. function=chromatin binding; Cellular component =chromatin; Biological process=chromatin assembly or disassembly
  Homolog annotation: Hit_ID=Q1SAV4; Match level="QueryCoverage=88%, HitCoverage=99%, E-value=2e-42, Identity=52%"; Hit description =Integrase, catalytic region
  Pfam annotation: Domain name=Chromo; Domain location=213-260; Score =17.0; E_value=0.0096; Accession=PF00385.14; Description='chromo' (CHRromatin Organisation MOdifier
MRKDVQFYIRSCSDCLHNKYVPQKPPGLLQPIFPPFRPWEDLALDFVTRLPMYQGATVILAVVDRFSKGAHFGMLPTHFTAHHVSHLFIDMVSRQETFRFLRKELEHAQASMKKIVDAHHKDVTFTVGNWVYVKLRPYQQSSVSGHKHHKQGKRYFWPYKIVERVGPVAYKLVLLESSKIHLVFHCSLLKPHFGPIHSDNHFPPVSLEEKPIIQPLVVLDSKWDSSTSPRKLVLVQWLGLQPENSTWEDWIELEDTYHLEDKVFFQGPRGDSNLHQSDCGHRPKRMGKKPQGWEDYVH

SEQ ID NO: 137590 - protein, 142 aa, Glycine max
  Coding DNA Sequence Number=SeqID_20812
MYVRNQATAYPSGLYISKATNIKDDAKMKGFNLHYTEEMLSRQMKWKKLVHAPDAYNARTFWNQIMLADTLKASTSDYDGSDNVVHRDIIQVLHSVRKYHFNCACICVTKMPTTTHSFSVFYDIPLFNTKGLKIPLRGVMNI

SEQ ID NO: 137591 - protein, 265 aa, Glycine max
  Coding DNA Sequence Number=SeqID_20813
  Homolog annotation: Hit_ID=Q2R135; Match level="QueryCoverage=21%, HitCoverage=30%, E-value=5e-15, Identity=67%"; Hit description =Signal peptidase I family protein, expressed
MKRVEGDNVTYFDALHSKAAQVAVVPKRHVWIQGDNIYASRDSRHFGPVPYGLIEGKVFFREGYCIQGSGNQGGALKRIDYQGNWVNADKAGDQKTIVYNLMCDKAKIWANILNKSVLHKVGSKKSVLNLHKFVLFHLMGNLPFDMPHTIYINILRGLKGLGGLDDIYYATLIKKVLCDQGIYHVFDKMDDNFKHTIIAKGSVIAKQQKYSKTNLKAMKVALKQNLKKALQVDLDAIDKRKQKSLAKAITDEDRGLNSFGIAKKI

SEQ ID NO: 137592 - protein, 88 aa, Glycine max
  Coding DNA Sequence Number=SeqID_20814
  Subcellular localization annotation: CTP_CleavageSite=40; ConfidenceScore=5.01e-01
MKDKHMRYATNTLDSSLHAMWYHFSVKNLVGRLGVHDRTCLTMGRPVRVTLFCENAPTMWDRHRLTGALKPDDPQGLHSEESVRASPS

SEQ ID NO: 137593 - protein, 323 aa, Glycine max
  Coding DNA Sequence Number=SeqID_20815
MVDRGRGGGRKSFNHGRRCGVSLRAPITTNPFTSSIHISTSELMIQVIALAPNTLPIAQDQPNSTFVRELIPTTPIGDASPSTSNDSLTLEYPPNPNYEHTVDHRPFICAYKGEFQPTYGCSNIILDIIREKFDELVASWLKKEYRWFLAKERAIRAIFETKGSHILKSEMNKIKNGQDKGKWITTNVRAALGERPNYKGNVYKLSTLSKRFNSSKSAPSTSIGLVKMCEIINKLNVELLAKADKEKTLEEKMLQLMENYEHQSQEMRQQVQEQNEQMQRILQHLYIQCIMSAPSPSITIADEIEHHVDDAQVDRSHDMSKDH

SEQ ID NO: 137594 - protein, 92 aa, Glycine max
  Coding DNA Sequence Number=SeqID_20816
  Subcellular localization annotation: CTP_CleavageSite=64; ConfidenceScore=5.12e-01
MTHRYFNLHHLSASSTDILHLYVSKASKSFKKFIKIQRSMRHRSIDGRTKRSLFDNSFTELRTTSSLEKEHADYGGCKEVPFYDFLGGSVDE

SEQ ID NO: 137595 - protein, 85 aa, Glycine max
  Coding DNA Sequence Number=SeqID_20817
  Homolog annotation: Hit_ID=Q6ZLH4; Match level="QueryCoverage=87%, HitCoverage=9%, E-value=5e-18, Identity=56%"; Hit description =Putative pentatricopeptide (PPR) repeat-containing protein
  Pfam annotation: Domain name=PPR; Domain location=28-62; Score=44.9; E_value=2.8e-10; Accession=PF01535.11; Description=PPR repeat
MFGQNGIDYQVSGVFEEMKRSRFVPERDTFNTLISAYGRCGSFDQAMAAYKRMLEAGVSPDVWLGRSVEASQEQGVAANMATSLQ

SEQ ID NO: 137596 - protein, 168 aa, Glycine max
  Coding DNA Sequence Number=SeqID_20818
MEIEWKNVGTITEGRDIAVPPRVEVSIAINSARIFSSATRWFMLSQKKKLSATNDLSLLARRMFSAAMLSAFLAPSHFFMTERMVVLDGEYGARERIEMTPYWELRVRLDWGELVVAKDIGEGDRGELVAGEVVIDSEVGVGDSENGEGSTIREICGEGHGGGEEGGE

SEQ ID NO: 137597 - protein, 200 aa, Glycine max
  Coding DNA Sequence Number=SeqID_20819
MKEAQATKVVEHGEVALITIESIQSANRKITIEATNVVVWDSGIWKPNWPLFDLKSRQAMHVNGKLQKLKRLVEVPKDPPLSPLSVATYPSAGGRRVTRGMRVPRKEYARSRHQRLFEENVGKTGKDAIYELLSERFGSCIYARGSKIGEVVAAQLAQASRVASSRSNRLLEESSGGPKWAWVLFAPPFLLSTPPSAVFW

SEQ ID NO: 137598 - protein, 101 aa, Glycine max
  Coding DNA Sequence Number=SeqID_20820
  Subcellular localization annotation: CTP_CleavageSite=65; ConfidenceScore=5.33e-01
MRVHCYQASRRPSMTTDSPPLLMFPRTWVLQPTLLRASDARLTGASSKGGKCTESPPTFTCGKCRKNRRKPVKKNIPDSGVVFMFEEGISISHVCPKGQQP

SEQ ID NO: 137599 - protein, 149 aa, Glycine max
  Coding DNA Sequence Number=SeqID_20821
  Gene Ontology: Mol. function=binding; Cellular component =mitochondrion; Biological process=transport
  Homolog annotation: Hit_ID=O23484; Match level="QueryCoverage=99%, HitCoverage=19%, E-value=4e-34, Identity=46%"; Hit description=Salt -inducible protein homolog
  Pfam annotation: Domain name=PPR; Domain location=25-59; Score=11.5; E_value=0.32; Accession=PF01535.11; Description=PPR repeat
  Pfam annotation: Domain name=PPR; Domain location=60-94; Score=33.2; E_value=8.9e-07; Accession=PF01535.11; Description=PPR repeat
  Pfam annotation: Domain name=PPR; Domain location=95-129; Score=35.7; E_value=1.6e-07; Accession=PF01535.11; Description=PPR repeat
  Pfam module annotation: Pfam domain module=PPR::PPR::PPR; Domain location=25-59::60-94::95-129
MVNCANKPMELFEKMFGFGYEPDGITCSAMVYAYGLSNNVDKVVSLYDCAIVEKWCLGVAALLALIKMYSMAGNYDRCLKIYQEMKVLGVKPNVVTYNSLLGAMLKAKKHQQAKAIYKEMRSNGVSLDFITYTCLVEVYTIPHYSEDGL

SEQ ID NO: 137600 - protein, 530 aa, Glycine max
  Coding DNA Sequence Number=SeqID_20822
  Gene Ontology: Mol. function=RNA-directed DNA polymerase activity; Cellular component=nucleus; Biological process=RNA-dependent DNA replication
MNGPSGKTENQDTGEQTRSRENCKKGATFIWELANQLGAIVVEDQGRMVEKFMAVEERDRKEAEKECWRTHQQRGWGGYVLKEKIKRLKARLKIWNRDQFGDTFKRYKKIEGELNRLEVSIIHRKLSPKEVLIRKQLQEDLWATAQSHKSLLRQKARARWTIGQQHNDMLTRRFLEEEIKDAVWGCGSEKISGPNGINFKFIKRFWHLVKPDVLQFLDELYVNGIFPRGCNASFVVLIPKVVEEAKISQKPCLVFKVDYEKAYDSVSWDFLVYMLRRLGFCAKWIQWIVGCLKSTSISVLVNGSPSTEFSPQRGLRQGDPLAPFLFNIVGEALNELASKENVRAIKAILRTFKLASGLKINFAKSCFGAIGMPERWKSEAAGCLNCSLLSIPFVYLGIPIGANLRWGQMWDPIIKKCERALTKWKAKTLIPKKVADKLVSLQRRFLWGGGPDKNKIAWVKWDIHEGQLWARVLESKYGGWRGLDEAPRGNKESIWWRELKMAFQNSQQGEEFKKGIQWRVGSGDRIILGG

SEQ ID NO: 137601 - protein, 123 aa, Glycine max
  Coding DNA Sequence Number=SeqID_20823
  Subcellular localization annotation: CTP_CleavageSite=28; ConfidenceScore=5.07e-01
MLPKLGPGFPNIGPRPFDSPDAYSATTSATNRTRGAYHGTLHSLFVQLFTHPVRVAGPCHPSDIWLKYPFHNPTLSKLAGFDSLPTHALLSHFSISSVGSSYTDDSPPSPLCTLFLFPATTSA

SEQ ID NO: 137602 - protein, 816 aa, Glycine max
  Coding DNA Sequence Number=SeqID_20824
  Gene Ontology: Mol. function=binding; Cellular component =intracellular; Biological process=protein amino acid phosphorylation
  Homolog annotation: Hit_ID=Q9LHZ4; Match level="QueryCoverage=93%, HitCoverage=96%, E-value=0.0, Identity=46%"; Hit description =Pentatricopeptide (PPR) repeat-containing protein-like
  Pfam annotation: Domain name=PPR; Domain location=109-143; Score =19.2; E_value=0.015; Accession=PF01535.11; Description=PPR repeat
  Pfam annotation: Domain name=PPR; Domain location=144-178; Score=2.1; E_value=4.2; Accession=PF01535.11; Description=PPR repeat
  Pfam annotation: Domain name=PPR; Domain location=210-244; Score =41.1; E_value=3.8e-09; Accession=PF01535.11; Description=PPR repeat
  Pfam annotation: Domain name=PPR; Domain location=311-345; Score =45.6; E_value=1.7e-10; Accession=PF01535.11; Description=PPR repeat
  Pfam annotation: Domain name=PPR; Domain location=346-380; Score=0.3; E_value=7; Accession=PF01535.11; Description=PPR repeat
  Pfam annotation: Domain name=PPR; Domain location=411-445; Score =50.4; E_value=6e-12; Accession=PF01535.11; Description=PPR repeat
  Pfam annotation: Domain name=PPR; Domain location=512-546; Score =39.3; E_value=1.4e-08; Accession=PF01535.11; Description=PPR repeat
  Pfam annotation: Domain name=PPR; Domain location=547-581; Score =20.9; E_value=0.0045; Accession=PF01535.11; Description=PPR repeat
  Pfam annotation: Domain name=PPR; Domain location=583-616; Score =11.8; E_value=0.29; Accession=PF01535.11; Description=PPR repeat
  Pfam module annotation: Pfam domain module=PPR::PPR::PPR::PPR::PPR::PP R::PPR::PPR::PPR; Domain location=109-143::144-178::210-244::311 -345::346-380::411-445::512-546::547-581::583-616
  Subcellular localization annotation: CTP_CleavageSite=54; ConfidenceScore=5.64e-01
MQLFALCPLPFGANTNTNTKYSKTTTTTTSFYQSNSIPTRVYSHRHPSVVLLENCTSKKELYQILPFIIKNGFYNEHLFQTKVISLFCKFGSNSEAARVFEHVELKLDVLYHIMLKGYAKNSSLGDALCFFLRMMCDEVRLVVGDYACLLQLCGENLDLKKGREIHGLIITNGFESNLFVMTAVMSLYAKCRQIDNAYKMFERMQHKDLVSWTTLVAGYAQNGHAKRALQLVLQMQEAGQKPDSVTLVSILPAVADMKALRIGRSIHGYAFRSGFESLVNVTNALLDMYFKCGSARIARLVFKGMRSKTVVSWNTMIDGCAQNGESEEAFATFLKMLDEGEVPTRVTMMGVLLACANLGDLERGWFVHKLLDKLKLDSNVSVMNSLISMYSKCKRVDIAASIFNNLEKTNVTWNAMILGYAQNGCVKEALNLFCMMQSQGIKLDCFTLVGVITALADFSVNRQAKWIHGLAVRACMDNNVFVSTALVDMYAKCGAIKTARKLFDMMQERHVITWNAMIDGYGTHGVGKETLDLFNEMQKGAVKPNDITFLSVISACSHSGFVEEGLLLFKSMQEDYYLEPTMDHYSAMVDLLGRAGQLDDAWNFIQEMPIKPGISVLGAMLGACKIHKNVELGEKAAQKLFKLDPDEGGYHVLLANIYASNSMWDKVAKVRTAMEDKGLHKTPGCSWVELRNEIHTFYSGSTNHPESKKIYAFLETLGDEIKAAGYVPDPDSIHDVEEDVKKQLLSSHSERLAIAFGLLNTSPGTTLHIRKNLRVCGDCHDTTKYISLVTGREIIVRDLRRFHHFKNGSCSCGDYW

SEQ ID NO: 137603 - protein, 33 aa, Glycine max
  Coding DNA Sequence Number=SeqID_20825
MSLRQTSKVTAEVVADYGGHGKLRGRELVVELV

SEQ ID NO: 137604 - protein, 204 aa, Glycine max
  Coding DNA Sequence Number=SeqID_20826
  Gene Ontology: Mol. function=DNA binding
  Homolog annotation: Hit_ID=Q10CY9; Match level="QueryCoverage=57%, HitCoverage=16%, E-value=3e-09, Identity=30%"; Hit description =Expressed protein
MERYDLQRQRRDMKKKGRNVVWSIAMDKCLIEALAAQARSGNKIDKCFNENAYMAACVAVNTCFNLNLNNQKVINRLKTIKKRYKVIKDILSQNGFWWNPNTEMIECDSDEIWKNYVAAHPDAKGFHGKQIEIYDELKLFAMKSGTQLMDMKNCDNESASFVSPNSEDMSGTDGTESYTATPELGQMLDGFQEPPVPQMLFRKH

SEQ ID NO: 137605 - protein, 434 aa, Glycine max
  Coding DNA Sequence Number=SeqID_20827
  Gene Ontology: Mol. function=hydrolase activity, acting on ester bonds; Biological process=nucleobase, nucleoside, nucleotide and nucleic acid metabolic process
  Homolog annotation: Hit_ID=Q2HUT6; Match level="QueryCoverage=94%, HitCoverage=41%, E-value=6e-49, Identity=33%"; Hit description=SH2 motif; Alcohol dehydrogenase, zinc-containing; Resolvase, RNase H- like fold; Nucleic ...
  Homolog annotation: Hit description=acid-binding, OB-fold, subgroup
MSRLKAFNHWVLRLLRKSLKNIVLDDEDLELIRENKSFNQETLIDGKFKKLRKAGVDSELMEYSSDDRVSLFDDIAEDQTNDDVEDDMADFIVDDEDVIYGMGDSLNKKLKARKHSPAFSKGKHSFGKEGQLENHIGIVQIQATKSDDPNKYKSFIPTDMHIAGEDNCVNDTDIPERMQIFDSITNMLKKAETESEIDDIDRKFNLHFPPAEEFFDSGLWSLANKFGNPEKFGSLVTLEKVGKSSEEDPQESPEEIASMYKCETFQTTEAAAVMLSSEIPFRKYVSTIFMDKALVSTSPTIKGNTTAEEEKLLQVKTELPGHIINELIMTCNDTYLKDSEGISTRLWNEQHKLIMPDAISNFLFPYMEKEARELLNAKAKNWLLMKYAMQVWNRVSVAPYLKNAQKKRVMACCGGNGKPGTTFVVLDSEENWLM

SEQ ID NO: 137606 - protein, 53 aa, Glycine max
  Coding DNA Sequence Number=SeqID_20828
MEGDRGSSRDLAQEGRQTSFAGYASGGIASVGASASTDAGVVADGIASGSPYY

SEQ ID NO: 137607 - protein, 56 aa, Glycine max
  Coding DNA Sequence Number=SeqID_20829
MKYKRGPLVKVKAEHHRRINSEGDVGPRLVRSNGMRREWSLKDLAGQQQDKGVRCY

SEQ ID NO: 137608 - protein, 96 aa, Glycine max
  Coding DNA Sequence Number=SeqID_20830
MSFDFITKTRTPFEEIKSAASYALGNIVVGKNNQPICIYSSYCCHCCEVVIMSMQHVRRAAVLAISTLAHNKPNLIKGLLPDLLPLLYDQTIVKVT

SEQ ID NO: 137609 - protein, 212 aa, Glycine max
  Coding DNA Sequence Number=SeqID_20831
  Gene Ontology: Mol. function=protein binding
  Homolog annotation: Hit_ID=UPI0000E47D1A; Match level="QueryCoverage =92%, HitCoverage=21%, E-value=1e-10, Identity=28%"; Hit description =PREDICTED: hypothetical protein, partial
MYATVGFCMPAFAVIAASLLRVDLSCVLEHVANHALRQATLGTLNSLIVAYGDKIVLFAYEVIIVELSRLISDSNLHMIALALELCCTLMGDKRSNQSIGLAVRNKVLPQALTLIKSSLLQGQALSALQNVFAALVYSANTSIDYVLESLFASAKPSPQSGGIAKQALHSIAQCVTILCLVAGDQKCSSTVKMLTDILKDDNSSNSVSFSLQ

SEQ ID NO: 137610 - protein, 34 aa, Glycine max
  Coding DNA Sequence Number=SeqID_20832
MRPISDATNIEANGWKSKDHCNMMVKRIYVRLAV

SEQ ID NO: 137611 - protein, 78 aa, Glycine max
  Coding DNA Sequence Number=SeqID_20833
MMKHDAKQISNVLRCINQDNNQYKCHSKELGMLKPKLLQAFLELQALALSCSMLLMLLPLSLRGSYFLTNGTILHLKV

SEQ ID NO: 137612 - protein, 144 aa, Glycine max
  Coding DNA Sequence Number=SeqID_20834
MVSTQSGHRLETPLEDSHPHPAAMADTNTLQQLQNRIVEMERCHEEELRKLKAAHDQLEACVRRPQDDGHSAYTLPERTQGDAILPPRVLDRRLQEDWARVAKEGPRVLMNLRVSLAIRGLLKEASQGSFSRKLLNDMSLAIRG

SEQ ID NO: 137613 - protein, 216 aa, Glycine max
  Coding DNA Sequence Number=SeqID_20835
  Gene Ontology: Mol. function=RNA-directed DNA polymerase activity; Biological process=RNA-dependent DNA replication
  Subcellular localization annotation: CTP_CleavageSite=63; ConfidenceScore=5.05e-01
MAKIQGQKEGKPILIFTKKSGPNLGPWAHKSTMRIVSQGESHPRRTVNTTNDLNLSHMHRPVRQTTRQHPFVDRIMEADIPFGWKSLNLERSIDNFDTLVRQFSVQYTTNRIVQIRNLNLKVVLHSILLALCPDKFMDSLCRKPPSGMGELHERVNDYIQMEEIPYKRQPLPKGPKYERYTPLTPNRTTILEEAFNFEATQPPSKSKSQRTPRGAA

SEQ ID NO: 137614 - protein, 102 aa, Glycine max
  Coding DNA Sequence Number=SeqID_20836
MSILTLRSKKKGKKEDFQSKRKQKKRKEGKFPIKEKAKKEKKENSQSKSGRKRKERKENSKSKKKEWEKVKKKQAPGPRNQKKCAERSLDRTISEQYRIVTK

SEQ ID NO: 137615 - protein, 86 aa, Glycine max
  Coding DNA Sequence Number=SeqID_20837
MSRNLTDYAIVPSLASGMLRNFTDCVLTLPFNSRHVAELHGLPNEGCQVPRSGQVKVASHQTDGPRTKLGYDNTDVAGPQRTPSLQ

SEQ ID NO: 137616 - protein, 74 aa, Glycine max
  Coding DNA Sequence Number=SeqID_20838
MEERKSKVNKMKMKANKTRNELKVSDSNTYRLNNEEQTKNGRRTVFGNFTEATEAPKTIFQQNVEELAAQFLPP

SEQ ID NO: 137617 - protein, 119 aa, Glycine max
  Coding DNA Sequence Number=SeqID_20839
MKLLSFFLEAHSVLPSEGKGKSSYPGSRFIAKRLMFWLKRLAEGKTWRMSGYLLSNQFRDKGMPHIISMTPPLELVGLGSSSSMDSFASWKMNGSGIEKEERDEMPLQGEDEFRRSSPP

SEQ ID NO: 137618 - protein, 111 aa, Glycine max
  Coding DNA Sequence Number=SeqID_20840
MRAGNSDVYGFLEPQSIQRSRQLQFESESYMKSWMQSLKRDVYLGAYLNGALKGLDDTPQPKSKAGARWIVVKTKIKGITEFGYYVMHWMSMIILGTFRNNWETYFNDVRP

SEQ ID NO: 137619 - protein, 217 aa, Glycine max
  Coding DNA Sequence Number=SeqID_20841
  Homolog annotation: Hit_ID=Q47522; Match level="QueryCoverage=23%, HitCoverage=64%, E-value=9e-24, Identity=100%"; Hit description=LacZ protein
  Pfam annotation: Domain name=CheB_methylest; Domain location=56-155; Score=-69.0; E_value=1e-05; Accession=PF01339.8; Description=CheB methylesterase
  Subcellular localization annotation: CTP_CleavageSite=14; ConfidenceScore=5.19e-01
MTMITPSSKLTLTKGNKSWGVVRDIPVAVAPLHPVGASVTSASPGGLLGRLSTEKLICIGASTGGTEAIKEVLVQMPADSPAIVITQHMPPGLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137620 - protein, 52 aa, Glycine max
  Coding DNA Sequence Number=SeqID_20842
MGRLQDRHRVLNSASKSLCNFQTQTAIAQTSKWTVARGIHRYQYSLLAYLYQ

SEQ ID NO: 137621 - protein, 253 aa, Glycine max
  Coding DNA Sequence Number=SeqID_20843
YTDNILGRNILPERKVEIYHYELDEFKAELERQNSHKRLTNLVDGSIDLALVKEFYANLYSSEDHPPKQSRVRGHLVKIDADSLNTFLETPVVLAEGETLPAYSRYCSLPIDYREIEAALCIPARGFILNSEGHPRKILRKDLTTLAQVWSALSYSNLAPTSHTFDLTLDRARLIFGLVSHLHMNIRALIYGHMTSIAQSNTSRLGFHALINALCRARGVVSDSLTFERLSLIINLAYIRKNCWNPEDLTVSI

SEQ ID NO: 137622 - protein, 255 aa, Glycine max
  Coding DNA Sequence Number=SeqID_20844
  Gene Ontology: Mol. function=two-component sensor activity; Biological process=two-component signal transduction system (phosphorelay)
  Homolog annotation: Hit_ID=P38097; Match level="QueryCoverage=75%, HitCoverage=19%, E-value=7e-29, Identity=38%"; Hit description =Hypothetical protein yegE
AEQQIVARQVDPVERQQQRDKAGVEEKQQKGFEFGQAHRAPEQNHHDKGKRPRQEAQRQIAGQQRDHQRHSSSTGPKASTPITSEITHVEKNGNEAWPSTCSIHSATTPPSSGAIRPAASAKRIQSASELSGALRSSSARSISPPRMACTILRMANLTLLRAGPITSRLASAVPSTQLASSSGTCREGARNTTTVINAVEYQSGEMRPLTTISSRQNSVSKNASAQSSRALSHFFCGLSCEVVISRVMHESSSAH

SEQ ID NO: 137623 - protein, 49 aa, Glycine max
  Coding DNA Sequence Number=SeqID_20845
  Subcellular localization annotation: CTP_CleavageSite=27; ConfidenceScore=5.14e-01
PSPNQASSSNPSCWRSLSKVVLAQRLCTAHPSSKIVHPLSQKMSGLASS

SEQ ID NO: 137624 - protein, 361 aa, Glycine max
  Coding DNA Sequence Number=SeqID_20846
  Gene Ontology: Mol. function=oxidoreductase activity
  Homolog annotation: Hit_ID=Q15W08; Match level="QueryCoverage=58%, HitCoverage=62%, E-value=8e-51, Identity=46%"; Hit description =Alcohol dehydrogenase, zinc-binding
  Pfam annotation: Domain name=ADH_zinc_N; Domain location=76-228; Score=58.6; E_value=2.1e-14; Accession=PF00107.16; Description=Zinc -binding dehydrogenase
ERLLGKSWLRVILCLTLARGVFTFSGWQKYYIGDAQNFTVHRLPETTLPPSIFLGAVGTPGRSAYFGLNKIAKPKPGETLVVSAASGSVGSVVGQLGKLAGCRVVGLAGSEDKCRYVVEELGFDSCLNYKTADLNRDLRAACPQGIDIYFENVGGRVSLFVAKLLNEGARVPICGNAANYNKGTDVDASGPADFFSALPDAPLNRFFLVTEWFKDYAESDAFLLNAAENGFLYWLLYWRYFQTTDNAYVQADITNVSARISAVVVNSMIRDNHRVNKGDLLAQLDDREFVVALQKAEATLAQSRAALTNAQASYQMQKSAIDEFRSDVNSAAATLQYAHQQYLRFQILQKKNYVSKGGGIL

SEQ ID NO: 137625 - protein, 41 aa, Glycine max
  Coding DNA Sequence Number=SeqID_20847
GTYWVRTSNLPLGLLEGTYWMRTSNLPLGLLKVYAWCPSLP

SEQ ID NO: 137626 - protein, 90 aa, Glycine max
  Coding DNA Sequence Number=SeqID_20848
  Subcellular localization annotation: CTP_CleavageSite=32; ConfidenceScore=5.30e-01
MVYDHTSIMSNPPMFPIHTTVMPQPPTPAAVDASMPRHVVVACQKIAKSLQHMINMRMVTTRIDAYTMTEHCLRLAMCVIEKGKVYLRSR

SEQ ID NO: 137627 - protein, 74 aa, Glycine max
  Coding DNA Sequence Number=SeqID_20849
MASKTLHRSPRLFCNSLFKAQCTDHSLLSQPTLWWEGDARAHGCVSKKGKCAESPPSIIRGKRRKNRKDVVYEL

SEQ ID NO: 137628 - protein, 247 aa, Glycine max
  Coding DNA Sequence Number=SeqID_20850
  Homolog annotation: Hit_ID=Q2SNH4; Match level="QueryCoverage=65%, HitCoverage=90%, E-value=4e-43, Identity=53%"; Hit description =Uncharacterized protein conserved in bacteria
QLHFAVLDQHAPAHGALDLLAPQFDEGTIEVDHRKVVEARQALALLAPPDVRSVAAVVHHLHLAAAVAGLADARFVWMAQVDPLQDVAGVVVLPQVRLVIGTQAAAEFQAVAGVQREGEQAHHQAIVGLGRVLGQGQVVGHVVAAIHVADLQFGLADGGGESHGGGVRGRAVCGASTWHPFTLSCRRSATDDPAQPPAAAARPLAQPARWPVCTFPSHRPCAVAGPLRPRPCAGSAGQGTGAGHALA

SEQ ID NO: 137629 - protein, 212 aa, Glycine max
  Coding DNA Sequence Number=SeqID_20851
  Gene Ontology: Mol. function=RNA-directed DNA polymerase activity; Cellular component=intracellular; Biological process=RNA-dependent DNA replication
MTATCGPIFKLLRKDQGVVWTEDCQKAFDSIKNYLLEPPILIPPVEGRPLIMYLTVLEDSMGCVLGQQDETGRKEHAIYYLSKKFTDCESRYSLLEKTCCALAWAAKRLRHYMINHTTWLISKMDPIKYIFEKPALTGRIARWQMLLSEYDIEYRTQKAIKGSVLADHLAHQPIEDYQPIKFDFPDEEIMHLKMKDCDEPLLGEGPDPESRW

SEQ ID NO: 137630 - protein, 93 aa, Glycine max
  Coding DNA Sequence Number=SeqID_20852
MVTRRPNAAGAPQHRLLQPLHFSVGRLPLPVEGKKKWDLIEERLRAIVGFGDYPFADMVELCLVRDVVIPSKFKVPDFNKYKGTTCPKNHLKI

SEQ ID NO: 137631 - protein, 510 aa, Glycine max
  Coding DNA Sequence Number=SeqID_20853
  Gene Ontology: Mol. function=ATP-dependent helicase activity; Cellular component=intracellular; Biological process=DNA recombination
  Homolog annotation: Hit_ID=Q7XHW1; Match level="QueryCoverage=77%, HitCoverage=44%, E-value=1e-144, Identity=63%"; Hit description =Putative ATP-dependent DNA helicase recQ
  Pfam annotation: Domain name=DEAD; Domain location=124-288; Score =112.6; E_value=1.1e-30; Accession=PF00270.19; Description=DEADDEAH box helicase
  Pfam annotation: Domain name=HIT; Domain location=1-64; Score=13.4; E_ value=5.4e-05; Accession=PF01230.13; Description=HIT domain
  Pfam annotation: Domain name=Helicase_C; Domain location=356-432; Score=95.0; E_value=2.3e-25; Accession=PF00271.21; Description =Helicase conserved C-terminal domain
  Pfam annotation: Domain name=ResIII; Domain location=120-282; Score =1.7; E_value=3.4e-05; Accession=PF04851.6; Description=Type III restriction enzyme, res subunit
  Pfam module annotation: Pfam domain module=DEAD::HIT::Helicase _C::ResIII; Domain location=124-288::1-64::356-432::120-282
REVKRVADLTDDETIDLWRIAKKLGRQLESYHKASSLSFGIQDGPQAGQTVPHVHIHILPWKSGDYENNDDIYDDMNEKEKELNRALKWLQTLGPYASLPPLATMSVETMCSVLKKYFGFSDFRPYQREVIEKIIEKRDCLVVMATGSGKSLCYQVPPLVAKKTGIVVSPLISLMQDQVMALKQRGIKAEYLGSAQKDFTVHSKAEHGQFDILFMTPEKACTVPSSFWSNLLKAGISLFAVDEAHCISEWGHDFRVEYKHLDKLREVLLDVPFVGLTATATEKVRYDIISSLKLNNPYVTIGSFDRTNLFYGVKLLNRGQSFIDELVREISKEVTNGGSTIIYCTTIKDVEQIFKSFAEAGIEAGMYHGQMNGKAREESHRLFVRDELQVMVATIAFGMGIDKPNIRQVIHYGCPKSLESYYQESGRCGRDEKVWLIEVADFLHIFWRQVIPVLLVTCESPMYQEKQRKAIMESLLAAERYCVLTTCRRKFLLEYFGEKFPADRCGLPFT

SEQ ID NO: 137632 - protein, 363 aa, Glycine max
  Coding DNA Sequence Number=SeqID_20854
  Homolog annotation: Hit_ID=Q10LX6; Match level="QueryCoverage=44%, HitCoverage=78%, E-value=6e-58, Identity=68%"; Hit description =Expressed protein
MENALENGNLSSKLCSEDKEKISSAITKATKLLEGENQNGEIDVFENLFERVIGKEEKTTMLGVTTLTLGSSTTLVAQNHAQQHATTLASANGNRRDSVSNRTHPLPMSLVSSTDQSFSFLSSFKEPTHARPFTTAVASVDSDKLNSSDPPTKNEASKYYFLVANAKFMLDEEEHFQEQLFERLRLFGERNQEQDFWLVIEPKFLDKFPNITKRLKRPAVALVSTNGPWITFMKLRLDRVLSDSFEAESLEEALAFNPTDLKFEKPEKWVAPYPKYEFGWWKPFLPPVQTEIRAIIHILHSCTLCDDMGVIVMRSGKLGAYVACRLLFEVGRPHLKCLSLRKYRGQCCNCDGRTDENFYSIRF

SEQ ID NO: 137633 - protein, 409 aa, Glycine max
  Coding DNA Sequence Number=SeqID_20855
  Gene Ontology: Mol. function=oxidoreductase activity; Cellular component=integral to membrane; Biological process=electron transport
  Homolog annotation: Hit_ID=Q2QYH7; Match level="QueryCoverage=99%, HitCoverage=78%, E-value=1e-130, Identity=53%"; Hit description =Cytochrome P450 family protein, expressed
  Pfam annotation: Domain name=p450; Domain location=2-405; Score =150.7; E_value=3.9e-42; Accession=PF00067.12; Description=Cytochrome P450
MPQILCVSQPDIVRDITTCTSLDLGKPSYQQKQLGPLLGQGVLTSNGTTWVHQRKILAPELYMEKVKGMMNIISESAISLLNLWKSRTEAEGGVADIKIDEYMRNFSGDVISRACFGSNYSKGEEIFLKLGALQEIMSWKNVSIGIPGMRYLPTKTNREAWKLEKEVKKLILQGVKERKETSFEKHLLQMVLEGARNSNTSQEAIDRFIVDNCKNIYLAGYETTAVAATWCLMLLASNQNWHDRVRTEVLEICRGSIPDFNMLCKMKQLTMVIHESLRLYPPVAVVSRQAFKDMKFGNIDVPKGFNLWIMVVTLHTDPDIWGDDANKFNPERFANGTIGACKLPHMYMPFGVGPRVCLGQNLAMVELKMLVALILSKFTFSLSPRYVHSPTLRLLIEPEHGVHLLVKKL

SEQ ID NO: 137634 - protein, 79 aa, Glycine max
  Coding DNA Sequence Number=SeqID_20856
MSSDSSSLDDKGADEDVRITIRYLRMSSDSPSLDDKGVDDDGWKFSSWVKVYGGLRSWLKRLAERPNMMYVKVLVWPAV

SEQ ID NO: 137635 - protein, 358 aa, Glycine max
  Coding DNA Sequence Number=SeqID_20857
  Gene Ontology: Mol. function=ATP binding; Cellular component =chloroplast; Biological process=response to heat
  Homolog annotation: Hit_ID=Q1SF16; Match level="QueryCoverage=88%, HitCoverage=62%, E-value=1e-106, Identity=55%"; Hit description=Heat shock protein Hsp70
  Pfam annotation: Domain name=HSP70; Domain location=39-356; Score =23.6; E_value=1.7e-16; Accession=PF00012.10; Description=Hsp70 protein
MVLAGLVRGRTLANLKLGMVHDAGGGGDVLRPIPHGAMLMGIDLGTTYSCVAVWQEHHCRVEIIHNDQGNNTTSFVAFTDDERLLKIRLLPIQRTMSLVVAGTHDKPMIILNYKDEEKHFCAEEISSIVLAKMWEIAEAFLEKRVKNAVIAGLNVMRIINEPTPAAIAYGLNRRTNNCVGERKIFIFDLGGGTFDVSLLTHKGKIFQVKVTTGNGHLGGEEIDNRMVDYFVKEIKRKKKVDISGNPKALRRLKTACERSKRILSCAVATHIETYALSDGIDFCSSTTRARFEEINMDLFKECMETVDKCLTDAEMDKSSVHDVILVGGSINTDEAVAYGEVVQAALLSEGIKNVLDLC

SEQ ID NO: 137636 - protein, 332 aa, Glycine max
  Coding DNA Sequence Number=SeqID_20858
  Gene Ontology: Mol. function=zinc ion binding; Cellular component =nucleus; Biological process=biological_process
  Homolog annotation: Hit_ID=Q1STQ3; Match level="QueryCoverage=45%, HitCoverage=91%, E-value=3e-17, Identity=30%"; Hit description =Bromodomain
  Pfam annotation: Domain name=Bromodomain; Domain location=97-184; Score=66.7; E_value=7.6e-17; Accession=PF00439.15; Description =Bromodomain
MRFLDEIEWMNRRSSRIIALEEKRHKEIERKLALALERKNNLVNHYKEKGKATMKVPDDLSDFSKDVEGPTKKGHKSKELYQLISSIKDSSLNDMPLRSILQIITDFLQRDDPDELFAQPINLDVVEKYHEIIKQPMDFGTIRAKIHEGLYTNLEQFKRDVFLMFSNAMNVNPATSKYHQVAEDISRDAKWIFEAFPNPYHFNSKLFLDKRSPTRKPQNEQLGTSQKVSPKEIGRNNATHVMVPKTEKRHMYWPPSKPLTTEVPCSNNPNILLNTNSIKYKESLLRFVEDLGPTAKRVAAKKLEALRDQQLCNVDSPTPQTSLQLSMPRHLL

SEQ ID NO: 137637 - protein, 68 aa, Glycine max
  Coding DNA Sequence Number=SeqID_20859
MAQLFTVEVCGLAIWLGGALIEGEKLNPKEREKLATHGHKEEAFDGGTMEGEFKYNQSSHLISSFFLS

SEQ ID NO: 137638 - protein, 408 aa, Glycine max
  Coding DNA Sequence Number=SeqID_20860
  Homolog annotation: Hit_ID=Q1STQ3; Match level="QueryCoverage=9%, HitCoverage=23%, E-value=2e-07, Identity=67%"; Hit description =Bromodomain
  Pfam annotation: Domain name=Bromodomain; Domain location=1-59; Score= -9.8; E_value=0.017; Accession=PF00439.15; Description=Bromodomain
MENYHEIVKQPMDFGTMRAKLYEGMYSNLNQFKRDIFLICSNGMNASPKTSKYHEVVGDINRYAKWIFEALNSDLGHFDSELSLNQRGPSRKQQKEQLRIPRRVTTKRAGRNNATHSTVLETEKRDKYWPPSKPLVAEVLNAKKPIIQLNENASKYKESLLRFVKDLGPTAQRVAAKKLEVISPVENVSYFHESAVQEHTNRLHLGANRTSNTRQWNTSAGTPTMLATGSSSNVFAHVHPTSMFSGRPQPRLTGNRNSLSLFSSLIPNPCLVSHSRPENSMSCMPSNNLALLPLVHQPRSEGTSNLSDLPLVSQPTPRESMYAMPSNNLTKLSLFPHREDCVSRMNPHGPVPQQEPNSSFLQILLGGETNNYGEGGGTLIGQPEEVPPQLPLNNDNDDHEEPNLELHL

SEQ ID NO: 137639 - protein, 92 aa, Glycine max
  Coding DNA Sequence Number=SeqID_20861
  Subcellular localization annotation: CTP_CleavageSite=39; ConfidenceScore=5.19e-01
MSPSPVSSMMSPTTTPLMTYISIYIMTLLLSQTPPTTIISATFETFIENLSTTQKRRDIHLELQVLKVVGKEEPPRILYFNSRLRGDWSGRS

SEQ ID NO: 137640 - protein, 231 aa, Glycine max
  Coding DNA Sequence Number=SeqID_20862
  Gene Ontology: Mol. function=nucleic acid binding; Cellular component= intracellular; Biological process=regulation of transcription from RNA polymerase II promoter
  Homolog annotation: Hit_ID=Q1STQ3; Match level="QueryCoverage=29%, HitCoverage=42%, E-value=6e-18, Identity=61%"; Hit description =Bromodomain
  Pfam annotation: Domain name=Bromodomain; Domain location=66-153; Score=67.2; E_value=5.3e-17; Accession=PF00439.15; Description =Bromodomain
MIFHLHGCTLPHDKLEVFHLIKPHVFHFLCVFTFSITSKLIQESGRDTHNASALETNGSYLNGMPLKKILNNIIDFLQRKDTYELFAEPANLDVVDNYHDIVKQPMDFGTMRAKLHEGMYTNIDHFKRDVFLICSNAINVNPPTSKYHQVAEGISKYAKQIFEALREEPQHSELKEFSQNKRRPSKKSEDGQRRTSPRVSPKPAGMETCSSLYNLFVVLTILTIMLYVPSS

SEQ ID NO: 137641 - protein, 85 aa, Glycine max
  Coding DNA Sequence Number=SeqID_20863
MKLTFHATFALSVLTMLNEYGGIRAQCVSHAKCAFTFQNYILGANHAFPVEPVHRAERLRRAKRVASHLQFASWDLLYFPAQIIH

SEQ ID NO: 137642 - protein, 266 aa, Glycine max
  Coding DNA Sequence Number=SeqID_20864
  Gene Ontology: Mol. function=protein kinase activity; Cellular component=integral to membrane; Biological process=protein amino acid phosphorylation
  Homolog annotation: Hit_ID=Q1T5L7; Match level="QueryCoverage=54%, HitCoverage=18%, E-value=1e-49, Identity=65%"; Hit description =Protein kinase
  Pfam annotation: Domain name=LRR_1; Domain location=1-23; Score=11.0; E_value=2.5; Accession=PF00560.23; Description=Leucine Rich Repeat
  Pfam annotation: Domain name=LRR_1; Domain location=119-139; Score =15.5; E_value=0.19; Accession=PF00560.23; Description=Leucine Rich Repeat
  Pfam annotation: Domain name=LRR_1; Domain location=25-47; Score =11.3; E_value=2.2; Accession=PF00560.23; Description=Leucine Rich Repeat
  Pfam annotation: Domain name=LRR_1; Domain location=49-71; Score =12.1; E_value=1.6; Accession=PF00560.23; Description=Leucine Rich Repeat
  Pfam annotation: Domain name=LRR_1; Domain location=74-95; Score =11.0; E_value=2.5; Accession=PF00560.23; Description=Leucine Rich Repeat
  Pfam annotation: Domain name=LRR_1; Domain location=97-116; Score =7.8; E_value=9.9; Accession=PF00560.23; Description=Leucine Rich Repeat
  Pfam module annotation: Pfam domain module=LRR_1::LRR_1::LRR_1::LRR _1::LRR_1::LRR_1; Domain location=1-23::119-139::25-47::49-71::74 -95::97-116
MLESIDLSSNNFSEEIPEAVSSLLSLRVLKLDHNRFAHSIPSGILKCQSLVSIDVSSNQLNGTLPEGFGAAFPKLRVLNLSGNNMYGHVSDISGLKSIVNLNISGNSFQGSIVDVFQGRLEVLDLSRNQFQGHIPQNNLSGDFFQNLNESLNLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 137643 - protein, 104 aa, Glycine max
  Coding DNA Sequence Number=SeqID_20865
MVQKGLVRHSVHPDHSEYSEHSEYLEHSVHSVVGDFEHSDFEHSSANYHIENMAQPPPRERTFREMVALDFTYESLCIQYPDEDVPYVLKTRLIHLMPKFHVLQ

SEQ ID NO: 137644 - protein, 167 aa, Glycine max
  Coding DNA Sequence Number=SeqID_20866
  Gene Ontology: Mol. function=phospholipase A2 activity; Biological process=lipid catabolic process
  Homolog annotation: Hit_ID=Q6ABB2; Match level="QueryCoverage=73%, HitCoverage=18%, E-value=2e-54, Identity=82%"; Hit description=RHS -family protein
  Pfam annotation: Domain name=RHS_repeat; Domain location=57-94; Score= 17.9; E_value=0.036; Accession=PF05593.4; Description=RHS Repeat
  Pfam annotation: Domain name=RHS_repeat; Domain location=99-137; Score=12.3; E_value=1.2; Accession=PF05593.4; Description=RHS Repeat
  Pfam module annotation: Pfam domain module=RHS_repeat::RHS_repeat; Domain location=57-94::99-137
MVKVGTSYVPINVSFSPKVGPGLPAVPPVQLLTGWCVTAKAPPDIIDADGQRTSMLYDRYGNLVSATDRAGKVIRHTYDGRGHCARTTLPTGGVIDYGWDEADRLTTISSGGTLRVRLDYQGTERTPVRLADAHATTLTMSWNRGLLRQLVDATGASISVDYDEYGQ

SEQ ID NO: 137645 - protein, 253 aa, Glycine max
  Coding DNA Sequence Number=SeqID_20867
  Homolog annotation: Hit_ID=UPI000067E801; Match level="QueryCoverage =31%, HitCoverage=20%, E-value=1e-32, Identity=85%"; Hit description =similar to ABC-type branched-chain amino acid transport systems periplasmic component
VPPVQLLTGWCVTAKAPPDISAGKCSGHAARRVPFAIQAAQLLGRAIGAGLFAITPAGERGMCCKAIKLGNARVFPVTTLNSIAPARSTTGSHRSACCSRRAPASRPRAGRRRACPRRRPPAPRPCGRRPRPWRWPRPPRSAPPAWPPRPAGRRRRTSSSPGRPATGPWSAPGRRRAARRTAPARRIKLIDTVDLEGGPVGKPVVPAALMNRPTRGERRFAYWALAECILAYYVGTDEGVSEVLHVAGEKRLH

SEQ ID NO: 137646 - protein, 126 aa, Glycine max
  Coding DNA Sequence Number=SeqID_20868
  Homolog annotation: Hit_ID=Q9LJR1; Match level="QueryCoverage=70%, HitCoverage=53%, E-value=2e-33, Identity=74%"; Hit description =Arabidopsis thaliana genomic DNA, chromosome 3, TAC clone: K7L4
MEGSLSTRGRGRQKNYRQNNLGRFKVKLVENDRLRNGNREALTALRKRARTTKSSVPSPFESIMKGVAGTSSRPLVQEVCTTCGKHDSSEQTWMMFPGTDLFARIPFHAAHTILETGAFIAARPNL

SEQ ID NO: 137647 - protein, 532 aa, Glycine max
  Coding DNA Sequence Number=SeqID_20869
  Homolog annotation: Hit_ID=Q2QXB9; Match level="QueryCoverage=41%, HitCoverage=23%, E-value=2e-24, Identity=31%"; Hit description =Expressed protein
  Pfam annotation: Domain name=DUF537; Domain location=45-194; Score =201.3; E_value=2.3e-57; Accession=PF04396.4; Description=Protein of unknown function, DUF537
MATPSKSTPIIASDTLEQKGKTMTESNANILQCPLNQQLYSSLDGPVAILWDIENCPVPCDVRPEDVAGNIRMALRVHPVIKGAVMMFSAYGDFNAFPRRLREGCQRTGVKLIDVPNGRKDAADKAILVDMFLFALDNPPPSSIMLISGDVDFAPALHILGQRGYTVILVIPANVGVSSALCNAGKFVWDWPSVVRGEGFVPPSKALVPPRGGPVELAGHFMGCHINDNSDGQNEEEAIVYRGMSQSYYNSREFSMVSQSLSEYNNGTLNTTCLPTTMRTHSLPSVLNDVPGGSMMPSSDLNECQLWVQPGDLNGLKGQLVRLLELFGGCLPLARVPAEYQKLYGRPLYVSEYGAIKLVNLFKKMGDALAVEGKGNRKFVYLRNWKAGPSAPPLSLAKKDKKGKEAQEENVNIVTGGCSSDEFSDEERVVIEEHDERSCIGKGNQGRAAKCEIDDRFIEQFKYELQEILVSYSCRIFLGCFEAIYQQRYKKQLEYQRFGVDKLEDLFEKVSDVVVLHEEPVSKKKFLAAVGG

SEQ ID NO: 137648 - protein, 408 aa, Glycine max
  Coding DNA Sequence Number=SeqID_20870
  Gene Ontology: Cellular component=mitochondrion
  Homolog annotation: Hit_ID=Q2QZ53; Match level="QueryCoverage=72%, HitCoverage=79%, E-value=5e-21, Identity=25%"; Hit description =Expressed protein
MESRKLAAILSSLVSQLLLLLLHNIFPFPPHNSILPLLLFSHQLAATLSPEPHKFLQRKRKRKRQRHFQLPNPLTRTPDSFRNTFLMSSSSFQWLSGLLDPLLECRDPAALFHSLNLSSGARLAIGLSRLAEGSDYPQISSRFSVSVPVAKFCVKQLCRVLCTNFRFWVSFPSPSDLPSVSQSFQTLSGLPNCCGSILCSRFNILVNANIPNNKVSISQVAAQIVVDSSSRILTIVAGFLGHKSDSQILHASSLYNDIQQGTLLNAPNAPFNQYLIGDSQYPLLPWLMVPYTNPAPGSAEENFNSAHQIMRLAALRASASLRNWGVLRKPVTEELKMAVAYIGACSILHNSLLMREDFSALASEFEDCNQGFCNAAAFEGEAVSSVALALRDNLANMAKEFCRDSKNS

SEQ ID NO: 137649 - protein, 650 aa, Glycine max
  Coding DNA Sequence Number=SeqID_20871
  Gene Ontology: Mol. function=protein serine/threonine kinase activity; Cellular component=integral to membrane; Biological process=protein amino acid phosphorylation
  Homolog annotation: Hit_ID=Q9LT87; Match level="QueryCoverage=96%, HitCoverage=95%, E-value=0.0, Identity=55%"; Hit description =Similarity to serine/threonine kinase
  Pfam annotation: Domain name=Pkinase; Domain location=302-570; Score =149.6; E_value=8.5e-42; Accession=PF00069.15; Description=Protein kinase domain
  Pfam annotation: Domain name=Pkinase_Tyr; Domain location=303-570; Score=121.9; E_value=1.9e-33; Accession=PF07714.7; Description =Protein tyrosine kinase
  Pfam module annotation: Pfam domain module=Pkinase::Pkinase_Tyr; Domain location=302-570::303-570
  Subcellular localization annotation: CTP_CleavageSite=55; ConfidenceScore=5.13e-01
MEVFRIVVKVKQTVGSTDCPLNFTGSNFTLASSLCSNHGDRGKCCRYINTNVAISVARFANATGNLGVPQNASDICLQTIFQTLELNGVAQNATAFCGFGTKIPVNYECKGRTSVVQMLQSPRFTEVTKNCKAPLGEESKCKKCLNAGFGYLHHIGIEDNITLSTCRDATFAALASQVDETSIIDIAICFFGVQGLLIPPVSESSPPLPAPKASPSPPRVADGPSHPLLSAPLKGNHHSYHLTLVPVLIVLIRQKSRELDEPDNFGKSCSKTLPPCATWKFQEGSSSMFRKFSYREIKKATNDFSTVIGQGGFGTVYKAQFSDGLIVAVKRMNRISEQGEDEFCREIELLARLHHRHLVALRGFCIKKCERFLMYEYMGNGSLKDHLHSPGKTPLSWRTRIQIAIDVANALEYLHFYCDPPLCHRDIKSSNTLLDENFVAKIADFGLAQASKDGSVCFEPVNTEIRGTPGYMDPEYIVTQELTEKSDIYSFGVLLLEIVTGRRAIQDNKNLVEWAQPYMESDTRLLELVDPNVRESFDLDQLQTVISIVVWCTQREGRARPSIKQVLRLLYETSEPMHSEFLQAVEDEEGQGSQHRGRRSKGKMLRNEALFHSGDGRYLASSSSTSRSYCSRTFLLESGSPQSPPNMFSL

SEQ ID NO: 137650 - protein, 59 aa, Glycine max
  Coding DNA Sequence Number=SeqID_20872
MPLRDRIASLVVVGGGEEDRAKRESNFYAECNSPCAKPDNSRLAQFPLGLELHLARFSR

SEQ ID NO: 137651 - protein, 91 aa, Glycine max
  Coding DNA Sequence Number=SeqID_20873
  Subcellular localization annotation: CTP_CleavageSite=43; ConfidenceScore=5.64e-01
MATPPTSPPPLPPSPLAVASQSLSTLKQTRKATRLQSLATRPPGAERSVVHVDPAIGKAEGPHKKKSSRHDIRDLEGSPCYSEGFDIGGYS

SEQ ID NO: 137652 - protein, 49 aa, Glycine max
  Coding DNA Sequence Number=SeqID_20874
MTQENIDIEYSLNDPTIDDLDDYDEQTFLSASSAYPNTGGTYIDIGDPV

SEQ ID NO: 137653 - protein, 101 aa, Glycine max
  Coding DNA Sequence Number=SeqID_20875
  Homolog annotation: Hit_ID=Q6R074; Match level="QueryCoverage=38%, HitCoverage=14%, E-value=2e-13, Identity=82%"; Hit description=MYB transcription factor
  Pfam annotation: Domain name=Myb_DNA-binding; Domain location=17-72; Score=22.5; E_value=0.0015; Accession=PF00249.21; Description=Myb -like DNA-binding domain
MAGHMGRGVIEEQVWRKGPWTAEEDRLLVEYVRLHGEGRWNSVARLAILRHPYLDSSKIATPLQRARLRLWRWWEQQVARVGTTEVRERRCEGGHKRDRVG

SEQ ID NO: 137654 - protein, 409 aa, Glycine max
  Coding DNA Sequence Number=SeqID_20876
  Gene Ontology: Mol. function=tetracycline:hydrogen antiporter activity; Cellular component=integral to membrane; Biological process=tetracycline transport
  Homolog annotation: Hit_ID=Q6D317; Match level="QueryCoverage=88%, HitCoverage=89%, E-value=1e-72, Identity=41%"; Hit description =Probable transporter
  Pfam annotation: Domain name=MFS_1; Domain location=26-378; Score =171.6; E_value=2e-48; Accession=PF07690.6; Description=Major Facilitator Superfamily
  Pfam annotation: Domain name=Sugar_tr; Domain location=23-409; Score=- 70.3; E_value=0.00011; Accession=PF00083.14; Description=Sugar (and other) transporter
  Pfam module annotation: Pfam domain module=MFS_1::Sugar_tr; Domain location=26-378::23-409
MKPSSRAPVPAENQAGTANRGVVLLLAALAAIGALSTNIILPSFPAMSKTLGASDAQLGLTLSVFFVVFAAGQLFVGPLSDRFGRRKLVIGGLLVFAAGGVVCAQAAAPAELIVGRAIQAAGVCAASVLARAIARDMYEGETLARVLAMVIVAMAAAPGFSPLLGGMTEKMIGWRMTFLTVSAFGLALSMWYAFRLPETHVASRRMPLAVGPILRIYASLLIDPRFLRPVIAVMCLTGGLYGFFAAAPSVLMGAIKLSALEMGLFFAATVPVVFAAGLAVPRLSHRWGAARVIQAGIVLALVGGVMIYLASVRYPSSLTAFTFALCVFLMGMGVANPLSTAQALSPFGAQAGAASAMLGFIQMSGAALGAMLVSTMAGISHMAAVGLLISVFALLAFITFWNQPRTAGF

SEQ ID NO: 137655 - protein, 192 aa, Glycine max
  Coding DNA Sequence Number=SeqID_20877
  Subcellular localization annotation: CTP_CleavageSite=23; ConfidenceScore=5.32e-01
MNCLFVHVSSTFEFGAMFHDCLSADPQGNPPFSPFFRSSMNCVFVHVSSTFEFGAVFHDCLSADPQGNPPFSPFFRSSMNCVFVHVSSTFEFGAVFHDCLSADPQGNPPFSPFFRSSMNCIFVHVSSTFEFGAVFHDCLSADPQGNPPFSPFFRSSMNCVFVHVPSTFEFGAVFHDCLSADPHGNPQFSPFL

SEQ ID NO: 137656 - protein, 410 aa, Glycine max
  Coding DNA Sequence Number=SeqID_20878
  Gene Ontology: Mol. function=protein serine/threonine kinase activity; Biological process=protein amino acid phosphorylation
  Homolog annotation: Hit_ID=Q1S8T0; Match level="QueryCoverage=92%, HitCoverage=63%, E-value=4e-91, Identity=43%"; Hit description =Protein kinase
  Pfam annotation: Domain name=Pkinase_Tyr; Domain location=276-410; Score=-107.4; E_value=7e-06; Accession=PF07714.7; Description =Protein tyrosine kinase
MFSFQKIYLLLTVLFLLGKPVISKDRCREKCGRVHIEFPFYLRNNNLSHTTGHHPGFDLFCNDKDETVLELPAVPIKLFVKKIDYKSQQIQIYDPENCLPKVFLKLGNYSIYPFKFQSDFSDKHDVSFFFCNSISCPIWRLSYLPWIDPELISCTKVEDVLSVEWLDGEEIINSILKWSKPNCNQCEAQGQKCKWKNGTQDETECFICPTNAFPTSTIVLIAAVGLMLFLLLVKALFYMYGYYKIKEEDQARIEKFLEDYAAMKPTRFTYADIKRITNGFSESLGEGAHGKVFKGMLSQQILVAVKILNDTVGDGKDFINEVGIIGKIHHINVVRLLGFCADGFHRALVYDFFPNGSLEKFLAPPDNNDVFLGWEKLQQIALGVATGIEYLHLGCDHRILHFDINPHNVY

SEQ ID NO: 137657 - protein, 150 aa, Glycine max
  Coding DNA Sequence Number=SeqID_20879
MVEFFVLSRAPPSIVVLGFLSLEKFFDRLSAFVNSVITWIHIKYIILPHRRSGFRSALIVMVSPVKVEKFILRCGVETMALNLFNISLPIKANYEPLECLLAKYVCGATLVMQSYPPRALDRRLQEDWDGDARKGPRVLMSLRVDFGLMG

SEQ ID NO: 137658 - protein, 92 aa, Glycine max
  Coding DNA Sequence Number=SeqID_20880
MVGAKCTYQNLELSNVRINVAKMGSMISHVELKVPFVMRTRGGTYKTKDSDAQVSMYNGVTTLGDNSYLVEITCPSSCSATNGDAFMLLRQD

SEQ ID NO: 137659 - protein, 223 aa, Glycine max
  Coding DNA Sequence Number=SeqID_20881
  Subcellular localization annotation: CTP_CleavageSite=55; ConfidenceScore=5.59e-01
MKQVVGLMSSSGRPFLASSQGPPSASLAVQATISTPAPPTLPSMPAQEVFVYPPTVATVSVPLAALSLMIASALNILPPSSSASPVPTLTILTSTLPSSSSCPNVSLHHVYTSHDTVGNVLTKLLCTRLDGDEVFGHCKDLMKKKNDLAGKVKSDVVEKEELAKVVVNSQSPSWKSLNSRHLRRGRPSRSRRKSYWHSRRKSWSSMIRAFTRLLGRTSSSQRS

SEQ ID NO: 137660 - protein, 567 aa, Glycine max
  Coding DNA Sequence Number=SeqID_20882
  Gene Ontology: Mol. function=ribonucleoside-diphosphate reductase activity; Cellular component=ribonucleoside-diphosphate reductase complex; Biological process=DNA replication
  Homolog annotation: Hit_ID=Q8GZU9; Match level="QueryCoverage=85%, HitCoverage=80%, E-value=4e-97, Identity=66%"; Hit description =Ribonucleotide reductase large subunit A
  Pfam annotation: Domain name=Ribonuc_red_lgC; Domain location=130 -559; Score=-32.3; E_value=8.6e-14; Accession=PF02867.5; Description =Ribonucleotide reductase, barrel doma
  Pfam annotation: Domain name=Ribonuc_red_lgN; Domain location=116 -186; Score=96.2; E_value=9.6e-26; Accession=PF00317.11; Description =Ribonucleotide reductase, all-alpha d
  Pfam module annotation: Pfam domain module=Ribonuc_red_lgC::Ribonuc _red_lgN; Domain location=130-559::116-186
MGVKNYMLTLGSYSILFYSHKRIEIKKHIEVAPRKIVLNSNPTLSKLHIFCEGSPTIQWAHTLSTQTLHCLRQDVMYYHFNERYAMKAPLIVDDIYEIIIKNVARLDSEIIYDRDFDYDYFGFKTLERSYILKVQGKVVERPQHMLMRVVVGIHKDDIDSAVRTYHMMSQRWFTHASPTLFNTEHLGLRSVLSLANQQEELVLVFTTFMPQAVTFVPHLGHQMVLFQCCVCSMILLAMLIRGEVRGKGGVKNLRNSTLSMKEKNGCVQLGINCSAAICKREGRTSLAYFIGVIMEFHPTKLVGSRGSKNRYFDFDKLEEVTAMVTTNLNKIIDVNYYPVDTAFVELLFDLQFKLDAQQLNKDIFQTIYYHALKTSSELAAKEGPYETFSGSPISKPYPCICKEAVSGFEPMTNKSSRHNFTAAPGLAHVTRAHGILQPDMMGVMASSRWDRGALWKMISKTGVRNSLLVAPMPTASTSQILGNNECFEPYTSNIYSRRVLRLIAFEIVRTVWEIKQKTLVDMAVDRGCYIDQSQSLNIHMDQPNFGKLTSLHFYAWSKASTFFLGSS

SEQ ID NO: 137661 - protein, 255 aa, Glycine max
  Coding DNA Sequence Number=SeqID_20883
  Gene Ontology: Mol. function=protein binding; Cellular component =protein complex; Biological process=ubiquitin-dependent protein catabolic process
  Homolog annotation: Hit_ID=Q1SS00; Match level="QueryCoverage=85%, HitCoverage=47%, E-value=1e-108, Identity=87%"; Hit description=IMP dehydrogenase/GMP reductase
  Pfam annotation: Domain name=PCI; Domain location=104-213; Score =95.0; E_value=2.2e-25; Accession=PF01399.17; Description=PCI domain
MFGISLSFMFDCHRLNSTFLIYLGLGPAMIPQAELLYYSHNNDYLEICRCYKAIYEIPSVKEDPAKWIPILRKICWYLVLAPYDPMQSSFLNSTLADKNLSEIPNFKLLLKQLVTMEVIQWTTLWDTYKSDFENEKASGKSLGEKAAEDLRQRIIEHNILVVSKYYARITLKRLAELLCLSVQDAEKHLSDMVVSKALVAKIDRPLGIVCFQTAKDSNDILNSWAANLEKLLDLVEKSCHQIHKETMVHKAALKV

SEQ ID NO: 137662 - protein, 384 aa, Glycine max
  Coding DNA Sequence Number=SeqID_20884
  Gene Ontology: Mol. function=ubiquitin thiolesterase activity; Cellular component=nucleus; Biological process=ubiquitin-dependent protein catabolic process
  Homolog annotation: Hit_ID=Q1SJA4; Match level="QueryCoverage=64%, HitCoverage=92%, E-value=2e-83, Identity=64%"; Hit description =Putative ubiquitin-specific protease UBP27-related
  Pfam annotation: Domain name=UCH; Domain location=51-329; Score= -68.1; E_value=0.027; Accession=PF00443.19; Description=Ubiquitin carboxyl-terminal hydrolase
MKENIGIEISINFEHFDCLPLSPVLSDTSTIRVGCTLVDCLKQFIVAEHVENYHCSQCWHNAAIKYLSIMEGNEVELEKLRRCSDPEICDCRKMYNLDKLPWSNRFSHTLKQLSMARCPRILCIQLKRVYMNVFGELVKLQGHISFPLILDVLSFMTTRLGVKKHDIDVQSVPLNLKYNKRIFFPNHSDLQSEISTLKFSGLHGAKKEQIKSDGVIDDGLVSSTNGQALHNDTVFPCSGSSESIHSDTHMQSIDQVDVSCNLVPQETCSYQLVSVVEHFGKAGSGHYTVYRSILKCMLFQWKMFFPVRPACFSMREFQGTEKIPLFCFGKFWVHTRCIGINVLNHRSLWCGVLTHHEWYKDMLRLFQIAKQAFAEANYNEGIIN

SEQ ID NO: 137663 - protein, 485 aa, Glycine max
  Coding DNA Sequence Number=SeqID_20885
  Homolog annotation: Hit_ID=Q6ZD98; Match level="QueryCoverage=25%, HitCoverage=51%, E-value=5e-34, Identity=55%"; Hit description =Putative vesicle-associated membrane protein-associated protein
  Pfam annotation: Domain name=Motile_Sperm; Domain location=1-106; Score=115.4; E_value=1.6e-31; Accession=PF00635.16; Description=MSP (Major sperm protein) domain
MCRDFSPIIVELKKQSSCSVQLTNNTNHYVAFKIKTTSPKKYSVRPNVGVLAPKATCEFIVTMQPQREAPEDMVCKDKFLIQSTKVPAETISEDVTSRLFVKDGSKYIEENKLKVTLICPPNSPDLSPINGDFKNGLDHEKVQIYSKDEIQSPETMVRGRFTNVLKNPDMVHEVLELEEDMELRPEYYVGHTMKHVGEPKEEARLKVSKNKELNMVKDLEELKPQKKLEVEVPKDLDLNKIKNAEELKPEKAAELKVSKLLVLNKVKNVEELKPEKAAELNVSKVLDLNLVNNVKELKPETETELKMSKDLELKTVKNAEELKPEKETELKISKDMELETFKNVEELKPENEIELKITKDREFRTVKNVEELKPGKEAELRVSESIEQLKLLKAIEEMKLKLDGLESKLNEGAICGMIKFHNVSGVTISKLTEERRLSNQETKILQEKLADLINKGPRKVQVGFPLLYVCMVALICVFLGYRLHS

SEQ ID NO: 137664 - protein, 119 aa, Glycine max
  Coding DNA Sequence Number=SeqID_20886
  Gene Ontology: Mol. function=nucleic acid binding
  Subcellular localization annotation: CTP_CleavageSite=49; ConfidenceScore=5.17e-01
MNRESNQSLNVHSPYSLHPSENPATALVSPVLDPTNYNSLRRSMFTALSAKNKVEFVDGSLPQPASNHILFSTWKSHAIPKFALIVASMDTRWMNVSRNMDILLAIDSINLKEPQSTTQ

SEQ ID NO: 137665 - protein, 91 aa, Glycine max
  Coding DNA Sequence Number=SeqID_20887
MTDSISSIKFLLDIDYLTRITEAVLWIWYLRAQILKEKSNMDSTSDARTYYQSETHDDHVFKPKEDKDNANEVFSMDYTPARRKPPIHNLN

SEQ ID NO: 137666 - protein, 501 aa, Glycine max
  Coding DNA Sequence Number=SeqID_20888
  Gene Ontology: Mol. function=protein kinase binding; Cellular component=nucleus; Biological process=regulation of progression through cell cycle
  Homolog annotation: Hit_ID=Q94L33; Match level="QueryCoverage=72%, HitCoverage=79%, E-value=1e-134, Identity=69%"; Hit description=Ania- 6a type cyclin
  Pfam annotation: Domain name=Cyclin_N; Domain location=20-164; Score=- 1.1; E_value=0.00018; Accession=PF00134.13; Description=Cyclin, N -terminal domain
  Pfam annotation: Domain name=DUF1777; Domain location=384-500; Score=- 67.4; E_value=0.0013; Accession=PF08648.2; Description=Protein of unknown function (DUF1777)
  Pfam module annotation: Pfam domain module=Cyclin_N::DUF1777; Domain location=20-164::384-500
MTKTVPSYVRVKDKGMIYTAIDTFYLTDEQLANSPSRKDGIDEATETTLRIYGCDLIQESGILLRLPQAVMATGQVLFHRFYCKKSFARFNVKKVAASCVWLASKLEENPRKARQVIIVFHRMECRRESFPMEHLDLYSKKYVDLKMELSRTERHILKEMGFICHVEHPHKFISNYLATLETPPELRQEAWNLANDSLRTTLCVRFKSEVVACGVVYAAARRFQVPLPENPPWWKAFDGEKSGIDEVGRVLAHLYSLPKAQYIPVCKDGDFTFSNKSSETKSQSTPKWWCKSASVGCYKINVGICKPVLLAINYKDVPQNSSPADTDNSVPKGAQGEANTESNGGKGAMVNVAIDKLKDSKRSDDESKGMSTEGEARDEPILKSKADHIGETRRNRDRDRDRERDRGRERDRDRDRDRTKSRDRDRGRDSDKEREREEAERDKLKDRGHRSRERAKDSGVYRFLDIQRSQNAIRRMIGFLTRQGRKIGIDIIDISLEDISR

SEQ ID NO: 137667 - protein, 452 aa, Glycine max
  Coding DNA Sequence Number=SeqID_20889
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q30D00; Match level="QueryCoverage=99%, HitCoverage=83%, E-value=1e-158, Identity=60%"; Hit description =Putative 3-dehydroquinate dehydratase/shikimate dehydrogenase
  Pfam annotation: Domain name=DHquinase_I; Domain location=1-161; Score=107.9; E_value=2.9e-29; Accession=PF01487.6; Description=Type I 3-dehydroquinase
  Pfam annotation: Domain name=Shikimate_DH; Domain location=289-406; Score=119.4; E_value=1e-32; Accession=PF01488.10; Description =Shikimate  quinate 5-dehydrogenase
  Pfam annotation: Domain name=Shikimate_dh_N; Domain location=176-256; Score=94.1; E_value=4.2e-25; Accession=PF08501.1; Description =Shikimate dehydrogenase substrate bin
  Pfam module annotation: Pfam domain module=DHquinase_I::Shikimate _DH::Shikimate_dh_N; Domain location=1-161::289-406::176-256
CFRPIWEGGEYDGDESQRQDALRLAIELGSEFVDVELKVADEFYKSIGGKKAESVKIIVSSHNLESTPSVEEIGNLAARIQATGADVVKIATTALDITDCARLFQVLVHSQVPMIGIAMGEKGFISRVLCAKFGGFLTFGSIEAGAISAPGQTTIKELLDLYNFRQIGVGTKVHGVIGNPIGHSKSPHLYNPAFKSVGFDGIYLPLLIDNVSDFLNTYSSPDFVGYSYTIPHKQNGLRCCDEVDPIAKAIGAISCMIKRPNDGRLIGYNFDYLGAIAAIEERLHLQDSNGRSISGCSPLYGKLFVVMGAGGAGKALAYGGKEKGARVVVANRTYAKAKELATKVGGEAITLSELESFHPEQGMILANTTSVGMKPKIDLTPIPKEALKHYSLVFDAIYTPKLTRLLREAQETGAAIVYGTEMFINQAFMQFEMFTKLPAPKQHMRDVLARNT

SEQ ID NO: 137668 - protein, 709 aa, Glycine max
  Coding DNA Sequence Number=SeqID_20890
  Gene Ontology: Mol. function=heat shock protein binding; Cellular component=integral to membrane; Biological process=protein folding
  Homolog annotation: Hit_ID=Q1EPG9; Match level="QueryCoverage=98%, HitCoverage=96%, E-value=1e-113, Identity=35%"; Hit description=Heat shock protein DnaJ N-terminal domain-containing protein
  Pfam annotation: Domain name=DnaJ; Domain location=67-128; Score =93.1; E_value=8.3e-25; Accession=PF00226.21; Description=DnaJ domain
MECNKDEALRARQIAEARMQRGEFAEALRFATKAKRLYADVENIAQIITVCEVHIAAQKKLSGCDMDWYAILQIERLADEATVKKQYRRLALLLHPDKNKFAGAEAAFKLIGQANGLLCDQAKRSLFDKKFGASVKGAAPKPKTSHNYSNGNVFAAKHNANATKTQKSSDSHHFSHGNVFAAKCGANATNYQNSYPNSTGFSNQGAQMTFWTSCQHCDAKYQYPIRFVNANLLCQQCKKPFKALANGFGIMGAATVLTSVNIPKEAPMHGPPKPASENTGRKPLGREQAGTFVRSNPTSMKKCAAGVGRRCGGEKSKDGNIPASSDMEPQTSQNFGSKRVRQSAPDSGESFKARNGDDTKAANIRENAVDSSNTRRSSRKKQHVSYIETSEDDDFEIPSKKPRQSGPLNADEAEEQNVPASGESSDNNIPATPGATDQNKEKVSESDIGLGTSKEDKRSPKNSKVPSRPRIFHCPVSDTDFNDFEKDKEEDCFAVNQLWAVYDSTDAMPRFYGLVKKVASPFQLKITWLEPDPDDKGEIDWNDAELPIACGKFRLGGSQQTTDRTMFSHQVRCIKETGRGSYLVCPNKGETWAIFRDWDINWSSNPKNHLKYDFEYVEILSDFSENVGIAVAYMGKVKGFVSLFQRTEKNGVNIFYIEPNELYRFSHRIPSYKMTGYEREGVPRGSFEFDPAALPTHLFEVGDSGNVKM

SEQ ID NO: 137669 - protein, 194 aa, Glycine max
  Coding DNA Sequence Number=SeqID_20891
  Gene Ontology: Mol. function=protein binding; Biological process=two -component signal transduction system (phosphorelay)
  Homolog annotation: Hit_ID=Q659H8; Match level="QueryCoverage=95%, HitCoverage=92%, E-value=8e-38, Identity=47%"; Hit description =Putative histidine-containing phosphotransfer protein 2
MDGIVQLERQLVDYTASLFHEGFLDDQFNQLQQLQDESNPDFVVEVVTLFFEDADRLLNELTKALGQPSIDFKRLDAHVHQLKGSSSSIVTWTSLTFVRAYSGGYIPICLTSLFGLSTTIKSLINEVIGKCSIGAQRIHRVCISFRNTCEEQNVEGCLKNLQQVKHEYSLVKSKLETLFRMEQQILAAGGSVSR

SEQ ID NO: 137670 - protein, 564 aa, Glycine max
  Coding DNA Sequence Number=SeqID_20892
  Gene Ontology: Mol. function=adenyl nucleotide binding; Cellular component=myosin II complex; Biological process=negative regulation of actin filament polymerization
  Homolog annotation: Hit_ID=Q513P3; Match level="QueryCoverage=81%, HitCoverage=87%, E-value=4e-16, Identity=19%"; Hit description=Viral A-type inclusion protein repeat, putative
  Pfam annotation: Domain name=M; Domain location=193-213; Score=3.0; E_ value=50; Accession=PF02370.7; Description=M protein repeat
  Pfam annotation: Domain name=M; Domain location=267-287; Score=8.2; E_ value=10; Accession=PF02370.7; Description=M protein repeat
  Pfam annotation: Domain name=M; Domain location=414-434; Score=11.6; E_value=2.8; Accession=PF02370.7; Description=M protein repeat
  Pfam module annotation: Pfam domain module=M::M::M; Domain location =193-213::267-287::414-434
MAKKKVSESLDPMAAPTDDSSSALQIQNLKNLNALLLKETTQRRHQIHSLQSALHRSAVTFDTNLAFHLQNAVVSVFFKNQLQEMNLRFDTLLGDRDFEVSALKHQLSDLVARLENETTALAEDRDGLVRETKRLEASVDRERKLREEAEKVRSEGEEFLSRKQRDIAELETERDLAVKSSQESRTAIGTLKEAFEAVTREKSEIQSRNSALETKIGYLETELKQLNDYTRKEEEITRAKILELEGNLGIAMQKEEEMKMEISALLKEKKEVEMNVEMLTEEKDGVREALSVVQKELEDKQRELDEAVKGRNEIEEVKVNLENKIVELRGKVNELKESGKKFEEENKQSLSQVKRYENAVDEAVLEKDSIKKAFDEEKKKVVKLELLIAKTKEVAAKSDAELGQVRSERNKLVEKEKELEGNVSVLREENEALQGMLAKARKESKDLNAKVEVWCSNSNKALSLLKTTAAALVCQHKERGGDEVVAAAADENPVEEIQPYAQELDAIKKAFKTKDEMVDDMKQQLVSLNKSVAEAHKSKSLWTVISSATTIFAAVLAAYVARGR

SEQ ID NO: 137671 - protein, 39 aa, Glycine max
  Coding DNA Sequence Number=SeqID_20893
MAKQYHAKAAAEARDGPEGPKPKLGFMPGHSKKIVRKCR

SEQ ID NO: 137672 - protein, 568 aa, Glycine max
  Coding DNA Sequence Number=SeqID_20894
MDPIVLSDEEDPSTPFPLRPKKRRTEPDPNPNPNRTVFVIDDDPTPHKSATPSIVPETPMSALFDSEIAIVKCTMLSDPAVMVSPKKFSAPSGISQMICLESDNESENCGISTRNENEARDSRWISNSGGSGRSPGICLESDNELENCGMDKPVENEPRDARWTSNLMGSGSSPRICLESDNELENCGMGERDENAPRDSRWTSNSMGFGSSTERHISGGNATQTEMPGDDLSNPTSSQGKFAMKSIVAEIDAKAVESGSIGGHLLTRFAEKGLTYHITSNLVAGSILWSMKVPEHISQLSTERIEIPYVLLIYEAGKFCNLVMNDSLFDQLSSIQSLYPAYTVCYLTNRLLAYINKKEQEKYKNPENSSCWRRPPVEEVLAKLTTNFNKVHSRQCLDEAELAEHVVSLTCSLASCQFRKKLSRLSVNADGALIPKDYVGRNLMKKSLWLKALVAMPKVQPRFAIAIGKKYPTMKSLLSVYMDPSKSKGWPEVCIIFLNDGRSMRRNFYLMTEVLLGGDRRLGEVCSKRVYRITMVQSGCIRKDDVENGADFCERQSQRTLSLYVNCV

SEQ ID NO: 137673 - protein, 458 aa, Glycine max
  Coding DNA Sequence Number=SeqID_20895
  Gene Ontology: Mol. function=protein serine/threonine kinase activity; Cellular component=cytoplasm; Biological process=protein amino acid phosphorylation
  Homolog annotation: Hit_ID=Q8RXC8; Match level="QueryCoverage=88%, HitCoverage=99%, E-value=1e-131, Identity=53%"; Hit description =Putative serine/threonine protein kinase
  Pfam annotation: Domain name=Pkinase; Domain location=147-415; Score =110.3; E_value=5.7e-30; Accession=PF00069.15; Description=Protein kinase domain
  Pfam annotation: Domain name=Pkinase_Tyr; Domain location=147-413; Score=93.6; E_value=5.8e-25; Accession=PF07714.7; Description =Protein tyrosine kinase
  Pfam module annotation: Pfam domain module=Pkinase::Pkinase_Tyr; Domain location=147-415::147-413
MHCSDQKKSQANKPKKLTIAEALDLQSDLLHPDTNANTRPKRATKRQASLFSCSSSAHDLRHLELEKEKENIASPRGVLEACMKDFDSHDQSHESKATCSTTRARSHWSKFFKIWRKKSFKRLGSLPPLISVPKIPKWKSKSSRENQVLKNIIGRGGFAEVYKGCLQDGQLIAVKKLSKGTTDEKTAGFLCELGVIAHVDHPNTAKLVGCCVEGEMQLVFELSTLGSLGSLLHGSDKKKLDWSKRYKIALGIADGLLYLHECCHRRIIHRDIKAENILLTENFEPQICDFGLAKWLPEQWTHHSVSKFEGTFGYFAPEYFMHGIVDEKTDVFSFGVLLLEIITGRPAVDHMQQSVVIWAKPLLDANHIKDLVDPSLGDDYKREQMGCVVLTASMCIEHSPILRPRMSQASEDHVLKATKSSRRRPLQRAYSEELLDAQEYNSTKHLRDLKRFEQIALG

SEQ ID NO: 137674 - protein, 143 aa, Glycine max
  Coding DNA Sequence Number=SeqID_20896
MVFFLYVPILLSLSFSFLLHVFKKHIHISLLDLVTTFNSTNIMIDNYKLYPNQIGFIEDVSEGIEGFMTCTKNLGFQSIDISDKIDDNDNNNDDEDEDNCWRKTRVTEGKGNFPPPLSSLNGNGQPSFILVPVRKNGRLQLSK

SEQ ID NO: 137675 - protein, 989 aa, Glycine max
  Coding DNA Sequence Number=SeqID_20897
  Homolog annotation: Hit_ID=Q9H6U6-2; Match level="QueryCoverage=37%, HitCoverage=38%, E-value=5e-30, Identity=27%"; Hit description =Isoform 1 of Q9H6U6
MEGVDAPSTSRVARPVSKLQTEAEREREGTVSVKVKFPQPPTKARRSSPPPRTANPDASYSYAIFDRPRSATLVDGIPGARAAMDSFLLPSSSYRLALRPPLPASAPPEPPSPPPSPVTDTTAETRLELSPSSFKHVLLLSYSNGFQVLDVEDASNVRELVSKRDDPVSFLQMQPIPAISEGCEGFRASHPLLLVVACDKSKIPGKMLNVRDGHNEAQAENIVSSATAVRFYSLRSHTYVHALRFRSTVYMVRCSPRIVAVGLATQIYCFDALTLENKFSVLTYPVPQLGGQGMIGVNIGYGPMAVGPRWLAYASNSPLLSNTGRLSPQSLTPPAVSPSTSPSSGNLVARYAMESSKHLAAGLINLSDMGYKTLSKYYQDLTPDGSSSPVSSNSSWKVTRFALNSTETDPAGMVVVKDFVSRAVVAQFRAHTSPISALCFDPSSQSSDWNYSHVHLYKLHRGMTSAVIQDICFSHYSQWVAIISSKGTCHIFVLAPFGGETVLKMHDQDTDGPALLPIFPLPWWFTPHFPVNQQQLCLTPPPPVVLSVVSRIKNSNAGWLNTVSNAASSAAGKVSIPSGAVSAVFHSSIPHDSHNSYLKNHAMEHLLVYTPSGHLIQYKLLPPLAAESSETVSRTALVPSAQIQEEDLRVKVEPVQWWDVCRRYDWPEKEVCILGNTVGGLEAAEMILDSSDYEDNNSVRNNNSIKLNKQCHFSNTEVHISSGRIPIWQESEVSFFVISPLEAGELNLCELNTSGEIEIENIPVNEIEIKQKDLLPIFDHFHRIQSTWGDRGIVMGRYSSSSSDSHGTEEKLSEDAAIFHSKLMVPGLAEKTFVASKVKTVDTNDVSAGASNFADGANAKVKSSKHEKAGDSFNSSLSGCDLNMNVTCEESIRDSPDFEQYFQEGYCKASVDCHESTEVITDVDCSSPCGRGKSDEDGDNDDMLGDVFDFSEEGNNGDDESDGDENNTNNDGDDLGINNDDDDTTTRGT

SEQ ID NO: 137676 - protein, 205 aa, Glycine max
  Coding DNA Sequence Number=SeqID_20898
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=9e-28, Identity=32%"; Hit description= UPI00006A17C9 related cluster
  Subcellular localization annotation: CTP_CleavageSite=10; ConfidenceScore=5.26e-01
MQSSEDGRVQPSEGGACSPLKARTCSPLKARACSPLKARTSSPLKVITCSPLKVRTCSPLKVRTSSPLKVRACSPLKVRACSPLKARTCSPLKERTCSPLKVRMSSPLNTRMCCPLKARMFSPQRARACSPLKARTCSPLKVRACSHLKMRTCSPLKARTCSPLKARTCSPLKARTCSPRKVRTCCPMKARICSPLKVRARSPLR

SEQ ID NO: 137677 - protein, 270 aa, Glycine max
  Coding DNA Sequence Number=SeqID_20899
  Gene Ontology: Mol. function=structural constituent of ribosome; Cellular component=intracellular; Biological process=translation
  Homolog annotation: Hit_ID=Q1SJB3; Match level="QueryCoverage=99%, HitCoverage=43%, E-value=5e-78, Identity=57%"; Hit description =Somatotropin hormone
MTTGRSLDRKVVKASGKCNPKTGFIGVRNSPKRTNKLDQKARGCGQELTDKENQYFPFKEHMRKCPELPNKCTFLTEKREAIELHPGQMLTSAKIKLQLFPINEGTRIGLEKDGHNPYLELTLRGRKKICSILKHLGKKWGSSSIAKGELMLFPYNIMENLSGCRRWTINDSDTTASAVYTAVGSPALFRLKYGWFYMLEPGSFGIPSTPTPDKPDVAGSGNANLEETLCGERDKVRISKEYKATEVGNAASETVSQKVENATVDPMVNL

SEQ ID NO: 137678 - protein, 77 aa, Glycine max
  Coding DNA Sequence Number=SeqID_20900
  Gene Ontology: Mol. function=protein translocase activity; Cellular component=mitochondrial inner membrane presequence translocase complex; Biological process=intracellular protein transport
MVEPVVKIRTLRARLIGVDRKDLNKTFIQLTLEILAKQKFEAYDSKGSVVAGDKSKEFSNSLSPGHISKSIEENRRG

SEQ ID NO: 137679 - protein, 286 aa, Glycine max
  Coding DNA Sequence Number=SeqID_20901
  Gene Ontology: Mol. function=catalytic activity; Biological process =metabolic process
  Homolog annotation: Hit_ID=Q01CB8; Match level="QueryCoverage=70%, HitCoverage=65%, E-value=5e-47, Identity=46%"; Hit description =Homology to unknown gene
  Pfam annotation: Domain name=PGAM; Domain location=8-183; Score =101.2; E_value=3e-27; Accession=PF00300.12; Description =Phosphoglycerate mutase family
MVSVLPKRIILMRHGESQGNLNTAAYTTTPDHSIQLTAQGMTQARHAGEQLRRVMGGDGCSPDWRVQFYVSPYGRTRSTLRELGRHFSRKRIIGVREESRVREQDFGNFQVEERMKVIKETRERFGRFFYRFPEGESAADVFDRVSSFFESLWRDIDMNRLRHDPSNDLNFVIVSHGLTSRIFLMKWFKWTVEQFEHLNNFGNCEFRVMQLGSGGEYSLAVHHTEEEMLEWGLSPEMIADQKWRATAIRGDWNDQCPWYLDAFFDHLPDDDAVENEAETNSLSVCA

SEQ ID NO: 137680 - protein, 109 aa, Glycine max
  Coding DNA Sequence Number=SeqID_20902
  Gene Ontology: Mol. function=hydrolase activity, acting on ester bonds; Biological process=lipid metabolic process
  Homolog annotation: Hit_ID=Q2HTP0; Match level="QueryCoverage=89%, HitCoverage=35%, E-value=1e-24, Identity=45%"; Hit description =Lipolytic enzyme, G-D-S-L
MDSKNVVAFQVVTFCICLAVANSVDFGYPAVFNFGDSNSDTVDSMKFPFLNAYMDSVGLPNFQHGCNFAAAGSTILPATATSISSFGFEVQVFQFLRFRAQSLQFLQGI

SEQ ID NO: 137681 - protein, 76 aa, Glycine max
  Coding DNA Sequence Number=SeqID_20903
MDSNQLNGTLLSVIRKLRLVTLTASRNNLEGAITDEWCQHNLVKLDLSHNKFSVARPTFQSGMPTRANQYLGPFAK

SEQ ID NO: 137682 - protein, 92 aa, Glycine max
  Coding DNA Sequence Number=SeqID_20904
MIDFLRFFQRFPQINVGGDSAHFPPLEDAPGSCPQVDPKKSNRVLELPALITDLCQFYGVPVAPSRVIRPPTNRAFIKKYCTPRQAQGETPQ

SEQ ID NO: 137683 - protein, 121 aa, Glycine max
  Coding DNA Sequence Number=SeqID_20905
MENWRTTLGNQFAGLQTRWWRMHERQSIHGAPNKSGEWKIALGNHIAWLQTHWWRMHERQSIHGAPNKSGEWRIALGNHLAWLQTHWWRMHERQSIHGAPNKSGEWRIALGNHFAWLQTHW

SEQ ID NO: 137684 - protein, 109 aa, Glycine max
  Coding DNA Sequence Number=SeqID_20906
MDPSHEVEPPKVENLKKVDYTPICIHVTAYSPGLHISKATKIKIVAYRVCPRLPIWYATKKKGLKLYYCVEMPTKKIMVEVVNIPKNWSSLFNGKRLIQDPDMYDAKKS

SEQ ID NO: 137685 - protein, 365 aa, Glycine max
  Coding DNA Sequence Number=SeqID_20907
  Gene Ontology: Cellular component=chloroplast thylakoid membrane
  Homolog annotation: Hit_ID=Q00XT9; Match level="QueryCoverage=49%, HitCoverage=73%, E-value=3e-40, Identity=43%"; Hit description =Homology to unknown gene
  Pfam annotation: Domain name=DUF477; Domain location=206-330; Score =88.8; E_value=1.6e-23; Accession=PF04536.5; Description=Protein of unknown function (DUF477)
KEAIWTATTLEVKIAQLRLEEEARFGVVGDADEIGEKNGHERKSTWLIDVIRFQTQPTNPDHPKSEPNHRTRNDVEEKKHTSALEVESLLIPIMGTIFPPHSLSPLLNIKPSPSRILLAPSPQPKSNSLFCSKPIVSSLRKNQTLSPKPSSGTSWLAHAQQGLAALAISLALNFSPVLFNGNALASEFDVLNEGPPKDSYVFDDAGVLSRVTRSDLKQLLSDLESRKNFRINFITVRKLTSKADAFEYADQVLERWYPSVEEGNKKGIVVLVTSQKEGAVTGGPAFVEAVGEKILDATVSENLPVLATDEKYNEAIFSTAKRLAAAIDGLPDPGGPTVKDNKRESNFKTKEETEEKRGQFTLVVG

SEQ ID NO: 137686 - protein, 176 aa, Glycine max
  Coding DNA Sequence Number=SeqID_20908
  Homolog annotation: Hit_ID=Q8RZF8; Match level="QueryCoverage=34%, HitCoverage=15%, E-value=4e-13, Identity=52%"; Hit description =Lustrin A-like
MKVDIRHAVVNVDLRLNQKLCLSGRNGQAELQKVYDDRKEKEAMENNKRWVPPIAGVKEIGPSIPFAPELALDEGTRGGIIGRVRFVHHPRSREHIALRIIQSRRRTLSSHFRQQQPMKKEEEQLQTTRDNTLTHFLNLSLLGTRRDKEYGNAEERGMERVLFSLMSYEYLCCSIH

SEQ ID NO: 137687 - protein, 353 aa, Glycine max
  Coding DNA Sequence Number=SeqID_20909
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=55%, HitCoverage=79%, E-value=3e-39, Identity=42%"; Hit description =Transcription factor, MADS-box
  Pfam annotation: Domain name=SRF-TF; Domain location=9-62; Score =33.1; E_value=9.6e-07; Accession=PF00319.9; Description=SRF-type transcription factor (DNA-binding and dimerisation domain)
MGRARITLKPISNERSRKSTFKTRKEGLITKISQLSTMCGVEACLIVYDDINGDVGAVTWPENPTLVRPIIENYERQRAEKPPKTFVIQDFFENRKNMVEAEISKLHKQAREIKYPTWGPSLSNMEKEQLSAFIANVNAKIEACDQRIHIKSMQNMAKESASSSHSSQLNFMQNISQSQMIPTHVEPLLNDNNNGRVLNSTNQVGGASSHGVSMLRNIQQGDVCVSYMPSMSQSQMIALETFKSLKGKNKMVDFTNQVVVPLDSTNHQLGESLDWANHHGSFDWANGPIGTEDWSNPLNGDLVGSQPDESVLQNIPILSENDHQGVVLPTLPLSLDGFQTDCRNMFFRMSNSK

SEQ ID NO: 137688 - protein, 64 aa, Glycine max
  Coding DNA Sequence Number=SeqID_20910
MTTLELHARSCTQTYQERKRKGRKLVGKEDGAEDEGGGGAVVADGGRAVEEAETVMANLCPSLQ

SEQ ID NO: 137689 - protein, 400 aa, Glycine max
  Coding DNA Sequence Number=SeqID_20911
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q9LVZ9; Match level="QueryCoverage=84%, HitCoverage=86%, E-value=1e-140, Identity=72%"; Hit description=Beta- 1,3-glucanase-like protein
  Pfam annotation: Domain name=Glyco_hydro_17; Domain location=32-351; Score=389.9; E_value=3.7e-114; Accession=PF00332.9; Description =Glycosyl hydrolases family 17
  Subcellular localization annotation: CTP_CleavageSite=18; ConfidenceScore=5.15e-01
MFYSSTSFFLCLLFFSVTFSHVFGDKVFTGTYGVNYGRVADNLPSPESVVTLLKAAKIRNVRIYDADRQVLSAFKGSGIAISVCVPNELLKEISVGEDRAMNWIKQNVEPYLPGTKIRGISIGNEILGGGDMELWEVLVPAAKNVYAALQRLNLAHQIQVSTPHSEAVFANSYPPSACTFREDILPFMKPLLQFFSQIGTPFYINAYPFLAYKNDPQHIDINYALFKKNPGIYDAKTKLHYDNMFLAQVDAAYAALEKLGFDKMEVIVSETGWASKGDDNEAGATVKNARTYNKNLRKLLLKKKGTPYRPKMVVRAYIFALFNENLKPGPTSERNFGLFKPDGSISYDIGFTGLVPSSATTSSFLSFKHVNADAVAFVHFRVLDLYMQWFLQAVRLFFFL

SEQ ID NO: 137690 - protein, 264 aa, Glycine max
  Coding DNA Sequence Number=SeqID_20912
  Gene Ontology: Mol. function=RNA-directed DNA polymerase activity; Cellular component=nucleus; Biological process=RNA-dependent DNA replication
  Homolog annotation: Hit_ID=Q1S4N5; Match level="QueryCoverage=35%, HitCoverage=18%, E-value=1e-24, Identity=58%"; Hit description =Peptidase M, neutral zinc metallopeptidases, zinc-binding site
MLNELLLLLVTSQEVKHIIFFRNYWDIVATDIWSLVAEAFGTGTINPDLANTLVVPIPKIDSLTKDFKPISLCNVTLKIISKVFVNHIRPYLDNLIGSLQSSFIPNQGTIDMLLLLRRLRITCTRGKTYFMQNLRFNWGESTSHRVKWPTLTRSRRDGGLGIQSAREIQMLRCWANTYGLFCLMIKSFGQRCNFINILRTKMFSGLKRLQGVLIYGSQFLKLLRIFALARVTSSFGMIDGYLVTIFAAWWIMLVSWTLTCYGSL

SEQ ID NO: 137691 - protein, 102 aa, Glycine max
  Coding DNA Sequence Number=SeqID_20913
MNTGHYCLDESDDDSQVSNQGNASGRQQPMHTQCKFGVNGKNNSLADGGLVVLVMRLGEKEKKPLQRHTAEIDDNKGNRGREKVEEGKKREKKDAHNGMTMR

SEQ ID NO: 137692 - protein, 126 aa, Glycine max
  Coding DNA Sequence Number=SeqID_20914
  Homolog annotation: Hit_ID=Q9LW01; Match level="QueryCoverage=60%, HitCoverage=52%, E-value=9e-07, Identity=34%"; Hit description =Arabidopsis thaliana genomic DNA, chromosome 3, P1 clone: MSJ11
  Subcellular localization annotation: CTP_CleavageSite=79; ConfidenceScore=5.79e-01
KWLLSQSPPQILRSSFSYALSLVLTLSPSLSTVNSNYSRLPPLCSAVFPGSSPPPPVLRSHLPKTIPAGTLKMDDVQSRADVATSLAKIQDRIQIFFAVLFWISLFFWASAWDGRNRPNKGSRFRR

SEQ ID NO: 137693 - protein, 257 aa, Glycine max
  Coding DNA Sequence Number=SeqID_20915
  Gene Ontology: Mol. function=RNA-directed DNA polymerase activity; Biological process=RNA-dependent DNA replication
  Homolog annotation: Hit_ID=Q1T518; Match level="QueryCoverage=99%, HitCoverage=50%, E-value=7e-46, Identity=47%"; Hit description =Tetratricopeptide-like helical
MLLRSSSAPILTSLLFYSKEFPSEPEHILHLPKTASALSLSQSLVDIDLKNSSSPRRKNRVPLSNVPNNQQSIKINERYEGKDPQQKTFMKAKPSILELFSSFDLDKGVLDHEECGAGKKDSWLQTSVMGAGMGSDGGWICGGCNGSGRGSDGGHGRRWGFDEGNDHGRDRTDAYYQNMIEANPSDALLLGNYAKFLKEVCEDYPKAKEYLERAILANPDDGHILSLYAELIWQTEKDADQAEGYFDQAIKSAPDDR

SEQ ID NO: 137694 - protein, 219 aa, Glycine max
  Coding DNA Sequence Number=SeqID_20916
  Gene Ontology: Mol. function=protein serine/threonine kinase activity; Biological process=protein amino acid phosphorylation
  Homolog annotation: Hit_ID=Q49N12; Match level="QueryCoverage=94%, HitCoverage=23%, E-value=9e-66, Identity=52%"; Hit description =Putative receptor-like protein kinase 2
MVVPAWYSLHINCGGKLISNGNMKYDDDSLEAGPARFRRTGSNWVFSNTGHFFDSSRLDYYTWSNTTKLAMDNGELYMDARVSALSLTYYAFCMGNGSYTRKLVVKDFNIAKEAGGVGKAIIKKFNVTVNISTLEIRLQWAGKGTTGIPFGSVHGPLISAISVDPDFTPREENRDGTPVQFIVAIVVTGALVIIIIFGIAWWKGCLGRKGSLERGEGRA

SEQ ID NO: 137695 - protein, 170 aa, Glycine max
  Coding DNA Sequence Number=SeqID_20917
  Gene Ontology: Mol. function=sequence-specific DNA binding; Cellular component=intracellular; Biological process=DNA repair
  Homolog annotation: Hit_ID=Q1RUW7; Match level="QueryCoverage=70%, HitCoverage=27%, E-value=3e-11, Identity=41%"; Hit description=DNA repair protein rad10, putative
MDTDYLSRSTFRLQTHILIDFIQKHFHQDVFLPFQYLCNIMGASMEDLARCPGIVGERKVYYQWSSACLTLFMNPSSMWNPAGKPFQRLLSRTSQLVRPVSSIRNNAESSSLIEDKHEDAEDLLPNILVELERGKALHRWRKKENQLFPKNQKLKHKITMKFFTGSIIYP

SEQ ID NO: 137696 - protein, 336 aa, Glycine max
  Coding DNA Sequence Number=SeqID_20918
  Gene Ontology: Mol. function=zinc ion binding; Cellular component =integral to membrane; Biological process=defense response
  Homolog annotation: Hit_ID=Q1RUW9; Match level="QueryCoverage=90%, HitCoverage=88%, E-value=1e-101, Identity=60%"; Hit description=Zinc finger, RING-type; RINGv
  Pfam annotation: Domain name=zf-C3HC4; Domain location=118-159; Score= 37.8; E_value=3.7e-08; Accession=PF00097.15; Description=Zinc finger, C3HC4 type (RING finger)
MNYSNRNGGICILLFLFLLPFAAAQHGNQNESYYNKFSPSMAIIIVILIAALFLMGFFSIYIRHCSGSPSASIRNLPAASGRSRRGSRGLDQAVIDTFPTLEYSTVNIHKLGKGTLECAVCLNEFEDTETLRLIPKCDHVFHPECIDEWLASHTTCPVCRANLVPQPGDSVHGIPILDAPQGIEAQQQQDPKAEPQVLTLNQTLNRNRTRGSQSGRPRRFPRSHSTGHSLVQPGEDTERFTLRLPQKVRKQILQKPELHRARSLVILPREGSSRRGYRTGEGSSRGRSSRRLDRWVFSMAPAFFVRASSIRSPRVANNGADGTSATAPLPPAVESV

SEQ ID NO: 137697 - protein, 193 aa, Glycine max
  Coding DNA Sequence Number=SeqID_20919
  Gene Ontology: Biological process=response to high light intensity
  Pfam annotation: Domain name=HSP20; Domain location=117-193; Score =42.7; E_value=1.3e-09; Accession=PF00011.11; Description=Hsp20alpha crystallin family
MVQHHMALKNLQKRVCASSSLIGNVQKQRWNNELVKRFGSALKLLSPKGKSLIGCFPGGGAEDGFGETMIVTSLHALLLIAREFFPWGLGSALMQASENINRLFENMNLRPWSLSGGMKEKDEHYKQGEHKEEKDDDEHWSSTSSYGYYNTSLLLPDDAKADDIKAELKDGVLTVTIPRTEKPKKDVKQVTVE

SEQ ID NO: 137698 - protein, 268 aa, Glycine max
  Coding DNA Sequence Number=SeqID_20920
  Gene Ontology: Mol. function=protein serine/threonine kinase activity; Cellular component=membrane; Biological process=protein amino acid phosphorylation
  Homolog annotation: Hit_ID=Q39886; Match level="QueryCoverage=76%, HitCoverage=45%, E-value=9e-73, Identity=63%"; Hit description =Protein kinase
  Pfam annotation: Domain name=Pkinase; Domain location=22-264; Score =121.7; E_value=2.1e-33; Accession=PF00069.15; Description=Protein kinase domain
  Pfam annotation: Domain name=Pkinase_Tyr; Domain location=23-244; Score=66.4; E_value=9.3e-17; Accession=PF07714.7; Description =Protein tyrosine kinase
  Pfam module annotation: Pfam domain module=Pkinase::Pkinase_Tyr; Domain location=22-264::23-244
MGKLSIKLHDKCRNRKESSWPLTKFKSIMVYTKKEHVAIKWVKLQDNDERGTLTSLLETQFFREVTHLPRLHHQNVVKYVAACKDTHFYFILTEYQQKGSLRVYLNKLEHKPISSKKVISFALDIAHGMEYVHAQGIIHRDLKPENVLVDGELHPKIADFGISCEASKCDSLRGTYRWMAPEMIKGKRYGREVDVYSFGLILWELVSGTVPFEDMGPCQVAVAVANRNSRPIIPSDYPHILVCIDGTMNVVQRHCSEDHSHLFLMEGS

SEQ ID NO: 137699 - protein, 286 aa, Glycine max
  Coding DNA Sequence Number=SeqID_20921
  Gene Ontology: Mol. function=protein serine/threonine kinase activity; Cellular component=membrane; Biological process=protein amino acid phosphorylation
  Homolog annotation: Hit_ID=Q49N12; Match level="QueryCoverage=99%, HitCoverage=32%, E-value=1e-101, Identity=58%"; Hit description =Putative receptor-like protein kinase 2
  Pfam annotation: Domain name=Pkinase; Domain location=5-209; Score =6.3; E_value=6.1e-09; Accession=PF00069.15; Description=Protein kinase domain
  Pfam annotation: Domain name=Pkinase_Tyr; Domain location=1-209; Score=-34.1; E_value=2.2e-10; Accession=PF07714.7; Description =Protein tyrosine kinase
  Pfam module annotation: Pfam domain module=Pkinase::Pkinase_Tyr; Domain location=5-209::1-209
MQGILSNGTIIAVKMLSSRSKQGNRSGESRLKLDWPTRHKICLGIARGLAFLHEESRLKIVHRDIKATNVLLDKDLNPKISDFGLAKLDEEDNTHISTRIAGTYGYMAPEYAMHGYLTDKADVYSFGVVALEIVSGKSNTIHRPKQEALHLLDWAHLLKEKGNLMELVDRRLGSNFNENEVMMMIKVALLCTNATSNLRPTMSSVLSILEGRTMIPEFISDPSEIMDEMKLEAMRQYYFQIEENERNETQTESHSLSIDGSWMASSSSAADLYPVHVDSSYWEKRN

SEQ ID NO: 137700 - protein, 105 aa, Glycine max
  Coding DNA Sequence Number=SeqID_20922
  Homolog annotation: Hit_ID=Q49N12; Match level="QueryCoverage=45%, HitCoverage=4%, E-value=2e-13, Identity=69%"; Hit description =Putative receptor-like protein kinase 2
MWAPTPPPPWDLENYCEETIVEETPSSSSSYIVSAPQQFSEAHGSGGVVEGSGAEEGTLGKKNWDFSVDPCSGQSNWTSFVQVKGFENAVTCICLANASICHVVS

SEQ ID NO: 137701 - protein, 312 aa, Glycine max
  Coding DNA Sequence Number=SeqID_20923
  Gene Ontology: Mol. function=protein kinase activity; Cellular component=membrane; Biological process=protein amino acid phosphorylation
  Homolog annotation: Hit_ID=Q1ST94; Match level="QueryCoverage=99%, HitCoverage=73%, E-value=1e-129, Identity=72%"; Hit description =Protein kinase
  Pfam annotation: Domain name=Pkinase; Domain location=70-309; Score =29.6; E_value=2.5e-10; Accession=PF00069.15; Description=Protein kinase domain
  Pfam annotation: Domain name=Pkinase_Tyr; Domain location=67-309; Score=11.1; E_value=3.8e-13; Accession=PF07714.7; Description =Protein tyrosine kinase
  Pfam module annotation: Pfam domain module=Pkinase::Pkinase_Tyr; Domain location=70-309::67-309
KNGTCEEDSRELHDTSSRLITSTTLNSSPDVKSGCLNGGNLSRTPAPKFRGVQVFTYRELEIATDGFSEANVIGSNGIGGHGLMYRGVLSDGTMAAIKLLHTEGKQGERAFRIAVDLLSRLHSPHSVELLGYCADQHHRIALDCARALEFLHEHAVSPVIHRDFKSNNVLLDQNLRAKVSDFGLPKMGSDKRNGQVSTRMLGTTGYLAPEYAMGKLTTKSDVYSYGVVLLELLTGRVPVDIKRAPGEHVLVSWALPRLTNREKVIEMVDPALRGQYSKKDLIQIAAIAAMCIQPEADYRPLMTDVVQSLIPL

SEQ ID NO: 137702 - protein, 197 aa, Glycine max
  Coding DNA Sequence Number=SeqID_20924
  Gene Ontology: Mol. function=protein serine/threonine kinase activity; Biological process=protein amino acid phosphorylation
  Homolog annotation: Hit_ID=Q49N12; Match level="QueryCoverage=94%, HitCoverage=18%, E-value=6e-58, Identity=61%"; Hit description =Putative receptor-like protein kinase 2
MQQAPFLNSLHINCGGARETSSEGIIYDGDSDSLGPSTSKEVGENWAISNTGHFLNSNASETYIQQNTTRLSMPDNALYKTARVSPISLTYYGFCLENGDYTVTLHFAEIAFTDDDTYKSLGRRIFDIYIQRKLVWKDFNIAYEAGGVGKEIKIPFPAYVNNNSLEIRFYWAGKGTDGIPYKSIYGPLISAISVTRG

SEQ ID NO: 137703 - protein, 156 aa, Glycine max
  Coding DNA Sequence Number=SeqID_20925
MAARRVMAKVNKALALSGCYYPEAEATLACKVVKQNRRICSASAVNIWANRLIFSLYRIRKPTRSGGFGQTHNTLIFVFGFGLGGGHRGGVATRFGGDAREGANTCVLYLDWDGGDSFGSMEKARGCEDLVSGQKRNFPRLILLIARIGIGNSSSL

SEQ ID NO: 137704 - protein, 263 aa, Glycine max
  Coding DNA Sequence Number=SeqID_20926
  Gene Ontology: Mol. function=sequence-specific DNA binding; Cellular component=intracellular; Biological process=regulation of transcription, DNA-dependent
  Homolog annotation: Hit_ID=Q1ST82; Match level="QueryCoverage=85%, HitCoverage=92%, E-value=4e-85, Identity=70%"; Hit description =Transcription factor CBF/NF-Y/archaeal histone
  Pfam annotation: Domain name=CBFD_NFYB_HMF; Domain location=98-162; Score=92.7; E_value=1.2e-24; Accession=PF00808.13; Description =Histone-like transcription factor (CBFNF-Y) and archaeal histone
  Pfam annotation: Domain name=Histone; Domain location=92-165; Score =51.8; E_value=2.3e-12; Accession=PF00125.14; Description=Core histone H2AH2BH3H4
  Pfam module annotation: Pfam domain module=CBFD_NFYB_HMF::Histone; Domain location=98-162::92-165
  Subcellular localization annotation: CTP_CleavageSite=43; ConfidenceScore=5.24e-01
MDNQGHGHGQNPSMGIVGNGPQLPYGSNPYQASHITGSPGMVVASPGTIQSTGQPAATQLGQHQLAYQQQQQQLQQRLQAFWANQYQEIKKVTDFKNHSLPLARIKKIMKADEDVRMISAEAPVIFARACEMFILELTLRSWNHTEENKRRTLQKNDIAAAITRTDIFDFLVDIVPREDLKDEVLASMPRGTVPVTGPAEALPYCYIPPQHAQQVGAAGVMMGNKPVMDPYAQQSHPYNMAPQMWPQLLPPPPPEQQQSSPDQ

SEQ ID NO: 137705 - protein, 91 aa, Glycine max
  Coding DNA Sequence Number=SeqID_20927
  Homolog annotation: Hit_ID=Q49N12; Match level="QueryCoverage=69%, HitCoverage=6%, E-value=2e-10, Identity=44%"; Hit description =Putative receptor-like protein kinase 2
MKKVTSSQFLLLQLLALWFTSLAFGANTTQPEEVQALKDMGKILGKKEWDTDIDPCSSQHPWFTPKVDTVENNVTCNCSIPGDNFCHVVSM

SEQ ID NO: 137706 - protein, 70 aa, Glycine max
  Coding DNA Sequence Number=SeqID_20928
MIRILKLAKYRLKAQVENDKAPEWRRMKAQVEKDESPEAETLSRLLIIAESHQICLRKTKISDSFTVGSS

SEQ ID NO: 137707 - protein, 377 aa, Glycine max
  Coding DNA Sequence Number=SeqID_20929
  Gene Ontology: Mol. function=carboxypeptidase activity
  Homolog annotation: Hit_ID=Q1ST81; Match level="QueryCoverage=97%, HitCoverage=87%, E-value=1e-108, Identity=57%"; Hit description =Peptidase M14, carboxypeptidase A; Heat shock protein Hsp20
MVSEADLENDDRCFLLYFIMGTYLGPDIKGEATKKSILQRVAEGLPPYTLEQLTHSCIEVVELERVYYYILRNTDKSLILNLTSLRRFFHGQAQGGDGNGNNNYPQFPELFPPGFHPQYRLKNKHKVIDNVVFINNPDSFYIRSEDVERFKRLSGVQELHVDRDVARLQLGTCFDNNNRVPSNSTISEGKVEPDGNVESCGGAGSSELQDRVNVVASTSDGTTCRGGGTNVMYDFMDTEDDESDPDKVGPAMLFLPSRPSKKEWSDIVAATKNGFALTGTVAMGGIGPTMGLVDIGECEDAYLFRLSLPGVKRDEREFSCEVGTDGKVLISGVTTTGENTVSRYSQVFEMQTQNLCPPGRFSISFQLPGPVDPHQFS

SEQ ID NO: 137708 - protein, 163 aa, Glycine max
  Coding DNA Sequence Number=SeqID_20930
  Gene Ontology: Mol. function=protein binding; Cellular component =integral to membrane; Biological process=protein amino acid phosphorylation
  Homolog annotation: Hit_ID=Q1S979; Match level="QueryCoverage=96%, HitCoverage=24%, E-value=1e-35, Identity=50%"; Hit description =Leucine-rich repeat
  Pfam annotation: Domain name=LRR_1; Domain location=111-133; Score =9.6; E_value=4.5; Accession=PF00560.23; Description=Leucine Rich Repeat
  Pfam annotation: Domain name=LRR_1; Domain location=135-157; Score =18.3; E_value=0.028; Accession=PF00560.23; Description=Leucine Rich Repeat
  Pfam annotation: Domain name=LRR_1; Domain location=63-85; Score=6.7; E_value=16; Accession=PF00560.23; Description=Leucine Rich Repeat
  Pfam annotation: Domain name=LRR_1; Domain location=87-109; Score =16.8; E_value=0.078; Accession=PF00560.23; Description=Leucine Rich Repeat
  Pfam module annotation: Pfam domain module=LRR_1::LRR_1::LRR_1::LRR _1; Domain location=111-133::135-157::63-85::87-109
MDAACVKLLQAISDKVENLNWKVTQHSCNGDRGFDNRNISRDKSQIIRNVTCDCSFNNNTTCHVTSIALKGLNISGPIPDEFGNLTRLEILDLTWNNFNGSIPKSLGRLSSVVNLSLLGNRLTGSIPSEIGDMASLQELNLEDNQLEGPLPQSLGKMSNLLRL

SEQ ID NO: 137709 - protein, 565 aa, Glycine max
  Coding DNA Sequence Number=SeqID_20931
  Gene Ontology: Mol. function=signal transducer activity; Cellular component=membrane; Biological process=response to light stimulus
  Homolog annotation: Hit_ID=Q1ST79; Match level="QueryCoverage=99%, HitCoverage=99%, E-value=0.0, Identity=67%"; Hit description =BTB/POZ; NPH3
  Pfam annotation: Domain name=BTB; Domain location=55-163; Score=24.4; E_value=2.5e-05; Accession=PF00651.21; Description=BTBPOZ domain
  Pfam annotation: Domain name=NPH3; Domain location=232-470; Score =194.3; E_value=2.9e-55; Accession=PF03000.5; Description=NPH3 family
  Pfam module annotation: Pfam domain module=BTB::NPH3; Domain location= 55-163::232-470
MKKGFQFAGYDKATIGTITLDCQSPYGEKRNRCALLPPNVPILAHSLERTQRNWIARSNSPTDIIIQVGDSSFHLHKLAIASRSEYLNRLVFQRGSNREKAGDSLIIQMKNLPGGKKTFELVVKFCYGRKIDITAANIVPLYCAAHFLEMSEDVEEGNLISKTESFLTFLILSSWKDTFRILKSSESISPWAKDLHIVKRCSEAIAWKLCTNPNASSFTCESETPLSNNSVDNWWFEDVSCLRIDHFIEVIQSIRKRGTKPELVGSCIEHWTRKWFSQVTFGLDKETPIPITLQLHRISTECLISILPSEENSVTCNFLLHLIKAGVMLKINSELLCVLERRVALMLEKCRVPDLLVKNQGDKDSLYDVSVVLRVLRFYVCGMSSNQSAKPHSVGRLVDGYLTQVARDENLTMESFKSLVEALPQKARHCDDNLYRAIDMYLKAHPNLAEEDRTDACRVLEYHRLSHEARQHVMQNDRLPLKLTTEFVLLEQVNMATSMTSNGSNYRRTNAQTIIRVNKDMEKRQITNAQEISMMKKDVEMIKSQLLEVYSCKMKLQNQLKRCIR

SEQ ID NO: 137710 - protein, 189 aa, Glycine max
  Coding DNA Sequence Number=SeqID_20932
  Gene Ontology: Mol. function=GPI anchor binding; Cellular component =membrane
  Homolog annotation: Hit_ID=P59833; Match level="QueryCoverage=97%, HitCoverage=94%, E-value=9e-28, Identity=38%"; Hit description =Putative GPI-anchored protein At5g19250 precursor
MTMFLFSNIFSFNLHACVVSLDEEDLLHDINVYRKVLNLPVLDESGKASCLAEEIAENLEHTKCEDFRDYYPLPSYTSKIPKFQKSINKCKININTTKDGVIMPLCVPKLDPDALFSNYTKSNRFSKYLNNSKYKIAGLGSEDDWMVLIISTNTSSGDFSSATSLLAGALKGHYLMLPFFLSTLIVFFN

SEQ ID NO: 137711 - protein, 468 aa, Glycine max
  Coding DNA Sequence Number=SeqID_20933
  Gene Ontology: Mol. function=amidase activity; Cellular component =chloroplast; Biological process=translation
  Homolog annotation: Hit_ID=Q1ST73; Match level="QueryCoverage=97%, HitCoverage=99%, E-value=1e-167, Identity=67%"; Hit description =Amidase
  Pfam annotation: Domain name=Amidase; Domain location=2-446; Score =82.6; E_value=1.3e-21; Accession=PF01425.11; Description=Amidase
METASDYGAFMEKFTLPPNSAPSLPLNSLTFAVKEIFDVEGYVTGFGNPDWARTHTVATSTAPTVLALLRAGATCVGKTVMDEMAYRLNLIVGSNITFVTFSQSVDYMEMTRLLNDYFVSININGENIHYGTPRNPCAPDRVPGGSSSGSAVAVGAELVDFSLGTDTGGSVRVPASYCGIFGFRPSHGAISESGVIPMSQSFDTVGWFARDPMILSRVGGVILQLPDVAPPIRPTCIIIAEDCFQLSSTPFDVVTGTVIQAVEKLYGGDVLKHEILGDYVKTNVPSLKHFMSKENTDQIYSIPSLAALSSAMRLLQRYEFKNNHGEWISAVKPDLGPGISERVSDALRTTGENIDICYSIKKELHDALAALLGDFGALMIPTVPGPPPKLQTNTSDLEIFRARAFSLLSIAGVSGFCQVSIPLGMYNNLPLSISLVARHGADRFLLHLVESLYDSIKDRKQHITEHKL

SEQ ID NO: 137712 - protein, 250 aa, Glycine max
  Coding DNA Sequence Number=SeqID_20934
  Gene Ontology: Mol. function=pepsin A activity; Biological process =proteolysis
  Homolog annotation: Hit_ID=Q05929; Match level="QueryCoverage=96%, HitCoverage=60%, E-value=1e-49, Identity=46%"; Hit description=EDGP precursor
  Subcellular localization annotation: CTP_CleavageSite=41; ConfidenceScore=5.49e-01
MLGLGRSRSSFPSQVFDNFSTHRKLTLCLSSFKGVVLLGNVATYESEVLKSLTFTPLITSFPRQEYIINVSSVKINGNRLSLDTSSSESSNEQDGSVGALTLLSTILPYTTMQSSIYNSFKTSFEDAAVAMNMTRVASVAPFELCFSSRGEQAGPSVPVIELVLQSEMVKWTIHGRNSMVRVSDEVVCLGFLDGGVNPRNSIVIGGYQLEDVVVQFDLATSMVGFSSSLVAKNTKCSDFKFASSITADSI

SEQ ID NO: 137713 - protein, 158 aa, Glycine max
  Coding DNA Sequence Number=SeqID_20935
  Subcellular localization annotation: CTP_CleavageSite=19; ConfidenceScore=5.25e-01
MPFPDGFLPQPQPKQRNPRETKRQGPQKQVKLSNPPRPQATRNADQHECKPRRFLLRQPPVGGYFPSPATDEKAQSLAIAARDFAGEGVEGLRQDLEIERDGGSQLKNFPIGWLGPAAAPLSAEDCGSWMRLRKAKRNRIEEARIDVDYGDWEWKGVI

SEQ ID NO: 137714 - protein, 48 aa, Glycine max
  Coding DNA Sequence Number=SeqID_20936
MGKKWSIHTSLEYGGKALAMKQLEALIRQLIEKYLPLLTPYTTELLVG

SEQ ID NO: 137715 - protein, 69 aa, Glycine max
  Coding DNA Sequence Number=SeqID_20937
  Homolog annotation: Hit_ID=Q9AX74; Match level="QueryCoverage=51%, HitCoverage=12%, E-value=5e-10, Identity=77%"; Hit description =Putative integral membrane Yip1 family protein
CMSVVPLEIFRWVVAGVAGFMSATFVALNLRAHIMSAVGSSCSTKGLPLHSNSMRGKWYYHHSASMNCR

SEQ ID NO: 137716 - protein, 1179 aa, Glycine max
  Coding DNA Sequence Number=SeqID_20938
  Homolog annotation: Hit_ID=O81983; Match level="QueryCoverage=36%, HitCoverage=98%, E-value=0.0, Identity=81%"; Hit description=Seryl -tRNA synthetase
  Pfam annotation: Domain name=Seryl_tRNA_N; Domain location=733-844; Score=147.2; E_value=4.4e-41; Accession=PF02403.12; Description =Seryl-tRNA synthetase N-terminal domain
  Pfam annotation: Domain name=tRNA-synt_2b; Domain location=908-1082; Score=221.4; E_value=2e-63; Accession=PF00587.15; Description=tRNA synthetase class II core domain (G, H, P, S and T)
  Pfam module annotation: Pfam domain module=Seryl_tRNA_N::tRNA-synt _2b; Domain location=733-844::908-1082
AETPKHDNGALDVGTVLDSSNGILDKAGRWHVEFEFSPHSASQDHVNPQPSPESESNDIGTGFAMFSQNFGEFSSGSGPNQNLEVLKKADIYPTNMELLKFEGATPHGTIDSSLTSESNQPDGWNFGFNFNSSSVGEDNHSSDSYFKTKNNQDDNNRNNASPTNINVDSHVNFFESESDVTKHEKPLTSSENRREAMPLSIFGDETPDTDKHPVTQDLSPYTPTSPIRNSFNSPGSNFSINDIWNLYNQAENQSSPNMTPKASENQIHASPEVLGSSLVTSNDNLDDDFWDYKDAATETRFTNESAQKTSSPQVNENVLQSSPTFLNSDLTNGDDDFVDDSWVFKDAISGTISQDHTPSLDHRDLPQLSTKLEQVDYAEFYSKVKDELCNYVLFHLQNLKKTQNVAALSGEDAKAKALLEEIQGILSMGVMGESGGRSFRIWHKEFSKILHQDNMSIPNEYLSEDYCPRNVCFNELLEVLKEPKFQPFESEYQLASRLLMAEKDIKCVMELLKDTVSTLRILKLGSTEEQSNYLTIWSKIAFVCSQELKHGAYVWKQAVLQNTHDQILSSPKGKLHDYVMPNVYAADVDELKQSEITSSFSGIGVQFILALGEIYRVAEIIGTSAKLHKPWMLSGATDHKSLCALLNECYGIWLASGLEEAILSISNWNNFEPDGISRELVESIKYIHELDEHALQSFVISGEQTTCQLSALPAGFIPVVAQVREVEGGVRSMLDINLFREEKGHNPEFIRESQRRRFASVEVVDEVINLDKEWRKRQFELENLRKEFNKINKEVSKLKRAGEDATKFISESEETKKSIGEKEVEVRETLNLLNSKLETIGNLVHDSVPISQDEANNVVVRSWGEKRVEPKLKNHVDLVELLGIADTKKGADVAGGRGFYLKGDGVRLNQALINFGLDFLEKREYTLLHTPFFMRKDIMSKCAQLAQFDEELYKVTGEGDDKYLIATAEQPLCAYHLDDWIHPTQLPLRYAGYSSCFRKEAGSHGRDTLGIFRVHQFEKVEQFCLTSPNDNDSWDMHEEMLKNSEDFYKALNLPYQVVSIVSGALNDAAAKKYDLEAWFPASQAYRELVSCSNCTDYQARRLEIRYGQKKSNEQMKQYVHLLNSTLTATERTICCILENNQKEDGVEIPEALRPFMGGKTFLPFKNQPSNEAKGKKSKA

SEQ ID NO: 137717 - protein, 171 aa, Glycine max
  Coding DNA Sequence Number=SeqID_20939
  Gene Ontology: Mol. function=pepsin A activity; Biological process =proteolysis
  Homolog annotation: Hit_ID=Q3SC86; Match level="QueryCoverage=96%, HitCoverage=37%, E-value=1e-20, Identity=39%"; Hit description =Xyloglucan-specific fungal endoglucanase inhibitor protein
MAYSFAMIISFLLCLMSTLSHSLSPVWFLIPVTKDASTLQYITTLSYGTPLLPTKLVLDLGGPFLWLHCASRNTPSSSSLTTPHRSLQCFTAKTHKSTNSFLSSPVDEVHQYHPCQVFPENSITGTVASEGELVEDLMALQSPQEEEGGQLVEHQSLFTCSPTTLLNGLAR

SEQ ID NO: 137718 - protein, 84 aa, Glycine max
  Coding DNA Sequence Number=SeqID_20940
  Gene Ontology: Mol. function=protein tyrosine/serine/threonine phosphatase activity; Biological process=protein amino acid dephosphorylation
  Homolog annotation: Hit_ID=Q9ZR37; Match level="QueryCoverage=76%, HitCoverage=32%, E-value=2e-09, Identity=53%"; Hit description =DsPTP1 protein
MEKLILGLEPVITRSSGSNLTVRLLQGSPFFYTVVAYLMKTRGMSFFEALKHVKSIRPAAGPNQGFICQLEDFEKSLQGANKLH

SEQ ID NO: 137719 - protein, 87 aa, Glycine max
  Coding DNA Sequence Number=SeqID_20941
MRTRKGGRGKVVAQHCEKGARVCMVEDEVTIVMGEGALVEMGCQSVAWGAAASLIEGREVLGFRNLGKGGVQEAEAFQMPSSNFGLS

SEQ ID NO: 137720 - protein, 139 aa, Glycine max
  Coding DNA Sequence Number=SeqID_20942
MVSSPAFVVIIALTVSTRISLPTTSARRQRAAATIAEDVDHGDHATDKVHEQPQEPITNHVGVDTEGFPGRPHDTSMLTHYVDHEHTKLKLTSHRRKVEKFERFAPEIEGIMVARGLSSLITCSVDTSDMRLLYAFAEG

SEQ ID NO: 137721 - protein, 61 aa, Glycine max
  Coding DNA Sequence Number=SeqID_20943
NNLGGRWVLVYSEVGNRDSEFRVCVLLRPLDWSMDLIKFNCPGEVCSQLHLATGTKFHSIL

SEQ ID NO: 137722 - protein, 289 aa, Glycine max
  Coding DNA Sequence Number=SeqID_20944
  Gene Ontology: Cellular component=nucleus
  Homolog annotation: Hit_ID=Q1S3S7; Match level="QueryCoverage=87%, HitCoverage=88%, E-value=4e-72, Identity=59%"; Hit description =Eukaryotic rRNA processing protein EBP2
  Pfam annotation: Domain name=Ebp2; Domain location=1-287; Score =287.7; E_value=2.2e-83; Accession=PF05890.2; Description=Eukaryotic rRNA processing protein EBP2
MAMPVNDDTMIEDETEDQSEKMSSSESEQEEDVRLAEPSKNAVYNRDALLDKLGDISWPANVEWIHKLSIDVDQEQEVDVNDDLARELAFYTQALEGTKEAFEKLQSMGLPFLRPADYYAEMVKTDGHMEKVKGRLLSEKRKMEEADERRKAREAKRLAKEIQAQKLKERAKQKKEDIESVKKWRKQRQQSGYADNGKDADMGFDFEDGKVFERSNKKRPGVSPGDRSGGKAKQAFGKGKKQKIRDGKNSKFGFGGKKGMKKQNTADTTNDFGKFNKGAVAGNKRKRLY

SEQ ID NO: 137723 - protein, 73 aa, Glycine max
  Coding DNA Sequence Number=SeqID_20945
  Homolog annotation: Hit_ID=Q1EJK0; Match level="QueryCoverage=50%, HitCoverage=22%, E-value=4e-08, Identity=62%"; Hit description =Putative glycogenin
MKSYNGGDQALVNEVFTWWHRLPTKLNYLKSFEKREGNENLEVVPEDLFMICHAHRGSILLWTTKKSKKCQFV

SEQ ID NO: 137724 - protein, 58 aa, Glycine max
  Coding DNA Sequence Number=SeqID_20946
MAISDREYKEKEKILGVGFLFFFSLSRRRRGPNNIGIQGTVNVDAKSESLKLGEGFQT

SEQ ID NO: 137725 - protein, 186 aa, Glycine max
  Coding DNA Sequence Number=SeqID_20947
  Gene Ontology: Mol. function=iron-sulfur cluster binding; Cellular component=integral to membrane; Biological process=electron transport
  Homolog annotation: Hit_ID=Q8H3D8; Match level="QueryCoverage=95%, HitCoverage=66%, E-value=5e-61, Identity=64%"; Hit description =Integral membrane protein-like
  Pfam annotation: Domain name=DUF988; Domain location=44-183; Score= -64.3; E_value=0.043; Accession=PF06177.2; Description=Protein of unknown function (DUF988)
  Pfam annotation: Domain name=SNARE_assoc; Domain location=65-184; Score=134.7; E_value=2.6e-37; Accession=PF09335.1; Description=SNARE associated Golgi protein
  Pfam module annotation: Pfam domain module=DUF988::SNARE_assoc; Domain location=44-183::65-184
MSFSWTSALNITFLLLLVAAAVVACLTLPVDKILKDLLEWIDRNLGPWGPLALIAAYIPLTVLSVPASVLTLGGGYLFGLPIGFIADSIGATVGAVAAFLLGRTIGKSLVVSRLKDYPQFRLVTIAIQRSGFKISILLRLAPFVPFNMLNYLLSVTPVPLGEYTLASWLGMMVSSSSLINYTDGYS

SEQ ID NO: 137726 - protein, 151 aa, Glycine max
  Coding DNA Sequence Number=SeqID_20948
MGKVQGFSLLSFGGCFDGCRDHTQGSGYGTRIWNLSDRPVELQIRVGSILKKIHTLKPGSSKRLKSKSIYKAYMPGRSGSVGGSLKSLLYYYDETYHPYIWIHDTGCHSLRMAKQQYISLEDLRDSSEIKVFWDHQRGSISVRKRTRPDFC

SEQ ID NO: 137727 - protein, 272 aa, Glycine max
  Coding DNA Sequence Number=SeqID_20949
  Gene Ontology: Mol. function=microtubule motor activity; Cellular component=microtubule associated complex; Biological process =microtubule-based movement
  Homolog annotation: Hit_ID=Q75HV1; Match level="QueryCoverage=24%, HitCoverage=7%, E-value=1e-17, Identity=62%"; Hit description =Putative kinesin-related protein
MTIPVPDNNNVSSTMRALFFASLLDHLSDHTLEIVRMVMVVTRVGDGGAQWHNDLEGYFCPLESFGRCRMRMGDQSMQIQMLAEKFHRFVLDCELKQPSIAQCSDIVSKQVNENSDSMDEHSLSNGTHEVSPDKGHTLPILKKILDLGAKIQDLKKQHITLCDEVKLTSESFPGNDILKSVQLLGAEYELLKRKYSEESSERRRLYNEVIELKGNIRVFCRCRPLNENEIANGSVSVVNFESSSDNELQVICADSSKKQFKFDHVFGPEDNQ

SEQ ID NO: 137728 - protein, 988 aa, Glycine max
  Coding DNA Sequence Number=SeqID_20950
  Gene Ontology: Mol. function=hydrolase activity, hydrolyzing O -glycosyl compounds; Cellular component=lysosome; Biological process =carbohydrate metabolic process
  Homolog annotation: Hit_ID=Q84XI2; Match level="QueryCoverage=98%, HitCoverage=98%, E-value=0.0, Identity=76%"; Hit description =Glycosyl hydrolase
  Pfam annotation: Domain name=Glyco_hydro_2_C; Domain location=348 -578; Score=-142.6; E_value=0.053; Accession=PF02836.7; Description =Glycosyl hydrolases family 2, TIM barrel domain
  Pfam annotation: Domain name=Glyco_hydro_2_N; Domain location=49-159; Score=-32.8; E_value=0.00048; Accession=PF02837.8; Description =Glycosyl hydrolases family 2, sugar binding domain
  Pfam module annotation: Pfam domain module=Glyco_hydro_2_C::Glyco _hydro_2_N; Domain location=348-578::49-159
MAKTTLDSGWLAARSTEVHFTGTQLTTTHPPSASTQPWMEAIVPGTVLATLVKNKAVPDPFRGLGNEAILDIADSGRDYYTFWFFTTFQCKLSGNQHCDLNFRGINYRADVYLNGHQMVLPKGMFRRHSLDVTNIIHSDGSNLLAVLVHPPDHPGSIPPQGGQGGDHEIGKDVATQYVQGWDWMAPIRDRNTGIWDEVSISITGPVKIIDPHLVSSFFDNYKRVYLHASTELENRSSSTAECSLSIHATTELEGSIHLVEQLQTQNLSIPARSRVQYTFPEFYLFFPSANDLHWQLFFYKPNLWWPNGMGKQSLYNVIINIDIKGYGESDSWNHHFGFRKIESHIDGATGGRLFKVNGEPIFIRGGNWILSDGLLRLSKKRYETDIKFHADMNFNMIRCWGGGLTERPEFYHYCDYYGLLVWQEFWITGDVDGRGIPVSNPNGPLDHDLFLFCARDTVKLLRNHPSLALWVGGNEQTPPDDINVALKNDLKLHPYFEHGEEKEKPVGDLSPRLGDPSQYLDGTRIYIQGSLWDGFADGKGDFTDGPYEIQNPEDFFTDSFYNYGFNPEVGSVGMPVAATIRATMPSEGWQIPLFNKLSHGYVEEVPNPIWKYHKYIPYSNPTKKVHDQIQLYGDVKDLDDFCLKAQLVNYIQYRALLEGWTSHMWKKYTGVLIWKTQNPWTGLRGQFYDHLLDQTAGFYGCRCAAEPIHVQLNLATYFIEVVNTTSEELSSVAMEVSVWDLEGTRPHYKVHENLTALPKKVTPIVEMKYSKSKNPRPVYFLLLKLYNMSDNTILSRNFYWLHLAGGDYMLLEPYRKKKVPLKITSEVFIEGSTYILRMHVQNTSKKPDSKSLTLVHGSTARLSNNCFVTDSPETIDSGTGKEHEVGWFKRIHKCFAGKSDGLKVSEINGQDIGVAFFLHFSVHASNKDHKEGEDTRILPVHYSDNYFSVVPGETMTIKISFEVPPGVSPRVTLHGWNYQGQTIHEALY

SEQ ID NO: 137729 - protein, 100 aa, Glycine max
  Coding DNA Sequence Number=SeqID_20951
MSCKKDKNNSTKHLVYKELRKSDFLIAIKEYVGARETPSSTAKRLKKHKKRLRPYSFLGTCTRESRVALPPKGKVVKDAMNNMIKLQHVEIKASFETSTH

SEQ ID NO: 137730 - protein, 222 aa, Glycine max
  Coding DNA Sequence Number=SeqID_20952
RNLISQRLLTAGRKGSYYRPWGRDEGSLNKISRGNGPLQPIRTLSRTLSDVRKKAQVIQKQNTTSHVLSRGGYDYLEQKLLAEKTKKKLEEAAQSGSVDGVNDPPSPDSFEEQATQGSFVLHGRQHVLAAAIGRPEHPRRPPWTSACYLTLFHEQVAVSPAKPPPKPDPEVDDPLYLMILTIPELFLRLYQVRWDATVFGVFNQDFPLYIKYEDLSEIAHGG

SEQ ID NO: 137731 - protein, 72 aa, Glycine max
  Coding DNA Sequence Number=SeqID_20953
  Gene Ontology: Mol. function=transposase activity; Biological process= regulation of transcription, DNA-dependent
  Pfam annotation: Domain name=Transposase_8; Domain location=11-72; Score=39.7; E_value=1e-08; Accession=PF01527.10; Description =Transposase
MAIKERCSMSGKRYPEEFKIAAVRQITEGGYAVSEVARRLDVTVDSLYAWVRKYGPNAAEHKAKTAEQAELQ

SEQ ID NO: 137732 - protein, 145 aa, Glycine max
  Coding DNA Sequence Number=SeqID_20954
  Homolog annotation: Hit_ID=O05000; Match level="QueryCoverage=36%, HitCoverage=10%, E-value=4e-21, Identity=96%"; Hit description=NADH -ubiquinone oxidoreductase chain 2
IHCCTPVPVDRPKPILRPPPENLPLKEVFGSFRKMSIFLRKDPHFIAPGERKFDRGLERRGGMEEKARDGFRSLCASRMRVVVGPTHPICSMIYGSTGATHFDQLAKILTGYEITGARSSGIFMGILSIAVGSLFKITAVPFRAA

SEQ ID NO: 137733 - protein, 134 aa, Glycine max
  Coding DNA Sequence Number=SeqID_20955
MARRDKLWSFCALLSSRGGEPDEMRRQIMVIPHTFSPFGDNRVRWHAETNYGHFAPFCHPEAASPMTCEDKLWSFRTLFRHSETIVSDGAKRHIMVILRFLSSRGGEPDDMRGYYYGHLRLSSIERNEFGNIRM

SEQ ID NO: 137734 - protein, 420 aa, Glycine max
  Coding DNA Sequence Number=SeqID_20956
  Gene Ontology: Mol. function=DNA binding; Cellular component=nucleus; Biological process=regulation of transcription, DNA-dependent
  Homolog annotation: Hit_ID=Q10G93; Match level="QueryCoverage=98%, HitCoverage=32%, E-value=1e-95, Identity=49%"; Hit description=DIRP family protein, expressed
  Pfam annotation: Domain name=Myb_DNA-binding; Domain location=57-102; Score=47.5; E_value=4.5e-11; Accession=PF00249.21; Description=Myb -like DNA-binding domain
MAPTRKSRSVNKRMSSSNDNSPEKDGINSNKNKLRKTRLQDSDYALCEKKKLTDKLGSQWSKEELERFYEAYRKYGKDWKKVAAFIRNRSTEMVEALYNMNRAYLSLPEGTASVVGLIAMMTDHYNVMEGSDSERESNDAPGSQKPVKRKHEEVQLSVSKDQSHSIASRDDCLSILKKRRFDGMQLKPYAVGKRTPRVPVYKKDDTENYVSPYRRSLKSTIDANDDEVAHVVALALTEAAHRGGSPQVSQTPSRRVEQKSSPIQSLERKHQMSETACAKFHDVSVDEEVLESSIESRGAENGEYARDNSSLMDTEGISTVKVFQKRKIFYRKRERVENVGNHQLDDGGEACSGTEEGLSFSSLKEKVDIDVTNEKLEKFSPKSQRKRNKKLFFGDETPALNALQTLADLSLMMPISTMES

SEQ ID NO: 137735 - protein, 236 aa, Glycine max
  Coding DNA Sequence Number=SeqID_20957
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=Q93YI8; Match level="QueryCoverage=93%, HitCoverage=28%, E-value=3e-98, Identity=68%"; Hit description =Lipoxygenase
  Pfam annotation: Domain name=Lipoxygenase; Domain location=1-215; Score=-81.1; E_value=5.5e-12; Accession=PF00305.9; Description =Lipoxygenase
MSYVGVAVEDSTSPYGLRLLIEDYPFAVDGLEIWFAIKTWVKDYCSFYYKEDDTIKKDTELQSWWKEIREVGHGDKKDEPWWPKMQTCEELIQTCTIIIWIASALHAAINFGQYPYGGFPPSRPQKKELQITSQFLAVLGISLVEILSKHSSDEVYLGQRDTPDWTSDAEPLQAFEKFGKKLADIEERILRMNSDEKFRNRYGPVKMPYTLLYPTSKGGLTGMGFPTVSQFNLKGL

SEQ ID NO: 137736 - protein, 170 aa, Glycine max
  Coding DNA Sequence Number=SeqID_20958
  Homolog annotation: Hit_ID=Q01CA2; Match level="QueryCoverage=53%, HitCoverage=40%, E-value=2e-08, Identity=37%"; Hit description=[R] KOG4840 Predicted hydrolases or acyltransferases
  Pfam annotation: Domain name=DUF1749; Domain location=1-170; Score= -134.6; E_value=2.5e-06; Accession=PF08538.1; Description=Protein of unknown function (DUF1749)
MDFLISLQLLVEFTLKDAKELDQLINYLINKEDSEGVALLGHSTGCQDIVHYMRTNFACSRAVRAAIFQAPVSDREYQATLPHTASMIDLAAKMISEGRGLELMPREADPSAPITAYRENSIEQCSGFKRKMQLRAENKEIRGDKLHDPVAGGTQNCQIDFLPLISSLVP

SEQ ID NO: 137737 - protein, 567 aa, Glycine max
  Coding DNA Sequence Number=SeqID_20959
MPEKVVISPQRALWSILMLHWRVGLLTALVLVGMVVVWSIDGCTVKNIIQAWRYQQDYLAVRSHTPNLTLTFVSPYSPVYGKKSLLVEGHASWVSNELEPNLTSNLIARWSARGGEPCKDSKAVEIAIPWLDGGEVVDLSAGYVHEFGFQALDDSEKPLCVGGDYFEADLSGESWKSRPLVKDFSNGSYSISLQVHPDFDGVYNLTIILLYRHFEGLKFTPWKFSYDRMLRNVAIRFYKSSVQLPELQACKASDFVRDVWIGRWTRHGKNDDCSIENDGRYRCLAPDFPCQAPWCDGSLGILESNGWVYSTHCSFKLYSAESAWNCLKNRWVFFWGDSNHVDTIRNLLNFVLDLPEISSVPRRFDMNFSNPRDPSQTVRITSIFNGHWNETQNYLGLDSLKDEGFQDLLKKYFSEDTIPDTVVMNSGLHDGVHWHNIRAFSVGADYAASFWGDVMKTVKQRGLAWPRVFYRNTIATGGYARSLAFNPNKMEVFNGVLLEKLKQAGVVSGVIDNFDMTFPWHFDNRCNDGVHYGRAPAKMKWRDGQIGHQYFVDLMLAHVLLNALCAR

SEQ ID NO: 137738 - protein, 852 aa, Glycine max
  Coding DNA Sequence Number=SeqID_20960
  Homolog annotation: Hit_ID=Q9FUH9; Match level="QueryCoverage=43%, HitCoverage=95%, E-value=4e-70, Identity=46%"; Hit description =Microtubule-binding protein TANGLED1
  Pfam annotation: Domain name=Kinesin; Domain location=1-112; Score= -103.4; E_value=9.1e-08; Accession=PF00225.13; Description=Kinesin motor domain
QAAEGTQEVPGLVEARVYGTEDVWEMLKTGNRVRSVGSTCANELSSRSHCERVGKTEAEGERLKESQFINKSLSALGGDCKTLMFVQVSPSSADLGETLCSLNFATRVRGIESGPARKQVDHTELFKYKQMAEKLKQDEKETKKLQDSLQIMQLRLAAREHHCRSLQEKVRDLENQIAEERKTRLKQESRSLAAVTVQPSSSTAHKTMTDKKPPLNPSKLRLPLRRITNSLPPRSPLRSKSYTAFMSGKENSVRRNSMATNAVRPASPSTTAQFLQARRRVSVAVRPPAPSTTQVFQPRRRVSIATLPSHTISDITTPLRTSALRVTGGSSQQSRIRSQRKDRYSSLFAPLPELRTSVETTPMTVRRSSKFMMSSPVRADSREGSARHPTLLALQRKPVVWSPLRVKDMDRLSRPLEKTNRYTEFVFVQHQHLGAKLCNKKQKVKGPDRVFVVERERVHIQSLVGWDILKMVARTPPKQKKLLAALNPVLIKETLNKVDQCVARLQELQYTVTGGTKVVSGVTLSPRSTRGYLRTSLRCKQESLRIKNGASRRSPVGKFPANTGEWKRMSLPAMLVGETVGEILQASQFAREIVSAVGKKTDPEDPKTPMSQRSNKKVELENTQLRARRKKEKQTKAQNDGSPSLQRARSRINFKVSPPKVREFDKERNRYMANRVSPRNRPWTRKTVLFPNPLFLSTHSSSQQQFCKTRSPIITRNRGTTSHKFLIKSPSSPSGPQQFSKTRSPVITRNRGGTPHKFLIKSPSSASKFQVQIKKSPPTVSISPTKPARLSRSPPKRSTSTASKFRRSFSPSRIASRLVSLSPLRTRKTVQKNDGFVSGLKQRPLSSVQYPA

SEQ ID NO: 137739 - protein, 279 aa, Glycine max
  Coding DNA Sequence Number=SeqID_20961
  Gene Ontology: Biological process=cell wall catabolic process
  Pfam annotation: Domain name=F-box; Domain location=59-107; Score =28.1; E_value=3.1e-05; Accession=PF00646.23; Description=F-box domain
  Pfam annotation: Domain name=LysM; Domain location=137-180; Score =40.2; E_value=7e-09; Accession=PF01476.10; Description=LysM domain
  Pfam module annotation: Pfam domain module=F-box::LysM; Domain location=59-107::137-180
MKVYPLKDLLFSRNLTPLPMGCCCDEDDGDIFRHLMNSNFPSSSSSTSSSCTVISPMNSHFSALSSTDILRLIFENLPIIDLARASCVCRLWCSVASQRDMVTRAFVAPWKLNDVVGNPLSGSFWRDNSLAKFAISHRITRGDTVASLAVKYSVQVMDIKRLNNMMSDHGIYSRERLLIPISNPDILINRRCFIELDVYAKREVAVLYPNDVPDRRTTYVSNRISSEESNKKVLESLKRSMHVDNETAQYYWSVANGDPRAAFAEFSADLKWDWQAGHS

SEQ ID NO: 137740 - protein, 160 aa, Glycine max
  Coding DNA Sequence Number=SeqID_20962
  Gene Ontology: Mol. function=protein dimerization activity; Cellular component=nucleus; Biological process=regulation of transcription
  Homolog annotation: Hit_ID=Q0PH24; Match level="QueryCoverage=90%, HitCoverage=60%, E-value=1e-62, Identity=77%"; Hit description=Auxin- regulated protein
  Pfam annotation: Domain name=AUX_IAA; Domain location=3-152; Score =258.5; E_value=1.4e-74; Accession=PF02309.7; Description=AUXIAA family
  Subcellular localization annotation: CTP_CleavageSite=52; ConfidenceScore=5.21e-01
MAHTHFLFLSALLFSRAQVVGWPPVRSFRKNIVQRNSNEEEAEKSTKNAFVKVSMDGAPYLRKVDIKLYKSYQELSDALAKMFSSFTIEKCGSQGMKDFMNETNGSDYVPTYEDKDGDWMLVGDVPWEMFVESCKRLRIMKGSEAIGLAPRAVEKCKNRS

SEQ ID NO: 137741 - protein, 267 aa, Glycine max
  Coding DNA Sequence Number=SeqID_20963
  Gene Ontology: Mol. function=helicase activity; Biological process =viral genome replication
  Homolog annotation: Hit_ID=Q1SRJ5; Match level="QueryCoverage=94%, HitCoverage=31%, E-value=2e-50, Identity=40%"; Hit description =Probable helicase [imported]-Arabidopsis thaliana-related
MNINQAFVEGQSLTYSEFVTKFVYNQKQRCWQLMKKGYTIVRLQWVPPTTGELFYLRMMLTISRGPISFEDIRTVDGVEYPTYRETCFAMGFLQDDREFIAAIKEAKDWSSAPYLRNLFVLLLLTGTMNKPEQVWEKTWHWLSDDIVYSHRRSTSTLGLHIDDCNLMNLVLLEVEQLLQANQRSLKDYPSMPYPENANLLTHADNGLILSELNFNNEELRSEFLNLFSQMTNQQAKIYNQIIQAVNKNEGGMFFLWDPLESTCRHAS

SEQ ID NO: 137742 - protein, 340 aa, Glycine max
  Coding DNA Sequence Number=SeqID_20964
  Gene Ontology: Mol. function=DNA binding; Cellular component=nucleus; Biological process=regulation of transcription, DNA-dependent
  Homolog annotation: Hit_ID=Q10G93; Match level="QueryCoverage=88%, HitCoverage=21%, E-value=1e-73, Identity=49%"; Hit description=DIRP family protein, expressed
  Pfam annotation: Domain name=DIRP; Domain location=116-217; Score =210.6; E_value=3.6e-60; Accession=PF06584.3; Description=DIRP
  Subcellular localization annotation: CTP_CleavageSite=45; ConfidenceScore=5.12e-01
MALDDDNKPVVKGKHTDQAFTLPKQLKTVKSSESSFCSDQKDLTVSTAEVPLLNEVSLPTKRSRRKMILQRTSLPKEKSSDYILKSQPNKYSTLKAKVSSCLASNMVRRWFIFEWFYSAIDYPWFAKREFMEYLNHVGLGNIPRLTRVEWSVIKSSLGKPRRFSEHFLCEERHKLEQYRESVRKHYTELRTGIRDGLPTDLAKPLYVGQRVIALHPKTREIHDGSVLTVDYDKCRIQFDRPELGVEFVMLLLCRVSRVRLDLLCAYRRQPCICKSMISRLESMTYSLQDIDCMPLNPSDNMPEALRRHIGSQKASFMNKEPQINGNSNFGGCEMHSFPVK

SEQ ID NO: 137743 - protein, 282 aa, Glycine max
  Coding DNA Sequence Number=SeqID_20965
  Gene Ontology: Mol. function=nucleic acid binding; Biological process= metabolic process
  Homolog annotation: Hit_ID=Q5QIV3; Match level="QueryCoverage=98%, HitCoverage=73%, E-value=4e-93, Identity=59%"; Hit description=Acyl CoA reductase
  Pfam annotation: Domain name=NAD_binding_4; Domain location=11-159; Score=11.6; E_value=2.1e-09; Accession=PF07993.2; Description=Male sterility protein
MPSAYVCGERGGLIIEDSCQLGVSLNGVPGLDIDMEKKAVEDKLYQLQQEGATEDDIKMAMKDFGMKRATIYGWPNTYVFTKAMGEMLIETLKENVSVVIVRPTMVTSTYREPFPGWVEGVRTIDSLIVAYGKGKLTCFLADIKATFDVIPADMVVNAIISTMVAHANKPCDNIIYHVGSSLENPVRYHNLQDYGFRYFKAKPYVNKEGNYVMVRKVTVLDSMASFQRYMFIRYFLPLKGLELANAAFCQYFQRTYLDIRRKIYTVMRLVDLYRPYLFFNGV

SEQ ID NO: 137744 - protein, 158 aa, Glycine max
  Coding DNA Sequence Number=SeqID_20966
  Gene Ontology: Mol. function=acyltransferase activity; Cellular component=integral to membrane; Biological process=metabolic process
  Homolog annotation: Hit_ID=Q9XGY7; Match level="QueryCoverage=98%, HitCoverage=32%, E-value=2e-47, Identity=60%"; Hit description=Acyl CoA reductase
  Pfam annotation: Domain name=NAD_binding_4; Domain location=17-158; Score=8.1; E_value=3.6e-09; Accession=PF07993.2; Description=Male sterility protein
MEFGSIIHFLEDKNVLVIGAAVFVEKILRVQPNVKKLYLLLRATDAESASQRLHNEIIQKDLFRLLKENLGAKFNTFVSEKLTLVPGDISQEDFNLKDPILREEICSQTHCIINFAATTNFDERYDVALGINTLGVKHVLNFAKSCIKLKVLVHVSTG

SEQ ID NO: 137745 - protein, 175 aa, Glycine max
  Coding DNA Sequence Number=SeqID_20967
  Homolog annotation: Hit_ID=Q2HRX8; Match level="QueryCoverage=55%, HitCoverage=20%, E-value=6e-09, Identity=30%"; Hit description=IMP dehydrogenase/GMP reductase
  Pfam annotation: Domain name=DUF1723; Domain location=84-137; Score =32.2; E_value=1.8e-06; Accession=PF08330.1; Description=Protein of unknown function (DUF1723)
MVRTGGLGRTLGMIIGIALGREREVGPIVEDVKHVDHATQEVHEQPQEAPADDVVNDVESFPSGSHDTSVLTDYVHHVAVTVWNREECLELKLSSHRRKRWHKETSSFHLPVGEVTITLDDVASLLHLPIIGAFHSFEALHVDDVVFLLVELLKVSFEEVRDEIIQCHGAYVRLS

SEQ ID NO: 137746 - protein, 308 aa, Glycine max
  Coding DNA Sequence Number=SeqID_20968
  Gene Ontology: Mol. function=RNA-directed DNA polymerase activity; Cellular component=chromatin; Biological process=chromatin assembly or disassembly
  Pfam annotation: Domain name=zf-H2C2; Domain location=261-301; Score =4.1; E_value=0.1; Accession=PF09337.1; Description=His(2)-Cys(2) zinc finger
MAEDDIPRQHFAPTRVITNRVMPFGLSNAPLMFQGQFYLRLSKCVFVQSQLKYLGHIVSQRGVEPDPSKIQAMVDWPTPSSSKSLRRFRISKPYRILPKIYLSICDHCCPFDQIPPQGQLLLERDASDLAMSAVLMQNHHPIVFFNKPFCPRLQHASTYVHELYAIVVAVRKWCLYLLASVPFKAIGADYTIQYKRGTNNVVAEALSRISNPSEATFFTLSLPNFVVLDQLETTLHACPEFGELMTQIQQYPTTHSDYTIHRDLIFYKGITKTLHRLQAYFFWKTICQHVQQYVAHCTTCQQMKYETK

SEQ ID NO: 137747 - protein, 340 aa, Glycine max
  Coding DNA Sequence Number=SeqID_20969
  Gene Ontology: Mol. function=kinase activity; Cellular component =nucleus; Biological process=carbohydrate metabolic process
  Homolog annotation: Hit_ID=Q84PE0; Match level="QueryCoverage=80%, HitCoverage=54%, E-value=1e-102, Identity=71%"; Hit description=AKIN betagamma
  Pfam annotation: Domain name=CBS; Domain location=192-339; Score =55.3; E_value=2e-13; Accession=PF00571.18; Description=CBS domain
MHFWQHLQRDGYWAYSVPPLEEAVWKHVSTVAYFVWICVHHVLLLAWLGLALFAFASACIVEFLGLLGIHGSNLTEEQLETHTIAAWREAKVQECRTDSNGRTYSQHLVHAGPLECLKDVALKILQNKVATVPIIHSSSEDDSFPQLLHLVSLTEILKCICRHFEHSSDSLPILQLPIGSIPVGTWVSKVGESNKKPLAMLRPNASLGDALSLLIQAEVSSIPIVDTNDSLLDIYSRRDIIALVKDKVYARISLAGFSIHQVLHFSRCTRLALLLGRDARFPYGLRNGPRCHMCLRSDSLHKVMVRLANPGVRRLVVVEAGSRRVEGIISIGDVFRLLLS

SEQ ID NO: 137748 - protein, 135 aa, Glycine max
  Coding DNA Sequence Number=SeqID_20970
  Gene Ontology: Mol. function=kinase activity; Cellular component=AMP -activated protein kinase complex; Biological process=cholesterol homeostasis
  Homolog annotation: Hit_ID=Q84PE0; Match level="QueryCoverage=88%, HitCoverage=24%, E-value=3e-48, Identity=76%"; Hit description=AKIN betagamma
MYLVREPDILPPILSAETPGQSHMEVDNDIFGHVEANPRMSESDLQVSKHRLSIFLSTHTAYELLPQSGKVVALDITLPVKQAFHALYQEGISMAPVWDSNKCQFVGMLSAMDFILILKELSVEVRKNENLPNGK

SEQ ID NO: 137749 - protein, 223 aa, Glycine max
  Coding DNA Sequence Number=SeqID_20971
MEDNGLAQIGECHGERGIVRHDWAKAFEPLDVEDERQNFSEAGIPEMVLRLIWGVEVSLMMATERLCGSNRGDNRSRVAGSSSSSAMRSNIHALQWWPVQWPGEGSWVAQLEPRARAPTTSQRQSNSKGTAEQGRRYAKHGIVHGSWSSKHGTSSLIKGLWLMGMGEGAGEGEEVLRVNNQSKMESILRESSVWLVVRQRTASSRRSVTNFLVLWSAMAGRTS

SEQ ID NO: 137750 - protein, 126 aa, Glycine max
  Coding DNA Sequence Number=SeqID_20972
  Gene Ontology: Mol. function=chromatin binding; Cellular component =chromatin; Biological process=chromatin assembly or disassembly
  Homolog annotation: Hit_ID=Q1SAV4; Match level="QueryCoverage=92%, HitCoverage=37%, E-value=2e-26, Identity=50%"; Hit description =Integrase, catalytic region
  Subcellular localization annotation: CTP_CleavageSite=55; ConfidenceScore=5.21e-01
MENHLERCLSHDSQVVPSGASPSHCTRTSLVGGDVVVSHFQSSSDRGSSKGRLSKASEESGAGLSMRGWILEEAGSCKRNAWRVYGRNQRWNVANKGEGEHTPNLQLKKSHPCTWCLQNASWQLEP

SEQ ID NO: 137751 - protein, 60 aa, Glycine max
  Coding DNA Sequence Number=SeqID_20973
MMLTDAPLLFPPGQLALAALGNSNALHRVIDFDRGKKREKKSKHKSKKSSNEAQNMPSIA

SEQ ID NO: 137752 - protein, 136 aa, Glycine max
  Coding DNA Sequence Number=SeqID_20974
  Subcellular localization annotation: CTP_CleavageSite=16; ConfidenceScore=5.03e-01
MAFLVSSTFTLPLRVRASPLNKNKLFNSNCSWLLISYYINISSLPGSWNTYPNVNHKGKSVEAQKILGTCSSNKRILSMKGSCHRCLMSCTIFLHETYSYNLDVDYCTEIVISGYWVGPDADDGWGFVEAVINQMN

SEQ ID NO: 137753 - protein, 65 aa, Glycine max
  Coding DNA Sequence Number=SeqID_20975
MKLCVTTRFTSLLQAGVSALDRRGESASELSERMRAKVNKSFQTSSGINQTTVPKDNHQEFPRHP

SEQ ID NO: 137754 - protein, 187 aa, Glycine max
  Coding DNA Sequence Number=SeqID_20976
  Gene Ontology: Mol. function=transcription factor activity; Biological process=regulation of transcription, DNA-dependent
  Homolog annotation: Hit_ID=Q89N09; Match level="QueryCoverage=34%, HitCoverage=30%, E-value=5e-13, Identity=51%"; Hit description =Transcriptional regulatory protein
  Pfam annotation: Domain name=TetR_N; Domain location=117-163; Score =76.9; E_value=6.2e-20; Accession=PF00440.13; Description=Bacterial regulatory proteins, tetR family
GRVIRSNTHGAMKWATPVAASTAPANRIRPVAEGSSAAGAIPIWVALDIEMVPLIGIASRTGRERWPAHTIRLACPTRRTELPEVSGAATEAWRYPHYVPEQLSRFERRKQETRREILGAALACFAERGYHATGIADIVRRVGIAQGTFYLYFQSKREIVEQILDDLMERLSAALLDLPPSAPTSLA

SEQ ID NO: 137755 - protein, 325 aa, Glycine max
  Coding DNA Sequence Number=SeqID_20977
  Gene Ontology: Mol. function=nucleic acid binding; Cellular component= chromatin; Biological process=DNA integration
  Homolog annotation: Hit_ID=Q1SHC9; Match level="QueryCoverage=93%, HitCoverage=78%, E-value=5e-58, Identity=35%"; Hit description=Zinc knuckle, putative
MGYQEVAEIVEEDDAHFEKIVGAATSQETWKILEKCNEVAEQLKKVKLQTMRRQYELMQMENNEKIVDFFNRIITHTNAMKNYGEKISNQTIVEKILRTLNPKFDHIVVAIEESKKLEEITVEELQECVAAPSSTDHRGNQSHSDYQAHMAKEENEADSEEKPLMLMMSHNNEIWYINSGCSNHMTGHRDWLVNFDVMKKSKVRFADNKVIQAEGAGNVAVRRLDGRQAMITDVLYVLGMKSNLISMGQLLEKGFSMKMSNGSLKVYDTAKKMIMKAPLARNRTFKVNLNTIEPQCLSAVTMSDDSWLWHLRLGHSNFKDLSLLR

SEQ ID NO: 137756 - protein, 106 aa, Glycine max
  Coding DNA Sequence Number=SeqID_20978
  Gene Ontology: Mol. function=sequence-specific DNA binding; Cellular component=intracellular; Biological process=regulation of transcription, DNA-dependent
  Homolog annotation: Hit_ID=Q1RSJ9; Match level="QueryCoverage=77%, HitCoverage=65%, E-value=1e-36, Identity=89%"; Hit description =Transcription factor CBF/NF-Y/archaeal histone
  Pfam annotation: Domain name=CBFD_NFYB_HMF; Domain location=8-73; Score=117.0; E_value=5.4e-32; Accession=PF00808.13; Description =Histone-like transcription factor (CBFNF-Y) and archaeal histone
  Pfam annotation: Domain name=Histone; Domain location=2-76; Score =3.8; E_value=0.053; Accession=PF00125.14; Description=Core histone H2AH2BH3H4
  Pfam module annotation: Pfam domain module=CBFD_NFYB_HMF::Histone; Domain location=8-73::2-76
MDQDVQDRALPIANVGRIMKQILPPSAKISKEGKQLMQECVTEFISFVTGEASDKCHKENRKTVNGDDICWALSSLGFDNYAEAIGSLCVFPMKIEQVDDKKNEHF

SEQ ID NO: 137757 - protein, 526 aa, Glycine max
  Coding DNA Sequence Number=SeqID_20979
  Gene Ontology: Mol. function=DNA binding
  Homolog annotation: Hit_ID=Q1SBB0; Match level="QueryCoverage=93%, HitCoverage=95%, E-value=2e-77, Identity=35%"; Hit description =Homeodomain-like
MEHESNRQLIPPSSPDKSNIVGAPRSNPRIGFEYQVEVPSMIKESKRLKLLMNTVDSELVHNEVEDNVANLNNSWSDADVKSFLLGHKNFSGRKQHELLSCLTHHVLEQFKDALQQVSKSYSEGRISLEEYITSLKSTVALGVLVEAVGSCLGRLLARGWHSEKLKNQGSLSSKNFVAFLFPGVKKFSRRKLVKGDHCFDSVSDVLSKVVAEPNLLKLEVVETKVGGSNEEDAETGSNKDGQPDNHHHRYLKHRASTNNGDHMKSAIFYTDLVHRGKSSNLRELKSLPGNSVGKVEVDADDIAYNKGNKHISKTKHRKGKLDDISPSGTETAKIYSKKNSSNADCQKAKHNRDATGQKEVNANPDDANKMTENQNHRESIQSKSKISHQQDVTLISSSAEVSVELKKEGKNFNRVCLDKGISCDKVDKYESQHSINFNAPQVPLKFEDGEMMAKAEKDEQGLKPNDTIPRRKSTRNRPLTVRALESFANEFLHAQRKQKRKDILILKDPFNACSRKARTKGLKNVA

SEQ ID NO: 137758 - protein, 115 aa, Glycine max
  Coding DNA Sequence Number=SeqID_20980
DRARKTPSGPGEVQQGLGVSISDYGPLSVLQSACRPYQGRRRARHHSSLGWPAVGNRRTAATSKAPQLIYKSWSVAYDSWSTNRRPTPKPNVSKSARSVTDKSSRVQLKTLKKRY

SEQ ID NO: 137759 - protein, 68 aa, Glycine max
  Coding DNA Sequence Number=SeqID_20981
MRLPGKESLLMKSPITINEILDVSILFLNDHLEETLGSTKIEEIHSKCINLAQCGARKKVASARDFGW

SEQ ID NO: 137760 - protein, 199 aa, Glycine max
  Coding DNA Sequence Number=SeqID_20982
MHHQFFKLSSLNQPSFSKFIAFKHCFICQTVLVDLMLACMVFPALGHVSGPQLWDPHDFDFGKNFGMDPAGLAFTSSLAFDSNPIRPLSNWMQTQHHHPFSPMVSVSSGTSSTTMPHSSVEQPSNQNYSGSYVSKRQEEKMIGIKRPNPFSLATSPVSSSNFKPLTFATTMKASETIPCGSGRGFNLDFGNSTLRLVQI

SEQ ID NO: 137761 - protein, 66 aa, Glycine max
  Coding DNA Sequence Number=SeqID_20983
MTLMEVTSGGGRCWWVLKWRMKEKLWMLCVGGEKKNESSTWPRTYVLLDMQGDKCSLSCKMTLGRT

SEQ ID NO: 137762 - protein, 53 aa, Glycine max
  Coding DNA Sequence Number=SeqID_20984
LSLLRLLRRQGLTDTYVSPLTAQITLNVVGEEEVDDVHANRNDHDEGELINIV

SEQ ID NO: 137763 - protein, 50 aa, Glycine max
  Coding DNA Sequence Number=SeqID_20985
MDNDKVFDLMLRLLLFKSYNRMHFARYTELKTNTNYAMNNEHFTNKQPLN

SEQ ID NO: 137764 - protein, 224 aa, Glycine max
  Coding DNA Sequence Number=SeqID_20986
  Gene Ontology: Mol. function=phosphoric monoester hydrolase activity; Cellular component=integral to membrane; Biological process=metabolic process
  Homolog annotation: Hit_ID=Q9XGY7; Match level="QueryCoverage=97%, HitCoverage=45%, E-value=8e-73, Identity=61%"; Hit description=Acyl CoA reductase
  Pfam annotation: Domain name=NAD_binding_4; Domain location=17-213; Score=132.2; E_value=1.4e-36; Accession=PF07993.2; Description=Male sterility protein
MELGSILHFLQDKSILITGATGFLAKVLLEKILRVQPNVKKLYLLLRTEDAKSATHRLHNEIIGKDLFRVLKEKLGANFNSFVSKKLTLVPGDISREDLGLEDSILREEIYDQTDVIINLAATTNFDERYDISLGLNTFGVKYVINFAKKCTKLKVLVHVSTAYVCGEGGREGLILEKPYHLGDSLNGVSGLDINAEEKVVRDKLKKEIKEVMKELGISRFVKI

SEQ ID NO: 137765 - protein, 176 aa, Glycine max
  Coding DNA Sequence Number=SeqID_20987
MRSDCLVQFSILNPFTEPMNCVFVHVSTTHEFGAMRSDCLVQFSILNPFSEPMNCVFVHVSSTHEFGAMRSDCLVQFSILNPFSEPMNCVFVHVSSTHEFGAMRSDCLVQFSILNPFSEPMNCIFFHVSSTHEFGAMRSDCLVQFPILNPFSELHELHFRSCILHPKSLELCFMID

SEQ ID NO: 137766 - protein, 246 aa, Glycine max
  Coding DNA Sequence Number=SeqID_20988
  Subcellular localization annotation: CTP_CleavageSite=41; ConfidenceScore=5.05e-01
MSRRSGDLGDVRWGAIAQNQAWLIPTQPRHSQSVRTCDVPKQASSWQSTNKRTKSTKQGSLCGGWPAMYLGWGDKTLVIDYQLGVIDYTVLPATGNRLPFMCNRLHSIVMAAQLIHDRVVMECLEGVWETLEGNERCRFRGTIRLTATSLVHPEEPARTLQQPVEWILPTPTPYRLVEPVQVIEVSSSEEDLEEDPEELPPEPAMDTLDLPEDDEDPLPDVDSLEDIMSASEADSTEESGPWRDNE

SEQ ID NO: 137767 - protein, 178 aa, Glycine max
  Coding DNA Sequence Number=SeqID_20989
  Homolog annotation: Hit_ID=Q1SP02; Match level="QueryCoverage=77%, HitCoverage=38%, E-value=4e-11, Identity=28%"; Hit description=IMP dehydrogenase/GMP reductase
AYMKGITGAPYRARCDALTVTDVSWLPYTEHRGVRAFEEISSFQGQLRWGPMVVTARPERVVRQFGYIQSIPPPPVSVDYMEWFFRISHPFMIPTQAGDQPRDAPAADPEDYIQLPSPQDDYDGYEAIAQRLERVLNLRMVTAATKLYEIMQDCLTIARGGASADGSVRARQRRRTEH

SEQ ID NO: 137768 - protein, 103 aa, Glycine max
  Coding DNA Sequence Number=SeqID_20990
MGDRLEDMIRDLGQESFQQAHAPMYEGLQSDSMKPFYTGCKNSLTLLSAVLSLVNVKARYGWSDKSFTSLLEILCPMDFGNEPRNLRLVVASDGMNPYGTLST

SEQ ID NO: 137769 - protein, 165 aa, Glycine max
  Coding DNA Sequence Number=SeqID_20991
SITRTIRYLYSTNNSRWRQELNPYNQYEKERAFDLESVFAEFMAYHASSKANHDSIQNQEIQFGKSYFLENYQGEPELQLCYQNEAERGSNLDTLLIQVKDTIGSIQRAFRSAKIQVGKLVEEVTQVMGRREEECVEVEAQEGSPVNEHDLEEDEEKVQQREQCS

SEQ ID NO: 137770 - protein, 173 aa, Glycine max
  Coding DNA Sequence Number=SeqID_20992
MAEMRKLDHLEERLRAIEGGEDYAFANLKELFLVLNIITPPKFKGIRKDEELLIHFFQESLTGVAVTWYTNLEPSRVHTWKDLMVAFVRQYQYYSDMVPDRMQLQNMCKKGDDDRDGKFSHPSWTNEKTGANEEGQKEGETHAVTAIPIWPSFPPTQQCHYSVNNKPPPYPPP

SEQ ID NO: 137771 - protein, 142 aa, Glycine max
  Coding DNA Sequence Number=SeqID_20993
MASTTCLFPHLLFTMLQDCYCLTVGIVDEIIIDAPWSYDSCPNCTTTFDPSKGGSACRSCHTSVIDTIPRIEHNGDKGNFLLWDATCIKLFGKTAGECRDELIAAGDDIKVFPMCVDEILSKTWAVKFKFHSQLRQSFFFWM

SEQ ID NO: 137772 - protein, 114 aa, Glycine max
  Coding DNA Sequence Number=SeqID_20994
MEHFLEQVAWPEAQLPLVRPNEAAPPEPTPVQVDPELADPQSPVVNPLSSPECEVVPPSPPLIIIFNASSDEAVAPPDSSAGEIADLPTSPVGGIFDLSDSSSGEVVALTDSPV

SEQ ID NO: 137773 - protein, 152 aa, Glycine max
  Coding DNA Sequence Number=SeqID_20995
METTKSTQRALQSVKIQVGELAEAVTQFMSRQEKYFVEIEAQDKIPIKEHESREKDEEKDEEQAQQQREKYSTIENQQENILQINNLPHQMIVKKGRQGEHEEIATAILSLITNTFLEIIGNVLLDYMKFMEFLAKRRNFKEDVFYVTFMSP

SEQ ID NO: 137774 - protein, 93 aa, Glycine max
  Coding DNA Sequence Number=SeqID_20996
MVSMDNTTFFSRNLGHNGLLVFQLSTPPEHSDYHGFHRKQRALYVETKTFQHADVEVVFDMNIRFSIRVDGSGVCGDGGGGKGNVFPGVRHGE

SEQ ID NO: 137775 - protein, 602 aa, Glycine max
  Coding DNA Sequence Number=SeqID_20997
  Gene Ontology: Mol. function=ATPase activity, coupled to transmembrane movement of substances; Cellular component=integral to membrane; Biological process=transport
  Homolog annotation: Hit_ID=Q42093; Match level="QueryCoverage=99%, HitCoverage=62%, E-value=0.0, Identity=52%"; Hit description =Multidrug resistance-associated protein 2
  Pfam annotation: Domain name=ABC_tran; Domain location=274-457; Score= 154.1; E_value=3.5e-43; Accession=PF00005.17; Description=ABC transporter
  Pfam annotation: Domain name=MMR_HSR1; Domain location=275-364; Score= -19.7; E_value=0.064; Accession=PF01926.13; Description=GTPase of unknown function
  Pfam module annotation: Pfam domain module=ABC_tran::MMR_HSR1; Domain location=274-457::275-364
MLDKILQAPMVFFQTNPVGRIINRFAKDTGDIDTNVFNLVNMFLGQVWQLLSIFVLIGTVSTISLWAIMPLLIFFYAAYLYYQSTAREVKRMDSITRSPVYAHFGESLNGLSSICAYKAYDRMAHINGKFMDNNIRFTLVNISSNLWLTIRLETLGGLMIWLIATSAVLQNARAANQAMFASTMGLLLSYTLNITNLLSGVLRQASRAENSLNSVERVDTYINLETEAPGVIETNRPPPGWPTSGSIEFEDVVLRYRPELPPVLHGLSFTVPPTEKIGVVGRTGAGKSSMLNALFRIVELQKGKIIIDGCDISTFGLEDVRKVLTIIPQSPVLFSGTVRFNLDPFNEHNDADLWQALERAHLKDVIRRNPFGLDAQVSEGGDNFSVGQRQLLSLARALLRRSKVLVLDEATAAVEVRTDALIQKTIRQEFQSCTMLIIAHRLNTIIDCNRILLLNAGRVLEYSSPEELLQNEGTAFYKMVQSTGPENAQYLCSLVFGKTENNSNEYNKELENHVRQLASSRWTAATQFAIVATLSSLSHHLQKPSSEDNKDILDKTKDAIITLQEVLVGKHDEDIEETLYKYHIPTDRWWSTLCKVIEGKHT

SEQ ID NO: 137776 - protein, 92 aa, Glycine max
  Coding DNA Sequence Number=SeqID_20998
MERYKKYEIKKVVWDVPTVRTLKLIKWRSNDNIVELDIRSGARVPDRCRSIPSAAKPNNDKGRTILVGRVVEESILRSWMTTNWYLENDQKV

SEQ ID NO: 137777 - protein, 74 aa, Glycine max
  Coding DNA Sequence Number=SeqID_20999
APRFRNSVVLKYSDESDLINAMLDMIPDSEPCCKIENSILESTDPTMLESQSLSITAEHDRSMLGSSEPTKFES

SEQ ID NO: 137778 - protein, 134 aa, Glycine max
  Coding DNA Sequence Number=SeqID_21000
  Gene Ontology: Mol. function=transferase activity, transferring glycosyl groups; Cellular component=chloroplast; Biological process =glucan biosynthetic process
  Homolog annotation: Hit_ID=Q75T80; Match level="QueryCoverage=99%, HitCoverage=26%, E-value=1e-50, Identity=71%"; Hit description =Starch synthase I precursor
MELMPLNGTRHAKCKILLQKELGLPVRPDYPMKGIDLIRLAMLELMEDGVQFVMLGLGNSIYEDWMSATKSAYKDKFRGWVGFNVPISHKITARLNQLYAMRYGTIPVVHETEGLRDTVHNLNPYTEESKAEST

SEQ ID NO: 137779 - protein, 740 aa, Glycine max
  Coding DNA Sequence Number=SeqID_21001
  Gene Ontology: Mol. function=RNA-directed DNA polymerase activity; Cellular component=nucleus; Biological process=RNA-dependent DNA replication
MEVDEAPWVGSKFTWVRPNGTTRSKLDRFLISLEWRTKWPGTAQYTLERNFSDHYPILLRSKYADWGPKPFRILDCWLSDKSFKKIVIKTWTSNQQRGWGGYVLKEKINALKVKIREWNKEHYGDTFEKQKARSRWIKEGDCNSRYFHLMINARRRNNCLKGLMIDGSWSEEPTIVKEAVRVFFAQRFQELDQDRPTLEDEVKRAVWDCRSDKSPGPDGLNFKFIKQLWPSIKPDFLRFLDEFHVNGLFPKCSNASFIALIPKVIDPQMLNEYKSISLIGCIYKIVAKILANRLKKAVEEAKRYQKPCIIFKVDYEKAYDSVSWKFLTYMMERMGFFPKWIQWMEGCLKLASISVLVNGSPSAEFLPQKGLRQGDPLSPLLFNIVVEALNGIMSQAMAKGLFRGFLIGDNKVEISVIQNADDTIFFGEATMDNVIAIKEMLRTFELVSGLKINFAKSGFGAFGVPEQWILDAANYLNCSLMSFPFTYLGVPIGANPRRYQTWDPIITKVPKKVVDKLVSLQRNFLWGGDSEQHKIAWVKWETVCLPIEAGGLGVKDINAFNISLIGKWHWNLFQHQGELWARVLESKYGGWRSLSGASTISAESIWWRDLKRMMESWRGVITRLGIGFQVEETIIYSAWGLSKIQVGNGISGGGDHCSIVEPSGQYSVKYAYQALTENIAAEDLDGALKELWKLNLPSKIDDTPGMVGIAVLGKFGGCFSSESKATLSPTYSWNDRGHEG

SEQ ID NO: 137780 - protein, 255 aa, Glycine max
  Coding DNA Sequence Number=SeqID_21002
  Homolog annotation: Hit_ID=Q3HRZ1; Match level="QueryCoverage=40%, HitCoverage=26%, E-value=3e-15, Identity=44%"; Hit description =Vacuolar protein sorting-associated protein 26-like protein
  Pfam annotation: Domain name=Vps26; Domain location=1-214; Score= -165.5; E_value=0.04; Accession=PF03643.6; Description=Vacuolar protein sorting-associated protein 26
MVPTLAAFVCVENQEFNVHIKKENGQMVMVPLYQSQENIVGEVIIEPSNGKKVKHNGVKIELLGRIGLFSVNAIAIVTDGLMSCILIEATAMTLLLLFSTPCNLCAIRELDVPGNLHERKTSDTAVAARGWLQGPVPPREKEQGRRTKKRQESVILIDLLQTSAIQQIPTASSAPSSSEIIFEFLFLLCYHLPAALGESPCPQGDDLVLADPNPPKTFHPKTVLAIELILPMEHPGQRMNDGSPEWLRETVKVDR

SEQ ID NO: 137781 - protein, 499 aa, Glycine max
  Coding DNA Sequence Number=SeqID_21003
  Gene Ontology: Mol. function=DNA binding; Cellular component=beta -galactosidase complex; Biological process=DNA integration
  Homolog annotation: Hit_ID=Q1SD84; Match level="QueryCoverage=54%, HitCoverage=31%, E-value=3e-47, Identity=51%"; Hit description =Integrase, catalytic region
MGVQIATRPTGALQKIPPEARLLLLEEATLLAWASWLRKISSLKKIQAEALPQRFRNVSESNYAKILDRSSRFIVRSSFSSVFNGLIDCDLILKEKVYMRRNKEIEDAQTLQHNHESESRENLISGTGMTWASLGRLASLLRVCGFTKIMKRRRFEAELLPYSRLRAVLKLSYSPHLVSLFEFCFESPHSYRHRWPLVAVLVVAGPLSSIVITASLVFTCTLSFASRHDAKEALNAPKWKEAILKKMRALEKNHTWSVMPLLTGKNIGFTQTYGIDYSKTFALVAKLNTIRILLSLAANLDWPLHQLDVKNAFLNGDLEEEPPRAWFEKFAQSVYVDNIILIGDDELELARLKKNLAAKFEIKDLGSLRYFLGMEIPLWIPMGNFGKKLVFLLMLEDTKVQKLNLKQWPKGFVKDCGFIVLEELKMTIELPLKFYYDKKATISIAHNPVQHDRTKHIEIDCHFIKEKLDTEIICLPFVPSNQQTTGILTKSLTRPIFEH

SEQ ID NO: 137782 - protein, 923 aa, Glycine max
  Coding DNA Sequence Number=SeqID_21004
  Gene Ontology: Mol. function=RNA-directed DNA polymerase activity; Cellular component=chromatin; Biological process=chromatin assembly or disassembly
  Pfam annotation: Domain name=RVP_2; Domain location=141-253; Score= -34.3; E_value=0.00047; Accession=PF08284.2; Description=Retroviral aspartyl protease
  Pfam annotation: Domain name=rve; Domain location=710-840; Score =20.0; E_value=0.00013; Accession=PF00665.16; Description=Integrase core domain
  Pfam annotation: Domain name=zf-CCHC; Domain location=77-94; Score =7.1; E_value=0.067; Accession=PF00098.13; Description=Zinc knuckle
  Pfam module annotation: Pfam domain module=RVP_2::RVT_1::rve::zf -CCHC; Domain location=141-253::311-486::710-840::77-94
MVQATGLARLQEEKFLDHRQPLRPRPPPPNPSPSPLRAIPTIPVPSLPPLLPPPPRSNPLTLKCLSPEEIILHRKRGLCFNCEEKFHRGHKCASRVFLLITDETEPVSPHIAIPDPPENPPPDPLDSPNLYLAQISLNSLVGHIAPETLRLVDSLAGQQLVLLFDGGSTHNFIQQQLVTQLGLSCRETNPLWVMVGNGQYLECHCICEDIAINIQDLTFTIDLYVSPISGANVVLGVQWLKSLGLVLTDYTAQNIQFIYEGRLGPGLYFHITVLIEDNPPSRMEDLPLVLRTLLTKFGALFRPHHAMPPARDTNHHIHLLPQSTPVNMRPYRYPHFQKREIELQIDSMLQKVLIQPSTSPFSLLCFSKLDLLQGYHQIRMHSEDIPKTAFRTHHGHYEFKVIPFGLCNAPLSFRATMNLIFRPYLRHFVIVFFDDILIYSGSLNDHLCHLEMTFQVEYLGHLVSPRGVEPVASKVADCLVVAGAPIHESLEEFFGPAFEQLNQALSTTPILALPNFQLPFTIETDASGIGMGAVLSQQGHSIAYFSKPFSTKLLRASILKELLTQVIQTPEQHMYLARLMGYDYTIQYRSGAHNQAADALSRLPEHTYSLSMILFVPCLTFLEELRQKLRYHPQYNKQHQDIVCSPETHPNFTIANDLILKKGRIWLPRDLPIISSLLEEYHATPIGGHMGVAKMIARLSENFQWPGLRDDIAKFEGLSLDFITGLPPYQGKIVIVDRFSKGIHLGILLLAHTAHMVASLFVDIIIKLHGIPRSLVSNKDPLFISRFWQELFKLSGTRLRMSSAYHPQSDAWGKLLPWVEWSHNTSWNMGIGSTPYEITFVRKPFNFPEYLLGSLNIDVIDNMLNNMDEVFHSIRKKLVKAQAIMNHNADAVSDKLAKHFYGPFQILDRVGTVAYRLKLPEGA

SEQ ID NO: 137783 - protein, 110 aa, Glycine max
  Coding DNA Sequence Number=SeqID_21005
MQGQVEVAATAVAWEGMASSKRSEDPEALSESGMTKVDIVVAAGGWLRGPVPPREKGQGRRTEKKQESVILIDLLGTNLNGYNRIITASQLFEQKLLMVENSKLLVPCMA

SEQ ID NO: 137784 - protein, 200 aa, Glycine max
  Coding DNA Sequence Number=SeqID_21006
  Gene Ontology: Mol. function=nucleoside-triphosphatase activity; Cellular component=membrane; Biological process=DNA replication
  Homolog annotation: Hit_ID=Q9CAM7; Match level="QueryCoverage=64%, HitCoverage=36%, E-value=6e-39, Identity=71%"; Hit description =Replication factor, putative; 74998-73295
MAKKLAKNMPFEITSDEPLKCMSLSSSSNGYDVPWVEKYRPSKVAIIVSYEDAVSRLQVIARDNNMPNLILSGPPGTDKPTSILALTHELLEGPNCKEAFSILDDFLLIYPFTFGYRGIDVVRNKIKMFAQKKVTLSLGRHKIVILDEADSNLGLPPEWYRALGWVFPTWARTHSLDTGEAVNFLKGVVVIADRIVTVSK

SEQ ID NO: 137785 - protein, 163 aa, Glycine max
  Coding DNA Sequence Number=SeqID_21007
  Gene Ontology: Mol. function=transferase activity; Cellular component= intracellular; Biological process=translation
MATPLAVAKEEEWYIVIVKKKCTTTIHILAYGSPADSVDEYVRIGETTAVECLERFVLGICTIFGNEYLRRPNNEDIKRLLQMGAAHGFPGMLGSIGCMHWEWKNCPVAWKGQFCRDDHRNPTIILEAVASQDLWIWHAFFGTAGSNNDITVLNGSNVFDEVL

SEQ ID NO: 137786 - protein, 77 aa, Glycine max
  Coding DNA Sequence Number=SeqID_21008
MRQFGYTQTIPAPPVDSWVSYDDIHNRWMHYLDHMVLAGEVCAVPAPSRPSGPTDKYPSRAGARSTVNICEARFGGA

SEQ ID NO: 137787 - protein, 240 aa, Glycine max
  Coding DNA Sequence Number=SeqID_21009
  Gene Ontology: Mol. function=DNA polymerase processivity factor activity; Cellular component=PCNA complex; Biological process =regulation of DNA replication
  Homolog annotation: Hit_ID=P22177; Match level="QueryCoverage=55%, HitCoverage=67%, E-value=1e-39, Identity=61%"; Hit description =Proliferating cell nuclear antigen
  Pfam annotation: Domain name=PCNA_C; Domain location=76-178; Score =61.3; E_value=3.1e-15; Accession=PF02747.6; Description =Proliferating cell nuclear antigen, C-terminal domain
MDEGEEGYGESGDEGFLGEEEDDDYEDLYNNVNFDEGFPNFKILGVAFIKEVFAYSEDKISDFEMKLMDIDSEHLGILEVYHAMPLLKSHPLSLLGFARISIVLVTLGVKFSTKGDIGTTNIVCRQNTSEDKLEEATVIEMNEQLSNTITISMPNELSIVVEYKIAKIGYVWFYLAPKIEEDEEDTKPKFNLPIRCWVMGIVEGENEEGIGVGVGLGALQRDHGDHNHERGGAEQQDRRA

SEQ ID NO: 137788 - protein, 104 aa, Glycine max
  Coding DNA Sequence Number=SeqID_21010
  Subcellular localization annotation: CTP_CleavageSite=56; ConfidenceScore=5.05e-01
MVINILNSGVNSSGGGARKRWHRIAKATLQGKRSDRTRWSIGPRVTHPARAILMAVAGNLGEGTNSLDMPTLLLSGLSEGLRGLECFQLVQSCNPDNGTRNDRR

SEQ ID NO: 137789 - protein, 1184 aa, Glycine max
  Coding DNA Sequence Number=SeqID_21011
  Gene Ontology: Mol. function=protein serine/threonine kinase activity; Cellular component=integral to membrane; Biological process=protein amino acid phosphorylation
  Homolog annotation: Hit_ID=Q76FZ8; Match level="QueryCoverage=97%, HitCoverage=96%, E-value=0.0, Identity=73%"; Hit description =Brassinosteroid receptor
  Pfam annotation: Domain name=LRRNT_2; Domain location=23-61; Score =38.0; E_value=3.2e-08; Accession=PF08263.3; Description=Leucine rich repeat N-terminal domain
  Pfam annotation: Domain name=LRR_1; Domain location=121-142; Score =11.7; E_value=1.9; Accession=PF00560.23; Description=Leucine Rich Repeat
  Pfam annotation: Domain name=LRR_1; Domain location=147-163; Score =6.5; E_value=17; Accession=PF00560.23; Description=Leucine Rich Repeat
  Pfam annotation: Domain name=LRR_1; Domain location=168-191; Score =2.0; E_value=1.2e+02; Accession=PF00560.23; Description=Leucine Rich Repeat
  Pfam annotation: Domain name=LRR_1; Domain location=214-235; Score =12.8; E_value=1.1; Accession=PF00560.23; Description=Leucine Rich Repeat
  Pfam annotation: Domain name=LRR_1; Domain location=237-259; Score =9.4; E_value=5; Accession=PF00560.23; Description=Leucine Rich Repeat
  Pfam annotation: Domain name=LRR_1; Domain location=261-282; Score =9.0; E_value=5.8; Accession=PF00560.23; Description=Leucine Rich Repeat
  Pfam annotation: Domain name=LRR_1; Domain location=283-305; Score =7.6; E_value=11; Accession=PF00560.23; Description=Leucine Rich Repeat
  Pfam annotation: Domain name=LRR_1; Domain location=308-330; Score =13.6; E_value=0.74; Accession=PF00560.23; Description=Leucine Rich Repeat
  Pfam annotation: Domain name=LRR_1; Domain location=332-355; Score =9.3; E_value=5.2; Accession=PF00560.23; Description=Leucine Rich Repeat
  Pfam annotation: Domain name=LRR_1; Domain location=357-379; Score =6.5; E_value=17; Accession=PF00560.23; Description=Leucine Rich Repeat
  Pfam annotation: Domain name=LRR_1; Domain location=381-400; Score =15.4; E_value=0.21; Accession=PF00560.23; Description=Leucine Rich Repeat
  Pfam annotation: Domain name=LRR_1; Domain location=410-432; Score =12.0; E_value=1.7; Accession=PF00560.23; Description=Leucine Rich Repeat
  Pfam annotation: Domain name=LRR_1; Domain location=434-456; Score =18.1; E_value=0.032; Accession=PF00560.23; Description=Leucine Rich Repeat
  Pfam annotation: Domain name=LRR_1; Domain location=458-480; Score =4.9; E_value=35; Accession=PF00560.23; Description=Leucine Rich Repeat
  Pfam annotation: Domain name=LRR_1; Domain location=482-504; Score =14.6; E_value=0.35; Accession=PF00560.23; Description=Leucine Rich Repeat
  Pfam annotation: Domain name=LRR_1; Domain location=506-528; Score =15.7; E_value=0.17; Accession=PF00560.23; Description=Leucine Rich Repeat
  Pfam annotation: Domain name=LRR_1; Domain location=530-552; Score =16.4; E_value=0.1; Accession=PF00560.23; Description=Leucine Rich Repeat
  Pfam annotation: Domain name=LRR_1; Domain location=554-577; Score =13.2; E_value=0.95; Accession=PF00560.23; Description=Leucine Rich Repeat
  Pfam annotation: Domain name=LRR_1; Domain location=646-668; Score =13.4; E_value=0.85; Accession=PF00560.23; Description=Leucine Rich Repeat
  Pfam annotation: Domain name=LRR_1; Domain location=65-86; Score=3.9; E_value=53; Accession=PF00560.23; Description=Leucine Rich Repeat
  Pfam annotation: Domain name=LRR_1; Domain location=670-692; Score =13.5; E_value=0.75; Accession=PF00560.23; Description=Leucine Rich Repeat
  Pfam annotation: Domain name=LRR_1; Domain location=694-716; Score =18.0; E_value=0.034; Accession=PF00560.23; Description=Leucine Rich Repeat
  Pfam annotation: Domain name=LRR_1; Domain location=718-739; Score =10.9; E_value=2.6; Accession=PF00560.23; Description=Leucine Rich Repeat
  Pfam annotation: Domain name=LRR_1; Domain location=92-116; Score =7.4; E_value=12; Accession=PF00560.23; Description=Leucine Rich Repeat
  Pfam annotation: Domain name=Pkinase; Domain location=871-1143; Score= 151.7; E_value=1.9e-42; Accession=PF00069.15; Description=Protein kinase domain
  Pfam annotation: Domain name=Pkinase_Tyr; Domain location=871-1143; Score=120.7; E_value=4e-33; Accession=PF07714.7; Description=Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=Pkinase::Pkinase_Tyr; Domain location=23-61::121-142::147-163::168-191::214-235::237 -259::261-282::283-305::308-330::332-355::357-379::381-400::410 -432::434-456::458-480::...
  Pfam module annotation: Domain location=482-504::506-528::530 -552::554-577::646-668::65-86::670-692::694-716::718-739::92-116::871- 1143::871-1143
  Subcellular localization annotation: CTP_CleavageSite=99; ConfidenceScore=5.64e-01
MKALYRSSLLLLFFLSVCSASSSSVPTLQLLSFKNSLPNPTLLPNWLPNQSPCSFTGITCNDTQHLTSIDLSGVPLTTNLTVIATFLLTLDNLQSLSLKSTNLSGPAAMPPPLSHSKCASTLTSLDLSQNALSGSLNDMSFLSSCSNLQSLNLSSNLLEFDSSHWKLHLLVADFSYNKISGPGILPWLLNPEIEHLALKGNKVTGETDFSGSNSLQFLDLSSNNFSVTLPTFGECSSLEYLDLSANKYFGDIARTLSPCKNLVYLNFSSNQFSGPVPSLPSGSLQFVYLASNHFHGQIPLPLADLCSTLLQLDLSSNNLSGALPEAFGACTSLQSFDISSNLFAGALPMDVLTQMKSLKELAVAFNAFLGPLPESLTKLSTLESLDLSSNNFSGSIPTTLCGGDAGNNNILKELYLQNNRFTGFIPPTLSNCSNLVALDLSFNFLTGTIPPSLGSLSKLKDLIIWLNQLHGEIPQELMYLKSLENLILDFNDLTGNIPSGLVNCTKLNWISLSNNRLSGEIPRWIGKLSNLAILKLSNNSFSGRIPPELGDCTSLIWLDLNTNMLTGPIPPELFKQSGKIAVNFISGKTYVYIKNDGSKECHGAGNLLEFAGISQQQLNRISTRNPCNFTRVYGGKLQPTFNHNGSMIFLDISHNMLSGSIPKEIGAMYYLYILNLGHNNVSGSIPQELGKMKNLNILDLSSNRLEGQIPQSLTGLSLLTEIDLSNNLLTGTIPESGQFDTFPAARFQNNSGLCGVPLGPCGSDPANNGNAQHMKSHRRQASLVGSVAMGLLFSLFCVFGLIIIAIETRKRRKKKEAALEAYADGNLHSGPANVSWKHTSTREALSINLATFKRPLRRLTFADLLDATNGFHNDSLIGSGGFGDVYKAQLKDGSVVAIKKLIHVSGQGDREFTAEMETIGKIKHRNLVPLLGYCKVGEERLLVYEYMKYGSLEDVLHDPKKAGIKLNWSIRRKIAIGAARGLSFLHHNCSPHIIHRDMKSSNVLLDENLEARVSDFGMARHMSAMDTHLSVSTLAGTPGYVPPEYYESFRCSTKGDVYSYGVVLLELLTGKRPTDSADFGDNNLVGWVKQHAKLKISDIFDPELMKEDPNLEMELLQHLKIAVSCLDDRHWRRPTMIQVLTMFKEIQAGSGIDSQSTIANEDDSFNAVEMVEMSIKETPELSKH

SEQ ID NO: 137790 - protein, 584 aa, Glycine max
  Coding DNA Sequence Number=SeqID_21012
  Gene Ontology: Mol. function=triacylglycerol lipase activity; Biological process=lipid metabolic process
  Homolog annotation: Hit_ID=Q8L570; Match level="QueryCoverage=83%, HitCoverage=82%, E-value=1e-127, Identity=46%"; Hit description =Lipase class 3-like protein
  Pfam annotation: Domain name=Lipase3_N; Domain location=36-117; Score= 69.0; E_value=1.5e-17; Accession=PF03893.7; Description=Lipase 3 N -terminal region
  Pfam annotation: Domain name=Lipase_3; Domain location=170-285; Score= 39.5; E_value=1.1e-08; Accession=PF01764.16; Description=Lipase (class 3)
  Pfam module annotation: Pfam domain module=Lipase3_N::Lipase_3; Domain location=36-117::170-285
  Subcellular localization annotation: CTP_CleavageSite=45; ConfidenceScore=5.03e-01
MTAGAVATAAGAAVMLYLVFRRRRKAEKEWSRSRTTWRLKPAQAPANMLESIATLSETLRFTYSETIGKWPIADLAFGINYLMRKQGDLAVASVYGGSSCVELKGPGVVDELQELLRLLTLCMLFSKKPFPEFLDSAGFSLDHVLLHNPEAGLLKPAFTIIHDTQSKCFLLLIRGTHSIKDTLTAATGTVVPFHHSILNDGGISNLVLGYAHCGMVAAARWIAKLCTPTLLKALNKCPDSEVKIVGHSLGGAACMTWELGESGKHFITTIINGYDLVPTLSASSVDDLRSEVAASSWMSDLWDQAEHTKVLKAVHNSATALGSHLQFISSAKDKVAGVGAILRPVTSGTQVVMKHAQSVVEAVVKTMASHRQNIGPLPKSKLNNLAESSLEPKNISKSLLTESVPVLNKDEPNYSSGRSGLDAIDEEEQLIDANEHITSSVVNDITEGELWYELEKELEKQNNILNIRAQVEEAAAAKEITEEENQLIDAAQGTSNSITASDKVDSYRFYPPGKIMHIVSTPSSDDFSSSSIEEHVLARPAVSKRSLTNRLSPPDRTVRFSAAEFVLHSTFHSVPLSVGVWDAL

SEQ ID NO: 137791 - protein, 171 aa, Glycine max
  Coding DNA Sequence Number=SeqID_21013
  Subcellular localization annotation: CTP_CleavageSite=49; ConfidenceScore=5.07e-01
MVNTLPSLDLTHHSDFDALASSPSAATVPSSPVVPESLDGKPFTNPAVLCASYTDEEFFKFRCNSIQAYILLENIVDYAKTLNCQGREKYFQQFGEYKIHKIWRDGVLPCPVYLGHCVLAAKSLGDEVHNNFLDHTFLADRKTTIHQYFEKVSTCILEEEPPESLKTRYGG

SEQ ID NO: 137792 - protein, 247 aa, Glycine max
  Coding DNA Sequence Number=SeqID_21014
  Gene Ontology: Mol. function=nucleic acid binding; Cellular component= mitochondrion
  Homolog annotation: Hit_ID=Q10HP1; Match level="QueryCoverage=76%, HitCoverage=82%, E-value=1e-66, Identity=67%"; Hit description=DAG protein, chloroplast, putative, expressed
  Subcellular localization annotation: CTP_CleavageSite=52; ConfidenceScore=5.34e-01
MAYLNARRTLAYRLAGALSSSSASASRCRFALALHHAKQTVPIPHPASFAVRTQSSGSGYSPLNDPSPNWSNRPPKETILLDGCDYEHWLIVMEFPDNPKPSEDHMVNSYVKTLAQVLGSEEEAKKKIYSVSTSTYTGFGALISEELSYKVKELPGVLWVLPDSYLDVPNKDYGGDLFVDGKVIPRPQYRYSDRQPSRSRPRPRHDRQRQTMQVERRDQQNWNQGPGGSMQPSTAMNSQNFVSGGEY

SEQ ID NO: 137793 - protein, 98 aa, Glycine max
  Coding DNA Sequence Number=SeqID_21015
MGTVYNLREQQKLELLSILTNKLPQQAFLQGVGCRMLRGVKCGRHCRILGGRAIWGGGDQGAVEVGFDVKGENMNLRLTSTDPTQQSKVDGNYREVGR

SEQ ID NO: 137794 - protein, 243 aa, Glycine max
  Coding DNA Sequence Number=SeqID_21016
  Gene Ontology: Mol. function=transposase activity; Cellular component= membrane; Biological process=transposition, DNA-mediated
  Homolog annotation: Hit_ID=Q1SUE7; Match level="QueryCoverage=59%, HitCoverage=43%, E-value=1e-35, Identity=50%"; Hit description =Transposase, IS4
MSQRTTTSRAREEQYKGKTSQTFQATSPISDPYSTKACMEFLDNMQDVPTLAYFKLMEKFTSSMSLNSSYDSSSSIDSELDDYDNLMDLVVFIDKTPCRTSMLTEKNEIGNLCDGKKVSIEEVVAMFLIIICHNLHHRVVDERFQHSLHTVSKWFRIILKAVCKLGTDIIHQRNQTSTHPHIRGNPKYYPYFKDYIGAIDGTHVFAWTFASKQTAFRGRKVLVTQNVLAVCDFDMLFTFVYSG

SEQ ID NO: 137795 - protein, 79 aa, Glycine max
  Coding DNA Sequence Number=SeqID_21017
MKPQPQADLANIGIGSPGQQKNVWNLSSEPQILCQYKFYPTYLTAKVIQMKVEDVKCNEAASRFIAENRPELPQRGLVG

SEQ ID NO: 137796 - protein, 442 aa, Glycine max
  Coding DNA Sequence Number=SeqID_21018
  Gene Ontology: Mol. function=binding
  Homolog annotation: Hit_ID=Q10LP1; Match level="QueryCoverage=98%, HitCoverage=95%, E-value=1e-48, Identity=48%"; Hit description=TPR Domain containing protein, expressed
  Pfam annotation: Domain name=TPR_1; Domain location=320-353; Score =2.4; E_value=2.8; Accession=PF00515.18; Description=Tetratricopeptide repeat
  Pfam annotation: Domain name=TPR_1; Domain location=360-393; Score =30.2; E_value=7.1e-06; Accession=PF00515.18; Description =Tetratricopeptide repeat
  Pfam annotation: Domain name=TPR_1; Domain location=394-427; Score =21.9; E_value=0.0023; Accession=PF00515.18; Description =Tetratricopeptide repeat
  Pfam annotation: Domain name=TPR_2; Domain location=320-353; Score =3.8; E_value=12; Accession=PF07719.7; Description=Tetratricopeptide repeat
  Pfam annotation: Domain name=TPR_2; Domain location=360-393; Score =21.8; E_value=0.0025; Accession=PF07719.7; Description =Tetratricopeptide repeat
  Pfam annotation: Domain name=TPR_2; Domain location=394-427; Score =17.8; E_value=0.04; Accession=PF07719.7; Description=Tetratricopeptid e repeat
  Pfam module annotation: Pfam domain module=TPR_1::TPR_1::TPR_1::TPR _2::TPR_2::TPR_2; Domain location=320-353::360-393::394-427::320 -353::360-393::394-427
  Subcellular localization annotation: CTP_CleavageSite=35; ConfidenceScore=5.30e-01
MNSNFNFDFDLGIGSNRPKSLNDQKNPKPTSSYSSAQPAWTHRPAPTQTTALPGGPPSMVGDIFGKSWGTPQPSSASKNIGIVNKNPNLFGDLVSSALGLGSKTNVPLKNAPAPNKTTTFSMGNMADSLPKTGSTPQSSASWASSSGGFNVNANKTTPNLGGPSLRNMGSGIGTNSNTNKDPFSSLSGIGSKQSSTLNSAAKGPKVDLGDDGFGDFQNASKPSSAAFPSTASPGIDINFTRSTAAAASNQGSGGGGDPMDMFFTTISSSASGEGAAAASDGFGGQDNWGLDSEFGGGGQDVGGTTTELEGLPPPPAGVSGSTAKGKGMDSYKQGQFADAIKWLSWAVVLLEKAGDSATTGEVLSSRASCYKEVGEYKKAVADCTKVLENDETNVSVLVQRALLYESMEKYRLGAEDLRTVLKIDPGNRIARGTVHRLAKMAD

SEQ ID NO: 137797 - protein, 297 aa, Glycine max
  Coding DNA Sequence Number=SeqID_21019
MMTTPTSDCAKTIEEVKGNVEASKKTFALCFLSKKERSVEKRVKERKKINQKVIPVVVSPTGRCQKAQKPNPSLKFGTPQVRIPKKDTWQFAQIRVTLPRPNCVKFTMITIMMVADTVAVTAAKGLGVLRAYQSTCNFSVADQISAMIQTYDAVAPPPVKPTTYRLRRRTLLRRKQLTKRRLSGDDSGDAGNEGFLFGDGGDGPFGGGGDFGGGGVGGGGWNFNRFGGGNNWDEPSSSVPDPAFDFVYQVLSWIMLSNCLHFSFKRIVRIVAAGSIVDSDREKVPPDWFQFADLVPF

SEQ ID NO: 137798 - protein, 53 aa, Glycine max
  Coding DNA Sequence Number=SeqID_21020
  Subcellular localization annotation: CTP_CleavageSite=34; ConfidenceScore=5.35e-01
MCWVFKTVLSLTLISFSSLHDFSLSPPDPLSRRRSSLVAGRWSSPPIAAFVSQ

SEQ ID NO: 137799 - protein, 101 aa, Glycine max
  Coding DNA Sequence Number=SeqID_21021
MTTELPLSPSFQFNHDPPSSMHNPTFNFSEQIFDAWEQNTKRHFIYLVCRYHPTLSLASMVAVLMFGHEGGSTMEGFHLFGGEDNNGYRGVECGEKGKGGR

SEQ ID NO: 137800 - protein, 596 aa, Glycine max
  Coding DNA Sequence Number=SeqID_21022
  Gene Ontology: Mol. function=protein serine/threonine kinase activity; Cellular component=nucleus; Biological process=protein amino acid phosphorylation
  Homolog annotation: Hit_ID=Q1SJB2; Match level="QueryCoverage=82%, HitCoverage=81%, E-value=1e-169, Identity=63%"; Hit description =Serine/threonine protein kinase, active site
  Pfam annotation: Domain name=Pkinase; Domain location=141-421; Score =300.8; E_value=2.5e-87; Accession=PF00069.15; Description=Protein kinase domain
  Pfam annotation: Domain name=Pkinase_Tyr; Domain location=141-420; Score=55.4; E_value=7.2e-16; Accession=PF07714.7; Description =Protein tyrosine kinase
  Pfam module annotation: Pfam domain module=Pkinase::Pkinase_Tyr; Domain location=141-421::141-420
MSPDSYRNRNICYQLMGCVCGKFSPPREERPRPPQVKRVASKEGSRTTRSSKHVGEGVKRETQRQRVSVSVNKDSTANDGGVVEGEKGKTVAKKGKTTKDLDVKEEKMAEYGFVDGWPKWLLDNIPANVLAKIVPKSADSFEKLAKIGRGTYSNVYKAREKGTGKIVALKKVRFDTSDSESIKFMAREIMILQMLDHPNVIKLKGLATSRMQYSLYLVFDFMQSDLTRIISRPGEKLTEAQIKCYMQQLLSGLQHCHETGIMHRDIKASNLLIDRRGVLKIADFGLATSIEAERPLTNRVVTLWYRAPELLLGSTDYGFSIDLWSAGCLLAEMLVGRPIMPGRTEVEQIHMIFKLCGSPSEDYFKKLKLRTSYRPPNHYKLSFKENFQNFPSSSQGLLATFLDLNPAHRGSAASALQSEFFKCSPLACDPSALPDIPKDEDERLQTKRGKRQRVSKRGQSSQTSRSDASQSEKVQITAEQPREDTESSKEKNMEQHKQGQETGHSASSTSSGSRLFMTEGSTNASMSPVFLSSGSVRKSPKIEGHPNALRNIENYSALLQQTSVLDMINRNEGKEFPQLLKSFSALDFRLDSDKLS

SEQ ID NO: 137801 - protein, 88 aa, Glycine max
  Coding DNA Sequence Number=SeqID_21023
MSGFTRNSPQISASPHQLDLAPYASEPYHAQWNAPGLLRDKHTLRLSHILGEMEVDEPWIGLWLPLNYHVDMGSSGVRHGKCGRQTLW

SEQ ID NO: 137802 - protein, 471 aa, Glycine max
  Coding DNA Sequence Number=SeqID_21024
  Gene Ontology: Mol. function=hydrolase activity, acting on glycosyl bonds; Cellular component=cellulose and pectin-containing cell wall; Biological process=carbohydrate metabolic process
  Homolog annotation: Hit_ID=Q9LRY8; Match level="QueryCoverage=87%, HitCoverage=90%, E-value=1e-156, Identity=62%"; Hit description =Polygalacturonase-like protein
  Pfam annotation: Domain name=Glyco_hydro_28; Domain location=93-449; Score=-14.7; E_value=2e-08; Accession=PF00295.8; Description =Glycosyl hydrolases family 28
MAVAVHECLVRMNVLISLPKILVQVALLLLLALSNEVRVNGDSDGRQCEVNPALKPRPHTVSILEFGAVGDGKTLNTIAFQNAIFYLKSFADKGGAQLYVPPGTWLTQSFNLTSHLTLFLEKGAVILGSQDPFHWEVVDPLPSYGRGVEVPGGRYQSLVNGYMLHDVVITGNNGIIDGMGLGWWELFSSHSLNYSRPHLIELVASNRVVVSNLTFLNAPAYSIHPVYCSNVHIHNVSISAPQESPYTIGIVPDSSDHVCIEDCVIATGYDAISLKSGWDEYGIAYGRPTENVHIRRVHLQAYSGSTIAFGSDMSGGISNILVENVHLYNSKSGIEFRTMRGRGGYMKEIIISDIEMENIYTAMAATGYCGSHPDDKFDPNALPLLDHIILQDMIGTNITIAGSFAGLQESPFTNICLSNVTLSINSVSSIPWECSNVSGFSDSVLPKPCPDLETLSDCLSLLSIKGKTAVM

SEQ ID NO: 137803 - protein, 105 aa, Glycine max
  Coding DNA Sequence Number=SeqID_21025
  Gene Ontology: Mol. function=structural constituent of ribosome; Cellular component=intracellular; Biological process=translation
  Homolog annotation: Hit_ID=Q1SCP5; Match level="QueryCoverage=97%, HitCoverage=58%, E-value=5e-20, Identity=54%"; Hit description =Ribosomal L18ae protein
  Pfam annotation: Domain name=Ribosomal_L18ae; Domain location=11-105; Score=-40.9; E_value=6.6e-05; Accession=PF01775.7; Description =Ribosomal L18ae protein family
MVFFLSYTKAKAKNAQVRNGLGHGNVAHTPNTFSKIRTGQEPLHHQRDFLDDSDTTLNGAVEAMYSEMASRHRVRSPCIQIIKTTTIPAKLCKKESTKQFHNSKI

SEQ ID NO: 137804 - protein, 66 aa, Glycine max
  Coding DNA Sequence Number=SeqID_21026
MAYEKNPHPFPRRKGQQNLLNGEQITNAKTRIPKERNGKEEMRRKEKIGGKQNNSRLIKEREQKVF

SEQ ID NO: 137805 - protein, 88 aa, Glycine max
  Coding DNA Sequence Number=SeqID_21027
STLADGGHPAQGTPSCLVLTPQPKSKAVARWIVIKCNRQKGSIEYGYYVIHWMSTITLGSFRNNWEATIGAREIKGISDPVGTVLSPS

SEQ ID NO: 137806 - protein, 119 aa, Glycine max
  Coding DNA Sequence Number=SeqID_21028
MGPEIYPKAHKNPWAFTCISGPIYLEFSIQCLCGPIVLSMEGPPPATEERRKLDLLEERLRAVEGFGDYPFADMTDLCLVPDVVIPPKFKVPDFDKYKGTTCPKNHLKMYCRSSVWTTL

SEQ ID NO: 137807 - protein, 68 aa, Glycine max
  Coding DNA Sequence Number=SeqID_21029
MSYDATIEVRNHVSPEPEVEDAGVASLANPKACDKFGMQNDFKGSKVASKSENVSKCEDFMASEIKVS

SEQ ID NO: 137808 - protein, 207 aa, Glycine max
  Coding DNA Sequence Number=SeqID_21030
  Gene Ontology: Mol. function=hydrolase activity; Biological process =response to biotic stimulus
  Homolog annotation: Hit_ID=Q43453; Match level="QueryCoverage=75%, HitCoverage=100%, E-value=3e-77, Identity=92%"; Hit description =G.max mRNA from stress-induced gene
  Pfam annotation: Domain name=Bet_v_I; Domain location=50-203; Score =196.0; E_value=9.2e-56; Accession=PF00407.9; Description =Pathogenesis-related protein Bet v I family
MVWGIHRSRVTPEVVLGCLIINRGHSSAKEAHSSKHLLLKLVESILLFIMGVFTFEDETTSPVAPATLYKALVTDADNVIPKAVEAFRSVENLEGNGGPGTIKKITFVEDGESKFVLHKIESVDEANLGYSYSVVGGVGLPDTVEKITFECKLAAGANGGSAGKLTVKYQTKGDAQPNPDDLKIGKVKSDALFKAVEAYLLANPHYN

SEQ ID NO: 137809 - protein, 282 aa, Glycine max
  Coding DNA Sequence Number=SeqID_21031
MNGLAKTNEHQSTYLCSPTLTRDAKFKVCSFQLSSMPPWLGIHRHLVSRKYRSEWTAKGIHDLRVDLLQQKLTIIGWADPEQVVKAIKKTKKNATICSSIELTSPSKPTEPEPKENAPVPDATQPPPARVPPPQASPPSKPPPQRPPPEATPPSHIPTQHKTSRQWQNNTGIEELEQVHVKQYYHLPNNVNRFSSGRNHVEHWHRYHNGPVFLQESSRPMYVTHSYNTHVPSSIVTEYEYVRSPSRQTHYNCIEHYSGDYQNDNVNITSMFSDDNPNACCIV

SEQ ID NO: 137810 - protein, 116 aa, Glycine max
  Coding DNA Sequence Number=SeqID_21032
MNNPTLSRLFPGLNREREMSAMVSALTHVVSGEVPITGDSSSSSSLVLHHQPHDDTVIVTPTMPSSSSSSTYVVGTSSLKRSRENDTYTSSLFSHPPSSSPAMPTKYNSSTFKIAV

SEQ ID NO: 137811 - protein, 111 aa, Glycine max
  Coding DNA Sequence Number=SeqID_21033
MEEMEREPLHWRFGNSFVLVGKKGRKKEIHLFRTVVNAAFSQTIRAHAVKKVMDITNCRWQWRFAGHLPRGKENASGDGEFFTSANRLSFWRVRAQMSKPPVKLAVLLLQP

SEQ ID NO: 137812 - protein, 397 aa, Glycine max
  Coding DNA Sequence Number=SeqID_21034
  Homolog annotation: Hit_ID=Q9ZU41; Match level="QueryCoverage=93%, HitCoverage=96%, E-value=2e-68, Identity=42%"; Hit description =Predicted by genscan and genefinder
  Pfam annotation: Domain name=DUF789; Domain location=71-389; Score =468.4; E_value=8.7e-138; Accession=PF05623.3; Description=Protein of unknown function (DUF789)
  Subcellular localization annotation: CTP_CleavageSite=47; ConfidenceScore=5.10e-01
MSASGGAAISGGSRNRNRHLGENRFYSPPPLRKHKEKQEQQRSSLSRASSENRPGSSSDCSISSRATSDMSNLDRLLEHITPLVPAQYFPKTNSRRWKSREAELHPYFVLGDLWESFKEWSAYGAGVPIVLHGNESVTQYYNVSLSAIQLYIDPSKPSTRLRKPSQESDSESARETSSDSSSGYCHERGAKSVHGSRNHLNVLDASNHSLERVSQGKPLMGSSSDETESCNPPGQLIFEYFEHETPYNREPLANKARCISDLERQFPELKTYWSCDLSPASWVSFAWYPIYRIPTGPTLQSLSACFLTFHSLSTALQSSNTDGLHNHYSRGRDISKLSLPIFGLASHKFKVSIWDPDGVSECQKANSLSRAAENWLRLLRVNHPDYNYFMSHYAYVR

SEQ ID NO: 137813 - protein, 70 aa, Glycine max
  Coding DNA Sequence Number=SeqID_21035
MEGEIRNTLTHPGGAQTVKPLVTHYSSSWPLVEHIVRTYYMELLRLFCMCKPSSSCDGLQIVLLFNSIPT

SEQ ID NO: 137814 - protein, 112 aa, Glycine max
  Coding DNA Sequence Number=SeqID_21036
  Gene Ontology: Mol. function=transporter activity; Cellular component= integral to membrane; Biological process=transport
  Homolog annotation: Hit_ID=Q39822; Match level="QueryCoverage=89%, HitCoverage=35%, E-value=1e-43, Identity=87%"; Hit description=Pip1 protein
  Pfam annotation: Domain name=MIP; Domain location=29-108; Score= -113.0; E_value=0.021; Accession=PF00230.10; Description=Major intrinsic protein
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGLAWFPFYILIS

SEQ ID NO: 137815 - protein, 69 aa, Glycine max
  Coding DNA Sequence Number=SeqID_21037
MEKEGKINVGKEKSQKLCLIRSGTCDYEVGGKGRVGDAHGPHFHLYWPYHVSPPFMMWTLPFFCLIGGV

SEQ ID NO: 137816 - protein, 121 aa, Glycine max
  Coding DNA Sequence Number=SeqID_21038
  Gene Ontology: Mol. function=transporter activity; Cellular component= integral to membrane; Biological process=transport
  Homolog annotation: Hit_ID=Q39822; Match level="QueryCoverage=81%, HitCoverage=35%, E-value=7e-49, Identity=97%"; Hit description=Pip1 protein
  Pfam annotation: Domain name=MIP; Domain location=1-121; Score=35.5; E_value=3.7e-12; Accession=PF00230.10; Description=Major intrinsic protein
MPEIADKYGQCGNVVAIDQNYGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPV

SEQ ID NO: 137817 - protein, 118 aa, Glycine max
  Coding DNA Sequence Number=SeqID_21039
MHLWPTKNLRDSFKDSYLKRLEWNYQRMKAEKNQQQSSTEQKLLENENQDHGNNNNGDAPNLLNCEAGSVSSLFQELLLVLSCCYCCFCCGGVDIDGLTFSRSSVVVLLDEMELVNFD

SEQ ID NO: 137818 - protein, 52 aa, Glycine max
  Coding DNA Sequence Number=SeqID_21040
MAMEDGDSINLQALLPRTKSLRENGWCVVFVKGHVVGVFVGWTWVGILVQFN

SEQ ID NO: 137819 - protein, 661 aa, Glycine max
  Coding DNA Sequence Number=SeqID_21041
MDGIFECIDGRFEVSLADSTMMGIVHHAMNKAQEKMKLKTGVIEQLNEISKFYELAVMQLEGCLSIVHTETESSFLESNHEEESELAIVEKDKELAERLENELQLRHALELKERQLVSLGISHGIETSSLNAENDQTTRKEHDNGDGDGDGNVCELRTSVDQSKLEAQHDMLSEVQNNGIGRIKVEEMGSDIDILKQTMDLAFGKMQSALFLCEMRPKEREWKLTIEKDVMSISIGSFMRDFQENIEVKVKREENQDSDCSSLSSPAKPSSPTKPSSPEGNHEIPNRFSLKMETDKSPEEEENEDGSSMYVAKLIKNHESIIRRKSEELNLSKHVISQERKASYVRRRKELNRMRERIHVVTEKLGNFIRRNAKLIESLFNQRSIHDAELFPRRKLSEVDEIHTIKDVESQRRAEKQVKGVCDAKNEKQDELIGMSQMEKEYNTMQNSISENVCGSVDDQVEVLDSKSYNFDLEKKIQECVYKYYLREVISEWNENIEMQTIERKSRDDINLIVLSEAVMDISANQEFSLIKGRGSEAEESCLQCLTCSDQEDVCMVVFKAMVKEWKLELDNYYMENYIRENINQVVMVWTLNDAFLLTIEDSCSTSTMMLNQVRKVHGEENLKILLLESLLGCFEAEESLMPSAKCEIKEQCRELDLGSE

SEQ ID NO: 137820 - protein, 227 aa, Glycine max
  Coding DNA Sequence Number=SeqID_21042
  Gene Ontology: Mol. function=transferase activity, transferring glycosyl groups; Cellular component=integral to membrane; Biological process=protein amino acid glycosylation
  Homolog annotation: Hit_ID=Q9C8W3; Match level="QueryCoverage=83%, HitCoverage=47%, E-value=6e-61, Identity=61%"; Hit description=Alpha- (1,4)-fucosyltransferase (EC 2.4.1.-) (FT4-M) (Galactoside 3(4)- L -fucosyltransferase)
MRVPNCSSFFTPPLRHFITLVNTLGFILLILFISGIIEFPSFSLFSQFSTKPIFKDQSKAFTDVVGAFKRWDSEVGCVRFKNEINQQRNNGSNYSFSTSLQDQLECGVLKMKHVSILVKGWTWIPDNLNSMYICPCGLSCLWTKSLVLADNPDAFLFETTKPPAQRIIGQPLRVYMDLESKRKRSGREEVFISYHAKDDLQSTYASAILHNGRNYHISSHKNNDCLV

SEQ ID NO: 137821 - protein, 85 aa, Glycine max
  Coding DNA Sequence Number=SeqID_21043
MVSEQLILGPVTASPRFVVTNTHHLLFTHQAFTLFILRWYQSHQAQQILGVRGCVEKHSSPTLVGDRAKLEYINERLGILNLKQE

SEQ ID NO: 137822 - protein, 119 aa, Glycine max
  Coding DNA Sequence Number=SeqID_21044
MDTVGGRNKMKQAEEEKVVSMPWQEKRELAQKEEEVLSKDIEDLKTWLDMMENMHDDDQQLKEYLEYHPGDLNLAKDKKNKNKVENTSKSVPKITNKSKSSASSKSNGILASVLRFHKN

SEQ ID NO: 137823 - protein, 161 aa, Glycine max
  Coding DNA Sequence Number=SeqID_21045
  Gene Ontology: Mol. function=sequence-specific DNA binding; Cellular component=nucleus; Biological process=regulation of transcription, DNA-dependent
  Homolog annotation: Hit_ID=Q8LG10; Match level="QueryCoverage=65%, HitCoverage=74%, E-value=3e-23, Identity=53%"; Hit description=GATA transcription factor 16
  Pfam annotation: Domain name=GATA; Domain location=60-95; Score=69.9; E_value=8e-18; Accession=PF00320.17; Description=GATA zinc finger
MERGGKEIRLLGIESQISEIRMVDPTGKGSEVEVEDSNSNPNAPSSGNSPSSNNEQKKTCADCGTTKTPLWRGGPAGPKSLCNACGIRSRKKKRAILGINKGSTEDGRKGKRTGGGGGIGGIGGGALGREVLLHRSHWKKLGEEEKAAVLLMSLSYGSVYA

SEQ ID NO: 137824 - protein, 60 aa, Glycine max
  Coding DNA Sequence Number=SeqID_21046
MDSCNVSGVLVLETVLHRGIVTNKQFNLEGQAFLLQFLYPEPPNGGSCGSQVSLISVLKP

SEQ ID NO: 137825 - protein, 108 aa, Glycine max
  Coding DNA Sequence Number=SeqID_21047
  Subcellular localization annotation: CTP_CleavageSite=66; ConfidenceScore=5.27e-01
MSPPPLGPHNHSQTHLKLSGRLPLQARFSAARAFLAQRDGLKRCASLDDHSLSAMHNSSFFHILPRAQSRSVALNGWLAKPEDWLSERVKINTSQTGLVNLKLRENDY

SEQ ID NO: 137826 - protein, 142 aa, Glycine max
  Coding DNA Sequence Number=SeqID_21048
GTLIDDWKFDYSIHDARRMVCNDQADMTGRLLALRTNAPLPYPHLVTLFLHHFKIPLEDEPFVQVKRSFAISAGAVISFGYRKDDDGQWVRKQDLPQPIPDEYTLSPPPQRVDSSSLLNDVLSELHSLRAFVGDRFDAMDTR

SEQ ID NO: 137827 - protein, 77 aa, Glycine max
  Coding DNA Sequence Number=SeqID_21049
MSLHVLYLYVFSGFPPGIPRLLYLSLQSFKEMNGQDHLELPSGVGTKHEQQKPIKVLRNGCKWGWSHDRLIVAPSLR

SEQ ID NO: 137828 - protein, 64 aa, Glycine max
  Coding DNA Sequence Number=SeqID_21050
ILLQHVDTATSEDDEDSESEMQSASVLFHACAVAKQLIAVEDRLPTWAFVQNLWIEIELCWWSM

SEQ ID NO: 137829 - protein, 149 aa, Glycine max
  Coding DNA Sequence Number=SeqID_21051
GKRVYRRSRVNFNSSSVGRGTAGLLLIKGMLLLLYGTIGAVTLAEENGAGGIAEACGVVAAATEVMTLIASLGVGENSCLCEIAEIKGFLVLENVDVVMQAPLELVGLGSSSSMDSFASWKINGSGMEKEEREETPLQGEDESRRSSPP

SEQ ID NO: 137830 - protein, 154 aa, Glycine max
  Coding DNA Sequence Number=SeqID_21052
MAASDHTILHNRVHIPTKKSLLELSSQDALLALNKLLSKKLEALTETLSCTLCGGAHGPGLCIPTEETSHEVNYMGNQPRQNFNVVGFSGFQHGQPYQQHNQWRTHPSNQFNKDQGGPPNRPQQQGPSLYERTKKLEETLAQFMQVSLTNHKST

SEQ ID NO: 137831 - protein, 873 aa, Glycine max
  Coding DNA Sequence Number=SeqID_21053
  Homolog annotation: Hit_ID=Q10MM5; Match level="QueryCoverage=99%, HitCoverage=88%, E-value=6e-93, Identity=31%"; Hit description =Expressed protein
MRVEKGAKNEGGYVGGFFHLFDWTSKSRKKLFAAKSDLPESSKQRRKVDGNMAMVLPYLVDEDDEIGVGKGIRECSDHSCASSVIDDEVCGTRSPGVVARLMGLDSLPSSSFLDPYFTPYFDSQSLQDVLYWRTKFNHLHDHQILYSGKSIEKAEGSSRNFMEEKPQQTRSRPIEKFQTEVMPPKSAKSIPFAHHKLLSPIKSPGFVPANNATYIMEAAARIIEPGPQATTKAKTPLVASSTVSLRVRDFKEKAEALQKGPLIGSSSLTSRVRDLKEKRETSHRTIRLSKPSQRSAESYDAQYLKGQSFNRSWNGSVDTQVRSSSQAEEDSSLKNKGKSISLAIQAKVNVQRREGLSFSSGKSLVEQKEQYDIKTPQQSLKANVHRSLHKKSSGQDASGVLRQNNLKQNCSMEKDKLPSKPLVSNSNGRKVVTGDSSCGCHRSSSSKATAKSKVGPKKSSMNVTDSEKEVLFTRTNNFPRKKRTTDRDWNDRVVDNLFIDKTQKPVKSNLVSNKHHGGAEEVKNKDMDVVSFTFTTPLTRCNSDFETSGQTGLKTDSLSLDQHIRRVLLDTDIDTDSTRTLVGYNAIGGDALGILLDQKLRELTYGVENSCDDSFKARSPSSNSCDDSFKARSPSSTVPKSKDLVSTLNSVNLFLELQQKTDQDMIWTDKLFSSRECDISFTCLPEISSKHRLWMEECKINPMEAELFSPGQPSPMSVLDPSFSTQSCESPFSTNAASSVDQNRKQVVGSGSGLNSSRKYHHAEADTELFDSASSSTVLKKQASPCSQMKFGGSRTWELDYVNDILCNVELMYMDFSLGRARDIVNPHLFNQLESRRGRRFESDGGECRMRRKVIFDCVSESLDLRCRRYVGG

SEQ ID NO: 137832 - protein, 143 aa, Glycine max
  Coding DNA Sequence Number=SeqID_21054
  Gene Ontology: Mol. function=nucleic acid binding; Cellular component= intracellular
  Homolog annotation: Hit_ID=Q39265; Match level="QueryCoverage=52%, HitCoverage=41%, E-value=2e-10, Identity=46%"; Hit description=Zinc finger protein 6
  Pfam annotation: Domain name=zf-C2H2; Domain location=30-52; Score =20.4; E_value=0.0063; Accession=PF00096.16; Description=Zinc finger, C2H2 type
MKLFGFPLKGSISTSEDIPCVVDDSGGKKFKCRYCRRQFANSQALGGHQNAHRKERAKLAQFKYLLRLQQHDQYHHRFKEASNGSPSVSVVGSAITSAAAGAALFEFHSAAAGSSHLGTVPASGNDVVDLNLRLACSSENFKN

SEQ ID NO: 137833 - protein, 253 aa, Glycine max
  Coding DNA Sequence Number=SeqID_21055
  Pfam annotation: Domain name=DUF1218; Domain location=66-190; Score =16.2; E_value=0.00035; Accession=PF06749.3; Description=Protein of unknown function (DUF1218)
MAVTHADLEPRRRKTDFSSKTGAFFVVLTILLGLLCFILCLMAEATRSKVMWMSTAEHGKGSKSECVYSGSGKMPLLCASCAFIGLAIAMLVEHTFLLMAVSNSSPALLTLDPDSASAKSLTWQSGFFFVTTWICFAVGEILLLAGVSVESGHLKNWSKPKPSCLSIREGLFCAAGVFALATVFLASALYLTALRALRISQEQENVRREVLMTSSLHASPPRTPQPHIRESPTTRETPLSVFPTPFNKSLTFV

SEQ ID NO: 137834 - protein, 549 aa, Glycine max
  Coding DNA Sequence Number=SeqID_21056
  Gene Ontology: Mol. function=protein transporter activity; Cellular component=nuclear pore; Biological process=intracellular protein transport
  Homolog annotation: Hit_ID=Q94KA9; Match level="QueryCoverage=94%, HitCoverage=100%, E-value=0.0, Identity=79%"; Hit description =Importin alpha 2
  Pfam annotation: Domain name=Arm; Domain location=105-144; Score =32.1; E_value=2e-06; Accession=PF00514.13; Description=Armadillobeta- catenin-like repeat
  Pfam annotation: Domain name=Arm; Domain location=146-186; Score =59.4; E_value=1.2e-14; Accession=PF00514.13; Description =Armadillobeta-catenin-like repeat
  Pfam annotation: Domain name=Arm; Domain location=188-229; Score =37.6; E_value=4.2e-08; Accession=PF00514.13; Description =Armadillobeta-catenin-like repeat
  Pfam annotation: Domain name=Arm; Domain location=231-270; Score =33.2; E_value=9.4e-07; Accession=PF00514.13; Description =Armadillobeta-catenin-like repeat
  Pfam annotation: Domain name=Arm; Domain location=272-312; Score =43.7; E_value=6.1e-10; Accession=PF00514.13; Description =Armadillobeta-catenin-like repeat
  Pfam annotation: Domain name=Arm; Domain location=346-386; Score =35.8; E_value=1.5e-07; Accession=PF00514.13; Description =Armadillobeta-catenin-like repeat
  Pfam annotation: Domain name=Arm; Domain location=389-429; Score =31.5; E_value=2.9e-06; Accession=PF00514.13; Description =Armadillobeta-catenin-like repeat
  Pfam annotation: Domain name=HEAT; Domain location=152-188; Score =28.3; E_value=2.7e-05; Accession=PF02985.12; Description=HEAT repeat
  Pfam annotation: Domain name=HEAT; Domain location=237-272; Score =10.3; E_value=2.4; Accession=PF02985.12; Description=HEAT repeat
  Pfam annotation: Domain name=HEAT; Domain location=278-314; Score =6.5; E_value=6.9; Accession=PF02985.12; Description=HEAT repeat
  Pfam annotation: Domain name=HEAT; Domain location=352-388; Score =5.8; E_value=8.3; Accession=PF02985.12; Description=HEAT repeat
  Pfam annotation: Domain name=HEAT; Domain location=395-431; Score =0.6; E_value=36; Accession=PF02985.12; Description=HEAT repeat
  Pfam annotation: Domain name=IBB; Domain location=4-96; Score=147.6; E_value=3.4e-41; Accession=PF01749.10; Description=Importin beta binding domain
  Pfam module annotation: Pfam domain module=Arm::Arm::Arm::Arm::Arm::Ar m::Arm::HEAT::HEAT::HEAT::HEAT::HEAT::IBB; Domain location=105 -144::146-186::188-229::231-270::272-312::346-386::389-429::152 -188::237-272::278-314::...
  Pfam module annotation: Domain location=352-388::395-431::4-96
MSLRPNARTEIRRNRYKVAVDADEGRRRREDNMVEIRKSKREESLLKKRREGLQAQQQFPAPLQNSTVDKKLESLPAMVAGVWSDDNSIQLEATTQFRKLLSIERSPPIEEVIQAGVVPRFVEFLVREDFPQLQAAWALTNIASGTSENTKVVIDHGAVPIFVKLLSSPSDDVREQAVWALGNVAGDSPRCRDLVLSQGALVPLLAQLNEHAKLSMLRNATWTLSNFCRGKPQPPFEQVRPALPALERLVFSNDEEVLTDACWALSYLSDGTNDKIQAVIEAGVCARLVQLLIHPSPSVLIPALRTVGNIVTGDDMQTQVSHVGCSMVPELGHISASHTVLNGSVLDWVAHTVIEAGLVAPLVNLLQNAEFDIKKEAAWAISNATSGGIHEQIKYLVSQGCIKPLCDLLVCPDPRIVTVCLEGLENILKVGEAEKSLGNTGDVNEYAQMIDDAEGLEKIENLQSHDNNEIYEKAVKILETYWLEEEDETLPSGDGAQPGFNFGNNELPVPSVGFMPGGRWDKVWRVSYCTLCPSWFMRCRGGSVYATKS

SEQ ID NO: 137835 - protein, 47 aa, Glycine max
  Coding DNA Sequence Number=SeqID_21057
MPITYTHMPGQLNWDTSSNISNNLSKWRKVRGRWNRLYSMTLLQHQQ

SEQ ID NO: 137836 - protein, 135 aa, Glycine max
  Coding DNA Sequence Number=SeqID_21058
  Gene Ontology: Mol. function=RNA binding; Cellular component =membrane; Biological process=signal transduction
  Homolog annotation: Hit_ID=Q5QLJ2; Match level="QueryCoverage=89%, HitCoverage=23%, E-value=1e-56, Identity=80%"; Hit description=STAM binding protein-like protein
MKYSLDLGVQRICQTLNEEEIFEVQDSLSLFPLGWIHTHPSQTCFMSSVDLHTHYSYQIMLPEAIAIVMAPTDTTSPHGIFHLSDPGGVSVIRNCQQRGFHPHEEPEDGTPIYEHCSHVYMNANLKFDVVDLRER

SEQ ID NO: 137837 - protein, 350 aa, Glycine max
  Coding DNA Sequence Number=SeqID_21059
  Gene Ontology: Mol. function=DNA binding; Cellular component=nucleus; Biological process=regulation of transcription, DNA-dependent
  Homolog annotation: Hit_ID=Q9FJ07; Match level="QueryCoverage=66%, HitCoverage=62%, E-value=2e-60, Identity=52%"; Hit description =Similarity to myb-related transcription factor
  Pfam annotation: Domain name=Myb_DNA-binding; Domain location=14-61; Score=44.8; E_value=2.9e-10; Accession=PF00249.21; Description=Myb -like DNA-binding domain
  Pfam annotation: Domain name=Myb_DNA-binding; Domain location=67-112; Score=51.5; E_value=2.9e-12; Accession=PF00249.21; Description=Myb -like DNA-binding domain
  Pfam module annotation: Pfam domain module=Myb_DNA-binding::Myb_DNA -binding; Domain location=14-61::67-112
MGRAPCCEKVGLKKGRWTAEEDKILTDYIQENGEGSWRSLPKNAGLLRCGKSCRLRWINYLRSDVKRGNITPQEEEIIVKLHAVLGNRWSVIAGHLPGRTDNEIKNYWNSHLRRKIYCFMKSLNESLPPIDMAAVNVAANSKRRTGGRGTKTQQTIQEDKNVAYNTSQVPQVQPTLKRSATSQSFINDEENPTEYSLDGYCENTYGTTASCLSSMDEVEALGPYQWLDDEIMKLTHMFENGVLVNQGGVLTNNEEWLSRNYDCGLMGANNEESKSGVWSSSNAESGEWNTTSCSSVNSVYDYHHHQWPDMQLEGSVDQSYNPWDFCEENQNEANCFWGTTGHNEGNGFYQ

SEQ ID NO: 137838 - protein, 439 aa, Glycine max
  Coding DNA Sequence Number=SeqID_21060
  Gene Ontology: Mol. function=ubiquitin thiolesterase activity; Cellular component=membrane; Biological process=positive regulation of cell proliferation
  Homolog annotation: Hit_ID=Q942M1; Match level="QueryCoverage=79%, HitCoverage=73%, E-value=3e-69, Identity=43%"; Hit description=STAM binding protein(Associated molecule with the SH3 domain of STAM)- like
MTIDLDSIARRVEVDNRIPIRYYYRIADNLLKQATIYREEHNVVDLYIILLRFLSLVSETIPYHRDYQASLPNERAAYKKRSRAVLDELESLKPEFKLRVEKMNDSHVKALLPEENGFNKALQSSVNSSLQWPAVNKQMSKWISSCRSVSLPPPNKETLSRHSFLGPNGLRGQWLGPSAEIKVQYPSSGELTQAKDSSPNQAGLYDLVAIKDGDQGPVTSTMDSVLSLDDGRWLRPAVESCSPVVTESREDPLQLLNIKQPLPPPILAQVYPERVPIPPSKVADPRPGPAKSSHDSRLDATTYQHLHIPVKMMEEFLRLASENTRKNLETCGVLAGSLLFVLAIWVALEKKGISYHNTYNPKARINFRLDFLVLTTELYMRNGRKKPSGLSHKLQNEMGNIKANDLKYSRLPTCKWKRIRRVYVWGKCKEKGELKLGRI

SEQ ID NO: 137839 - protein, 923 aa, Glycine max
  Coding DNA Sequence Number=SeqID_21061
  Gene Ontology: Mol. function=calcium ion binding; Cellular component =nucleus; Biological process=regulation of transcription, DNA -dependent
  Homolog annotation: Hit_ID=Q1T0C7; Match level="QueryCoverage=99%, HitCoverage=99%, E-value=0.0, Identity=74%"; Hit description=IQ calmodulin-binding region; CG-1
  Pfam annotation: Domain name=Ank; Domain location=597-629; Score=1.6; E_value=18; Accession=PF00023.20; Description=Ankyrin repeat
  Pfam annotation: Domain name=Ank; Domain location=630-662; Score =42.6; E_value=1.4e-09; Accession=PF00023.20; Description=Ankyrin repeat
  Pfam annotation: Domain name=CG-1; Domain location=18-136; Score =218.7; E_value=1.3e-62; Accession=PF03859.7; Description=CG-1 domain
  Pfam annotation: Domain name=IQ; Domain location=795-815; Score=20.3; E_value=0.0068; Accession=PF00612.17; Description=IQ calmodulin -binding motif
  Pfam annotation: Domain name=IQ; Domain location=818-838; Score=22.2; E_value=0.0018; Accession=PF00612.17; Description=IQ calmodulin -binding motif
  Pfam module annotation: Pfam domain module=Ank::Ank::CG-1::IQ::IQ; Domain location=597-629::630-662::18-136::795-815::818-838
MANNLAAQQLVDLDVGSIMEEARTRWLRPNEIHAMLCNYKYFTINVKPVNLPKSGTIVLFDRKMLRNFRKDGHNWKKKKDGKTVKEAHEHLKVGNEERIHVYYAHGQDNPNFVRRCYWLLDKSMEHIVLVHYREIQEMQGSPVTPVNSHSSSVSDPPAPWILSEEIDSGTTTAYAGDVKCLFGNNERQDNELQEKNTCYVHVYISSFLIWTKTDTSANINVKSHELRLHEINTLDWDDLVDANDHNTTTVPNGGTVPYFDLQDQILLNDSFSNVANNLSADIPSFGSLTQPIAGSNSVPYNFSSVNLQTMDDQANPHEQRNNTVSLSGVDSLDTLVNDRLQSQNSFGMWVNPIMSDSPCSVDDPALESPVSSVHEPYSSLIVDSQQSSLPGQVFTITDVSPTCVSSTEKSKVLVTGFFHKDYMHLSKSNLLCVCGDVSVPAEIVQVGVYRCWVSPHSPGFVNLYMSIDGHKPISQVVNFEYRTPALHDPAVSMEESDNWDEFQLQMRLAYLLFKQLNLDVISTKVSPNRLKEARQFALKTSFISNSWQYLIKSTEDNQIPFSQAKDALFGIALKSRLKEWLLERIVLGCKTTEYDAHGQSVIHLCAILGYTWAVSLFSWSGLSLDFRDRSGWTALHWAAYCGREKMVATLLSAGAKPNLVTDPTPQNPGGCTAADLAYMRGHDGLAAYLSEKSLVQHFNDMSLAGNISGSLETSTTDPVISANLTEDQQNLKDTLAAYRTAAEAASRIHAAFREHSLKLRTKAVASSHPEAQARKIVAAMKIQHAFRNHKTKKVMAAAARIQCTYRTWKIRKEFLNMRCQAVKIQAAFRCFQVRKHYCKILWSVGVVEKAVLRWRLKRRGFRGLQVKTVEAGTGDQDQQSDAMFRSKKAQEEYRRMKLALDQAKLEREFERLLSTEVDMQLKT

SEQ ID NO: 137840 - protein, 255 aa, Glycine max
  Coding DNA Sequence Number=SeqID_21062
  Gene Ontology: Mol. function=nucleotide binding; Cellular component =endoplasmic reticulum; Biological process=small GTPase mediated signal transduction
  Homolog annotation: Hit_ID=O04834; Match level="QueryCoverage=79%, HitCoverage=100%, E-value=1e-100, Identity=88%"; Hit description=GTP- binding protein SAR1A
  Pfam annotation: Domain name=Arf; Domain location=57-254; Score =342.1; E_value=9.5e-100; Accession=PF00025.11; Description=ADP -ribosylation factor family
  Pfam annotation: Domain name=MMR_HSR1; Domain location=73-194; Score =25.1; E_value=5e-06; Accession=PF01926.13; Description=GTPase of unknown function
  Pfam annotation: Domain name=Miro; Domain location=74-194; Score =10.3; E_value=0.00054; Accession=PF08477.3; Description=Miro-like protein
  Pfam annotation: Domain name=Ras; Domain location=74-235; Score= -99.5; E_value=0.081; Accession=PF00071.12; Description=Ras family
  Pfam module annotation: Pfam domain module=Arf::MMR_HSR1::Miro::Ras; Domain location=57-254::73-194::74-194::74-235
MGPSVFLVRCRVWDKKKRNEVSSNQRNLGLFFLSPHTQIQKLSSALSFGSQNMFFFDWFYGILASLGLWQKEAKILFLGLDNAGKTTLLHMLKDERLVQHQPTQHPTSEELSIGKIKFKAFDLGGHQVARRVWKDYYAKICEFSFKSRMVDAVVYLVDAFDKERFAESKKELDALLSDESLANVPFLVLGNKIDIPYAASEEELRYHLGLTNFTTGKGKVNITESNLRPLEVFMCSIVRKMGYGDGFQWVSQYIK

SEQ ID NO: 137841 - protein, 83 aa, Glycine max
  Coding DNA Sequence Number=SeqID_21063
MEPVLWGSVNKDECMRSNGRGSQQFIPIPTLKISQLSPQKNTTQMILTNPNRQINTKDNNHTFRWLELCGGDLGQVTPERERV

SEQ ID NO: 137842 - protein, 301 aa, Glycine max
  Coding DNA Sequence Number=SeqID_21064
  Homolog annotation: Hit_ID=Q9SWB6; Match level="QueryCoverage=75%, HitCoverage=99%, E-value=1e-130, Identity=100%"; Hit description =Seed maturation protein PM36
  Pfam annotation: Domain name=TENA_THI-4; Domain location=19-228; Score=219.4; E_value=8.1e-63; Accession=PF03070.6; Description =TENATHI-4 family
MEEKAKAEQKKIGMTETWLKKHRLLYNGATRHPLIISIRDGTINTASFKTWLAQDYLFVRAFVPFVASVLIKAWKESDCSGDMEVILGGMASLEDEISWFKTEANKWGISLSDVVPQQANKNYCGLLESLMSPDAEYTVAITAFWAIETVYQESFAHCIEEGSKTPPELKETCVRWGNEAFGKYCQSLQNIANRCLQKASDEELKKAEVMLLSVLEHEVEFWNMSRGNGLVGVLNSMDEGETHNNATSPNNPHNPTPMPGRNHSIGKYNNSGTQKIKGLSNQTGFTEGNANGAINFGSLHA

SEQ ID NO: 137843 - protein, 405 aa, Glycine max
  Coding DNA Sequence Number=SeqID_21065
  Gene Ontology: Mol. function=enzyme inhibitor activity
  Homolog annotation: Hit_ID=Q1T0F2; Match level="QueryCoverage=96%, HitCoverage=92%, E-value=4e-82, Identity=46%"; Hit description=PAPA -1-like conserved region; Zinc finger, HIT-type
  Pfam annotation: Domain name=PAPA-1; Domain location=293-380; Score =101.3; E_value=2.8e-27; Accession=PF04795.3; Description=PAPA-1-like conserved region
MEILGVSRLLLAMKRKRSTVSHQPRANADTLFQSYFGQLSPVEPFGKQAENENVKEKMDASAGLETGNKLKKLKLKFRGVTHTIHAKSKTETGFSSDSLIKKISPCSDCSKPHDDTDGNYVCPFDKRKGLGNKLLMPSVTESGFTAENHSHRGKTTGETIDVNHEHVCESKHITRRCALSVEFSDEDNKDAELHFLKDPGIPGSIKYGKMKLKSGKKYEDSDYVEEDPTSSDESISEWKKPKRESVDLLVQRGNHTCSVDSLKDVLSGSAASIADISDALVPMGKGENCQKWSNKSRKLRLQRRKIQSEKAAREAEAAAIRKILGQESGRKKREDKMKKHRDEFVKEKSNKSFNLGSNTVRLTMRPQGTVVTFSEDIGLPTILPREKCSGPNCTDEYKYRDSKSK

SEQ ID NO: 137844 - protein, 259 aa, Glycine max
  Coding DNA Sequence Number=SeqID_21066
  Gene Ontology: Mol. function=nucleic acid binding
  Homolog annotation: Hit_ID=Q1T0E0; Match level="QueryCoverage=39%, HitCoverage=39%, E-value=4e-47, Identity=87%"; Hit description=Zinc finger, CCHC-type
  Pfam annotation: Domain name=zf-CCHC; Domain location=94-111; Score =12.1; E_value=0.01; Accession=PF00098.13; Description=Zinc knuckle
MSSKKEEKSQAAAERIKAAALSAAKGLSRAQAERAATAAARNVNAYGQKEEGPSRWQEKREAKRQMYLMSTEKAVKLGERKDLKPAMSAAGGLAQCQKCFQSGHWTYECKNERVYISRPSRTQQLKNPKLRVNVSVTYDLDDNIPDAKEEKAKTSSKKTKRKHRKDSDSASDSEDSVFETDSGSGSSSVTGSDYSSESSSGYSSSSDSEEERRRRRKKKQKRGRRKRYTSSESSDSDSASDSDSDDKSSRRKKRNNRRR

SEQ ID NO: 137845 - protein, 218 aa, Glycine max
  Coding DNA Sequence Number=SeqID_21067
MTKKKQATKRKNLELNLDDASSENDWIVENDDGTMKVWIWTTWMGMLQIEDKDLVLDQGAKDINDAAKWRIWMMKMDKMKIVELAALVDVVTFLKGTLVNLIADVEVGFRRRVVRGHETQRNSQARVLRGVFGFKLSQTGLNKGWIVHQNATEACAEELRVSSLAQRSPMDGNSSWNRSLVKGIGGDGQTMDASIVGRQAKMFTEDSRSPMENNKPKL

SEQ ID NO: 137846 - protein, 111 aa, Glycine max
  Coding DNA Sequence Number=SeqID_21068
  Gene Ontology: Mol. function=aldehyde dehydrogenase (NAD) activity; Biological process=metabolic process
  Homolog annotation: Hit_ID=Q0WSF1; Match level="QueryCoverage=77%, HitCoverage=14%, E-value=8e-34, Identity=77%"; Hit description =Aldehyde dehydrogenase 22A1 precursor
MAFWWPLLVLAFAYGICRFLLMLIPPKVPSIDVDTSDVLDDGNQAQENSFIYVPPRGTSQQSGKIVQCYEPATMKYLGYVPALTRDEELRSTDTLIYFKYLYPICILYRYS

SEQ ID NO: 137847 - protein, 342 aa, Glycine max
  Coding DNA Sequence Number=SeqID_21069
  Gene Ontology: Mol. function=oxidoreductase activity; Cellular component=cytoplasm; Biological process=metabolic process
  Homolog annotation: Hit_ID=Q8H5F0; Match level="QueryCoverage=97%, HitCoverage=55%, E-value=1e-165, Identity=83%"; Hit description =Betaine aldehyde dehydrogenase-like
  Pfam annotation: Domain name=Aldedh; Domain location=2-342; Score =90.8; E_value=4.3e-24; Accession=PF00171.12; Description=Aldehyde dehydrogenase family
MWAKSSFKQRRLFLRILLKYIIKHQALICEISSRDTGKTMVDASLGEIMTTCEKINWLLSEGEQWLKPEYRSSGRSMLHKRAKVEFHPLGVIGAIVSWNYPFHNIFNPMLAAIFSGNGIVIKISEHASWSGCFYFRIIQSALAAIGAPEDLVEVITGFAETGEALVSSVDKVIFVGSPGVGKMIMNNAANTLTPVTLELGGKDAFIVCEDVDLDHVAQIAVRAVLQSSGQNCAGAERFYVHREIYSSFVSLVTKIVKSVTAGPPLVGKYDMGALCMHEHSEKLEGLVNDALDKGAEIVARGSFGHIGEDAVDQYFPPTVIVNVNHTMRLMQEEVAKLTIFST

SEQ ID NO: 137848 - protein, 544 aa, Glycine max
  Coding DNA Sequence Number=SeqID_21070
  Homolog annotation: Hit_ID=UPI0000D568C8; Match level="QueryCoverage =43%, HitCoverage=34%, E-value=2e-45, Identity=40%"; Hit description =PREDICTED: similar to CG9351-PA, isoform A
  Pfam annotation: Domain name=DUF625; Domain location=83-260; Score =309.9; E_value=4.7e-90; Accession=PF04802.5; Description=Protein of unknown function (DUF625)
MGHGVYQFDGFFCSSDTIISWRDPEYATELALSFQEPSGCSYICVSSEPRELPAVELSTLPLILKTVVDSGFADQLRLTELILSDQAFFRKLMEVFRMCEDLENIDGLHMIFKIVKGIVLLNSSAIFERIFSDDFIVDIIGALEYDPEVPFVQHHRKFLKEHVVFKEAIPIKDPVVLSKIHQTYRVGFLKDVVLARVLDEGIGANLNSIIHSNNAYVVSLLKDDSTFIQELFARLKSPTTSQESKKNLCLDNGGTKDATAVEDIRRRNDERALEREEERYFNEDSDEEDSASASVPRNQKGHQQPNLSNGVAASYSQLRSLVDYEDDEDDEDYKPPPREQPETSEEDDGIMESLRLKRKLPSKDKEPELEKKQKLSKNSKSKDSVFAALCSTLSQAVLPSKKTSIDIHTCARTDGRMSSSEDNQGDVQNISRSSSSNNSNIAAEDNHVEKEGEASRSFSDCLHAKSDNIQLGGEERPLVAPKSSPEMAFCNCPAFTLMSLCCGFATTVHGLDWLCGLLKYISCATNLGPGKWVAEWNQIAALYS

SEQ ID NO: 137849 - protein, 377 aa, Glycine max
  Coding DNA Sequence Number=SeqID_21071
  Homolog annotation: Hit_ID=Q1ZY19; Match level="QueryCoverage=93%, HitCoverage=79%, E-value=1e-22, Identity=24%"; Hit description =Fgenesh protein 60
  Pfam annotation: Domain name=DUF247; Domain location=26-371; Score =209.0; E_value=1.1e-59; Accession=PF03140.6; Description=Plant protein of unknown function
MDHNPASAITQANEDLVSSIKEKLEAVSSLKSIYRVPENLREANEKMYIPSTVSIGPLHHGKEGLKYMEDRKWHYLFTLLSRQPNQLESSLHEFVNALSDLEKPARNFYSELNLTWSQFMEMMLVDGCFIIELFLKYSLKDIRSRGDPTFSTPGLLNRVRCDLILLENQIPFLILQRLFQIVLIPIQYELTLTLCELAVRFFRKMLPGDKDIVNEKFSQEGYHLLDLIRQCYLPTYARVMSKKSVSQGDLENESATKLKKDGIKSKSSKAKSLLNIKFANGHQNDSQPFTSYVFLMKALVCNENDVKLFRNRGIVIMDNYTEKEVCDLFKRLCGEVEYVEDKFYFAGLIEQILEYKRTPRSWRKILKCSWLKTRTST

SEQ ID NO: 137850 - protein, 77 aa, Glycine max
  Coding DNA Sequence Number=SeqID_21072
  Subcellular localization annotation: CTP_CleavageSite=33; ConfidenceScore=5.23e-01
PLGQASVSVTVSPASLLLSDSDTNSVSSEPNLCVGLRNSAVNFPWPTIHHSFSHQGDKELVGTLRGFDVYASGVLED

SEQ ID NO: 137851 - protein, 132 aa, Glycine max
  Coding DNA Sequence Number=SeqID_21073
  Homolog annotation: Hit_ID=Q1T0F4; Match level="QueryCoverage=69%, HitCoverage=17%, E-value=4e-30, Identity=61%"; Hit description =Nucleic acid-binding, OB-fold
MTGISLYGAVTDIIKEENNQQTVFSLRIADTSGEIWTKLHFARFCLEVLWFENDIGASFINLSCLPALINSSCLHKLSRLTDIFYQTSYAQLDVPCFVALCTCSTIMNEALVGIPDDPSLIYGWACSFTGHS

SEQ ID NO: 137852 - protein, 117 aa, Glycine max
  Coding DNA Sequence Number=SeqID_21074
  Homolog annotation: Hit_ID=Q1T0F4; Match level="QueryCoverage=98%, HitCoverage=16%, E-value=5e-41, Identity=78%"; Hit description =Nucleic acid-binding, OB-fold
IEKIESSEIHRKFETLQRKQITLVDGDGVKLKFFLWGEQILLANLFRVGSMLALDKPYVNISVDCDTETSEDLCLEYGSETQLYLVPYIQHEEQLCRLGVRNIDSKPPSWFTALGFF

SEQ ID NO: 137853 - protein, 65 aa, Glycine max
  Coding DNA Sequence Number=SeqID_21075
MARLNAVFQNDAVTQEGEMREMHACLRRNDFLRRPGTTQEDNAKKCHNGFNPKPKIAHQLPSENP

SEQ ID NO: 137854 - protein, 254 aa, Glycine max
  Coding DNA Sequence Number=SeqID_21076
  Homolog annotation: Hit_ID=Q1T0F4; Match level="QueryCoverage=87%, HitCoverage=32%, E-value=2e-97, Identity=82%"; Hit description =Nucleic acid-binding, OB-fold
MENRGYACNTKVGSAMDVDHCQQKEEEEEQEDPFLKFVDYARSELLSLEGDRNKDDDGSDGLGWSWIVSRILKTCIAYSSGVTPAILLSELSQAWSEQRWVGAPKKPLELINHLKKNHRRTKLPNTVTIDSIYAKNFLSLNSVLEAVIIDAFVLPGTNIHMLTLGDYWSSNIIDVYLHRRFYDLTGLQNGILKRGREIFLTGCYLRTATGGSGHPRLLPTEYLVILLDENQDDDAMLLGAQFCSDPFSSISLDA

SEQ ID NO: 137855 - protein, 378 aa, Glycine max
  Coding DNA Sequence Number=SeqID_21077
  Gene Ontology: Mol. function=solute:hydrogen antiporter activity; Cellular component=integral to membrane; Biological process =metabolic process
  Homolog annotation: Hit_ID=Q9FFB8; Match level="QueryCoverage=96%, HitCoverage=45%, E-value=6e-83, Identity=42%"; Hit description =Na+/H+ antiporter-like protein
MQGMPDNVFALVMVCIILNATAIPMVLTHLYDPMKKYAGNYTKRNIFDLKTNGELRVLTCIHRPDNIPPTINLLEATFPTKEDPVCAYVLQLIELIGRASPLFVCHQLQKKKRADSNSSMAEKLVDAFQNFEQEFKGALVVNTFTSISPQENMYDDICTLALDKFASLIVLPFHKKWSSDGNFIEIEDESLRELNYRVMERAPCSVGILIERAQMTHIFSPETPYTVCMLFIGGKDDREALFFAKRMTKNPHVRLTVVRFFVDSCNEMNTRDWQGMLDTEILNDIKVNKKVGEAYVNYIEKTVKDGPDTALVIRSLVTEYDLIIVGRQAGVETPQTSGLLQWSEYPELGVLGDLLASTDAAGKASVFVMQQQRTAKDA

SEQ ID NO: 137856 - protein, 83 aa, Glycine max
  Coding DNA Sequence Number=SeqID_21078
MKDWGNFLHQILEEDSKDSARLQRSSWRGGLAAINGGSWWPPVVMGGGEAGPKVRYSLGSSQHRGVLHLLPYIASKGAMPMVE

SEQ ID NO: 137857 - protein, 109 aa, Glycine max
  Coding DNA Sequence Number=SeqID_21079
VKDAGKNGGSLVTVSLPEDPLGVLPELPEEDLPEDFRKKGSSIFRKTLGTPLPECFRKMYLFRKHSGRGFFRKSFQWFRKHFPEEPSSGIVPEEVLLPELFRKKYFFRK

SEQ ID NO: 137858 - protein, 109 aa, Glycine max
  Coding DNA Sequence Number=SeqID_21080
MAMRSWVSRGSVTRLMDSANRGAFSRFFSDKGRVLSEEEQAKENVYIQKWERERLEKQKQQAEKTKADKGKDAAADKLVSSISVLWGGGTTQSVYLCYAIMLIFHIMNN

SEQ ID NO: 137859 - protein, 482 aa, Glycine max
  Coding DNA Sequence Number=SeqID_21081
  Gene Ontology: Mol. function=catalytic activity; Cellular component =cytosol; Biological process=metabolic process
  Homolog annotation: Hit_ID=Q9C522; Match level="QueryCoverage=92%, HitCoverage=76%, E-value=0.0, Identity=85%"; Hit description=ATP citrate lyase, putative; 3734-7120
  Pfam annotation: Domain name=Ligase_CoA; Domain location=155-300; Score=125.6; E_value=1.4e-34; Accession=PF00549.10; Description=CoA -ligase
MATGQLFSRTTQALFYNYKQLPVQRMLDFDFLCGRETPSVAGIINPGSEGFQKLFFGQVEIAIPVHAGIEAACAAHPTADVFINFASFRSASASSMAALKQTTIRVVAIIAEGVPESDTKQLIAYARANSKVVIGPATVGGIQAGAFKIGDTAGTIDNIIHCKLYRPGSVGFVSKSGGMSNELYNTIARVTDGIYEGIAIGGDVFPGSTLSDHVLRFNNIPQVKMMVVLGELGGRDEYSLVEALKQGKVTKPVVAWVSGTCARLFKSEVQFGHAGAKSGGEMESAQAKNQALKEAGAVVPTSFEAFEDAIKETFDKLVQEGNITPFKEFTAPPIPEDLNTAIRSGKVRAPTHIISTISDDRGEEPCYAGVPMSTIIENGYGVGDICIMLCADHGPCVSGAHNSIVTARAGKDLVSCLVSGLLTIGPRFGGAIDDAARYFKDAYDRVILSHPHLFIYLPLMPHTMTSLFYLSIPQMPLQRLNR

SEQ ID NO: 137860 - protein, 402 aa, Glycine max
  Coding DNA Sequence Number=SeqID_21082
  Gene Ontology: Mol. function=N-acetyltransferase activity; Biological process=metabolic process
  Homolog annotation: Hit_ID=Q1T0F6; Match level="QueryCoverage=71%, HitCoverage=98%, E-value=1e-114, Identity=71%"; Hit description=GCN5- related N-acetyltransferase
  Pfam annotation: Domain name=Acetyltransf_1; Domain location=69-153; Score=53.9; E_value=5.4e-13; Accession=PF00583.14; Description =Acetyltransferase (GNAT) family
  Pfam annotation: Domain name=FR47; Domain location=73-153; Score= -1.3; E_value=0.018; Accession=PF08445.1; Description=FR47-like protein
  Pfam module annotation: Pfam domain module=Acetyltransf_1::FR47; Domain location=69-153::73-153
MVDTFSIESRLLIREFDEDRDVKVVGKLEKNCEIGTKKGVSIFTNMMGDPLSRIRFYPLHVMLVAELLESKELVGVVRGCIKSMRTPSESLLKIGCILGLRVSPTHRRKGIGLKLVNSVEEWMLRNGAEYAFLATEKNNDASINLFTNKCKYVSLSSLVIFVHPIISFPAKHIPKDIKIEKVNMEQAISLYRRTLRAKELYPLDMDSILKEKLSLGTWVSYYKDEGCRLNLQRNMVESVDEDIITNEITSSWIIFSIWNTCEAYRLQLKKSQPLRFLHTTLNHARDKIFPCLRMSVSESLCTPFGFLFLYGLHGEGENLGELMESIWRFTSRLGESLKDCRVVITELGFGDALVNHVPLTASMSCIDDIWYTKRISSHSDENDDELLMKRQIGNVFVDPRDF

SEQ ID NO: 137861 - protein, 92 aa, Glycine max
  Coding DNA Sequence Number=SeqID_21083
MWNNILLALVIASSFTECTRGGRVEVCVGAMVVQGTRREQAVVQRELQRWLCDDGSWIMVEGVTYGFNVKSGCDVVGAVVVLHAANIGVVGQ

SEQ ID NO: 137862 - protein, 66 aa, Glycine max
  Coding DNA Sequence Number=SeqID_21084
MHYSDSHPPHDDRNHSICALLSCYCDLPSVAATAKPKAKPAKVATKKTTVKVVKKPDSVLSKPKSV

SEQ ID NO: 137863 - protein, 242 aa, Glycine max
  Coding DNA Sequence Number=SeqID_21085
  Gene Ontology: Cellular component=integral to membrane; Biological process=vesicle-mediated transport
  Homolog annotation: Hit_ID=Q9M376; Match level="QueryCoverage=96%, HitCoverage=99%, E-value=1e-105, Identity=83%"; Hit description =Vesicle-associated membrane protein 727
  Pfam annotation: Domain name=Synaptobrevin; Domain location=146-240; Score=30.4; E_value=6.5e-06; Accession=PF00957.11; Description =Synaptobrevin
MSQRGLIYSFVAKGTVVLAEHTQYTGNFSTIAVQCLQKLPSNSSKYTYSCDGHTFNFLLDNGFVFLVVADESIGRSVPFVFLERVKDDFMKRYGASIKNDGAHPLADDEDDDDLFEDRFSIAYNLDREFGPALKEHMQYCMNHPEEMSKLSKLKAQITEVKGIMMDNIEKVLDRGEKIELLVDKTENLQFQLPEAGQAAEKEDVAAESPNEADGGRRNPYLNYNSVGYCLWGFQMLMETLEV

SEQ ID NO: 137864 - protein, 82 aa, Glycine max
  Coding DNA Sequence Number=SeqID_21086
MVFKIVHETIQRADLNHIVEQIKSSDKRFIRLWKEHQDKGIFYVLKILASEQGRGREKPKQTSLAQLCQQHRKQQEAGLLPS

SEQ ID NO: 137865 - protein, 664 aa, Glycine max
  Coding DNA Sequence Number=SeqID_21087
  Gene Ontology: Mol. function=protein serine/threonine kinase activity; Cellular component=membrane; Biological process=regulation of transcription, DNA-dependent
  Homolog annotation: Hit_ID=UPI00005DC312; Match level="QueryCoverage =99%, HitCoverage=84%, E-value=0.0, Identity=51%"; Hit description =ATP binding / kinase/ protein kinase/ protein serine/threonine kinase/ ...
  Homolog annotation: Hit description=protein-tyrosine kinase/ signal transducer
  Pfam annotation: Domain name=PAS_3; Domain location=1-87; Score=2.6; E_value=0.053; Accession=PF08447.1; Description=PAS fold
  Pfam annotation: Domain name=Pkinase; Domain location=353-638; Score =205.1; E_value=1.7e-58; Accession=PF00069.15; Description=Protein kinase domain
  Pfam annotation: Domain name=Pkinase_Tyr; Domain location=353-638; Score=203.5; E_value=4.8e-58; Accession=PF07714.7; Description =Protein tyrosine kinase
  Pfam module annotation: Pfam domain module=PAS_3::Pkinase::Pkinase _Tyr; Domain location=1-87::353-638::353-638
NRSAENLYGYTAEEALGQDGIELLVDPRDLDLANNTVNRVMMGESWTGQFPVKNKTGEKFLAVATNTPFYDDDGSLVGLICVSIDLRPFLEMKVPMPTSVRNIESDSDSGGTRPRSSITNKLGLDTQQPLQASIASKISNLASKVGNKVKSRIWMGENNLDRESGSGESHHSEHSLLESVFLEQREDANSSGASTPRGDVPPSHFGAFSHVEEKSQGKALRESGDESEGKSIHKIIPKAEAWIQRKTLSWPWRTKDREGSDAMNVRVAGSWRQNDQENESVNQKILSSGLKQESQAGESNRPTNNEASGSWSSFNVNSTSSASSCGSAGSGAVNNKVDVDTDCLDYEILWEDLTIGEQIGQGSCGTVYHALWYGSDVAVKVFSKQEYSDDVILSFRQEVSVMKRLRHPNILLYMGAVTSPQRLCIVTEFLPRWTDHCSVHLYFMTSVEACAACYTETHLNLTGDGEFIWPWILNHLSVRSMLYAYNLLFLQARGVNYLHHCNPPIIHRDLKSSNLLVDKNWTVKVGDFGLSRLKHETYLTTKTGRGTPQWMAPEVLRNEPSDEKSDVYSFGVILWEIATEKIPWDNLNSMQVIGAVGFMNQRLEIPKNVDPRWASIIESCWHSDPACRPTFPELLDKLKELQKQYAIQFQAARSTAKESTQKES

SEQ ID NO: 137866 - protein, 211 aa, Glycine max
  Coding DNA Sequence Number=SeqID_21088
MTLLLSNILPSDRNANLPLQKYQLVYVVPTWGSHPQRHPVDLKKSNRALGFPALVTGLYQSYRLPVPPRQGHAIIGIALARHPVDPKKSNRVLELSSSNYGSLSVLGSACRLPARLSGPPTNRAFIKKYCAPRQAQGENTTAALGWPVAGNRHTATTSRVHLSSSAKRLERCLRHMADQQATKSKAKGKQSTRSVTYKPSCVQLKTLKKRY

SEQ ID NO: 137867 - protein, 107 aa, Glycine max
  Coding DNA Sequence Number=SeqID_21089
MPATIYLTCCEGWVLVEKGRKNKPKPDPLLVKRADAVVPLCGGGWLVVLTFSPVRPEKQPSTNKQTNSIKCTSSSVARGCKKFPFVSNTMAKVCAFWNCIDFWGQKA

SEQ ID NO: 137868 - protein, 362 aa, Glycine max
  Coding DNA Sequence Number=SeqID_21090
  Pfam annotation: Domain name=Hemerythrin; Domain location=112-185; Score=13.5; E_value=0.64; Accession=PF01814.13; Description =Hemerythrin
  Pfam annotation: Domain name=Hemerythrin; Domain location=193-260; Score=15.4; E_value=0.21; Accession=PF01814.13; Description =Hemerythrin
  Pfam module annotation: Pfam domain module=Hemerythrin::Hemerythrin; Domain location=112-185::193-260
MGNCLGKSEKKLTAEIVPRDGAKVYPTVRLHGSPKSILAAYIRFALLHKSVSLDLVETETERVGDGGGGAVTLQVGSEVVSGSRETLLRFIDARFPGPSLGSGREDETTPLLASLTRAHHTSMLWHVERMVKWAEDLTTRGGKKIVDPSVGTPRMEIRKFAKSYSELLELMMEHAQMEETILFPLFDKADRGLAKVAKEEHARDLPLMNGIKEVIKSVGVLDSGSPDYHEALCSLSTRLKSLQGQCKQHFAEEEVELLPLMKALELSKEQEVSALEQCFEVMQGTHNRLLKFFLEGLPPHDAMKYLDLISKCRDKEKMESILQKIVNQVLVCPLADSSRGIPSKIPSPLVKVSDCKVRFLTA

SEQ ID NO: 137869 - protein, 32 aa, Glycine max
  Coding DNA Sequence Number=SeqID_21091
MTLLEAATRESLQCSTKDSLYEAGATVAVVPV

SEQ ID NO: 137870 - protein, 144 aa, Glycine max
  Coding DNA Sequence Number=SeqID_21092
  Gene Ontology: Mol. function=DNA binding; Cellular component=oxygen evolving complex; Biological process=DNA integration
  Homolog annotation: Hit_ID=Q0KIN0; Match level="QueryCoverage=69%, HitCoverage=7%, E-value=5e-32, Identity=55%"; Hit description =Integrase core domain containing protein
MDPNMKLLLGQQEPLKDPRRYCHLVGRLNYLIVTRPDITFVVNVVSQFMKEPCNDKIVCYSDADWAGSPSNRRSISGYCVIIGGNLISWRSKKQLTVARSIGKPVVPAALMNRPTRGERRFAYWALFRFLAHLTRCARSFGCGE

SEQ ID NO: 137871 - protein, 135 aa, Glycine max
  Coding DNA Sequence Number=SeqID_21093
  Gene Ontology: Mol. function=hydrolase activity, hydrolyzing O -glycosyl compounds; Biological process=carbohydrate metabolic process
  Homolog annotation: Hit_ID=Q5BMA5; Match level="QueryCoverage=81%, HitCoverage=48%, E-value=5e-50, Identity=49%"; Hit description =Putative endo-1,4-beta-xylanase
  Pfam annotation: Domain name=CBM_4_9; Domain location=3-123; Score =29.9; E_value=6.5e-06; Accession=PF02018.8; Description=Carbohydrate binding domain
MARDSLGSHEFLSGRYILVTNRTQTWMGPAQTITDKVKLFVTYQVSAWVRIGSGSSGPQNVNVALGVDNQWVNGGQTQVSDDMWHEIGGSFRIEKQPSKVMVYVQGPASGGLRIGRSSASSLTDSLALGRSAAAS

SEQ ID NO: 137872 - protein, 327 aa, Glycine max
  Coding DNA Sequence Number=SeqID_21094
  Gene Ontology: Mol. function=ubiquitin-specific protease activity; Cellular component=proteasome complex (sensu Eukaryota); Biological process=ubiquitin-dependent protein catabolic process
  Homolog annotation: Hit_ID=Q307X2; Match level="QueryCoverage=92%, HitCoverage=88%, E-value=2e-82, Identity=54%"; Hit description =Ubiquitin fusion-degradation protein-like
  Pfam annotation: Domain name=UFD1; Domain location=3-169; Score =306.5; E_value=4.8e-89; Accession=PF03152.5; Description=Ubiquitin fusion degradation protein UFD1
MVVKLFMPIKLLMQTLFLPSVIMPPSALLRLAHLDIVYPMLFELRNPSAERVTHCGVLEFTADEGIIYMPEWMMKNMKLQERNTVILKNTHVPRATYAKLQPHTKDFLDISDPKSILEISLRSYSCLTTGDTIMIPYNNKKYYIDIVETKPSHAVSIIETDCEVDFAQPLDYKEPEKLLPSASSDKGCTEGYCLLEIGICFLNSLEDSDYSVSVHDDSATKTARIIPFTGFGRRLDGEPCTPSVEETSSMLKQLEIENETKNCNSKISSTASRRASGKLVFRSNANANASKIQTPPKGSLKGTTQESSKEEEPKFKAFAGKKYSLNN

SEQ ID NO: 137873 - protein, 108 aa, Glycine max
  Coding DNA Sequence Number=SeqID_21095
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=Q31948; Match level="QueryCoverage=99%, HitCoverage=23%, E-value=5e-47, Identity=84%"; Hit description =Ribulose bisphosphate carboxylase large chain
  Pfam annotation: Domain name=RuBisCO_large; Domain location=1-95; Score=-130.1; E_value=0.028; Accession=PF00016.10; Description =Ribulose bisphosphate carboxylase large chain, catalytic domain
DWISLPGVLCVVFGGIHVWHMPAQTKIFGDDSVLQFGRGTLGHLWGNAPGAVANRVALEAYVQARNEGHLACEGNEIISETSKWSPKLAAACEVWKKIKFDFEAMDTL

SEQ ID NO: 137874 - protein, 354 aa, Glycine max
  Coding DNA Sequence Number=SeqID_21096
  Gene Ontology: Mol. function=protein phosphatase type 2C activity; Cellular component=protein serine/threonine phosphatase complex; Biological process=protein amino acid dephosphorylation
  Homolog annotation: Hit_ID=Q10S32; Match level="QueryCoverage=84%, HitCoverage=75%, E-value=1e-96, Identity=57%"; Hit description =Protein phosphatase 2C, putative, expressed
  Pfam annotation: Domain name=PP2C; Domain location=96-354; Score =42.8; E_value=1.2e-09; Accession=PF00481.12; Description=Protein phosphatase 2C
  Subcellular localization annotation: CTP_CleavageSite=54; ConfidenceScore=5.27e-01
MLREYSPKDTKLKKVFVPTQLRVNRPLSLSLSDRSETGGSGVGGVRVRVRVSKRCGMLQALMNLFSLCWKPFGRDAADRIDSIGVTGREGKDGLLWFRDGGKYGSGDFSMAVVQANQVLEDQSQIESGPLGTFVGIYDGHGGPDASRYVCDHLFRHFQAISAESRGVVTPETIERAFRQTEEGYTALVSGSWNARPQIVSAGTCCLVGVIFQQTLFVANAGDSRVVLGKKVGNTGGMAAIQLSAEHNANLEAVRQELKELHPHDPQIVVLKHGVWRVKGIIQVSRSIGDVYLKHAQFNREPLNAKFRLPEPMNMPILSANPTILSHPLQPNDSFLIFASDGLWEHLSNEKAVDI

SEQ ID NO: 137875 - protein, 333 aa, Glycine max
  Coding DNA Sequence Number=SeqID_21097
  Gene Ontology: Mol. function=small conjugating protein ligase activity; Cellular component=membrane; Biological process=protein modification process
  Homolog annotation: Hit_ID=Q2HSL7; Match level="QueryCoverage=94%, HitCoverage=95%, E-value=6e-72, Identity=46%"; Hit description =Ubiquitin-conjugating enzyme, E2
  Pfam annotation: Domain name=UQ_con; Domain location=42-188; Score =105.9; E_value=1.2e-28; Accession=PF00179.16; Description=Ubiquitin -conjugating enzyme
MANTKDIERFDVVSDDSDHYFLSAVGPNPYSFTNARSDVHKRIMMEWKILANNNLPESIYVRVYANRIDLLRAVIVGAAGTPYHDGLFFFDIAFPHDYPFHPPEVHYRSYGFSLNPNLYNNGHVCLSLINTWVGKSTEKWDPCGSTVLQLLLSLQALVLNDKPFFNDFWCEMIGRGRGLFEKKSLAYNDTVFALNCKTILGLLRHPPRNFQTFVVGHFRNRARAILGACDDYANGRVRVGRYSEDGDGEASDRRVRVSEKFRESMRVLYPQLLEIFLRCGAFSQSDAERYLKMERTNVLSKNMGNVTNRTYRVLVRKVIGKIRKLYASKLISC

SEQ ID NO: 137876 - protein, 337 aa, Glycine max
  Coding DNA Sequence Number=SeqID_21098
  Gene Ontology: Mol. function=small conjugating protein ligase activity; Cellular component=membrane; Biological process=protein modification process
  Homolog annotation: Hit_ID=Q2HSL7; Match level="QueryCoverage=89%, HitCoverage=93%, E-value=4e-82, Identity=52%"; Hit description =Ubiquitin-conjugating enzyme, E2
  Pfam annotation: Domain name=UEV; Domain location=42-162; Score= -41.9; E_value=0.087; Accession=PF05743.3; Description=UEV domain
  Pfam annotation: Domain name=UQ_con; Domain location=41-185; Score =102.2; E_value=1.5e-27; Accession=PF00179.16; Description=Ubiquitin -conjugating enzyme
  Pfam module annotation: Pfam domain module=UEV::UQ_con; Domain location=42-162::41-185
MEVKTNEFGHFDVVSDDSDHHFLGSNNGKCFYDSNSKVYRTIMKEWKILEQSLPESIYVRVYERRIDLMRAVIVGTAGTPYHDGLFFFDIMFPSDYPKHPPMLHFHSFGYRINPNLYINGKVCLSLLNTWNGKGTEMWDPSKSTMLQVLVSIQGLVLNKNPYFNEPLRLFDSESKSRVYNENAFIITCYTSFLLLQRPLRNFEAFVSAHFCERAFPILSACSDYVNGRVEVGYYSSDLRSSSSTVRVSREFKEKMIQFYPKLFQAFRLKGASVGGLVEHLELEIEQSEKKSSGGGQRQQLKNKSRRIFKKVMEKIKQTLGWKKKSQIEGRDRSLQSS

SEQ ID NO: 137877 - protein, 66 aa, Glycine max
  Coding DNA Sequence Number=SeqID_21099
MSKKKRPSWYGVPAAPTIDQYVAPRHLLKIAKTRELLKRCRCSQSKGSEGFESSLFTICQILVAVG

SEQ ID NO: 137878 - protein, 172 aa, Glycine max
  Coding DNA Sequence Number=SeqID_21100
  Gene Ontology: Mol. function=small conjugating protein ligase activity; Biological process=protein modification process
  Homolog annotation: Hit_ID=Q1SZJ2; Match level="QueryCoverage=72%, HitCoverage=49%, E-value=2e-13, Identity=36%"; Hit description =Ubiquitin-conjugating enzyme, E2
MLQVLVSIQALVLNEKPYYNEPGVASSESASHVYNENAFLITCKTSYLLLRIPPSERFGFSQACNEYANGCMSVGYYSSDFPRPSKSDTSFSGVQAFRLNGASLECLDEHLDLEMKQSKNKNSGIFKDKNVLKLYRKQNKTSEIFKNELAVRGLLEIIMPSNLHRLSVGIMN

SEQ ID NO: 137879 - protein, 70 aa, Glycine max
  Coding DNA Sequence Number=SeqID_21101
MARQRGDYARGRSFGDGGTLVLPSMEAYVSSVYCMCCMCIVGCGVWVQGRGFVHWSVGGINLERSLILKC

SEQ ID NO: 137880 - protein, 86 aa, Glycine max
  Coding DNA Sequence Number=SeqID_21102
  Gene Ontology: Mol. function=protein phosphatase type 2C activity
  Homolog annotation: Hit_ID=Q9ZSQ7; Match level="QueryCoverage=83%, HitCoverage=18%, E-value=4e-19, Identity=66%"; Hit description =Protein phosphatase 2C homolog
MPLSDSDMRGFRLPLLGSAKRLIKAALHEAARKREMRYSDLRKIDKKVRRHFHDDISVIVLFLNHDLISRGTVLDPALSIRSALDH

SEQ ID NO: 137881 - protein, 177 aa, Glycine max
  Coding DNA Sequence Number=SeqID_21103
MDSSGDFENEIINLGLMANDYESGEKLMSFNYDLSISFDELQDAFNDLHKESIKLAKLVSYSKKTISSLEKEILKLNVELENLKSEVKTLKLVDKDQLSQPALRREGDARAHRCVYQERKMCGVATNVYSRKTSEKPERRGLRTLSVKGSGVVFTHGEGYFPCSYAFLNCDKKIRPT

SEQ ID NO: 137882 - protein, 74 aa, Glycine max
  Coding DNA Sequence Number=SeqID_21104
MVPKFVNSKAERQKHHDQDESQSKWFSCMKQDVHLMQALNDPMTTTFRRKLKGKLYPFRDNKHLKMKTYKYHML

SEQ ID NO: 137883 - protein, 70 aa, Glycine max
  Coding DNA Sequence Number=SeqID_21105
MWRHPSMEEAMVRGVMVEPTEEVEGRLDEEEVIIVVLDLEGERKKGRQTTRHRGCHGGERRRGWDKKASE

SEQ ID NO: 137884 - protein, 64 aa, Glycine max
  Coding DNA Sequence Number=SeqID_21106
  Homolog annotation: Hit_ID=Q6Q2Z9; Match level="QueryCoverage=63%, HitCoverage=3%, E-value=1e-07, Identity=60%"; Hit description =Phosphoenolpyruvate carboxylase
MERKSHNFTTVPSSAPVSAPGFEGDCKLLGNLLNDILQREAGSTFVDKLEKIRVLSQVLIFLFT

SEQ ID NO: 137885 - protein, 147 aa, Glycine max
  Coding DNA Sequence Number=SeqID_21107
MKKSVELVWDVTKFGIPNAAASLFVTCADVNEIISGVQCLNIAILQLWTMYMDQLSQSDGLGSVYGFLEPQAILNANDRRGQCEEYIEKWLKESNRDVYLGAYLNYAFKTLETKSEGKFGHSTPRWIEVKSHVQSGVIEAVPELNKH

SEQ ID NO: 137886 - protein, 62 aa, Glycine max
  Coding DNA Sequence Number=SeqID_21108
MTDALSVIATRLAKKDLRLAWQGMLSATTLLNSTGLASKLAKPNSNNLKNKEIIAVSVTGHA

SEQ ID NO: 137887 - protein, 127 aa, Glycine max
  Coding DNA Sequence Number=SeqID_21109
MASHKRKATVLVSRAGYDRSRFGSIDVAIVKEFYANLYVPDDKFPKQVRVRGHLIKFDVDSLNTFLETLVVVEQGENLPSYSRFARLRPDPQELATQLCIPRRGFVLNVEGLPWKLLRKDLTVLVQT

SEQ ID NO: 137888 - protein, 266 aa, Glycine max
  Coding DNA Sequence Number=SeqID_21110
MTTLTQIWMTLLLSNILPTDHNSDLPMPKCQLVYAILTRMSIHVAQLIADAIYIFTGMAPTRHPLDPDKSNRALGFPALITGLCQSFGVPVAPTKVIRPPITRVFIEKYCTQRQAQGDAPQAAGVPPTPHQAGQAGAFDIEQYLRHLVRQQADNHRAHVRTHDCLYQMSLSMQSQGFASFSCPTPDQFRAEVAWPRRLAPRPKQERHPHKLPGDGEEAHEDEEMADLPPPPPEGVEIRDWEKKQIHVFFHISFVIFILCYCFDLRD

SEQ ID NO: 137889 - protein, 223 aa, Glycine max
  Coding DNA Sequence Number=SeqID_21111
MNTANAIRQVCCLIGGVGFSSHHRSNMVSSARVCEISDKGSTIEEDDLLHRSTTKTREGSEIVEEVPKEKEGDVNETIHGPVIPLSDVELLRQYESSRMFLVETDASNAVATRIIPKTSFNWFTKVPCFKNTNYFGKPCVTLLRKAWMVIGDFNIVLNAHDRIGAHDFRDMMQGRTFTWMTGNLLQCLDKAIFNIEWHLQFPNVLVLHLPYFKSNHIGLCLLS

SEQ ID NO: 137890 - protein, 257 aa, Glycine max
  Coding DNA Sequence Number=SeqID_21112
  Gene Ontology: Mol. function=nucleoside-triphosphatase activity; Cellular component=integral to membrane; Biological process=protein catabolic process
  Homolog annotation: Hit_ID=Q94ES0; Match level="QueryCoverage=98%, HitCoverage=34%, E-value=3e-82, Identity=60%"; Hit description=AAA -metalloprotease FtsH
  Pfam annotation: Domain name=FtsH_ext; Domain location=137-257; Score= -11.5; E_value=0.024; Accession=PF06480.5; Description=FtsH Extracellular
  Subcellular localization annotation: CTP_CleavageSite=55; ConfidenceScore=5.37e-01
MIFSRIARSVSSSSRARNLLHGDGRLGTHVGSPRTNACSEGAQGVLGFVRGYVSSARALSNGFVSNLPDFKSVAANPTIRRLFCSKAPKKENNSNANTEDSGNFQEAFMKQVKYLVTPLLLMGLFLTSFSFGPPEQNQISFQEFKNKLLEPGLVDHIVVSNKSVAKVYVRNTPLNQTDNEVAQGTQPAIGSGGQYKYYFNIGSVESFEEKLEEAQEALGICSHDFVPVTYSFELGYREWIALASILLFLGFVTYISF

SEQ ID NO: 137891 - protein, 208 aa, Glycine max
  Coding DNA Sequence Number=SeqID_21113
MACTKKTGQMTPEAAKEIDDKIASQGSFVAHGCYDVLTAAIGRLEHPGRVHVARAGVTIKQYFEPAPRTSYTSSSMAPEDLKQLTQKIRDQLEESITEKGLALPPKPEVSPLAARVNTKESYVDPSGKNPDTGDSDKSGLYIEENPRHLVALGRLYEGSTTVHNIPLLHDQVKGVVGPAKLADRPDHDVNDPLYLMTLTIPQLFLKPL

SEQ ID NO: 137892 - protein, 189 aa, Glycine max
  Coding DNA Sequence Number=SeqID_21114
  Gene Ontology: Mol. function=nucleoside-triphosphatase activity; Cellular component=integral to membrane; Biological process=transport
  Homolog annotation: Hit_ID=Q9LFH0; Match level="QueryCoverage=88%, HitCoverage=14%, E-value=9e-50, Identity=50%"; Hit description =Probable pleiotropic drug resistance protein 9
MAQLAGADEIESLRNELAEIGRNIRSSFRSHASSFQRVSSINPVQQEVVDVRKLGAQERHTFIEKLIKHIENDNLRLLQKFRKRIDKVGINLPTVELRYQNLSVEAECKIVQGKPIPTLWNTLKEWIFDTTKLSVLKSQNSKISIIKNDNGIIKPGRMTLLLGPPASGQPFFFRTQIKFITYRYMTNVL

SEQ ID NO: 137893 - protein, 558 aa, Glycine max
  Coding DNA Sequence Number=SeqID_21115
  Gene Ontology: Cellular component=membrane
  Homolog annotation: Hit_ID=Q10MF7; Match level="QueryCoverage=97%, HitCoverage=67%, E-value=0.0, Identity=67%"; Hit description =Expressed protein
MAPRSFLLALLSLLLTQSESAPQAFKREPGHPQWHHGAFHDVRDSVRSDVRRMLHSRAEVPFQVPLEVNVVLIGFSGDGGYRYNIDAHRLEQFLKTSFPVHRPSCLETGELLDIEHHMVYNAFPAGQPELIALEKELKGAMVPAGKARETEFGREVPLFEVEATAVEPIFQRLYSYIFDMDSVGSSVTEMDRPVPSAIFIVNFDKVRVDPRNKEVNLDSSLYEKIPDLTEEDMKRQEGDYIYRYRYNGGGATQVWLSSGRFVVIDLSAGPCTYGKIEAEEGSVCSRTLPRLQNVIRPSSSSTTSHQSSNDIFLGQLASLVSTTVEHVIAPDVRFETVDLTSRLLVPIIVLQNHNRYNIMEKGHNYSINIEEIEAEVKSMLHDGQELVIIGGVHSLHRHEKLAIAVSKAMRGHSLQETKNDGRFHVHTKTYLDGAILKEEMERSADVLAAGLLEVSDPSLSSKYFLRQNWMDEPEGSTDSILKHKSLWDSYNSKYSQKRRKKVKKQGDLQPTYGTRVIPVFVLSLADVDPNLMMEDESMVWTSKDVVIVLEHQNKKIPL

SEQ ID NO: 137894 - protein, 224 aa, Glycine max
  Coding DNA Sequence Number=SeqID_21116
  Gene Ontology: Cellular component=membrane
  Homolog annotation: Hit_ID=Q10MF7; Match level="QueryCoverage=94%, HitCoverage=26%, E-value=3e-95, Identity=77%"; Hit description =Expressed protein
YVSETQRRHALPSQAQRHILAGLASVVGGLSAPYEKASHVHERPVVNWLWAAGCHPFGPFSNTSHISQMLLDVALRNSIYARVDSVLHKIRDTSETVQTFVAEYLKTPLGEPVKGKKEKSNTELWLEKFYKKTTNLPEPFPHELVDRIEKYLDGLEELLVDMSSLLYDHRLQDAYLNSSDILQSTMFTEQYVDHVLTSERDNMRCCKIEYKYPVLAGASGLVYF

SEQ ID NO: 137895 - protein, 212 aa, Glycine max
  Coding DNA Sequence Number=SeqID_21117
  Gene Ontology: Mol. function=calcium ion binding; Cellular component =plasma membrane; Biological process=epidermis development
  Homolog annotation: Hit_ID=Q9SWP6; Match level="QueryCoverage=66%, HitCoverage=91%, E-value=3e-50, Identity=73%"; Hit description =Hypersensitive reaction associated Ca2+-binding protein
  Pfam annotation: Domain name=efhand; Domain location=125-153; Score =28.1; E_value=3.2e-05; Accession=PF00036.22; Description=EF hand
  Pfam annotation: Domain name=efhand; Domain location=53-81; Score =27.0; E_value=6.6e-05; Accession=PF00036.22; Description=EF hand
  Pfam annotation: Domain name=efhand; Domain location=88-116; Score =25.9; E_value=0.00014; Accession=PF00036.22; Description=EF hand
  Pfam module annotation: Pfam domain module=efhand::efhand::efhand; Domain location=125-153::53-81::88-116
  Subcellular localization annotation: CTP_CleavageSite=62; ConfidenceScore=5.22e-01
MKRKQKGNDVIAYVTKHTHAFLFLSTHIANTLFLQSFQMCPSGRTLLPSSVSDFRPAFDVLDADRDGKISRDDLRAFYAGVGGGGDDVIGAMMTVADTNKDGFVEYEEFERVVSAERKPVGYCGAMEDVFRVMDKDGDGKLSHHDLKTYMACAGFPATDNDINAMIRFGGGDQNGGVTFDVYDMVIDGSLVVLGGMGGVETSRRGWGVRIGI

SEQ ID NO: 137896 - protein, 243 aa, Glycine max
  Coding DNA Sequence Number=SeqID_21118
  Subcellular localization annotation: CTP_CleavageSite=71; ConfidenceScore=5.44e-01
MKESQTPHKTHALARSSEKSNRRSQDSPNFNKAQRTSQNLTQFFRLCFLHIQFFMFIVAFIFCQIQTKCLNAALKSISEVPMNSSTISDTLYANRSEDATISLVEEGLKETLLPSDKIPSEKVIDEVGIVSIKCLYAYELESSMFPSTESEIAAIDLTNAKPKVFNSHNAAPQYKNLMDEITKYIIEDLYTNTVPEDFDRSYQLMSAKNRTVLLLFCTWLIGVLAIFFFTSDIHCPYRGPLPT

SEQ ID NO: 137897 - protein, 661 aa, Glycine max
  Coding DNA Sequence Number=SeqID_21119
  Gene Ontology: Mol. function=DNA-dependent ATPase activity; Cellular component=nucleus; Biological process=DNA replication initiation
  Homolog annotation: Hit_ID=Q8H0G9; Match level="QueryCoverage=88%, HitCoverage=68%, E-value=0.0, Identity=84%"; Hit description=MCM protein-like protein
  Pfam annotation: Domain name=AAA_5; Domain location=544-661; Score= -21.2; E_value=0.074; Accession=PF07728.4; Description=ATPase family associated with various
  Pfam annotation: Domain name=MCM; Domain location=486-661; Score =275.4; E_value=1.1e-79; Accession=PF00493.13; Description=MCM235 family
  Pfam module annotation: Pfam domain module=AAA_5::MCM; Domain location=544-661::486-661
MAPENPSTPDPESPTSPSVGFNTDQLPHTHTSHASQDDEASVDPDIVRDDIEEQPEEEEEDGEDLYNDNFLDDYKRMDEADQFESFGLDDSLEDDRDFDQIMQDRRAAEVELEARDGRASNRNKLPQLLHDQDTDDDNHRSSKRARADFRPSVASDDDFDGMQSSPGRSQRHSREDILMTDQTEDDRDDDDFDDGYEMYHVQGTLREWVTRDEVRRFIARKFKDFLLTYLNPKNEHRDKEYVWLINEMVSASKCSLEIDYKQFIYVHPNIAIWLADAPQSVLEVMEDVTKNVVFELHPNYRNIHQKIYVRITNLPVYDQIRNIRQIHLNTMIRIGGVVTRRSGVFPQLQQVKYDCNKCGAILGPFFQNSYSEVKVGSCPECQSKGPFTVNIEQTIYRNFQKLTLQESPGIVPAGRLPRYKEVILLNDLIDCARPGEEIEVTGVYTNNFDLSLNTKNGFPVFATVVEANYVTKKQDLFSAYKLTQEDIEEIENLAKDPRIGERIVKSIAPSIYGHDDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPVGG

SEQ ID NO: 137898 - protein, 87 aa, Glycine max
  Coding DNA Sequence Number=SeqID_21120
  Subcellular localization annotation: CTP_CleavageSite=62; ConfidenceScore=5.04e-01
MFGPRKVGPILMYTDSFSLAAQLASFCWCPSLLLSRNLFPTGQLHMVDPNLASVTVAILTIQEELGAPLIPNKKLKDAILKSTLRVR

SEQ ID NO: 137899 - protein, 479 aa, Glycine max
  Coding DNA Sequence Number=SeqID_21121
  Gene Ontology: Mol. function=RNA-directed DNA polymerase activity; Cellular component=extracellular region; Biological process=RNA -dependent DNA replication
MVIGDFNIVLNAHDRIGGSENPSWRGAHDFRDMMQNENVFGDIVKYKKKLLRDLDAISHKITHQGMHYLEERQRSIWHDYQEVLRHEELLWFLRSRTKWLSFGVQNTHYFHGVTAIRRHKNIYEAIQDAKNNWVTNGADLERPIILCNVSYKIFTKVMTARLRRVMEDLISSCQSTFILHGSTRDNIIIVQEWDFIVETLTGIGFPNNFIDMVRFCISSSKMQVMWNRKALESFKPSREIRQVNDTQLSRVGPRLSYLAFADNLLFFAEASIDQENIIKDSIATQLGYQRTADLGNYLGIPMHHQRISSKSFSFITKKVDQRLGNWKAKNLSLAGRVTLTKFVIQALPTYAMQSYYISASVCDEIDKRCCIFIWEDSNDSRKVHWTSWKALCSPKKSGGVSKVNCDGVVFIHEAIATWMASCSILEAKLWSIFYGMRLAEDCGVQHIIMESDSVEAVNHLMEHSYDNHPLFHLVQEIKR

SEQ ID NO: 137900 - protein, 620 aa, Glycine max
  Coding DNA Sequence Number=SeqID_21122
  Gene Ontology: Mol. function=nucleoside-triphosphatase activity; Cellular component=integral to membrane; Biological process=protein catabolic process
  Homolog annotation: Hit_ID=Q94ES0; Match level="QueryCoverage=99%, HitCoverage=73%, E-value=0.0, Identity=72%"; Hit description=AAA -metalloprotease FtsH
  Pfam annotation: Domain name=AAA; Domain location=380-569; Score =304.0; E_value=2.8e-88; Accession=PF00004.19; Description=ATPase family associated with various cellular activities (AAA)
  Pfam annotation: Domain name=AAA_2; Domain location=377-508; Score= -24.9; E_value=0.0007; Accession=PF07724.4; Description=ATPase family associated with various
  Pfam annotation: Domain name=AAA_3; Domain location=380-511; Score= -17.3; E_value=0.025; Accession=PF07726.2; Description=ATPase family associated with various
  Pfam annotation: Domain name=AAA_5; Domain location=380-515; Score= -1.0; E_value=0.0021; Accession=PF07728.4; Description=ATPase family associated with various
  Pfam annotation: Domain name=FtsH_ext; Domain location=161-354; Score= 47.1; E_value=5.8e-11; Accession=PF06480.5; Description=FtsH Extracellular
  Pfam module annotation: Pfam domain module=AAA::AAA_2::AAA_3::AAA _5::FtsH_ext; Domain location=380-569::377-508::380-511::380-515::161- 354
  Subcellular localization annotation: CTP_CleavageSite=54; ConfidenceScore=5.32e-01
MIFSRIARSVSSSSRARNLLHGDGRLGTHVGSPRTNACSEGAEGVLGSVRGYVSSARARSNGFVSNLPDFKSVAANPTIRRLFCSKAPKKENYGNFYPKEKKEVPKGNDKKYESKDNSNANTEDSGNFQEAFMKQVKYLVTPLLLMGLFLTSFSFGPPEQNQISFQEFKNKLLEPGLVDHIVVSNKSVAKVYVRNTPLNQTDNEVAQGTQPAIGSGGQYKYYFNIGSVESFEEKLEEAQEALGIYSHDFVPVTYSFELGYREWITLASILLLLGFLVCAVGFIKGAIDAARGKGAPGIFNIGKAPVTKVDRNAKNKVGRFLFLLSMRWLLIFSYFLQAGVLIYFKDVAGCDEAKQEIMEFVHFLKSPKKYEELGAKIPKGALLVGPPGTGKTLLAKATAGESGVPFLSISGSDFLEMFVGVGPSRVRNLFQEARQCSPSIVFIDEIDAIGRARRGSFSGANAERESTLNQLLVEMDGFGTTSGVVVLAGTNRPEILDKALLRPGRFDRQITIDKPDIKGRDQIFQIYLKKIKLDHEPSYYSQRLAALTPGFAGADIANVCNEAALIAARGEGTQVTMEHFEAAIDRIIGGLEKRNKVCLFKFYITISYACEMGEVELGVF

SEQ ID NO: 137901 - protein, 78 aa, Glycine max
  Coding DNA Sequence Number=SeqID_21123
  Gene Ontology: Mol. function=drug transporter activity; Cellular component=membrane; Biological process=multidrug transport
  Homolog annotation: Hit_ID=Q9FJ87; Match level="QueryCoverage=94%, HitCoverage=14%, E-value=2e-08, Identity=40%"; Hit description =Integral membrane protein-like
MYKRRKKRLLKLATKDEIAIPGTPRLSLKVRKVRVGRCRRMDSKVHHNSGQVVPLLRRKIRRGWRKLLAMRSGIAKRQ

SEQ ID NO: 137902 - protein, 185 aa, Glycine max
  Coding DNA Sequence Number=SeqID_21124
  Gene Ontology: Mol. function=drug transporter activity; Cellular component=membrane; Biological process=multidrug transport
  Homolog annotation: Hit_ID=Q2QNV0; Match level="QueryCoverage=90%, HitCoverage=38%, E-value=1e-53, Identity=62%"; Hit description=MATE efflux family protein
  Pfam annotation: Domain name=MatE; Domain location=1-149; Score =105.6; E_value=1.4e-28; Accession=PF01554.9; Description=MatE
  Subcellular localization annotation: CTP_CleavageSite=38; ConfidenceScore=5.27e-01
MTISAGYLDNPRVALATAGIVIQTTSLMYTLPTALSASVSTRVGNELGAGQGERANLSTVVAIGLALVSSIFGLLWTTMGRERWGRVFTSDSEVLQLTVAVLPIIGLCELANCPQTTSCGILRGSARPGIGAVINFCSFYLVGAPVAIVLAFYWKLGMARCLVGKASCGTFAYDEDQTDALKCEE

SEQ ID NO: 137903 - protein, 118 aa, Glycine max
  Coding DNA Sequence Number=SeqID_21125
  Subcellular localization annotation: CTP_CleavageSite=67; ConfidenceScore=5.06e-01
MEHATRGTARRTRQQQGSAPDAGASGSALLLGATGSAQRVGATGSAPDAGTTQACAWVVPASGALPVAPSGRALPDAPVSGALPCCCLVRRAVPRVACSMEAPSWGTLCNKKTDPLGK

SEQ ID NO: 137904 - protein, 37 aa, Glycine max
  Coding DNA Sequence Number=SeqID_21126
MQTLTADFEAIDLLQNQDNAKASLEVLATDIQFLRDQ

SEQ ID NO: 137905 - protein, 184 aa, Glycine max
  Coding DNA Sequence Number=SeqID_21127
  Gene Ontology: Mol. function=RNA-directed DNA polymerase activity; Cellular component=chromatin; Biological process=chromatin assembly or disassembly
MNDILQPFLRKFTTIFFDDILIYNESLSTHLTFGIGAQNLITRQVLSGTLQMLVCPMTIGVPRSCLIGFYRRLIKGYAAIASPFTTLLYRDKFHWLPKAQQAFDHLKRAMTKAPILVSLDFSSPFVLETNASGNATGAILMQQSRPIAFFSEQFSVILHQWFHCIPKLIYIHLSLNLSMMGGNH

SEQ ID NO: 137906 - protein, 38 aa, Glycine max
  Coding DNA Sequence Number=SeqID_21128
MAMVKVAIKNVCIANRSFPSTNILHNGIVISGTVGALD

SEQ ID NO: 137907 - protein, 54 aa, Glycine max
  Coding DNA Sequence Number=SeqID_21129
MGENGFAHQPNLIELCNLKKSTVESTQMESSIGFVVLPETQKIRQMLWELVIEK

SEQ ID NO: 137908 - protein, 55 aa, Glycine max
  Coding DNA Sequence Number=SeqID_21130
MSQLRANRVKDWIITKWAKVPSNKVPHQPKALDKFVVRKVTHHWPTKPFSTLFTL

SEQ ID NO: 137909 - protein, 57 aa, Glycine max
  Coding DNA Sequence Number=SeqID_21131
MVREKREFPKEEFSDFGCWSGLGPVYLRLAPSVHLAQVPVFELSTLSSLSAGTGVRA

SEQ ID NO: 137910 - protein, 305 aa, Glycine max
  Coding DNA Sequence Number=SeqID_21132
  Gene Ontology: Mol. function=nucleic acid binding; Cellular component= intracellular; Biological process=DNA integration
  Homolog annotation: Hit_ID=Q1S9T9; Match level="QueryCoverage=85%, HitCoverage=22%, E-value=3e-80, Identity=57%"; Hit description =Peptidase S8 and S53, subtilisin, kexin, sedolisin; Integrase, catalytic region; Zinc finger, CCHC-type
MKVKKFYVYIPKRDEEQVPAWIQIDRLKAMLSAEFEMKELGKAKRILGMDINKNRSKGKLFLSQQGYIKKVVEKFRMHESKPVSTPLGQHDNLSTKDAPNSDEERERMRLIPYSNGMGSIMYYMVCSRPDLAYVVNMVSRFMTNLRPKHWGALKWVFRYLNDSLSSSLKFKRKMKSEEPIKGYTNSNFAGNISTRKSLFAYVFTFFGTVVSWRSVLQLVLALSTTEAEFIALTKAVKEARVELSFQNNKFNMKSLSTLMSGYTSFKMLLKPRRFWLRRFHTKIFVLNHNMFHGNFYLSHLLQILA

SEQ ID NO: 137911 - protein, 51 aa, Glycine max
  Coding DNA Sequence Number=SeqID_21133
  Gene Ontology: Mol. function=heat shock protein binding; Biological process=protein folding
  Homolog annotation: Hit_ID=Q6K8D7; Match level="QueryCoverage=90%, HitCoverage=35%, E-value=2e-14, Identity=70%"; Hit description=DNAJ heat shock N-terminal domain-containing protein-like
MGLFLSDPVKRREYDINGMRYEYDYNIIDYLNRYKGLILTCNGLGIKHSIW

SEQ ID NO: 137912 - protein, 1247 aa, Glycine max
  Coding DNA Sequence Number=SeqID_21134
  Gene Ontology: Mol. function=DNA binding; Cellular component=beta -galactosidase complex; Biological process=DNA integration
  Homolog annotation: Hit_ID=Q1S3I6; Match level="QueryCoverage=96%, HitCoverage=91%, E-value=0.0, Identity=54%"; Hit description =Integrase, catalytic region
  Pfam annotation: Domain name=rve; Domain location=584-697; Score =48.1; E_value=3e-11; Accession=PF00665.16; Description=Integrase core domain
  Pfam module annotation: Pfam domain module=RVT_2::rve; Domain location=861-1118::584-697
MVISYSDFATNPSNPYYMHPNENPSLVLVQPVLDNKNYQIWCRSMKVALISKNKVKFVDGTLSPPPISDPLYEPWLRCNNLVLSWLQRSISEEIAKSLLWCDRASLVWKSLANRFSQGDIFRVADIQEEVARLQQGTLDISSYFTKLMTLWEEIENFRPIRDCTCAIPCSCGAATDLHKFKEQDKVIKFLKGLGDQYSHVRSQIMLMSPLPTLDNAFNLILQQERQFNLPSTTDSSIENQSSVNHFSQTPSRPSNNSGRGRGRGYSSGGRGNRLCTHYNHTNHTVETCFIKHGYPPGFQHRKSNSSGNAFVVNSTQDAGSAHISSSSSASTSTNGSSASLSTIQEQYTQILQLLQQSNLQSTSPSSVNSVFATNSVSHTSPSPSSGKHLSNNTSHWWIADTGATDHITHIFDSFSSTYHIAPKTMTMPNGDTVTTTIAGSVLLYDSLVLHNVYYFPSFHVNIISVTTLFDSTLYDVKLYPNCCKIVQLRHPKMTGFTARRIGKLYVLDTTSPLVFSPTPGSVNTSISHDPATIWHFRLGHLSSHIHKCISSYFPFVTFNDNHKPCNTCHLAKQRNLPFAHSTTKSVAIFDFIHADIWGPLSTPSISGHKYFLTLVDDYSSFYLTKGIIHHRSCVETPQQNGIVERKHQHILNVARALSFHSHLPHNLWHLSIQQAIHIINRLPTPLLNNLTPYQMLHFIPPSLHHLRVFGCLAYSSTLHNHRTKFAPKARKSIFLGYREGTKGYLLYDPITHEFYVSRNVIFHEIVFPFASPPPANNPVSVNPDIATLDTSDILLDLPLSLPPPNEPTSPPAPTRKSHRLTKPPSYLSEYHCNFLSSMLPASNPEPKTYKQACKFDCWNLAMKSELDALASTNTWSVVDLPEGKQPIGCKWVFKIKHHADGSIEQYKARLVAKGYTQLEGVDYFDTFSPVAKLTTIRTLLSVAAIKDWHLEQLDVNNAFLHGDLHEEVYMDLPPGFLPPGSSSNKVCKLHKSLYGLKQASRQWFSKLSTALISLGYSPSSADHSLFTKLHNSHFTALLVYVDDIVLTGDDLQEIQSVKQFLDSTFKIKDLGKLKYFLGLEIARSTQGIFLNQRKYALELLEDSGLLATKPSTTPFDCSLKLHDSDSPPYEDETAYRRLVGRLLYLTTTRYDIAFIVQQLSQFISQPLQVHHSAAIRVLKYLKSAPAKGLFYSSSSTQTLWFCRLRFGKLPCYSQISDWLLCLSWHIYAVLEIQKAVHNIPVKFRSRI

SEQ ID NO: 137913 - protein, 453 aa, Glycine max
  Coding DNA Sequence Number=SeqID_21135
  Gene Ontology: Mol. function=nucleic acid binding; Cellular component= nucleus; Biological process=DNA integration
MSTNRMFILLDESSNITPPIEECLHTSSDLTYLWHQRYGHLSYKELKTLQTKKMVRGLPQLEASNVPCEDCFVGKLHRNPIPKKSESRANKVLKLIHADICRPIEPISNSGKRYLLCFIDDYSRMGWVYLLFEKSKALECFKIYKKLVEKENITPQEAWSGVKPSVEHLRVWGCMACVHIPEAKRGKLDDKSFPCILLGVSDESKGYHFFDPKTKRIVVSKDVVFEEQKSWDWGPNYKEQIEAELVWGDDGFSSDESEGEYRDEVVGDRLQEDMEFNNGDDNDGNNMRGSEAESSQENVIEGRVRRTPTWMEGFVSGEGLSEEEAEAYMLGDMIRDYLTLFEEAVTHEKWRKAMDSEISSIEKNQTWELMDVPTGAKTIGMEWIFKTKLNELGEVDKYKVRLAAKGYSQQHGIDYSEVFAPVARMDTIRMIVALAACRTSFSWMSNLHSYMEN

SEQ ID NO: 137914 - protein, 448 aa, Glycine max
  Coding DNA Sequence Number=SeqID_21136
  Gene Ontology: Mol. function=oxidoreductase activity; Biological process=metabolic process
  Homolog annotation: Hit_ID=Q9PCN7; Match level="QueryCoverage=53%, HitCoverage=82%, E-value=7e-93, Identity=69%"; Hit description =Daunorubicin C-13 ketoreductase
TQTVSLHQDIGDARRFEQHAPFRDDNQECMHGDNRKNKQNRSDSHCIRKASPVHPAGIKKPVGKRRRANKALSSSLRQAHPAGARQLRQQRRLKRLVVYRRVRFEALLMVPIAAGRQSLRLIAAHQPRLRHMPQRQIVGRIRAAHFGRHPAGIDRAADHVRPQARHGGGQRGDEQFAVRIGAGCAAEPVHAAQFRHAVKVHAAAQIDDTLGAFDQGRQQVGRNDVHRHHLRPGKHTGVVDHRVRAAEAVDLLGKLPDLLHIGQIADRRLCAAIPQIAHRVQTAGLTRMQNYLMPFVQQRLRGGAAQPVYRTGNENAHGQQQRIRFGDGLVLRQLLDQLVRLGGIAAAEDRPGLRVDIPQLIALLAAAAEVVAIPLIHQREDAAADGNPRLARMARLLPGGAVGADLLGLLDMEGFAGFVVLERRALQVHAQLRRPDGGGVRTGAPPDA

SEQ ID NO: 137915 - protein, 191 aa, Glycine max
  Coding DNA Sequence Number=SeqID_21137
  Gene Ontology: Mol. function=RNA-directed DNA polymerase activity; Biological process=RNA-dependent DNA replication
MTRAGKGIFHGEDCFLTMKLILPSVSLESAYNLIWEEIAGGQKEDCSMELWKTKIPSKIATAHKAESAKKEHTDHLFIHCIKIQPIWWESMSWMNIKGAFPFSPKQHFMQHISIQMEGLRAKRWRYWWLPVTWSIWKLRNKILFANAEFDTNRLFEDAIFIIWTWLRQFEKDFTIHYNQWSSNIRQGFLFL

SEQ ID NO: 137916 - protein, 183 aa, Glycine max
  Coding DNA Sequence Number=SeqID_21138
  Homolog annotation: Hit_ID=Q1S0F5; Match level="QueryCoverage=96%, HitCoverage=40%, E-value=3e-07, Identity=27%"; Hit description=IMP dehydrogenase/GMP reductase
MGSSQKPSLKKRFYPVKVKSLGITSLRELGQLMGQLQRQAFRKVYGKIWDLARDFQLVPTVKEFEEILECPLGGRKPYLFSGFYPSTTRVAKVVKISAQELDRVKQNRNGVVGVPRKCFEERQRPWQNQGEWASFIDILALLIFGGVLFPNMEGLVDLAAIDAFLAFHHGKEIPVVAILAMPD

SEQ ID NO: 137917 - protein, 62 aa, Glycine max
  Coding DNA Sequence Number=SeqID_21139
MAFQRGKRLTFPFFHIIFKLVQINNKVISAQTRVFKLMRILKLAKYRLKAQVEKDEGPSGEG

SEQ ID NO: 137918 - protein, 122 aa, Glycine max
  Coding DNA Sequence Number=SeqID_21140
MEIKCTTESKRVGKKKTNTQEFLYWFGNNPCLHPVPKRLAVLEISFNLVKILLQAKIHKGWRRETQKEFRRLVLGEFFLAKGEENEKMNSISFQGLENQKTSESFWYKEEEEVQRDSRLVKD

SEQ ID NO: 137919 - protein, 76 aa, Glycine max
  Coding DNA Sequence Number=SeqID_21141
MAWGVGEEGEATVPDGGEEGKGGVVEDASVEADMWEKKESNEDSTSEGFNPFSVSLTFGNSIGVVEGKTGGISGNR

SEQ ID NO: 137920 - protein, 585 aa, Glycine max
  Coding DNA Sequence Number=SeqID_21142
  Gene Ontology: Mol. function=nucleic acid binding; Biological process= multicellular organismal development
  Homolog annotation: Hit_ID=Q1SWB7; Match level="QueryCoverage=85%, HitCoverage=65%, E-value=1e-121, Identity=50%"; Hit description =WW/Rsp5/WWP; Paraneoplastic encephalomyelitis antigen
  Pfam annotation: Domain name=WW; Domain location=373-402; Score=49.1; E_value=1.5e-11; Accession=PF00397.16; Description=WW domain
MALAAINALNGIYTMRGCEQPLIVRFADPKRPRQGDSRGLAFGGPGFGPRFDAPGTRHPSNITDPIGDRMPPPNAWRPMHPPNVGPPSNAGLQGMGPPLISRSGDMALPTNAAMGSNLGNNLSNFEGGPMTSLGGPIDGRFQVQSMPMSQQNFNQPMPQIPPVNQQISPLQKPVQSSQELPHSHQLYPQAPVPYPQTSLRQHAQPQLPLPSQQVHGVSGQFPTSQPQTQQSALSAAIPQTNLETGMQSNAALTTPNQQQVPPSVQQQPLQQSPSPLAQMLSQQTQTLQASFHSSQQAFSQLQQQLQMMQPSSQALTFQQNAEATKKQSQWAGPGTAVAQAVASTRAAAPAADVPSSTPANSALPAINQNMALVKCNWTEHISPEGFKYYYNSVTGESRWEKPEELVLYEQKKQQQRPSVQQSQTQSQPSILPAQQVPQIQHVQPQSHLQGQVLHQQQIQHPSSLSSSAYGVTGPQNVQEVGYKQLQASVISAGDPGRYSQVEYLNAFAMNVEERIVRLGYAANTDVTASKGRDNHLHFDASKSVFCDMLMFWDNSSVAFCNIARQERFVPSRSSVELKELMAFIH

SEQ ID NO: 137921 - protein, 1233 aa, Glycine max
  Coding DNA Sequence Number=SeqID_21143
  Homolog annotation: Hit_ID=Q9FKP6; Match level="QueryCoverage=79%, HitCoverage=88%, E-value=0.0, Identity=56%"; Hit description =Arabidopsis thaliana genomic DNA, chromosome 5, P1 clone:MNA5
MFTEGLDRNALRWVREKEVPFSNTALRSRNDPISGMKSGAGRGFGLPPPSKFRSGHLPANAIPVSTVMLGETGDSGSNSDNDDSIESEEEVYGGRYSLDSSPQDRRVPNGAARRYGNLTGPRYASDYTYSEVSSSRETLVGRPGTVRDPLMRGATNVRQSGFTEDDSSDSAASSEFSTTQVGGSINGALPRGRTYLSEGYASSVPSRMNVKSAAEKNGRISDDEEDDIPSAPPFAGSTQEIRQTHEEIPASRVDATPNKAESSSLKSMSGDKIENHVENGSPDQFARTATGSEAATSSNSHPPRLPTFHASALGPWHGVIAYDACVRLCLHAWAMQCMEAPMFLENECALLRDAFGLRQILLQSEDELMVKCNAEPSSEGVAPKPKKLIGKMKVQVRKVKMGLDPPTGCSMSSIMTHNIKMESVRHRFSNLQSSLSAGWQALRRIRFLPRLPANGSLARQSLAYVHASTRYIQQVSGLLKVGVVTTLRNNSSSYEVGQETYSCFLRLKSTVEEDAIRLQPGSSEVHMFFPDSLGDDLIVEVQDSKGKHFGRVLVQVAAIADDPADKLRWWPIYREPDHELVGKLQLYINYSTSADDNSHLKYGSVAETVAYDLVMEVAMKIQGFQQRNLLLQGPWKWLLTQFASYYGVSEIYTKLRYLSYVMDVATPTADCLNLVYNLLAPVIMKGNSKTSLSHQENRILGETKDQIEQILTLVFENYKSLDESSFSGIIEVFRPATGQAAPALEPAVKLYKLLHDILSPEAQTAFCHYFQVAAKKRSKRHLSETDEYITQNNESSLMDGMAMSTTYQKMKTLCINLRNEIHTDIQIHNQNILPSFVDLPNLSASIYSTELCNRLRAFLISCPPMGPSSPVAELVIATSDFQRDLVSWGIDSIKGGVDAKELFHLYILVWIQDKRLSLLESCKLDKVKWSGVRTQHSTTPFVDDMYERLKETLTDYEVIICRWPEYTLVLENAIADIEKAIVEALDKQYADVLSPLKESMGPKKFGLNKYVQKLAKRSTCAYVVPDELGILLNSLKRMLDSLRPRIESQFKTWGSCLPHVGNTTPGERLSEVTVMLRAKFRNYVQAIVEKLAENAKLQNTTKLKKILQDSKETVVESDLRTRMQPLKDQLASTISHLHTVFETHVFIAICRGYWDRMGQEILSFLENRKENRSWYKGSMVAVSILDDTFASQMQQLLGNALHEKDLEPPRSIMEVRSMLCKDAPNHKDNTFYY

SEQ ID NO: 137922 - protein, 320 aa, Glycine max
  Coding DNA Sequence Number=SeqID_21144
  Gene Ontology: Mol. function=glucose-6-phosphate isomerase activity; Biological process=gluconeogenesis
  Homolog annotation: Hit_ID=Q68HC8; Match level="QueryCoverage=63%, HitCoverage=43%, E-value=5e-82, Identity=63%"; Hit description =Glucose-6-phosphate isomerase
DLHISLDQPISVYCDNKSAIYLAHNPIFHERTKHIEIDCHVIREKIQTGLIHLLPVSSAAQLADVLTKPLPAPSFNSLISKLGLLDIHSPACGGLLHDQQLVMESLGKEFDLDGNRIRNNPAALLALCWYWATDGVGSKDMVILPYKDSLLLFSRYLQQLVMESLGKEFDLDGNRGTRSALYANNRESITVTVQEVTPRSVGALIALYERAVGIYASLVNINAYHQPGVEAGKKAAGEVLALQKRVLAVLNEARYSEPVEPLTLEEVADLCHAAEDIEMIYKIIAHMAANDRALIAEGNCGSPRSIKVFLGECNLDELYA

SEQ ID NO: 137923 - protein, 34 aa, Glycine max
  Coding DNA Sequence Number=SeqID_21145
MAAPLHTGLQSMLKAAVESVRWVYGIFWQLSPQQ

SEQ ID NO: 137924 - protein, 415 aa, Glycine max
  Coding DNA Sequence Number=SeqID_21146
  Gene Ontology: Mol. function=nucleotide binding; Cellular component =membrane; Biological process=small GTPase mediated signal transduction
  Homolog annotation: Hit_ID=Q10MD7; Match level="QueryCoverage=85%, HitCoverage=83%, E-value=1e-125, Identity=66%"; Hit description=XPA -binding protein 1, putative, expressed
  Pfam annotation: Domain name=ATP_bind_1; Domain location=55-295; Score=360.0; E_value=3.8e-105; Accession=PF03029.7; Description =Conserved hypothetical ATP binding prot
  Pfam annotation: Domain name=MMR_HSR1; Domain location=51-223; Score=- 10.8; E_value=0.0098; Accession=PF01926.13; Description=GTPase of unknown function
  Pfam module annotation: Pfam domain module=ATP_bind_1::MMR_HSR1; Domain location=55-295::51-223
MNADNGSRDAKLDNQHAKDKEKEELTENMNKLHIEGSSSGSGSSSFRRKPVIIIVVGMAGSGKTTLMHRLVCHTHLKDIRGYVVNLDPAVMTLPYAANIDVRDTVKYKEVMKQFNLGPNGGILTSLNLFATKFDEVISVIEKRADQLDYVLVDTPGQIEIFTWSASGAIITEAFASTFPTVVAYVVDTPRSEDPTTFMSNMLYACSILYKTRLPLILTFNKVDVAAHQFALEWMEDFEAFQTAASSDHSYSSTLTQSLSLVLDEFYNNLKSVGVSAVSGVGMEAFFNAVEASAEEYMETYNIYSRVFEMTNQITSLYRALFRADLDKRREEKQRLEEDRRKESMDKLRRDMEKSGGETVVLSTGLKDKEASKSMMDEEDEDEEMDDDDDDDLGIYTEEEDAIDEDEDEEVDRFGF

SEQ ID NO: 137925 - protein, 140 aa, Glycine max
  Coding DNA Sequence Number=SeqID_21147
  Gene Ontology: Mol. function=enzyme inhibitor activity
  Homolog annotation: Hit_ID=Q1SWB9; Match level="QueryCoverage=98%, HitCoverage=75%, E-value=6e-40, Identity=60%"; Hit description =Pectinesterase inhibitor
  Pfam annotation: Domain name=PMEI; Domain location=1-126; Score=9.7; E_value=0.0023; Accession=PF04043.6; Description=Plant invertasepectin methylesterase inhibitor
MTLRSSIHHRSKADIAGFAHLTLEIVNANASITLEHIPKFHGQTEDPKLKMALKDCLVSYNTIVKVHLREALNAMDVGDYRAVQQKAYVTIIEAESCNTKFRNLATSPLRDTNRYVQNLCAIAISIAKKLVLPYQLPTSI

SEQ ID NO: 137926 - protein, 138 aa, Glycine max
  Coding DNA Sequence Number=SeqID_21148
MVLKGEEFRGMNSDSVEVEWESKTASNLVVCYCHGQRMKEKANVKTYKNIMQIVNVDDGVSSSSSSGPIVEYGVPLTRCITQVVEEARTSTRSTMHHFLVRFSRAQTQAAPSSGRSAPTTRRSKPWALETFKVNNFTL

SEQ ID NO: 137927 - protein, 185 aa, Glycine max
  Coding DNA Sequence Number=SeqID_21149
  Gene Ontology: Mol. function=ribonuclease H activity; Cellular component=nucleus; Biological process=RNA-dependent DNA replication
  Homolog annotation: Hit_ID=Q1SZM6; Match level="QueryCoverage=69%, HitCoverage=42%, E-value=6e-25, Identity=43%"; Hit description =Ribonuclease H
  Pfam annotation: Domain name=RnaseH; Domain location=52-167; Score= -9.0; E_value=0.0004; Accession=PF00075.14; Description=RNase H
MDSESIPQCQTKHAHRDCPKSARFWNHLRLDVNLQDQDMEAPNWLRFFCMGNLGVSGIGGIIRDSNGSWVQGFAGLCEVKTNLYAELLAILKVLQMAWDYNGQALIYESNSRTALSLTLHGADHTHHYFPLISRIRSFLHHPWELSFQHEFREANYCADWLAKLGASSANHPLVFYSCPIAMAHL

SEQ ID NO: 137928 - protein, 93 aa, Glycine max
  Coding DNA Sequence Number=SeqID_21150
  Gene Ontology: Mol. function=phosphotransferase activity, alcohol group as acceptor; Cellular component=cytoplasm; Biological process =carbohydrate phosphorylation
  Homolog annotation: Hit_ID=Q1SWC0; Match level="QueryCoverage=62%, HitCoverage=11%, E-value=4e-25, Identity=94%"; Hit description =Mevalonate and galactokinase
  Pfam annotation: Domain name=GHMP_kinases_N; Domain location=41-92; Score=19.0; E_value=0.0042; Accession=PF00288.16; Description=GHMP kinases N terminal domain
MKGLMDRCGDFLFWVNKKEYKGFHDYAKLKGVNVGEPVGLEVLVDGTVPTGSGLSSSAAFVCSSTIAIMAAFDVNFPKSYDKELLLEFYVPFK

SEQ ID NO: 137929 - protein, 78 aa, Glycine max
  Coding DNA Sequence Number=SeqID_21151
MGSVCSAEKNKNKEVGGKTLGKKLKKLKSIAKGKGDCYSNSRTSDRGTKQKERNSGFSSEFNLSNPSRKEGKEGLSLC

SEQ ID NO: 137930 - protein, 178 aa, Glycine max
  Coding DNA Sequence Number=SeqID_21152
  Gene Ontology: Biological process=response to stress
  Homolog annotation: Hit_ID=Q9SWV2; Match level="QueryCoverage=93%, HitCoverage=86%, E-value=5e-51, Identity=62%"; Hit description=ER6 protein
  Pfam annotation: Domain name=Usp; Domain location=6-171; Score=12.3; E_value=0.057; Accession=PF00582.16; Description=Universal stress protein family
MSSGGNLSCVLVAVDGSEESMNALRWALNNLKLRSPAPDSTDAPSFTVFHVQSPPSIATGLNPGAIPFGGPSSVHYILSNSHPNLSIQSLSLSDLEVPAFTAAIEAHQKRITNAVLDHALGICSEFNLTSKVRTHVLVGDPKEKICEAVQDLNADVLVMGSRAFGPIKRYKLTSDKSA

SEQ ID NO: 137931 - protein, 100 aa, Glycine max
  Coding DNA Sequence Number=SeqID_21153
MESHPLNVATIMMRLMTHFVCDLSVAKMKSFKNVQMLELRFRSEFFFFFPDLRWSNFNTGDVESEWFLYSDATTVFQAAMKGFVVVMTGWCRRGRSGCKL

SEQ ID NO: 137932 - protein, 189 aa, Glycine max
  Coding DNA Sequence Number=SeqID_21154
  Gene Ontology: Mol. function=enzyme inhibitor activity
  Homolog annotation: Hit_ID=O49908; Match level="QueryCoverage=78%, HitCoverage=89%, E-value=2e-30, Identity=46%"; Hit description =Invertase inhibitor precursor
  Pfam annotation: Domain name=PMEI; Domain location=30-174; Score =105.4; E_value=1.7e-28; Accession=PF04043.6; Description=Plant invertasepectin methylesterase inhibitor
MESLALIFYSTLVLATISVPATNSRIIHQKNNANLIEETCKQTPHHDLCIQYLSSDPRSTEADVTGLALIMVNVIKIKANNALDKIHQLLQKNPEPSQKEPLSSCAARYKAIVEADVAQAVASLQKGDPKFAEDGANDAAIEATTCENSFSAGKSPLTNHNNAMHDVATITAAIRMGCDMPLSCASTFF

SEQ ID NO: 137933 - protein, 320 aa, Glycine max
  Coding DNA Sequence Number=SeqID_21155
  Gene Ontology: Mol. function=peroxidase activity; Cellular component =vacuole; Biological process=response to oxidative stress
  Homolog annotation: Hit_ID=Q1SWB6; Match level="QueryCoverage=95%, HitCoverage=95%, E-value=1e-139, Identity=78%"; Hit description=Haem peroxidase, plant/fungal/bacterial
  Pfam annotation: Domain name=peroxidase; Domain location=50-284; Score=418.3; E_value=1.1e-122; Accession=PF00141.13; Description =Peroxidase
MQLVLLCLLILKLTPAFATTPNDAYGGDSSGCPLGTDIYQYTCPEAEAIIFSWVEQAVSQDSRMAASLLRLHFHDCFGCDASVLLDDTQDFVGEKTAGPNLNSLRGFEVIDQIKSELELVCPQTVSCADILATAARDSVLLSGGPIWEVQMGRKDGITASKNAANNNIPGPNSTVDVLVAKFENVGLTLKDMVALSGAHTIGKARCRTFRSRLQTSSNIDFVASLQQLCSGPDTVAHLDLATPATFDNQYFVNLLSGEGLLPSDQALVNGNDQTRQIVENYVENPLAFFEDFKLSMLKMGSLASPTQTNAQIRRNCRTIN

SEQ ID NO: 137934 - protein, 163 aa, Glycine max
  Coding DNA Sequence Number=SeqID_21156
  Gene Ontology: Mol. function=nucleic acid binding; Cellular component= oxygen evolving complex; Biological process=DNA integration
  Homolog annotation: Hit_ID=Q1S4N1; Match level="QueryCoverage=95%, HitCoverage=14%, E-value=4e-57, Identity=63%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MLVVKGYAQVFGVDYFDTFAPVARLDTIRMLLAITTQKQWKIYQFDVKSAFLNGFLKEEIYVEQLEGFAAKGDEDKVYLLKKALFGLKQAPRAWYSRIDEYLLGFVKSFIIGCNIELIQQFKEDMMQVFEMTDLGETSYFLGIEIKQRQNEIFICQQSMQGRS

SEQ ID NO: 137935 - protein, 269 aa, Glycine max
  Coding DNA Sequence Number=SeqID_21157
MVLTCVITDKDFYLYMNYENMTSEITLSLLKRKCFYIDRPIKCHVIDPREIDFERPGSALQKNWGKRREEAERNILWFLDLKMKATKELSQHVEENEVTVLVDEEEDEEYESEDEVVDDGEDDEDDDDDDDDDDDNEDEEDDDEDDAPDGGDDDDDEDEEEESDVQRGGEPDDDDNDDDDEDEDEEDEEEQGEEADLGTEYLIRPLVTAEEEEASSDFEPEENGEEEEEDVDDEDGEKSEAPPKRKRSDKDDSDDDDGGEDDDERPSKR

SEQ ID NO: 137936 - protein, 501 aa, Glycine max
  Coding DNA Sequence Number=SeqID_21158
  Gene Ontology: Mol. function=hydrogen ion transporting ATP synthase activity, rotational mechanism; Cellular component=proton -transporting two-sector ATPase complex; Biological process =intracellular signaling cascade
  Homolog annotation: Hit_ID=Q69T67; Match level="QueryCoverage=61%, HitCoverage=40%, E-value=1e-120, Identity=58%"; Hit description =Lustrin A-like
  Pfam annotation: Domain name=DUF231; Domain location=326-491; Score =213.3; E_value=5.7e-61; Accession=PF03005.6; Description=Arabidopsis proteins of unknown function
  Subcellular localization annotation: CTP_CleavageSite=15; ConfidenceScore=5.36e-01
MDSCSKRLAFSEPFMSQRRKVISGFSLGVGVSLLFLTLILLNNTSLSVPKVQVFLQGSDSNSSSSSFSWRFPFTTTLSSNASVSPLHRVEVNVSSSEGSEKSSEETLLGNLTGDQKNASLHDGHEEDDEHCCSLKNVTLAVKENAQVGNSSCNGGGSGVGKCEDGLLMKESNNNDSISVSGLLGECDIFDGKWVRDESKPYYPLGSCPHVDRDFDCHLNGRPDSEYVKWKWQPNGCDIPSLNATDFLEKLRGQKLVFVGDSLNRNMWESMDYNCSVDFVSSPFIVQESNFKGINGSFETLRLDLMDQTSTTYRDADIIVFNTGHWWTHEKTSRGEDYYQVGNHVYPRLKVLDAYTRALTTWATWVDNNIDANRTQVFFRGYSVTHFRGGQWNSGGKCHKETEPISNGKHLRKYPSKMRAFEHVVIPKMKTPVIYMNISRLTDYRKDGHPSIYRMEYKTAEEQTAAEQHQDCSHWCLPGVPDTWNELLYVSLLKYGKGHWKS

SEQ ID NO: 137937 - protein, 533 aa, Glycine max
  Coding DNA Sequence Number=SeqID_21159
  Gene Ontology: Mol. function=transferase activity; Cellular component= integral to membrane; Biological process=transport
  Homolog annotation: Hit_ID=Q5ZCH7; Match level="QueryCoverage=94%, HitCoverage=93%, E-value=0.0, Identity=70%"; Hit description=O -acetyltransferase-like
  Pfam annotation: Domain name=Cas1p; Domain location=98-337; Score =547.9; E_value=1e-161; Accession=PF07779.2; Description=Cas1p-like protein
MCKNESSLRSCCHDFLRKLFLFSRQSDINLVEIGSDVVKDEDRAALLEGGALQSGSPKARSLTASPSIIRFLLMDEYFLLENRLTLRAMSEFGLILAYFYLCDRTDFFASSKKSYNRDLFLFLYFLLIIVSAMTSFKIHHDKSPLSGKSILYLNRHQTEEWKGWMQVLFLMYHYFAASEIYNAIRLFIAAYVWMTGFGNFSYYYVRKDFSLARFAQMMWRLNFFVVFSCIVLNNSYMLYYICPMHTLFTLMVYGALGILHKYNEIGSVIAVKIIGCFLVVILVWEIPGVFEWLWSPFTFFLGYTDPNPAKSHLSRLHEWHFRSGLDRYIWIIGMIYAYYHPTVERWMEKLEEAEIKRRISIKATVVLICSLVGYLWFEHIYKLDKVTYNKYHPYTSWIPITVYICLRNVTQSFRSYTLTLFAWLGKITLETYISQIHIWLRSGIPDGQPKLLLSLIPDYPMLNFMLTTSIYVAISYRLFDLTNTLKMAFVPSKDDKRLVHNLITATTISVVLYSLSLGFLRVPQMLVRVIAIT

SEQ ID NO: 137938 - protein, 133 aa, Glycine max
  Coding DNA Sequence Number=SeqID_21160
YVSGSLSDEGKVELGGDSGKSESSLEKGLVDRSDASDVDAKVDNMARCFRTNQRILVLSAAKVAKKMKLKFTKEWIAYLRLPLPIDVYKEVIHKCLKVVMRSNVGLEGGKKHKWWNCKINSAYGLLFFIQNLY

SEQ ID NO: 137939 - protein, 232 aa, Glycine max
  Coding DNA Sequence Number=SeqID_21161
  Gene Ontology: Cellular component=integral to membrane; Biological process=polysaccharide biosynthetic process
  Homolog annotation: Hit_ID=Q46633; Match level="QueryCoverage=99%, HitCoverage=60%, E-value=4e-26, Identity=31%"; Hit description =Amylovoran biosynthesis protein amsC
MNQIRFGLCSAFLMGFVWHMSRRSKSGMITTFILSFISHATAIVALLIPLAMIVRKNKYIPIAIVVASLPLAFLGSSALIAALSSHLGALGDRAMGYADADSRQEQGILTLSNLKNIGFVFIFSYMLLSDKIKNFDPEKFNTYYILVITFAIGSGLRMALQDYASGGRLANYLLQVEPVLISLCIWETRKLKKVLAVAVTILMVLYYLYYNTVSSKQSIVGYEVSRTFQLFR

SEQ ID NO: 137940 - protein, 102 aa, Glycine max
  Coding DNA Sequence Number=SeqID_21162
QKNVYTDNHSGISARQHDSKVSMTDLVSAEDDVNLRVSTGLSAAIDEGCRMTTLAAACHRACRLWMTKGYLRVSSGPPPPDDTRGADNRKVSPRVIGPAASG

SEQ ID NO: 137941 - protein, 266 aa, Glycine max
  Coding DNA Sequence Number=SeqID_21163
  Homolog annotation: Hit_ID=Q49N12; Match level="QueryCoverage=39%, HitCoverage=10%, E-value=5e-22, Identity=51%"; Hit description =Putative receptor-like protein kinase 2
  Pfam annotation: Domain name=KH_1; Domain location=1-57; Score=57.1; E_value=5.6e-14; Accession=PF00013.19; Description=KH domain
VGLIIGRGGETIKSLQSKSGARIQLIPQHLPEGDDSKERTVQVTGDKRQIQIAQELIKEVMNQVNILFAVELLPPHIACKVLLFWISSCNMVLKRKGYPNAIKLVLCACPGNAEKEKEIKNNERMEQYNLNELPFLVTFLLCLNLLMVSNSDPLLLVTDVESLHINCGGKQVVVGDITYDEDMDSAGPTVFKQSRNNWTFSNTGHFVVNDTLAKQGKLPAYATENETRLYMTDAELYKNARISPISLTYYGFCLENGDYTVKPYFA

SEQ ID NO: 137942 - protein, 116 aa, Glycine max
  Coding DNA Sequence Number=SeqID_21164
  Gene Ontology: Cellular component=integral to membrane
  Homolog annotation: Hit_ID=Q9FGZ2; Match level="QueryCoverage=83%, HitCoverage=61%, E-value=2e-29, Identity=64%"; Hit description =Arabidopsis thaliana genomic DNA, chromosome 5, TAC clone:K6M13
  Pfam annotation: Domain name=DUF786; Domain location=11-104; Score =105.3; E_value=1.8e-28; Accession=PF05646.4; Description=Protein of unknown function (DUF786)
MAGPFELGSSKKKPGDGVNDLLTFNAENMQSNMKIIYYSRTFLSIIGGVVAGILGFTSLKGFVFYFLLMMVTSLGLVAKARFSIHSYFDSSNRVLLDGFLGGLMEGSKIKYARHPP

SEQ ID NO: 137943 - protein, 128 aa, Glycine max
  Coding DNA Sequence Number=SeqID_21165
MLKATIINNLNPHSHKEGPVYITITLSKQKKSHSLESDSHSHQNSNFSLTQFNEHQTKQNPDAKIASFFATTKPSWKMENLNPSKRIAGNKKEVRAWSRSTLTTQPKKRTKHRTKQNAKVDTNVDAQL

SEQ ID NO: 137944 - protein, 238 aa, Glycine max
  Coding DNA Sequence Number=SeqID_21166
  Gene Ontology: Mol. function=translation initiation factor activity; Cellular component=transcription factor TFIID complex; Biological process=transcription initiation
  Homolog annotation: Hit_ID=Q10JT5; Match level="QueryCoverage=63%, HitCoverage=67%, E-value=2e-49, Identity=66%"; Hit description =Transcription initiation factor IID, 31kD subunit family protein, expressed
  Pfam annotation: Domain name=Bromo_TP; Domain location=88-165; Score =6.8; E_value=0.027; Accession=PF07524.3; Description=Bromodomain associated
  Pfam annotation: Domain name=TFIID-31kDa; Domain location=82-210; Score=151.7; E_value=1.9e-42; Accession=PF02291.6; Description =Transcription initiation factor IID, 31
  Pfam module annotation: Pfam domain module=Bromo_TP::TFIID-31kDa; Domain location=88-165::82-210
MRLFKTPATVEDGIVVVMARVVQGREGSKKEDAGSKSLEQPVDSLGSIRTVGYDKAQWQKEEFLCPFLLLTIRNSESDSVGGMGDKEEESAMPRDAKIVKSLLKSMGVEDYEPRVIHKFLELWYRYVVDVLTDAQVYSEHAGKPAIDCDDVKLAIQSKVNFSFSQPPPREVLLELAQNRNKIPLPKTIAGPGIPLPPDQDTLISPNYQFAIPNKRPAQPLEETEDEEATIPNPSQEQK

SEQ ID NO: 137945 - protein, 210 aa, Glycine max
  Coding DNA Sequence Number=SeqID_21167
  Gene Ontology: Mol. function=serine carboxypeptidase activity; Cellular component=cellulose and pectin-containing cell wall; Biological process=proteolysis
  Homolog annotation: Hit_ID=Q5W727; Match level="QueryCoverage=98%, HitCoverage=47%, E-value=2e-64, Identity=55%"; Hit description =Putative serine carboxypeptidase II
  Pfam annotation: Domain name=Peptidase_S10; Domain location=11-208; Score=-58.3; E_value=4.5e-10; Accession=PF00450.12; Description =Serine carboxypeptidase
MGKDYISTPTPGIKLLQSAEDTYNFLVNWLQRFPQFKSREFFISGESYGGHYIPQLAELIFDRNKDRNKYPSINLKGFIVGNPETGDYYDYKGVLEYAWSHAVISDQQYDKAKQLCDFKQFDWPNECNKAMNEVFLDYSEIDIFNIYAPACRLNSTSSIADHSNSNNPESSTKERNDYRLRMRIFGGYDPCYSNYAEEYFSRKDVQSFFM

SEQ ID NO: 137946 - protein, 115 aa, Glycine max
  Coding DNA Sequence Number=SeqID_21168
  Homolog annotation: Hit_ID=Q8LAU8; Match level="QueryCoverage=91%, HitCoverage=39%, E-value=6e-26, Identity=56%"; Hit description =Dessication-related protein, putative
MGTSQLQLVAGLLGVEAGQDAVVRAMLYERVNPYKVTVEEFTNRISNLRNKLGNQRTKDEGLEINVLAADKDSLSYSRNVQEILRILNGGNERVPGSFFSKGANGRLAKSYLGAT

SEQ ID NO: 137947 - protein, 998 aa, Glycine max
  Coding DNA Sequence Number=SeqID_21169
  Gene Ontology: Mol. function=hydrolase activity, hydrolyzing O -glycosyl compounds; Biological process=carbohydrate metabolic process
  Homolog annotation: Hit_ID=Q1M320; Match level="QueryCoverage=56%, HitCoverage=89%, E-value=0.0, Identity=91%"; Hit description =Putative beta-glycosidase
  Pfam annotation: Domain name=Cellulase; Domain location=157-489; Score=-82.9; E_value=0.032; Accession=PF00150.8; Description =Cellulase (glycosyl hydrolase family 5
  Pfam annotation: Domain name=Glyco_hydro_1; Domain location=171-527; Score=-3.1; E_value=1.5e-18; Accession=PF00232.9; Description =Glycosyl hydrolase family 1
  Pfam annotation: Domain name=Peptidase_S10; Domain location=581-990; Score=599.8; E_value=2.5e-177; Accession=PF00450.12; Description =Serine carboxypeptidase
  Pfam module annotation: Pfam domain module=Cellulase::Glyco_hydro _1::Peptidase_S10; Domain location=157-489::171-527::581-990
  Subcellular localization annotation: CTP_CleavageSite=25; ConfidenceScore=5.35e-01
MTVVGLFLTATKLAGALFTLTVAANAFSYSRFRKKNLRGFRSPIDESQDTLAHFNVAGEDGFFFGLATAPAHVEDRLDDAWIQFAEKKSGEGGGDSEGKQRVDAVIGSASGDGGSQPAITSPRSRKPLKVAMEAMIRGIEKYMEVEGKEREEEARPNVTAWHNVPCPEERLRFWSDPETEIKLAKDTGVTVFRMGIDWTRIMPVEPVNYAALERYKWIINRVRSYGMKVMLTLFHHSLPPWAGEYGGWKLEKTVDYFMDFTRLVVDSVSDLVDYWVTFNEPHVFCMLTYCAGAWPGGHPDMLEAATSALPTGVFQQAMHWMSIAHSKAYDYIHGLSNPLNSIVGVAHHVSFMRPYGLFDIAAVSLANSLTLFPYIDEISEKLDYIGINYYGQEVVSGAGLKLVENDEYSESGRGVYPDGLYRMLLQYHERYKHLNIPFIITENGVSDETDLIRRPYLLEHLLAIYAAMIMGVRVLGYLFWTISDNWEWADGYGPKFGLVAVDRANNLARTPRPSYHLFSKIVNTGKVTHEDRERAWDELQRVAKEKKTRPFYRAVDKHRLMYAASAINVETYESDRIIDLPGQPSSPSVSHFSGYITVNENHGRALFYWFFEAQSEPSKKPLLLWLNGGPGCSSIGYGGVVEIGPLIVNKNGEGLHFNTHSWNQVAIFDKLLESAEDAYIFLVNWLQRFPQFKSRDFFISGESYGGHYIPQLAELIFDRNKDGSKYPFINLKGFIVGNPETDDYYDYKGLLEYAWSHAVISDQQYDKAKQVCDFKQFDWSNECNKAMNEVFQDYSEIDIYNIYAPSCLLNSTSSIADDSNGNGPESFTKERNDYRLKRMRIFGGYDPCYSNYVEEYFNRKDVQSSFHADTKRDTNVAWKVCNNSILRTYNFSVFSVLPVYTKLIKGGLKIWIYSGDADGRVPVIGTRYCVEALGLPLKSRWRTWYHDNQVGGRIVEYEGLTYVTVRGAGHLVPLNKPSEALSLIHSFLTGQHLPTTHG

SEQ ID NO: 137948 - protein, 192 aa, Glycine max
  Coding DNA Sequence Number=SeqID_21170
  Gene Ontology: Mol. function=protein binding
  Homolog annotation: Hit_ID=Q2QNJ0; Match level="QueryCoverage=68%, HitCoverage=66%, E-value=1e-27, Identity=48%"; Hit description =Expressed protein
  Pfam annotation: Domain name=DUF538; Domain location=3-147; Score =132.3; E_value=1.4e-36; Accession=PF04398.3; Description=Protein of unknown function, DUF538
MSLLTDELKSKAEVYYGDKVCREKFSLLLAEIGLPDGLLTIQDIEECGYVKEIGFVWLKLEKKREQWFDKILVCYDTVVTAYVEPNKIKNLTGVKARDFLLWFTLNEIFVKDNPEAPVITFKSLVGLSMSFPLSLFEAGKEANKEEAKEEKWWRMIIDLSQAFLLKILTWALAGRTKKEEPKFFRTPSSFAN

SEQ ID NO: 137949 - protein, 65 aa, Glycine max
  Coding DNA Sequence Number=SeqID_21171
  Gene Ontology: Mol. function=oxidoreductase activity
  Homolog annotation: Hit_ID=Q4W8C1; Match level="QueryCoverage=98%, HitCoverage=19%, E-value=1e-17, Identity=69%"; Hit description =Gibberellin 2-oxidase
MVLASPNSIRSEGILPSNELIPVVDLTAERSQVTKLIVKACEEYGFFKVINHGISHEVISKTEEA

SEQ ID NO: 137950 - protein, 91 aa, Glycine max
  Coding DNA Sequence Number=SeqID_21172
  Homolog annotation: Hit_ID=Q45W70; Match level="QueryCoverage=36%, HitCoverage=15%, E-value=3e-11, Identity=94%"; Hit description =Isomerase-like protein
MKSLPLMLVVTLDCFICLKDMLMDRTRNDSSQLVQDLSLNLYIFDMRWLDIYACTPPGVGPVKEGQTITAGITGLVDVQFNVEKRARPVLS

SEQ ID NO: 137951 - protein, 110 aa, Glycine max
  Coding DNA Sequence Number=SeqID_21173
MFGYPPHEKRTPSFPSFHRGNQLIVLPPIPAKSWSQSILLFSMHERWLRSGHGCLVSCRNKCETNQTQRADLPRQLPPDFPCYGGKARKASIAARSTKPSTFGKRTNPKN

SEQ ID NO: 137952 - protein, 86 aa, Glycine max
  Coding DNA Sequence Number=SeqID_21174
MKTLHRCTPDSFDDQVNISYVQINRNPRIIYAYGFSPLIQKRYALQFQVKNSPREEKKKLTGNRRRGEARRGEGQSRSVLTNGAKR

SEQ ID NO: 137953 - protein, 620 aa, Glycine max
  Coding DNA Sequence Number=SeqID_21175
  Gene Ontology: Mol. function=aminoacyl-tRNA ligase activity; Cellular component=cytoplasm; Biological process=tRNA aminoacylation for protein translation
  Homolog annotation: Hit_ID=Q1RSU9; Match level="QueryCoverage=89%, HitCoverage=97%, E-value=0.0, Identity=76%"; Hit description=Lysyl -tRNA synthetase, class-2; Aminoacyl-transfer RNA synthetase, class II
  Pfam annotation: Domain name=tRNA-synt_2; Domain location=266-618; Score=438.9; E_value=6.6e-129; Accession=PF00152.11; Description =tRNA synthetases class II (D, K and N)
  Pfam annotation: Domain name=tRNA_anti; Domain location=125-224; Score=49.7; E_value=9.9e-12; Accession=PF01336.15; Description=OB -fold nucleic acid binding domain
  Pfam module annotation: Pfam domain module=tRNA-synt_2::tRNA_anti; Domain location=266-618::125-224
MEVPSEVPSTDTGTSTGTGETMSKNALKRELKNKQREEERKRKDEEKAKKAAEAQQAKDNKSAPADDEDMDPTQYLENRLKYLAVQKTEGKNPYPHKFFVTMSIDQYIKEYGGLSNGQHIEDVSVSLAGRIMHKRTSGSKLVFYDLHGGGCKVQVMADARDVVVEPGQMKKLISLQCSKSDLDEAGFSKFHSNVKRGDIVGVTGFPGKSKKGELSIFPKNFVSLSHCLHMMPRQKSAAAAIDNVNLKRNPWIPGSTRNPETYILKDQETRYRLRHLDLMLNPEVRDIFKTRSKIISYIRRFLDDLDFLEVETPMMNMIAGGAAARPFVTHHNDLNMRLFMRIAPELYLKELVVGGLDRVYEIGKQFRNEGIDLTHNPEFTTCEFYMAYKDYNDLMDLTEQMLSGMVKELTKGSYKIKYHADGIDKEPIEIDFTTPFRRIDMIEELEKMAGLSIPKDLSSEEANQYLKDACVKYEIKCPPPETTARLLDKLVGHFLEETCVNPTFIKNHPEIMSPLAKWHRSKPGLTERFELFVNKRELCNAYTELNDPVVQRQRFAEQLKDRQSGDDEAMALDETFCTALEYGLPPTGGWGLGIDRLTMLLTDSQNIKEVLLFPAMKPQD

SEQ ID NO: 137954 - protein, 144 aa, Glycine max
  Coding DNA Sequence Number=SeqID_21176
  Subcellular localization annotation: CTP_CleavageSite=68; ConfidenceScore=5.81e-01
ELNFSPFQPITTTTSSNLVTSSFSPSFATAKSKKQGSPTPTPRSSLTPPAPAAWSLNSLTRTHSLLSCASSPSSCASAMSVNFTVSTPPVSTSSSSSVNHTLYVASLLRSSYLPPRQDLDTVVARLASSPDLHDGPIEVLCESH

SEQ ID NO: 137955 - protein, 78 aa, Glycine max
  Coding DNA Sequence Number=SeqID_21177
SLQVVAPPGSIPSVEQFTEMVAWPGTQPFLHREDESPTTQVPQHVEDESSEATIPEPFVIGEEAEETQVRQVAVATPD

SEQ ID NO: 137956 - protein, 139 aa, Glycine max
  Coding DNA Sequence Number=SeqID_21178
MGRDSHDPTSFHSSIALLQERFRQLQRVKEMREERELQKMLNEPKQFSSNTNTSISSSTYHNSNNSILSHPELIMPSRSPPHVSLSLWPTSQGKQEDYRSTQTPVSMNYAHSRSMQVSWKNANDCDSGADSGVDTSLHL

SEQ ID NO: 137957 - protein, 144 aa, Glycine max
  Coding DNA Sequence Number=SeqID_21179
MKPKVECKTGEERPNRGHKRSKVRTAATESVVLLRFFVAEFSAMNTDITASTKPEYPVIDRNPPFTKVVGNFNTLDYLRFVTITGVSVTVGYLSGIKPGIRGPSMVTGGLIGVMGGFMYAYQNSAGRLMGFFPNDDEVARYNKK

SEQ ID NO: 137958 - protein, 166 aa, Glycine max
  Coding DNA Sequence Number=SeqID_21180
  Gene Ontology: Biological process=cell adhesion
  Homolog annotation: Hit_ID=Q2QVD8; Match level="QueryCoverage=76%, HitCoverage=51%, E-value=2e-18, Identity=36%"; Hit description =Expressed protein
  Pfam annotation: Domain name=Fasciclin; Domain location=45-163; Score= -17.4; E_value=0.1; Accession=PF02469.12; Description=Fasciclin domain
MALLGCCLFLILFLLGLAESQSQTFNHPFNRTDIQAAIGDMRAKSYYGFAMLLQMLNGTSQPNNRDLTFLMPDDKELSASSISIDEVEEFLLKHAIPMPLYFNDLSHFPTGTLVPSGNRTQMIRIHNRARGDFFVNNAQIVSANVCLSSVIKCHGVDAIIEYDHGN

SEQ ID NO: 137959 - protein, 145 aa, Glycine max
  Coding DNA Sequence Number=SeqID_21181
  Gene Ontology: Mol. function=ferredoxin hydrogenase activity; Cellular component=periplasmic space; Biological process=electron transport
  Homolog annotation: Hit_ID=O23488; Match level="QueryCoverage=84%, HitCoverage=20%, E-value=2e-27, Identity=47%"; Hit description=LET1 like protein
  Pfam annotation: Domain name=DUF588; Domain location=26-141; Score =76.4; E_value=9.2e-20; Accession=PF04535.3; Description=Domain of unknown function (DUF588)
MSSYLGVGVSPGNVPVYHSTNVNVLDRRIKITELVLRCVILGLGVLAAVLVGTDSQVKEFFSFQKEAKFTDMKSLVFLVVANGLASGYSLIQGLRCIISMIRGRVLFSKPLAWAIFSGDQNLCSLHVSEAQLGSVWIWFEIKAQI

SEQ ID NO: 137960 - protein, 155 aa, Glycine max
  Coding DNA Sequence Number=SeqID_21182
MASRKRKEPSTPTQEASAREERGGLLYKFDEFKEELERRHWDEELTDFGDGNIDVAIVKEFYVNLLDPEDKSPKQVRVRGHLIKFDEDTLNTFLKTPVIVEEGESLCAYSRFSLLRPDPQELAAKICIPGRGFELNADGQPLKILRKNMTTLAQT

SEQ ID NO: 137961 - protein, 433 aa, Glycine max
  Coding DNA Sequence Number=SeqID_21183
  Gene Ontology: Mol. function=transporter activity; Cellular component= outer membrane-bounded periplasmic space; Biological process=transport
  Homolog annotation: Hit_ID=Q1H288; Match level="QueryCoverage=89%, HitCoverage=82%, E-value=1e-110, Identity=50%"; Hit description =Lytic transglycosylase, catalytic
  Pfam annotation: Domain name=SBP_bac_3; Domain location=49-275; Score= 63.3; E_value=8e-16; Accession=PF00497.10; Description=Bacterial extracellular solute-binding proteins, family 3
  Pfam annotation: Domain name=SLT; Domain location=300-416; Score =93.4; E_value=7e-25; Accession=PF01464.10; Description =Transglycosylase SLT domain
  Pfam module annotation: Pfam domain module=SBP_bac_3::SLT; Domain location=49-275::300-416
MWGYSSKSVRQVWLKVILATLCAALLSCSDNNTPKQLVRAKPKPDPYTIRFVTINSPSTYFIDSQNNYAGLEYDLAKRFVEFLGPPYSLKFIVVDSFDKVFPTLLRGDADIAAADISITAARKRQVLFGPAFNQVQSMVVFNRDNNKEPTKAEALLQKRIVLPQSTSFVERMRELQSKLPALTWRETDKLSSEQLIEAVARNEIDFTVADNHLLAIMQYNYPQLDAGMMLGQTDKIAWALNKLKGEERLKQVEAFFKKIEKDGTLRNLLDRYHGYTKRLKPVDITAFLSKSQTLLPKYVRLFKNAQEITDIDWRLLAALSYQESHWDNYSTSPTNVRGLMMLTEQTANMMNVTDRLDPKQSIVAGAKFFLWMKDRIPTRIPEPDRTFMTLAAYNNGVGHLEDARIIAQRLGLNPDSWADVKRGYQLLNDPGIL

SEQ ID NO: 137962 - protein, 154 aa, Glycine max
  Coding DNA Sequence Number=SeqID_21184
MHHHHRIKKEALSLSILTMSGPGASGVLKATSADPWSASFMVETRTLFVFHKSKNFTSDYEIRMPPTVPVNHYSDPEGQHNRIRILTGGTTRPVKDRSASPAEGTSRPVHTGGGPIDPTQAGITAAAGTRLALQWILVKGFRLYSFQLPDSMSP

SEQ ID NO: 137963 - protein, 327 aa, Glycine max
  Coding DNA Sequence Number=SeqID_21185
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=98%, HitCoverage=18%, E-value=1e-141, Identity=77%"; Hit description =Putative glucan synthase component
  Pfam annotation: Domain name=Glucan_synthase; Domain location=1-327; Score=-146.4; E_value=0.0033; Accession=PF02364.6; Description=1,3 -beta-glucan synthase component
MRREGLAKDSDIWTDKLRDLRLWASYRGQTLSRTVRGMMYYYRALKMLTFLDSASEMDIREGARELVSMRHDDLESSNSKSPSSKSLSRASSSVSLLFKGHEYGTALMKFTYVIACQIYGTQKEKKDPHADEILYLMQNNEALRVAYVDEKTTGRDEKEYYSVLVKYDQQLQMEVEIYRVKLPGPLKLGEGKPENQNHAIIFTRGDAVQTIDMNQDNYFEEALKMRNLLEEYRSYYGIRKPTILGVREHIFTGSVSSLAWFMSAQETSFVTLGQRVLANPLKVRMHYGHPDVFDRFWFLTRGGISKASRVISISEDIFAGFIVLFVE

SEQ ID NO: 137964 - protein, 303 aa, Glycine max
  Coding DNA Sequence Number=SeqID_21186
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8S1X0; Match level="QueryCoverage=98%, HitCoverage=16%, E-value=1e-126, Identity=68%"; Hit description =Putative callose synthase 1 catalytic subunit
HKRFAEIYRLFARSHFVKAIELGLILVIYASHSPVATDTFVYIALTITSWFLVASWIMAPFVFNPSGFDWLKTVYDFDDFMNWIWYSGSVFAKAEQSWERWWYEEQDHLKVTGLWGKLLEIILDLRFFFFQYGIVYQLGISDHNTSIAVYLLSWIYVFVVSGIYAVVVYARNKYAAKEHIYYRLVQFLVIILAILVIVGLLEFTKFKFMDIFTSLLAFIPTGWGLISIAQVFRPFLQSTIIWDGVVSVARIYDIMFGVIIMSPVALLSWLPGFQNMQTRILFNEAFSRGLRIFQIVTGKKSQS

SEQ ID NO: 137965 - protein, 383 aa, Glycine max
  Coding DNA Sequence Number=SeqID_21187
  Homolog annotation: Hit_ID=A0CIC5; Match level="QueryCoverage=35%, HitCoverage=4%, E-value=1e-07, Identity=25%"; Hit description =Chromosome undetermined scaffold_19, whole genome shotgun sequence
  Subcellular localization annotation: CTP_CleavageSite=89; ConfidenceScore=5.87e-01
MASRVKPSSRYSSYDSRSSTSSHFSDPSSSHEFNNLKTKTSSSSSSSRALVKAKPSNTAKVDPTFTTMVKKFMDRKPKSSTATRLIIPSDSLAKDLKKDAKKVAGFSALQKKLFGKGASEKKEKVKALTEVKNNTRTLAMVLRSERELLSINKEQEQQVSQLKQMLEDKNKEVEKLKDLCLKQREEIKSLKSAILFPDVMNSQLQELLEKQGSELKQAKQVIPALQQQVSSLTGQLQSLAEDLAEVKADKYSAKAGLPGYGSSPRTPTHAREDASNFWEFSSDDLSDDLLLNDLNPCLTPCAVKSRSREFECRGSGSMHYESLSDEDDAKVYPEMSFSSHDRKFSKSSDCCHNSSKISVATKAGRRSDESKLAYGGRMNHKFV

SEQ ID NO: 137966 - protein, 99 aa, Glycine max
  Coding DNA Sequence Number=SeqID_21188
MRHHWALLPATIMKQSRREKNHEPCHNSEEIAHNWSEKGWIFENQGVRKRALQSLGLTLAGAHKQILKQHSVGGKTVFSPIFEIVTTKVANCCNSHHST

SEQ ID NO: 137967 - protein, 51 aa, Glycine max
  Coding DNA Sequence Number=SeqID_21189
MAGGVDARRTMTNDGDYNGKERRQWLQWQEVAQRRGVVGLVGKVLENKGFL

SEQ ID NO: 137968 - protein, 208 aa, Glycine max
  Coding DNA Sequence Number=SeqID_21190
MGLTKEESSQIESHTTPWEMPRVSEKNTCAAPEYPSKEKEIQFPLYPLGFLVWFFSSLFLSSPPPLIHSPVTTWHRNRRSEEKGFFLVQFTSVSERPIVGLRMSGGGGGCGGVFVTWEEQVICQERGNRVIHFYLKDALGNSVLAVVGTERSVRHMMARREVVDWLTCLVSRNRSHHAGCLLCPTNVFEKLSVNVISARALGCLVYPQ

SEQ ID NO: 137969 - protein, 563 aa, Glycine max
  Coding DNA Sequence Number=SeqID_21191
  Gene Ontology: Mol. function=transferase activity; Cellular component= nucleus; Biological process=regulation of transcription, DNA-dependent
  Homolog annotation: Hit_ID=Q8L8G6; Match level="QueryCoverage=98%, HitCoverage=95%, E-value=1e-166, Identity=54%"; Hit description =Histone acetyltransferase complex component
  Pfam annotation: Domain name=Myb_DNA-binding; Domain location=92-138; Score=52.1; E_value=1.8e-12; Accession=PF00249.21; Description=Myb -like DNA-binding domain
  Pfam annotation: Domain name=SWIRM; Domain location=477-563; Score =33.6; E_value=6.9e-07; Accession=PF04433.7; Description=SWIRM domain
  Pfam annotation: Domain name=ZZ; Domain location=31-76; Score=43.1; E_ value=9.6e-10; Accession=PF00569.8; Description=Zinc finger, ZZ type
  Pfam module annotation: Pfam domain module=Myb_DNA-binding::SWIRM::ZZ; Domain location=92-138::477-563::31-76
MKETRRKVVIHWSCAGRLVECLLGQGAGEGKKALYHCNYCNKDITGKIRIKCAMCPDFDLCIECFSVGAEVTPHKSNHPYRVMDNLSFPLICPDWNADDEILLLEGIEMYGLGNWTEVAEHVGTKNKESCIEHYRNVYLNSPFFPVPDMSHVVGKNRKELLAMAKGQGEDKKGISMADLSIKAESSFSPSRVKVEDSHKAGSANRLASSLNSESDGPSGNTHAANQKASNVGRGKGGPGIIKMEDSQLDRDFGGKKPTSSGNEGPSLVESSGYNAKRQEFDPEYDNDAEQLLAEMEFKDTDTDDERELKLRVLRFYAKRLDERKRRKDFILERNLLYPNPFEKDFTPEEKAICRNYDLFMRFHTKEEHEELLRTVISEHRTRKRLQDLKKLLEMDILLLVESRKIFMLISLEARAAGCRNSAEADRYLAQKRKREAEESARRTKESAQGGPSNLGVSNALMSPDSAGKDLRGRPAGPATSSSVNEMDVTGYYGADLLSESEKRLCCELRLPPAMYLKMQEQLSLQILAGTVTAKSDAHQLFKMDAMKIDRVYDILIKKGIGSP

SEQ ID NO: 137970 - protein, 610 aa, Glycine max
  Coding DNA Sequence Number=SeqID_21192
  Gene Ontology: Mol. function=RNA binding
  Homolog annotation: Hit_ID=Q69N36; Match level="QueryCoverage=68%, HitCoverage=42%, E-value=1e-44, Identity=30%"; Hit description =Agenet domain-containing protein / bromo-adjacent homology (BAH) domain-containing protein-like
  Pfam annotation: Domain name=Agenet; Domain location=304-385; Score =75.3; E_value=1.9e-19; Accession=PF05641.3; Description=Agenet domain
  Pfam annotation: Domain name=BAH; Domain location=79-196; Score=35.6; E_value=1.7e-07; Accession=PF01426.8; Description=BAH domain
  Pfam module annotation: Pfam domain module=Agenet::BAH; Domain location=304-385::79-196
MNVLYSMNCIVCVQLDDSAQAVESLKILTSGINVNNRILPDKMISRKLKFQSSDIQWSGFSWFCAKQLKHYSGFCRNGTTINVHSFVYIMAEEENHYLGYVEDMYEDKKRQKKVKVRWFHHGQEVKHVIPQLNLQEGEVFITPHVQVISAECVNGPATVLTPKHYEKYLAAVPHTSLSEIHMCFRQFKNNKLKPFTLTKLRGYSNQTVLSSLNSPTLSKRKAKFEKSRTDDDENFTQDDALRSSNKRNRSSKDHVLEKGFSCLQISVPVKEMTKCEPKHPSLKLKLSRKTLGIKVIGPKPQLSFQVGAKIEVLCQDSGIRGCWFRCKILSMSPRLLKVQYDDLLDIDGPQKLEEWVPASRVAAPDKLGMRSSGRLTVRLCPPEYNTGHTFEIGAPVDAWWCDGWWEGVVTAVNVCGDGVLQVYTPGEERFLKVEKKNIRISRDWINNRWVDIQGKPDICSYLSSNARSSIRMSANSAVVDGSMSDCSAILESKPTPSAKVEVAKKVEPELSGLEAPVNLENIITTLREPLYAIHEDKDNNSGDGCDDEADKAVKTLLALNEHKDKYSGGGNNGDTDNDVDVDADNDEDDSEEDFDCSESKLDAAEAIQVA

SEQ ID NO: 137971 - protein, 230 aa, Glycine max
  Coding DNA Sequence Number=SeqID_21193
MDIQNQSEDHVLREYYLNNKQFLKRTWQFVLSVSVFSVFVWYSSGLSIHPQSFNAYFSTCLFYSMITHTLERKYMFLICNGILAFVAKTSLRTSNSSDSADSFDHLQNLSETKTTAVSDMVVVPLGSFESPENVPLMVEEQQGENNEEVSEADEDQEESHITEEEDIKEEDEEGEAESEAEVAQDYELEETTTTNEELVNTEELNRKFEEFIRKMKEEIRIEAQRQLIAV

SEQ ID NO: 137972 - protein, 691 aa, Glycine max
  Coding DNA Sequence Number=SeqID_21194
  Gene Ontology: Mol. function=zinc ion binding; Cellular component =nucleus; Biological process=transcription
  Homolog annotation: Hit_ID=Q1S4D5; Match level="QueryCoverage=90%, HitCoverage=88%, E-value=1e-148, Identity=42%"; Hit description =FAR1; Zinc finger, SWIM-type
  Pfam annotation: Domain name=FAR1; Domain location=68-293; Score =114.4; E_value=3.4e-31; Accession=PF03101.5; Description=FAR1 family
  Pfam annotation: Domain name=SWIM; Domain location=562-598; Score =33.3; E_value=8.4e-07; Accession=PF04434.8; Description=SWIM zinc finger
  Pfam module annotation: Pfam domain module=FAR1::SWIM; Domain location=68-293::562-598
MASMPSKNICIRRQQCPCGDWKCYITYEGDAEEGSAAPELVKAEKASSGAMVTPYVGMVFKSDDDAFEYYGNFARKNGFSIRKERSRISPQLGIYKRDFVCYRSGFAPVKKKPNGEHHRDRKSVRCGCDAKMYLSKEVVEGVSQWFVVQFSNVHNHELLEDDQVRLLPAYRKIHEADQERILLLSKAGFPIHRIVKMLELEKGIQGGQLPFLERDVRNFVQNRKKVVQENEALLSEKRENDVLELLEACKAMKEADDDFVYDFTVDANDKVENVAWSYSDSVNANAMFGDVVYFDSSHRSVTYGLLFGVWFGIDSYGRTIFFGCVLLQDETPQSFSWALQTFVRFMRGRCPQTILTDLDPGLRDAIRSEFPGTKHVIPHWNILYKVPCWFSPPLGSRYTEFKSEFDALFHIENTEEFEHQWRQMISLFELGSDKHTDLLYSVRASWAQAYVRGYFLAQMATIAYSKSIDAFLKGIFTAHTCLRSFFEQVGISASFQHQAHQETQYIHLKTCIPIEEHARSILTPFAFNALQQELLLAMQYAASEMANGSYIVRHFKSMDGEWLVIWLAEDDQIHCSCKEFESSGILCRHALRVLVIKNYFQLPDKYFLGRWRRECSLLVDDDQNNLGIGEEWFQEYQSLAETLFQESSITKERSDYVRKELTKELTRLLNEVRNLPEADGVCMNTSVSPAN

SEQ ID NO: 137973 - protein, 552 aa, Glycine max
  Coding DNA Sequence Number=SeqID_21195
  Gene Ontology: Mol. function=microtubule binding; Cellular component =cortical microtubule, transverse to long axis; Biological process =cytoskeleton organization and biogenesis
  Homolog annotation: Hit_ID=O23565; Match level="QueryCoverage=90%, HitCoverage=84%, E-value=1e-92, Identity=43%"; Hit description =Myosin II heavy chain like protein
  Pfam annotation: Domain name=DUF662; Domain location=19-210; Score= -51.1; E_value=0.047; Accession=PF04949.3; Description=Family of unknown function (DUF662)
  Pfam annotation: Domain name=Myosin_HC-like; Domain location=163-533; Score=434.2; E_value=1.7e-127; Accession=PF07058.2; Description =Myosin II heavy chain-like
  Pfam module annotation: Pfam domain module=DUF662::Myosin_HC-like; Domain location=19-210::163-533
MVASEEIYGGEELSLVQPDPMGLQIDRLHNQLTEKVKELANCQSEIKALRATEAKKDKAIEELRNEVGKLDDKLRLTEDHLKHKKLEIKKLTEEKKDALAAQYAAEATLRRLHADQKEDDFVPLESVITPLEAEIKMYRNEIASLQEDKKALERLTKSKEAALLEAEKILRSALERVLIVEEEEIKILEKTHRQKILEVEKLSQTIHELEEIILSSGVNANAIRDYQRQISELQEEKRTLERELARVKVSANRVATVVANEWKDENDKVMPVKQWLEERRIMQAEMQRLKDKLAISERTAKAESQLKDKLKLRLKTLEEGLKHFSNHPVSSNSVSAKSEKSKILSFLTTNSGLRNRSTSQPRGSAIGSSLFQKSNAKSNTDSVTGSLIPGSIMKKKYGSAENVLKKGIWASRHKVADSDEKENEMQVNAGMNSNKCNDEKEAAEIKTSIDDNDDSKSNSCNDLGSNDVVSGFLYDRLQKEFINLRKSCEIKESNLHTKDEEIKILTKKVDALTKAMEIEWKKMKREAAAREKEAASTKSDDNRKLRRSNSSR

SEQ ID NO: 137974 - protein, 1013 aa, Glycine max
  Coding DNA Sequence Number=SeqID_21196
  Gene Ontology: Mol. function=transferase activity; Cellular component= mitochondrion; Biological process=transport
  Homolog annotation: Hit_ID=Q9FSB6; Match level="QueryCoverage=96%, HitCoverage=93%, E-value=0.0, Identity=51%"; Hit description=67kD chloroplastic RNA-binding protein, P67.1
  Pfam annotation: Domain name=PPR; Domain location=158-192; Score =28.2; E_value=2.9e-05; Accession=PF01535.11; Description=PPR repeat
  Pfam annotation: Domain name=PPR; Domain location=193-227; Score =32.5; E_value=1.5e-06; Accession=PF01535.11; Description=PPR repeat
  Pfam annotation: Domain name=PPR; Domain location=228-262; Score =16.7; E_value=0.079; Accession=PF01535.11; Description=PPR repeat
  Pfam annotation: Domain name=PPR; Domain location=263-297; Score =24.2; E_value=0.00046; Accession=PF01535.11; Description=PPR repeat
  Pfam annotation: Domain name=PPR; Domain location=298-332; Score =38.6; E_value=2.2e-08; Accession=PF01535.11; Description=PPR repeat
  Pfam annotation: Domain name=PPR; Domain location=333-367; Score =32.7; E_value=1.2e-06; Accession=PF01535.11; Description=PPR repeat
  Pfam annotation: Domain name=PPR; Domain location=368-402; Score =27.3; E_value=5.4e-05; Accession=PF01535.11; Description=PPR repeat
  Pfam annotation: Domain name=PPR; Domain location=482-516; Score =41.0; E_value=4e-09; Accession=PF01535.11; Description=PPR repeat
  Pfam annotation: Domain name=PPR; Domain location=517-551; Score =32.6; E_value=1.3e-06; Accession=PF01535.11; Description=PPR repeat
  Pfam annotation: Domain name=PPR; Domain location=552-586; Score =24.9; E_value=0.0003; Accession=PF01535.11; Description=PPR repeat
  Pfam annotation: Domain name=PPR; Domain location=587-621; Score =48.0; E_value=3.2e-11; Accession=PF01535.11; Description=PPR repeat
  Pfam annotation: Domain name=PPR; Domain location=622-656; Score =41.1; E_value=3.9e-09; Accession=PF01535.11; Description=PPR repeat
  Pfam annotation: Domain name=PPR; Domain location=657-691; Score =25.2; E_value=0.00023; Accession=PF01535.11; Description=PPR repeat
  Pfam annotation: Domain name=PPR; Domain location=692-726; Score =18.0; E_value=0.034; Accession=PF01535.11; Description=PPR repeat
  Pfam annotation: Domain name=PPR; Domain location=728-762; Score =42.6; E_value=1.3e-09; Accession=PF01535.11; Description=PPR repeat
  Pfam annotation: Domain name=PPR; Domain location=763-797; Score =32.9; E_value=1.1e-06; Accession=PF01535.11; Description=PPR repeat
  Pfam annotation: Domain name=PPR; Domain location=864-898; Score=4.4; E_value=2.2; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR; Domain location=158-192::193-227::228-262::263-297::298-332::333-367::368 -402::482-516::...
  Pfam module annotation: Domain location=517-551::552-586::587 -621::622-656::657-691::692-726::728-762::763-797::864-898
  Subcellular localization annotation: CTP_CleavageSite=12; ConfidenceScore=5.22e-01
MAQPYPLCSSRSASSFSSHYRIPFFTIIPSHSKTLLHAPRFSFQPFNTLQDAAKLDDPDAKSPSLSKKSFWVNPRSPRAKQLQQNSPHARSSSLTKLAKSLDSCNPTEEHVSEILNVLGNNVAERDAVFILNTMANPNTALLALKYFQQKISPGKHVVLYNVTLKVLREVKDFEGSEKLFDEMLQRGVEPNLITFSTIISSASVCSLPDKAMEWFEKMPSFGVEPDASVASFMIHAYAHSGNADMALKLYGRAKAEKWRVDTAAFSALIKMCGMLENFDGCLSVYNDMKVLGAKPNMVTYNALLYAMGRAKRALDAKAIYEEMISNGFSPNWPTHAALLQAYCKARFPEDALGVYNEMKKKGMDVNLFLYNLLFDMCADVGCMDEAVEIFENMKRSGTCQPDNFTYSCLINMYSSHLKLIESLESSNPWEQQVSAILKGLGDDVSEGDIIFILNRMVDRNTASFVLRYFQNMINFTRDKEVILYNVVMNLFRKSRDFQGAEKLFDEMLQRGVKPDNITFSTLVNCASVSGLPNKAVVLFEKMSHFGCEPDGVTCSAMVYAYARTNNVDKAVNLYDRAKAEKWSLDAVTFSTLIKMYSMAGKYDKCLEVYQEMKVVGVKPNVVTYNTLLGALLRSKKHRQAKAIYKEMKSNGVSPDFITYASLLEVYTRAQCSEEALGVYKEMKGNGMDITADLYNKLLAMCADVGYTDRASEIFYEMKSSGTCQPDSWTFSSMITMYSRSGKVSEAEGMLNEMIQSGFQPTIFVMTSLICCYGKAKRTDDVVKIFKQLLDLGIVPNDHFCCSLLNVLTQTPKEELGKLTDCIEKANTKLGTVVRYLMEELEGDEAFRKEALELLNSIDAEVKKPLCNCLIDLCVKLNVPERARDLLDLGLMLEIYTNIQFKSQTQWSLHLKELSVGAAMTALHVWINDLSKALESGEDLPPLLGINTGQGKHKYSDKGLASVFESHLKELNAPFHESKAGWFLVTKAAAKSWLESRDSTESIAGLNSLEHVPC

SEQ ID NO: 137975 - protein, 692 aa, Glycine max
  Coding DNA Sequence Number=SeqID_21197
  Gene Ontology: Mol. function=binding; Cellular component =mitochondrion; Biological process=transport
  Homolog annotation: Hit_ID=Q9FSB6; Match level="QueryCoverage=92%, HitCoverage=93%, E-value=0.0, Identity=54%"; Hit description=67kD chloroplastic RNA-binding protein, P67.1
  Pfam annotation: Domain name=PPR; Domain location=168-202; Score =28.5; E_value=2.4e-05; Accession=PF01535.11; Description=PPR repeat
  Pfam annotation: Domain name=PPR; Domain location=203-237; Score =28.2; E_value=2.8e-05; Accession=PF01535.11; Description=PPR repeat
  Pfam annotation: Domain name=PPR; Domain location=238-272; Score =20.5; E_value=0.0061; Accession=PF01535.11; Description=PPR repeat
  Pfam annotation: Domain name=PPR; Domain location=273-307; Score =21.7; E_value=0.0026; Accession=PF01535.11; Description=PPR repeat
  Pfam annotation: Domain name=PPR; Domain location=308-342; Score =38.3; E_value=2.7e-08; Accession=PF01535.11; Description=PPR repeat
  Pfam annotation: Domain name=PPR; Domain location=343-377; Score =28.6; E_value=2.2e-05; Accession=PF01535.11; Description=PPR repeat
  Pfam annotation: Domain name=PPR; Domain location=378-412; Score =21.2; E_value=0.0037; Accession=PF01535.11; Description=PPR repeat
  Pfam annotation: Domain name=PPR; Domain location=414-448; Score =41.2; E_value=3.6e-09; Accession=PF01535.11; Description=PPR repeat
  Pfam annotation: Domain name=PPR; Domain location=449-483; Score =29.5; E_value=1.2e-05; Accession=PF01535.11; Description=PPR repeat
  Pfam annotation: Domain name=PPR; Domain location=550-584; Score=5.5; E_value=1.7; Accession=PF01535.11; Description=PPR repeat
  Pfam module annotation: Pfam domain module=PPR::PPR::PPR::PPR::PPR::PP R::PPR::PPR::PPR::PPR; Domain location=168-202::203-237::238-272::273- 307::308-342::343-377::378-412::414-448::449-483::550-584
  Subcellular localization annotation: CTP_CleavageSite=71; ConfidenceScore=5.68e-01
MAQSYLLCCSSSFPLLPSSSSSSSFHYRKQITNTTSIPSYSSRHSKLPNFPSSHQSKTLLQDTILDDPDAKSSSLSKTSIWVNPKSPRAKHLWKNSYHTRSSSLTKLARSLDSCNPTQQHVSEILKVLGDNVLEADAVFILNSMVNPYTALLAVEYFKQKIKHARHVILYNVTLKLFREVKDFEGAEKLFDEMLQRGVNPNLITFSTMIICASVCSLPHKAVKWFEMMPSFGCEPDDNVCSSMIYSYARTGNADMALRLYDRAKAEKWHVDTVVFSGLIKMHGMSGNYDGCLNVYNDLKVLGAKPNLVTYNALLYAMGRAKRARDAKAIYEEMINNGLTPNWPTYAALLQAYCRARFNRDALNVYKEMKEKGKDLDILLYNMLFDMCANVGCEGEAVKIFEDMKSSGTCRPDSFTYASLINMYSSIGKISEMEAMFNEMMESGFEPNIIVLTSLVHCYGKAKRTDDVVKIFNQLMDLGISPDGRFCDCLLYAMTQVPKEELGKLTGCVEKANPKLGSVLRYIMEKQEGGGDFRMEASELLNSTEADIKKSMCNCLIDLCVNLDVPDRARDLLDLGLTLEIYTDIQSRSQAKWSLHLKRLSVGAALTALSVWINDLSKTLELGEELPPLLGINTGGGKHRFSDKVLPTVFELYLKELKAPFHKAANKAGWFLATSEAATSWLQSRGSVVVLPQ

SEQ ID NO: 137976 - protein, 1024 aa, Glycine max
  Coding DNA Sequence Number=SeqID_21198
  Gene Ontology: Mol. function=binding; Cellular component=plastid chromosome; Biological process=transport
  Homolog annotation: Hit_ID=Q9FSB6; Match level="QueryCoverage=91%, HitCoverage=88%, E-value=0.0, Identity=56%"; Hit description=67kD chloroplastic RNA-binding protein, P67.1
  Pfam annotation: Domain name=PPR; Domain location=173-207; Score =20.3; E_value=0.0072; Accession=PF01535.11; Description=PPR repeat
  Pfam annotation: Domain name=PPR; Domain location=208-242; Score =28.6; E_value=2.2e-05; Accession=PF01535.11; Description=PPR repeat
  Pfam annotation: Domain name=PPR; Domain location=243-277; Score=8.5; E_value=0.73; Accession=PF01535.11; Description=PPR repeat
  Pfam annotation: Domain name=PPR; Domain location=278-312; Score =19.8; E_value=0.0098; Accession=PF01535.11; Description=PPR repeat
  Pfam annotation: Domain name=PPR; Domain location=313-347; Score =25.7; E_value=0.00017; Accession=PF01535.11; Description=PPR repeat
  Pfam annotation: Domain name=PPR; Domain location=348-382; Score =37.8; E_value=3.8e-08; Accession=PF01535.11; Description=PPR repeat
  Pfam annotation: Domain name=PPR; Domain location=383-417; Score =20.5; E_value=0.0062; Accession=PF01535.11; Description=PPR repeat
  Pfam annotation: Domain name=PPR; Domain location=497-531; Score =37.9; E_value=3.5e-08; Accession=PF01535.11; Description=PPR repeat
  Pfam annotation: Domain name=PPR; Domain location=561-595; Score =20.1; E_value=0.0082; Accession=PF01535.11; Description=PPR repeat
  Pfam annotation: Domain name=PPR; Domain location=596-630; Score =40.2; E_value=7.1e-09; Accession=PF01535.11; Description=PPR repeat
  Pfam annotation: Domain name=PPR; Domain location=631-665; Score =38.1; E_value=3.1e-08; Accession=PF01535.11; Description=PPR repeat
  Pfam annotation: Domain name=PPR; Domain location=666-700; Score =21.3; E_value=0.0034; Accession=PF01535.11; Description=PPR repeat
  Pfam annotation: Domain name=PPR; Domain location=701-735; Score =17.4; E_value=0.053; Accession=PF01535.11; Description=PPR repeat
  Pfam annotation: Domain name=PPR; Domain location=737-771; Score =42.6; E_value=1.3e-09; Accession=PF01535.11; Description=PPR repeat
  Pfam annotation: Domain name=PPR; Domain location=772-806; Score =32.3; E_value=1.7e-06; Accession=PF01535.11; Description=PPR repeat
  Pfam annotation: Domain name=PPR; Domain location=872-906; Score =10.0; E_value=0.49; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR; Domain location =173-207::208-242::243-277::278-312::313-347::348-382::383-417::497 -531::561-595::...
  Pfam module annotation: Domain location=596-630::631-665::666 -700::701-735::737-771::772-806::872-906
  Subcellular localization annotation: CTP_CleavageSite=64; ConfidenceScore=5.80e-01
MAQSYLICSSSSSSSSSSSSPPCSSAFHYRKPITTSISFSCFSRHFKLPTFPLSHNPKTLLQVQATYTPQDPDAKSSSLSKTSIWVNPKSPRVKHLWKNPYHARSSSLTKLAKSLDSCNPTQQRVSQILQVLGDKVFESDAVVILNSMVNPYTALLAVNYYFTQKIKPSRHVVLYNVTLKLFRAVRDFEGEEKVFDEMLQRGVNPNLITFSTIISSASMFSLPYKAIEFFEKMPSFGVQPDAGVTSFMIHAYACSWNADMALKLYDHAKTEKWRVDTAAFLALIKMFGKFDDFDGCLRVYNDMKVLGAKPIKETYDTLLNVMGRAKRAGDTKAIYEEMISNGFSPNWPTYAALLEAYCKARCHEDALRVYKEMKEKRINVDVFLYNLLFEMCADVGCMDEAVEIFKDMKSSWTCQPDNFTYSCLINMYSSHLKLTESLESSNPWEQQVSTILKGIGDMVSEGDVIFILNRMVNPNTASFVLKYFLNRINFTIDKELIFYNAVLNLFRKYRDFEGAKKLFDEMLQRGVKPNNFTFSTMVNCANKPVELFEKMSGFGYEPDGITCSAMVYAYALSNNVDKAVSLYDRAIAEKWCLDAATFSALIKMYSMAGNYDKCLKVYQEMKVLGAKPNVVTYNTLLGAMLKAQKHRQAKAIYKEMKSNGVSPDFITYACLLEVYTIAHCSEEALGVYKEMKGNGMDMTADLYNKLLAMCADVGYTDRAAEIFYEMKSSGTCQPDSWTFSSMITMYSRSGKVSEAEGMLNEMIQSGFQPTIFVLTSLVHCYGKAKRTDDVVKVFKQLLDLGIVPNDHFCCSLLNVLTQTPKEEYGKLTDCIEKANTKLGSVVKYLVEEEGDGDFKKEASEFLNSIDAKVKMPLCNCLIDLCVKLNVPERACDLLDLGLVLEIYPNIQSKSQTQWSLHLKELSVGAAMTALHVWINELSKALESGEDLPPLLGINTGKGKLKYSEKGLAGVFESHLKELHAPFHEAKAGWFLVTKAAAKSWLESRGSIADLNFELYGFTCSNFQQ

SEQ ID NO: 137977 - protein, 134 aa, Glycine max
  Coding DNA Sequence Number=SeqID_21199
MGNCMGYHSQPKKQTRYPLIEGRELDASVPVEKMNSAPNKHYIVVRRKLRHGEVYQLAPFMLQSDMPCRTTNNRKLKARSVKIVVTAEELESLLSGSKRLQIQCRAARLRRSYGLRGCQKWLPSLPTIQEVHNY

SEQ ID NO: 137978 - protein, 239 aa, Glycine max
  Coding DNA Sequence Number=SeqID_21200
  Gene Ontology: Mol. function=metal ion binding; Biological process =metal ion transport
  Homolog annotation: Hit_ID=Q9C684; Match level="QueryCoverage=30%, HitCoverage=43%, E-value=3e-10, Identity=50%"; Hit description =Proline-rich protein, putative
MAEKVTIMKLKVDLECEKCYKKVKKLLGKEIRDQKFDEKENIVFITVVCCSPEKIRDKLCYKGGGSIKSIEILEPPKPKPAGPEKKEAEKPKAEPEKKKDPEKPKADPPKAEKPKTEPEKKKDGGGEKPKEEPEKKKDGGEKPKPGPEKPKDKPTPAPLPVQPHIAAPMAVPVGMLYAPPPCYGGRPVGPGYEYGGPMLCYDGYYARPVYDSYSGGRPCYGNRCDQYFSEENPQGCTIM

SEQ ID NO: 137979 - protein, 130 aa, Glycine max
  Coding DNA Sequence Number=SeqID_21201
MKRVKLEIERVRPLLLPLLSLSFATATTLSIRVKLFLASGDLSDLALQEMLIPITIIGTSCFIDSPSSFGTHDPGKPPPRDGFSQFLSKISALGKLNKFTRLMRLVRYHCLWLLSSYITNFSGNYLISLL

SEQ ID NO: 137980 - protein, 162 aa, Glycine max
  Coding DNA Sequence Number=SeqID_21202
  Homolog annotation: Hit_ID=Q9LUE7; Match level="QueryCoverage=40%, HitCoverage=40%, E-value=6e-10, Identity=48%"; Hit description =Similarity to ATFP3
  Pfam annotation: Domain name=HMA; Domain location=25-88; Score=45.7; E_value=1.6e-10; Accession=PF00403.16; Description=Heavy-metal -associated domain
MGENKEEEKKEETTEEKKEKEPPEIVLKVDMHCEACARKVAKALKGFEGVEEVTADSKASKVVVKGKAADPIKVCERLQKKSGKKVELISPLPKPPEEKKEEEIKEEPQPEEKKEERNMTNMACLLQSENGNTLGGVSISIVFMFWFLVPVVSKEDGCYMQA

SEQ ID NO: 137981 - protein, 705 aa, Glycine max
  Coding DNA Sequence Number=SeqID_21203
  Gene Ontology: Mol. function=binding; Cellular component=plastid chromosome; Biological process=transport
  Homolog annotation: Hit_ID=Q9FSB6; Match level="QueryCoverage=87%, HitCoverage=88%, E-value=0.0, Identity=61%"; Hit description=67kD chloroplastic RNA-binding protein, P67.1
  Pfam annotation: Domain name=PPR; Domain location=165-199; Score =39.0; E_value=1.6e-08; Accession=PF01535.11; Description=PPR repeat
  Pfam annotation: Domain name=PPR; Domain location=200-234; Score =31.3; E_value=3.3e-06; Accession=PF01535.11; Description=PPR repeat
  Pfam annotation: Domain name=PPR; Domain location=235-269; Score =21.4; E_value=0.0032; Accession=PF01535.11; Description=PPR repeat
  Pfam annotation: Domain name=PPR; Domain location=270-304; Score =38.8; E_value=1.9e-08; Accession=PF01535.11; Description=PPR repeat
  Pfam annotation: Domain name=PPR; Domain location=305-339; Score =37.8; E_value=3.6e-08; Accession=PF01535.11; Description=PPR repeat
  Pfam annotation: Domain name=PPR; Domain location=340-374; Score =22.0; E_value=0.0021; Accession=PF01535.11; Description=PPR repeat
  Pfam annotation: Domain name=PPR; Domain location=375-409; Score =26.1; E_value=0.00012; Accession=PF01535.11; Description=PPR repeat
  Pfam annotation: Domain name=PPR; Domain location=411-445; Score =39.8; E_value=9.6e-09; Accession=PF01535.11; Description=PPR repeat
  Pfam annotation: Domain name=PPR; Domain location=446-480; Score =31.5; E_value=2.9e-06; Accession=PF01535.11; Description=PPR repeat
  Pfam module annotation: Pfam domain module=PPR::PPR::PPR::PPR::PPR::PP R::PPR::PPR::PPR; Domain location=165-199::200-234::235-269::270 -304::305-339::340-374::375-409::411-445::446-480
  Subcellular localization annotation: CTP_CleavageSite=20; ConfidenceScore=5.44e-01
MASCICASHSSLFHDRHYVSTSISSSFSLRNFKFPNAASSHKSLSLHSKASQALHQDAASHDPDANSLSLSKTRIWVNPNSPRAKHLQPKSPSARYSYLARLTESLNSCTPSAQHVSTILKGLRDNVSERDAVFILDKMTNPETAPFVLGHFRDKIKPSTDKEVILYNATLKAFRKSRDFEGAEKLFDEMLQRGVKPDNITFSTLINSARMCALPDKAVEWFKKMPSFGCEPDAMTCSAMVSAYAQTNNVDMALSLYGRAKAEKWSLDASTFSTLIKMYGVLGNYVECLRIFGEMKVLGVKPTVVTYNTLLGSLFRSKKSWQAKNVYKEMISNGVSPDFITYATLLRIYAGAQYREDALSVYKEMKGNGMDMTVDLYNRLLDMCADVGCIEEAVEIFEDMKSSGTCQPDSLTFSSLITVYSCNGKVSEAEGMLNEMIQSGFQPTIYVLTSLVQCYGRAKQTDDVVKIFKQLLDLGIVPDVYFCCCLLNVMTQTPKEEFGKLTDCIEKANTRLGSVVRYLVEGQEGDGDFRKEASELLNSIDFKVKKPLCNCLIDLCVSLNAPNRARDVLDLGLMLEIYKNIQSRSETQWSLHLKKLSVGAAITALHVWINDLSKALESWEDLPPLLGVNTGQGKHKYSDKGLASVFESHLRELNAPFHQAPDKAGWFLVTKEAAKSWLESRGSAETIDDLNSQVSGASTVALQYQ

SEQ ID NO: 137982 - protein, 150 aa, Glycine max
  Coding DNA Sequence Number=SeqID_21204
  Gene Ontology: Mol. function=kinase activity; Biological process =fatty acid biosynthetic process
  Homolog annotation: Hit_ID=Q7XYX7; Match level="QueryCoverage=71%, HitCoverage=37%, E-value=7e-49, Identity=87%"; Hit description=AKIN beta2
  Pfam annotation: Domain name=AMPKBI; Domain location=16-106; Score =136.8; E_value=5.7e-38; Accession=PF04739.5; Description=5'-AMP -activated protein kinase, beta subunit, complex-interacting region
DYVPEDIGSISSFEPPQSPDSSYNNLQLSSEDYAKEPPLVPPYLQMTLLNVPSTNMEVQPLTSRPQHVVLNHLYMQKGKGSPSVVALGTTQRFVAKYVTVVLYKSLQRNSELHKDHYMKVKIVVHIMQLLDGHSSCNSVSILTSFDDAIL

SEQ ID NO: 137983 - protein, 142 aa, Glycine max
  Coding DNA Sequence Number=SeqID_21205
MVCNDKTDMTGRLLVESFTFDCLIMNYIIINWAHLVRYYMHKALRANAPLPYPYLDVDGQWVRKQDLPPPIPNERTPFPPPQRDASSSLLTEVLTELCDLRAFMGEHFDAMDTHFDGIGTRITRLEDDISFIRRCFDPPTDF

SEQ ID NO: 137984 - protein, 171 aa, Glycine max
  Coding DNA Sequence Number=SeqID_21206
  Gene Ontology: Mol. function=structural constituent of ribosome; Cellular component=ribonucleoprotein complex; Biological process =translation
  Homolog annotation: Hit_ID=P29393; Match level="QueryCoverage=74%, HitCoverage=54%, E-value=7e-55, Identity=86%"; Hit description=50S ribosomal protein L1
  Pfam annotation: Domain name=Ribosomal_L1; Domain location=44-171; Score=187.2; E_value=3.9e-53; Accession=PF00687.11; Description =Ribosomal protein L1pL10e family
MMPYLNATDLQAAMMSLKEPSRVWEYNYWTDVTERKRPIAKALREYYDLDEAIELVKKTATAKFDETIELHIQTGIYYRKPEQHIRGTIVLPHGTGKEVKVLVFAKGEKAKEALEAGADYVGAEDLVEKIEKEGFLDFDVAIATPDMMRIIGRLGKILGPRGLMPSPKSRT

SEQ ID NO: 137985 - protein, 313 aa, Glycine max
  Coding DNA Sequence Number=SeqID_21207
  Gene Ontology: Mol. function=RNA-directed DNA polymerase activity; Biological process=RNA-dependent DNA replication
MGEVEEVQEQMKADTEALKEQMATMMEAMMSIKEIMEVNAAAIAATSTIVERLSFSAKNKHAFPPYGLPPNYTPPNVAYTPSEDVNNSASILIESRQPQTDHAYVSQPMGETHEIPYHNLADFKPCLRYATEGQAVGGIPVQNTLEVPQYHPQPHPLHSTAGKNPHAMTKMGKLDHLEERLRAIEGGEDYAFANVEEFFLVPNIITPPMFNVSDFDKYKGTTFPKNHLKMYCRKMGAYAKDKELLIHFFQESLTGIAVTWYTNLEPSRVHSWKDLMVAFVRQYQYNSDMAPDRMQLQNICKKGARIFQRIHLK

SEQ ID NO: 137986 - protein, 136 aa, Glycine max
  Coding DNA Sequence Number=SeqID_21208
  Homolog annotation: Hit_ID=Q1S5T5; Match level="QueryCoverage=64%, HitCoverage=21%, E-value=3e-08, Identity=34%"; Hit description =Multicopper oxidase, copper-binding site
MVQEWVVTTRWQLRKTIFKGFMVGSKGVEVNSMCSPLRYVWGSGLERDQVKFFASILNCRLMSIPLVYLGILVGASPRKEATWDPMPRKVDKKLAWWKNKVLSLAERMGCLPQLMGVMGPNFRIQTSRLERVERGG

SEQ ID NO: 137987 - protein, 253 aa, Glycine max
  Coding DNA Sequence Number=SeqID_21209
  Homolog annotation: Hit_ID=Q9FGJ4; Match level="QueryCoverage=45%, HitCoverage=91%, E-value=5e-27, Identity=55%"; Hit description =Putative acyl carrier protein
  Pfam annotation: Domain name=PP-binding; Domain location=184-251; Score=62.4; E_value=1.5e-15; Accession=PF00550.15; Description =Phosphopantetheine attachment site
MERERSEGGTLCWGWMDGWMVVTGHVITIHKEPCVVFVPMAGRQANTECFRLRAEKARTGGKETQYGYHMGPVPTIGPSVVWVEQGVLWVKYINFKKGLNGTLDRIHSLMTPLLCSETNTLDNFEVVPGSFADLNMQSIRKSILTRVNLRRSTERWFLAGDEGAHKQLRCWCSSTAVSSDQILDRVIALAKKYDKIDGSKVTETADFQKDLNLDSLDRVELIMALEEEFSIEIPDEKADKLACCADIAKYIAE

SEQ ID NO: 137988 - protein, 50 aa, Glycine max
  Coding DNA Sequence Number=SeqID_21210
MVLLLRRLKINGGVRRLGVAVVGVAMRSRSERKTPSRKGLHHCSEEYLER

SEQ ID NO: 137989 - protein, 114 aa, Glycine max
  Coding DNA Sequence Number=SeqID_21211
  Gene Ontology: Mol. function=peptidase activity; Cellular component =chloroplast thylakoid membrane; Biological process=lipid transport
  Homolog annotation: Hit_ID=Q9LEN8; Match level="QueryCoverage=99%, HitCoverage=99%, E-value=3e-39, Identity=64%"; Hit description =Putative 14-kDa proline-rich protein
  Pfam annotation: Domain name=Tryp_alpha_amyl; Domain location=47-113; Score=52.9; E_value=1e-12; Accession=PF00234.12; Description=Protease inhibitorseed storageLTP f
MASKGTVASTYVALFLCLNMLSYTMVSSTYNIPVIPDPSVPYQKGTCPIDALKLGSPPTLPCCNLIKGLADLEVAACLCTALKANVLGINLNVPISLSVILNNCGRNNAGFQCP

SEQ ID NO: 137990 - protein, 85 aa, Glycine max
  Coding DNA Sequence Number=SeqID_21212
MVPFHKTLPPRVGNGGGGDGPDRAELLGVGAVGEEVGGEDEVAGIGERSDVVGDREVVAGEEVKNGGEWGGYWLVSKMTTALPRR

SEQ ID NO: 137991 - protein, 174 aa, Glycine max
  Coding DNA Sequence Number=SeqID_21213
  Gene Ontology: Mol. function=transferase activity, transferring hexosyl groups; Cellular component=cytosol; Biological process =carbohydrate biosynthetic process
  Homolog annotation: Hit_ID=Q1RTV6; Match level="QueryCoverage=63%, HitCoverage=21%, E-value=1e-30, Identity=47%"; Hit description=NUDIX hydrolase; Glycosyl transferase, family 8
MKKIRVKIGVASTVPIRSMSTSTISSAITSETAAEDQVQRVNLLRSTDDNYDGVIVELDQPMDSTTFISILRASVSHWKKLGKKGVWIKLPIHLVNLVEALVKVLVVQENSGLFQGTGVWKFPTGVVDQGEDICVAAVREVKEETGVDSEFVEVLSFRWQCLCQFVYLMGSSND

SEQ ID NO: 137992 - protein, 80 aa, Glycine max
  Coding DNA Sequence Number=SeqID_21214
MVGAFSQNIVTLTGLPMILLSESDLTNSLCARNVITHSLCVVVFGSCDDLELVFGGAENRWMTMKNLMLEDTGTQRSDRM

SEQ ID NO: 137993 - protein, 101 aa, Glycine max
  Coding DNA Sequence Number=SeqID_21215
  Homolog annotation: Hit_ID=Q1S0F5; Match level="QueryCoverage=66%, HitCoverage=14%, E-value=5e-08, Identity=41%"; Hit description=IMP dehydrogenase/GMP reductase
MLFLLITIARKVRSSLFWPMLMKGKANWEKLLAGMVGASVNWFPRWKEGRAGVLSSCEGFPNIPLMGMRDCISYNHVLAIRQLGYPMRGAPLKESIAPFNA

SEQ ID NO: 137994 - protein, 73 aa, Glycine max
  Coding DNA Sequence Number=SeqID_21216
MKTLTPQARMWGYAIRRLISHTRETKRKFESVYEGGTMNTPDSGKVFQYWHCCGSEDPFDPGCTASPHSSYDD

SEQ ID NO: 137995 - protein, 196 aa, Glycine max
  Coding DNA Sequence Number=SeqID_21217
  Gene Ontology: Mol. function=zinc ion binding
  Homolog annotation: Hit_ID=Q1SHK9; Match level="QueryCoverage=94%, HitCoverage=82%, E-value=2e-47, Identity=55%"; Hit description=Zinc finger, RING-type; RINGv
MSAVIGIQYLQYAHKKCVQRWCNEKGDTICEICQQQLKPGYTAPPLPPLLHYGGSPITFGWNWEISRRDLHSHQFIAMFNANREFLDLDFSYSSAPSTRSLIFFRIIAIIFIVLLLLRHTLPIIFILSGARAYSLAVFMLVVLRIIGMIVPVYIMVKAIIAMQQFQYQTLDNQHSPMQAHGEDEIGQSQLRVIHIQ

SEQ ID NO: 137996 - protein, 66 aa, Glycine max
  Coding DNA Sequence Number=SeqID_21218
  Subcellular localization annotation: CTP_CleavageSite=3; ConfidenceScore=5.11e-01
MVSVKKSKSRHFRNASETFPWMISRRFSAVLRSFFGLQPNYVGLISLSKIEEYVGARETPSSTTKR

SEQ ID NO: 137997 - protein, 123 aa, Glycine max
  Coding DNA Sequence Number=SeqID_21219
  Pfam annotation: Domain name=zf-CCHC; Domain location=102-119; Score =7.2; E_value=0.065; Accession=PF00098.13; Description=Zinc knuckle
MMFTKTKISARICGSVDQHEKVRDLFKAIDEQFITSDKANKHIDHEVLLSLTYQCERRKACNGDGRECNATTAYGKNKATKSQANQKGNGKIPPQADIKKVTKCFFYKKKGHRKRIVPDSRNG

SEQ ID NO: 137998 - protein, 124 aa, Glycine max
  Coding DNA Sequence Number=SeqID_21220
  Gene Ontology: Mol. function=RNA-directed DNA polymerase activity; Biological process=RNA-dependent DNA replication
MAFTFSGSTSIPFWLTMKPSNFPDLTPKVDKVFFLGFRFSNYVVHVDLDLLMHHIMEQSYHGVATYPSAGGRRVTRGMRVPRKEYARSRHQRLFEENVGKTGKDAIYELLSERFGSCIYARGRY

SEQ ID NO: 137999 - protein, 112 aa, Glycine max
  Coding DNA Sequence Number=SeqID_21221
  Homolog annotation: Hit_ID=Q10BK2; Match level="QueryCoverage=30%, HitCoverage=15%, E-value=1e-07, Identity=79%"; Hit description =Glycosyl transferase, group 2 family protein, expressed
MGTGEGDQPMDQELDTSPRKPIYGKYILEERQGLLGVSREVAVSHCGGSRRLSMGLEACFCFLKSSWKPMLLIECRDNQRNILCGWINNMWARNLNMQEYQAKPYHNSELSS

SEQ ID NO: 138000 - protein, 106 aa, Glycine max
  Coding DNA Sequence Number=SeqID_21222
MAHDDALLTNQSRHHRGMVASDLCPIFVFTPKSIMHRIIKSMKKFSNLVWVIGFSSMLFDFKIAIKFIEEGYLPTHECAQLVNMIQQTVAMLDSNHRGISLGRTTK

SEQ ID NO: 138001 - protein, 154 aa, Glycine max
  Coding DNA Sequence Number=SeqID_21223
  Gene Ontology: Mol. function=unfolded protein binding; Cellular component=mitochondrion; Biological process=protein folding
  Homolog annotation: Hit_ID=P37900; Match level="QueryCoverage=52%, HitCoverage=12%, E-value=2e-28, Identity=75%"; Hit description=Heat shock 70 kDa protein, mitochondrial precursor
MESNFHVDVADSSSRGDTMVQLVTPLHPALPLESINNFHCGNSLPPLVLEVGNHADEKVPCDTAEELVLLGMSELLVGTPTEPQAVPNPQNTLLDTKCLIGKRFNDAQTQKEMKMVPFNIVKVPNGDAWVEANAQQYLPSHISAFVLTKMKEIA

SEQ ID NO: 138002 - protein, 56 aa, Glycine max
  Coding DNA Sequence Number=SeqID_21224
MKTVHTPFNTPKHLSIVYIVHRKCASTKDIFGNKNNKDAMGAGKENRASKAAFGSG

SEQ ID NO: 138003 - protein, 98 aa, Glycine max
  Coding DNA Sequence Number=SeqID_21225
MVDGCVERMPWKEVVWQLVWAGMAAMEGNHWSSMKAPNVMITKSEKRNRLASKARTSRKKEFSTSRHAKKWQTTMFLLIESYPAASPFLNRISFTQNP

SEQ ID NO: 138004 - protein, 204 aa, Glycine max
  Coding DNA Sequence Number=SeqID_21226
  Gene Ontology: Mol. function=transferase activity; Cellular component= endoplasmic reticulum; Biological process=determination of left/right symmetry
  Homolog annotation: Hit_ID=Q10BK3; Match level="QueryCoverage=97%, HitCoverage=64%, E-value=2e-71, Identity=60%"; Hit description =Glycosyl transferase, group 2 family protein, expressed
VVIIDDGSADETKRVAFEFVRKYTVDKVRVILLGRNHGKGEAIRKGMMHSRGELLLMLDADGATKVTDLEKLENQIQAVAKREYHHGDSSDSDPRFRISDIPAAVFGSRAHLEEKALATCGFKMFTRAAARKLFSNVRLKRWCFDVELVFLCKWFRISISEISVNWSEIPGSKVNLLSIPNMLWELVLMSVGYRTGMWRISNSA

SEQ ID NO: 138005 - protein, 112 aa, Glycine max
  Coding DNA Sequence Number=SeqID_21227
MNRWMTMKNLMLEDTGTQRSDRIMYVRGRGCHINQRSSEIDERLSDFPSKIYGKCNSYYDHRQYEKYDFTSLGKKLSTTNGNEREQQIHEDNDNSKLLLKQENDSNSKEVTE

SEQ ID NO: 138006 - protein, 419 aa, Glycine max
  Coding DNA Sequence Number=SeqID_21228
  Gene Ontology: Mol. function=structural molecule activity; Cellular component=cytoskeleton; Biological process=sperm individualization
  Homolog annotation: Hit_ID=P10987; Match level="QueryCoverage=86%, HitCoverage=96%, E-value=0.0, Identity=90%"; Hit description=Actin-5C
  Pfam annotation: Domain name=Actin; Domain location=4-371; Score =761.1; E_value=6.9e-226; Accession=PF00022.9; Description=Actin
MADTEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDFLMKILTERGYSFTTSAEREIVRDVKEKLSYIALDYEQELETARTSSSVEKSYELPDGQVITIGDERFRCPEVLFQPSMIGMEASGIHETTYNSIMKCDVDIRKDLYGNIVLSGGTTMFPGIADRMSKEISALAPSSMKIKVVAPPERKYSVWIGGSILASLSTFQQMWIAKAEYDESVCCNVMVVHNSVVVVPDEERGGELSEITFPKWRAVVEVNENGGLAEEIRGLR

SEQ ID NO: 138007 - protein, 190 aa, Glycine max
  Coding DNA Sequence Number=SeqID_21229
  Gene Ontology: Mol. function=RNA-directed DNA polymerase activity; Biological process=RNA-dependent DNA replication
MPLRGRHFVAYPCQTLWGPQYCPQPQPLHFVMGGGPPAMVEKEKFDHIEERLRVIEGSGNYAFANMVELCLVPDMVIPLKFKVSDFDKYKGTTCPKNHLKMHCRKIGAYAKDEKLLMHFFQKSLTGAAVTWYTNLEPSQVHSWKDIMVAFIRQYQYNSDMAPDRIQLQNMCKREHESFKEYAQMWRDLAT

SEQ ID NO: 138008 - protein, 264 aa, Glycine max
  Coding DNA Sequence Number=SeqID_21230
  Gene Ontology: Mol. function=ATP binding
  Homolog annotation: Hit_ID=Q1SEZ2; Match level="QueryCoverage=50%, HitCoverage=32%, E-value=2e-39, Identity=48%"; Hit description=Heat shock protein Hsp70
  Pfam annotation: Domain name=HSP70; Domain location=9-262; Score= -333.7; E_value=0.002; Accession=PF00012.10; Description=Hsp70 protein
MAKENQGFAIGIDLGTTYSCVAVWLEQHNRVEIIHNDQDAKRLIGRKHSDSTIQKVKMMWPFKIVAGVNDKPIIIVNYKGKEKHLWAEERKTTKDVGAIAGLNVMRIINIEPTAAAIAYGLDKRTNCVGEYRNLSHNGMTNENKRRGPIRVHGLHSTLKKRKEKKEELTGYCTRYKASKRSDVGNDPRLRFGNILASLFFYFLPLISSFFIPKPSEPPKLFPYMAIYRKSHLGQGQFAQASWLLKAEGISWSRQAKCSPERAKI

SEQ ID NO: 138009 - protein, 495 aa, Glycine max
  Coding DNA Sequence Number=SeqID_21231
  Gene Ontology: Mol. function=DNA binding; Cellular component=oxygen evolving complex; Biological process=DNA integration
  Homolog annotation: Hit_ID=Q1S1B7; Match level="QueryCoverage=52%, HitCoverage=44%, E-value=6e-54, Identity=42%"; Hit description =Integrase, catalytic region
  Pfam annotation: Domain name=HSP70; Domain location=77-494; Score= -209.3; E_value=5.5e-08; Accession=PF00012.10; Description=Hsp70 protein
  Pfam module annotation: Pfam domain module=HSP70::RVT_2; Domain location=77-494::1-170
HAEIKALELNDTWILTNLLKHKNVIGCKWVYKIKHRSDGSIERYIARLVAKGYTQVKGQDYLDTFSPLAKLTTVRLLLALAAINQWHLKQQDVNNAFLHGNDLSKIQRITHLLVSAFKIKDLGDLRYFLGFEVAKSSIGINLCQKKYALDILSDVGMLGSKPVSTLCDYITKLYQHLGSPLLVEDVSSYRRLIGRLIYLTNTRSDITDTSKGLPGVGIFLSAASNTHLKGFSDSDWAGCIDTKRSIIGYTVYIGDSLISWKSNKQENMLIGLVKLLPVSSANQLADIYTKALCLAALLTQGIKNVPDLVLLDVMSLSLGIAVKGYLLSVVIPRNTTIPGERTRASDNNLLGFFSLSGFPPTPQYHPFDICFDIDVNGILSVSAEEKTTGYKNDIAITNDEGKLSAEEIKRMIEKAETYQAEDNKFLRKANAMNALDDYIYKMKTILKKDDISLKLCSQERQKISFAVTKATNLLHDDKQQNEAVVFEDSLKELAI

SEQ ID NO: 138010 - protein, 109 aa, Glycine max
  Coding DNA Sequence Number=SeqID_21232
MDRIDKMEFLLEHYNKDNEELDVDAVDFEKPDLAVSDELQSKNDKTNGEVEEYMVFSCFSNSIHSLFLKVDPLGAQQEVLEIANNLGLNVSVVVAREVFVTNIGIKISL

SEQ ID NO: 138011 - protein, 67 aa, Glycine max
  Coding DNA Sequence Number=SeqID_21233
MSLTLQSCAQETDDLYDAMEKVVARSEYRGVYLGEHVALKVLRSKLLNDALEDEFAQEVAILRINHA

SEQ ID NO: 138012 - protein, 366 aa, Glycine max
  Coding DNA Sequence Number=SeqID_21234
  Gene Ontology: Mol. function=phenylalanine-tRNA ligase activity; Cellular component=cytoplasm; Biological process=tRNA aminoacylation for protein translation
  Homolog annotation: Hit_ID=Q2QPD4; Match level="QueryCoverage=85%, HitCoverage=71%, E-value=1e-145, Identity=76%"; Hit description =Phenylalanyl-tRNA synthetase class IIc family protein, putative, expressed
  Pfam annotation: Domain name=tRNA-synt_2d; Domain location=79-332; Score=100.6; E_value=4.7e-27; Accession=PF01409.10; Description=tRNA synthetases class II core domain (F)
  Subcellular localization annotation: CTP_CleavageSite=35; ConfidenceScore=5.78e-01
MVISSVHATLFARASFFCQSSGLRSFRSCLPFSSSAASVSSHNLSRKKWRQPVLSVLDLGGVKISREDVVRDDPANNVPDNIFSKLGVQLHRRDQHPLGILKNAIYEYFDTNYSNKFNKFDDLCPIVSVKQNFDDVLFPEDHVSRSYNDTYYIDPQTVLRCHTSAHQAELLRSEYTHFLVTGDVYRRDSIDSTHYPVFHQMEGFRVFVPEEWEGSGMDATLFAATDLKQCLEVVKDGSCGNILFEGAVEMRWVDTYFPFTNPSFELEIYFKEKWLEVLGCGVTEQEILKRNGKPNKVAWAFGLGLERLAMVLFDIPDIRLFWSNDERFTSQYPPCYKDMSFWISESFTENNLCEVVRGIAGDLVEE

SEQ ID NO: 138013 - protein, 66 aa, Glycine max
  Coding DNA Sequence Number=SeqID_21235
MQKKRDQQRPKCRISSRERISACMSINSDEAVAYGAAVQAALLSKGNNRQGSSIHMSVQCSESFQF

SEQ ID NO: 138014 - protein, 140 aa, Glycine max
  Coding DNA Sequence Number=SeqID_21236
  Homolog annotation: Hit_ID=Q2R2T4; Match level="QueryCoverage=68%, HitCoverage=57%, E-value=1e-07, Identity=37%"; Hit description=Plant integral membrane protein TIGR01569 containing protein
  Pfam annotation: Domain name=DUF588; Domain location=2-122; Score =8.0; E_value=0.0011; Accession=PF04535.3; Description=Domain of unknown function (DUF588)
MALIFISIDTLPIETSDYAVYEEINFNYVYAYRYMLSTIVIGFAYNLLQMGFSIFTVVSGKRVLSSYGGYLFDFFGDQIISYLLISGSAAEFGYDVQRRRVTNSFTEKANVSASLLLVGFLFTATASIFTSFALPKKAIN

SEQ ID NO: 138015 - protein, 108 aa, Glycine max
  Coding DNA Sequence Number=SeqID_21237
MGPPKLQKLFTEKDRNTKNTGMKHFRKKVLPEEEGGLPKEPSSGSFPEMRLSKNFSKEDSSRRSDRRRVISLIHCLLGAPVILLGACSMSSFKDALCIYSFLTPLTHG

SEQ ID NO: 138016 - protein, 145 aa, Glycine max
  Coding DNA Sequence Number=SeqID_21238
  Subcellular localization annotation: CTP_CleavageSite=13; ConfidenceScore=5.03e-01
MLILSISAYNSTYSTTKTSCSNHDLQIMWNTSSSSGKFPEKWLFRKVLPEYPKVIRKNPSSGKFLEELLLPETFWKKCSENFPEEPFFRMTLGYFRNNPTSGNFLEQLLPEVSEEVFTILPETATVTSPLSPFSPASSTPKVPLS

SEQ ID NO: 138017 - protein, 39 aa, Glycine max
  Coding DNA Sequence Number=SeqID_21239
MPTPRDGLKPKLYFEEIGHATLPPFLCYSFLNMHPPSAR

SEQ ID NO: 138018 - protein, 277 aa, Glycine max
  Coding DNA Sequence Number=SeqID_21240
  Gene Ontology: Mol. function=nucleotide binding; Cellular component =endoplasmic reticulum; Biological process=determination of adult life span
  Homolog annotation: Hit_ID=P22954; Match level="QueryCoverage=99%, HitCoverage=52%, E-value=2e-99, Identity=59%"; Hit description=Heat shock cognate 70 kDa protein 2
  Pfam annotation: Domain name=HSP70; Domain location=1-277; Score =35.3; E_value=6.3e-17; Accession=PF00012.10; Description=Hsp70 protein
AKRLIGRRVSDPSVHSDMKLWPFKVIAGAGEKPMIGVNYKGKEKQFSTEEISSMVLTKMRKIAEAYLGSTVKNAFVTVPAYFNDSQRQASKDVGVITGLNVMRIINEPTVVAIALGLDKKATSVGEKNVLIFDLGGGTFDEEQEGDYWKPKSLEKGIDFYSTITRARFEELNMNLFRKCMEPVEKCLREAKMSKITVHDVVLVGGSTRIPKVQQLLQDFFNGKDLCKNINPNEVAAYGVAVQATILSGEGNEKVQDLLLLDFTPLSLGLETAGDVMT

SEQ ID NO: 138019 - protein, 342 aa, Glycine max
  Coding DNA Sequence Number=SeqID_21241
  Gene Ontology: Cellular component=membrane; Biological process =transport
  Homolog annotation: Hit_ID=Q8NU75; Match level="QueryCoverage=55%, HitCoverage=85%, E-value=2e-62, Identity=58%"; Hit description =Nicotinamide mononucleotide transporter
RGAGEVSGHDVPADAALREVVERAESSREGVGVLERGAGRDAEAQVLGHGGHRADQQDRVVHGHLGAVADRGLVGAAVHVVGTKDVRDEDTVERRAFQQLRQVRPVRDGDGAARVERRRNARTQFRSGSGGLVLAPRARVGREDLDVVVGRALCPPPDHEADRGEDAVEQVHQPGGVIAGAEQQGDSDRVDGDPDQPELRPPPGHPVRGEERADERPRVSPHRLPRAERAEHGRQRDGADDQHEDHADACARRRPPRHHASALRVPPADPSVDRHGDEHDLPAGLAQQMRQRRVGAQGGAEEHGEQQQVADDADRPRPHLAPHTAERTRQPECVADDFADEE

SEQ ID NO: 138020 - protein, 117 aa, Glycine max
  Coding DNA Sequence Number=SeqID_21242
  Gene Ontology: Mol. function=nucleic acid binding; Biological process= lipid transport
MTQDHEKLDSDLIATCVVGMIREDPSIRISLIQERINSEFAYKAFKYCKPIIQVDDTHLYGKYRGTLLMATSQDGNGGVLPLAFAVVKGETLIAWSWFLAHLREHVTDKNGICLISY

SEQ ID NO: 138021 - protein, 205 aa, Glycine max
  Coding DNA Sequence Number=SeqID_21243
  Homolog annotation: Hit_ID=Q8H6Q8; Match level="QueryCoverage=94%, HitCoverage=6%, E-value=4e-11, Identity=27%"; Hit description=CTV.20
  Pfam annotation: Domain name=zf-CCHC; Domain location=88-105; Score =30.4; E_value=6.5e-06; Accession=PF00098.13; Description=Zinc knuckle
VALKICQDDKIQRQLAKEKAQTKRDLGSFCEQFGLPACPKQKKKQTSRKEIQDHKPANKRRFSKRRYSQKPSTSKEIENPKQKIKSKITCYNCGKQGHISKYCRLKKKLRNLNLEPTIEEQINNLLIETSEEETETETSSSVLSDENLNLIQQDDQLSSTDDDDKKINTLTREQDLSFEAINSIPDPQEKKVFSGKTQEDLRSQT

SEQ ID NO: 138022 - protein, 120 aa, Glycine max
  Coding DNA Sequence Number=SeqID_21244
  Gene Ontology: Mol. function=nucleic acid binding; Biological process= DNA integration
  Homolog annotation: Hit_ID=Q1SIY6; Match level="QueryCoverage=75%, HitCoverage=8%, E-value=3e-32, Identity=80%"; Hit description =Integrase, catalytic region; Zinc finger, CCHC-type
MKESKMIKGYSYRLLDIANKVRLLGTKFADSRIVEKIMVTIPLRYEASITTLENTNDLSKITLSEVLHDLQAHEQQRLMRQDHIVEGALLAKQQNMSKSKKNKDFDAIRASSTSTSAKGN

SEQ ID NO: 138023 - protein, 599 aa, Glycine max
  Coding DNA Sequence Number=SeqID_21245
  Homolog annotation: Hit_ID=Q5ZFS5; Match level="QueryCoverage=45%, HitCoverage=82%, E-value=3e-40, Identity=42%"; Hit description=Nod factor-like protein
  Pfam annotation: Domain name=Extensin_2; Domain location=11-388; Score=-142.7; E_value=0.1; Accession=PF04554.4; Description=Extensin- like region
  Pfam annotation: Domain name=GRP; Domain location=520-594; Score= -30.4; E_value=0.1; Accession=PF07172.2; Description=Glycine rich protein family
  Pfam module annotation: Pfam domain module=Extensin_2::GRP; Domain location=11-388::520-594
MSCHSAKVVIGLPFNNTDYMRSFGTEGRKKDGPQIPPSDKVYEYILFRGTDIKDLQVKSSPPVQPTPQVNNDPAIIQSHYPFPVTTSTSLPSAVSGSLTDPSSHTTQLGLPGSNFQGPLPLYQPGGNIGSWGASPPAPNANGGRLAMPPMYWQGYYGAPNGLPQLHQQSLLQPPPGLSMPSSMQQPMQYPNFTPPLPTVSSNLPELPSSLLPVSASTPSVTSASLPPNLPPAPSALPPAPSALPPAPSALSPVPSATLASEIFPVSVANKAPNVSTSAAMLASNLPSLALLTNPARDINAIVPPISSKSNAISGSSLPYQSVSQLSPAVVESSTSIHTETSAPSLVTPGQLLKPGPIIVSSAQPSQAPHKDVEVVQVSSTSSPEPSVPVSVETQPPILPLPVTSRPNHRPGGAPTQTHHHGYSYRGRGRGRGTGAFLESLVPIEIENGFRSVTKFTEDFDFTAMNEKFKKDEVWGHLGKSKSHSKDNNGEENAFDEDYQDEDNDDVSNIEVKPVYNKDDFFDSLSSNMHGNASQNGRTRYSEQIKIDTETFGDYVRYHGGRGGRGPGRGGRTRGGYYGRGGGYGYSGRGRGRGMPSRTL

SEQ ID NO: 138024 - protein, 433 aa, Glycine max
  Coding DNA Sequence Number=SeqID_21246
  Gene Ontology: Mol. function=receptor activity; Cellular component =integral to membrane; Biological process=protein amino acid phosphorylation
  Homolog annotation: Hit_ID=Q1SBD8; Match level="QueryCoverage=98%, HitCoverage=91%, E-value=1e-155, Identity=64%"; Hit description =Unnamed protein product; contains similarity to elicitor-inducible receptor EIR gene_id:T5M7.12
  Pfam annotation: Domain name=LRR_1; Domain location=112-135; Score =8.1; E_value=8.7; Accession=PF00560.23; Description=Leucine Rich Repeat
  Pfam annotation: Domain name=LRR_1; Domain location=137-159; Score =11.6; E_value=1.9; Accession=PF00560.23; Description=Leucine Rich Repeat
  Pfam annotation: Domain name=LRR_1; Domain location=161-183; Score =13.8; E_value=0.62; Accession=PF00560.23; Description=Leucine Rich Repeat
  Pfam annotation: Domain name=LRR_1; Domain location=185-207; Score =14.2; E_value=0.46; Accession=PF00560.23; Description=Leucine Rich Repeat
  Pfam annotation: Domain name=LRR_1; Domain location=209-231; Score =11.7; E_value=1.8; Accession=PF00560.23; Description=Leucine Rich Repeat
  Pfam annotation: Domain name=LRR_1; Domain location=233-255; Score =9.9; E_value=4; Accession=PF00560.23; Description=Leucine Rich Repeat
  Pfam annotation: Domain name=LRR_1; Domain location=257-280; Score =9.4; E_value=4.9; Accession=PF00560.23; Description=Leucine Rich Repeat
  Pfam annotation: Domain name=LRR_1; Domain location=282-304; Score =11.5; E_value=2; Accession=PF00560.23; Description=Leucine Rich Repeat
  Pfam annotation: Domain name=LRR_1; Domain location=306-328; Score =14.0; E_value=0.54; Accession=PF00560.23; Description=Leucine Rich Repeat
  Pfam annotation: Domain name=LRR_1; Domain location=330-349; Score =3.5; E_value=64; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=112 -135::137-159::161-183::185-207::209-231::233-255::257-280::282 -304::306-328::330-349
MEKAERDALYSTIQGFVGNWWNGSDLYPDPCGWTPIQGVSCDLFNGFWYVTVLNIGPIHDNSLSCAKNLEFRPQLFELKHLKALSLFKCFESQHKHHQATIPNAHWEKLAGSLESLEYRSNRGLIGKIPSSFGALKNLQSLVVLENGLTGEIPPDIGNLNKLKRLVLAGNYFSGHIPDIFSALSDLLILDLSRNSLSGTLPSTLGSLTSLLKLDVSHNHLEGNLLKELADLKNLTLMDLRNNRFSGGLTLSIQDMYSLEEMVLSNNGIGGDIRTLKWENLHNLVILDLSNMGLKGEIPESMSELKRLRFLGLSDNNLTGNLSPKLSTLPCLNALYVSGNNLVGELKFSMEFYGKMGTRFGAWNNPSLCYHLGVMSTSHVPYGVKPCQQEIKLLESNTNDGYVKRTFHSLASLSHAPNGFWWIFLVLLNSYLGL

SEQ ID NO: 138025 - protein, 970 aa, Glycine max
  Coding DNA Sequence Number=SeqID_21247
  Gene Ontology: Mol. function=binding; Cellular component=nucleus; Biological process=protein amino acid phosphorylation
  Homolog annotation: Hit_ID=O04390; Match level="QueryCoverage=99%, HitCoverage=85%, E-value=1e-173, Identity=38%"; Hit description =Nuclear matrix constituent protein 1
  Pfam annotation: Domain name=M; Domain location=339-359; Score=6.8; E_ value=16; Accession=PF02370.7; Description=M protein repeat
  Pfam annotation: Domain name=M; Domain location=367-387; Score=8.4; E_ value=9.7; Accession=PF02370.7; Description=M protein repeat
  Pfam annotation: Domain name=M; Domain location=598-618; Score=4.9; E_ value=28; Accession=PF02370.7; Description=M protein repeat
  Pfam annotation: Domain name=Strep_SA_rep; Domain location=101-125; Score=4.4; E_value=19; Accession=PF06696.2; Description =Streptococcal surface antigen repeat
  Pfam annotation: Domain name=Strep_SA_rep; Domain location=164-188; Score=1.2; E_value=66; Accession=PF06696.2; Description =Streptococcal surface antigen repeat
  Pfam annotation: Domain name=Strep_SA_rep; Domain location=192-216; Score=1.6; E_value=55; Accession=PF06696.2; Description =Streptococcal surface antigen repeat
  Pfam annotation: Domain name=Strep_SA_rep; Domain location=278-302; Score=1.7; E_value=54; Accession=PF06696.2; Description =Streptococcal surface antigen repeat
  Pfam annotation: Domain name=Strep_SA_rep; Domain location=540-564; Score=0.4; E_value=89; Accession=PF06696.2; Description =Streptococcal surface antigen repeat
  Pfam annotation: Domain name=Strep_SA_rep; Domain location=62-86; Score=8.8; E_value=3.8; Accession=PF06696.2; Description =Streptococcal surface antigen repeat
  Pfam module annotation: Pfam domain module=M::M::M::Strep_SA _rep::Strep_SA_rep::Strep_SA_rep::Strep_SA_rep::Strep_SA_rep::Strep _SA_rep; Domain location=339-359::367-387::598-618::101-125::164 -188::192-216::278-302::540-564::62-86
MGLLLIEKKEWNSKFDQLRQELAETEEILKREQSAHLIALFEVEKREENLKKALSTERQCGADLERALRAMQEEHAQVKSSSHTKLAKANALVDGIEEKSSVVDKKLLDAEAKLAEINRKNAELDMKLRQVDVRESLLQKERLSLATDRESFEATFYKQREDLKDWERKLKQREDMLCDGRQNLGEKEEKIVETEKNLKQKERDLEVLEKKIDSSNSLVKEKEAEIIQRVADLDVEEKKVNSLKSMLEMKEKELLALELKLSAREREGIEKLLGEQKATLDLKLQQVELEMEQKQKSLVEEFSSKEEALEQREVEVNHREKKVGKEEQALNKKAERIKEQNKEIEAKLKSLKEKEKTMIIKEKELEKEKQQLLADRESLENLNAELEKMKAEISQKELQICQETENLKLTEDDRAEHSRLQLELKQEIEHTRLQKDFIMKEAENLREERQRFEKEWEVLDEKRAEITNKQHGIDMEKESLRKFQNSEEERLKSEKQHMQDHIKKELEMLESEKESFRDSMKQEKHLLSEKVKNEKAQMLQDFELKMRNLENEIQKRQEEMEKDLQERERNFQEEMQRELDNINNLKDVTEKEWEEVKAEGIRLENERKVLESNKQQLKSGQHEMHEDSEMLMNLSRKVKKERERLVAERKHFLELVEKLRSCKGCGEVVRDFVVSDIQLPDFKERVAIPSPISPVLNDNPPKNSQDNIAASEFNISGSVKPVSWLRKCTTKIFNLSPSKRADAVGALDMPGTSPLSDVNFSVENIDEELPTSLPNIGARVIFDERQPAGGMAHHSSDTPHLQSDNIGKEVGDEYSLSVGDHSRVDSFVDGDPGDSQQSVPKLGRRKPGRKSKSGIARTRSVKAVVEEAKEFLGKAPKKIENASLQSLNTDHIREDSREDSSHTEKAIGNTRRKRQRAQTSRITESEQNAGDSEGQSDSITAGGRRKKRQTVAPLTQVTGEKRYNLRRHKM

SEQ ID NO: 138026 - protein, 826 aa, Glycine max
  Coding DNA Sequence Number=SeqID_21248
  Gene Ontology: Mol. function=catalytic activity; Cellular component =intracellular; Biological process=metabolic process
  Homolog annotation: Hit_ID=Q1S1R8; Match level="QueryCoverage=93%, HitCoverage=100%, E-value=0.0, Identity=50%"; Hit description =Tetratricopeptide-like helical
  Pfam annotation: Domain name=PPR; Domain location=117-151; Score =40.5; E_value=5.6e-09; Accession=PF01535.11; Description=PPR repeat
  Pfam annotation: Domain name=PPR; Domain location=152-186; Score =11.6; E_value=0.31; Accession=PF01535.11; Description=PPR repeat
  Pfam annotation: Domain name=PPR; Domain location=220-254; Score =32.1; E_value=1.9e-06; Accession=PF01535.11; Description=PPR repeat
  Pfam annotation: Domain name=PPR; Domain location=321-355; Score =41.9; E_value=2.2e-09; Accession=PF01535.11; Description=PPR repeat
  Pfam annotation: Domain name=PPR; Domain location=420-454; Score =37.8; E_value=3.8e-08; Accession=PF01535.11; Description=PPR repeat
  Pfam annotation: Domain name=PPR; Domain location=521-555; Score =39.1; E_value=1.5e-08; Accession=PF01535.11; Description=PPR repeat
  Pfam annotation: Domain name=PPR; Domain location=55-88; Score=20.9; E_value=0.0046; Accession=PF01535.11; Description=PPR repeat
  Pfam annotation: Domain name=PPR; Domain location=556-590; Score=6.4; E_value=1.3; Accession=PF01535.11; Description=PPR repeat
  Pfam annotation: Domain name=PPR; Domain location=592-625; Score =16.8; E_value=0.077; Accession=PF01535.11; Description=PPR repeat
  Pfam annotation: Domain name=PPR; Domain location=658-692; Score=6.6; E_value=1.2; Accession=PF01535.11; Description=PPR repeat
  Pfam module annotation: Pfam domain module=PPR::PPR::PPR::PPR::PPR::PP R::PPR::PPR::PPR::PPR; Domain location=117-151::152-186::220-254::321- 355::420-454::521-555::55-88::556-590::592-625::658-692
MKTLMIQGCNKWLCTSWTQKSKVVAFSYNPCYPFKLMSFLRSIHTSIADSYQSIFHSNQLLNGLSKSGQIDDARELFDKMLQRDEYTWNTMVSGYANVGRLVEARELFNGFSSRSSITWSSLISGYCRFGRQAEAFDLFKRMRLEGQKPSQYTLGSILRGCSALGLIQKGEMIHGYVVKNGFESNVYVVAGLVDMYAKCRHISEAEILFKGLAFNKGNHVLWTAMVTGYAQNGDDHKAIEFFRYMHTEGVESNQFTFPSILTACSSVSAHCFGEQVHGCIVRNGFGCNAYVQSALVDMYAKCGDLGSAKRVLENMEDDDVVSWNSMIVGCVRHGFEEEAILLFKKMHARNMKIDHYTFPSVLNCCIVGRIDGKSVHCLVIKTGFENYKLVSNALVDMYAKTEDLNCAYAVFEKMFEKDVISWTSLVTGYTQNGSHEESLKTFCDMRISGVSPDQFIVASILSACAELTLLEFGKQVHSDFIKLGLRSSLSVNNSLVTMYAKCGCLDDADAIFVSMHVRDVITWTALIVGYARNGKGRDSLKFYDAMVSSGTKPDFITFIGLLFACSHAGLVDEGRTYFQQMKKIYGIEPGPEHYACMIDLFGRLGKLDEAKEILNQMDVKPDATVWKALLAACRVHGNLELGERAATNLFELEPMNAMPYVMLSNMYLAARKWDDAAKIRRLMKSKGITKEPGCSWIEMNSRLHTFISEDRGHPREAEIYSKIDEIIRRIKEVGYVPDMNFSLHDMDREGKEAGLAYHSEKLAVAFGLLASPPGAPIRIFKNLRVCGDCHSAMKYISGVFTRHIILRDSNCFHHFKEGECSCEDYW

SEQ ID NO: 138027 - protein, 233 aa, Glycine max
  Coding DNA Sequence Number=SeqID_21249
  Gene Ontology: Mol. function=RNA-directed DNA polymerase activity; Biological process=RNA-dependent DNA replication
  Homolog annotation: Hit_ID=Q1S1D9; Match level="QueryCoverage=81%, HitCoverage=38%, E-value=7e-15, Identity=26%"; Hit description=RNA -directed DNA polymerase
MGKLSSWRHRQLSLVGRVCLINSVFTSLPLFYRLSLFLGIFCGGKGGIIGNWVNWRNVCCLRSHGGLGVEDLKLFNVALLAKWRWNLFHQQDTLLGDILNAKYGVSWKVVVGEKISFWREPLVEEQNEESIKKYAAVGRRCVEVEDKWWWKIRLIKHYMSYTISHNPKMPLKNRLPTRDNLNKRRWVQLVTVLPRNVEDHMWQHGASIKDEVEQERQYVLWLCHYMVCMEEKE

SEQ ID NO: 138028 - protein, 110 aa, Glycine max
  Coding DNA Sequence Number=SeqID_21250
MRVKENECKEKKDMFGVFLKRKILMQHEESHENWDTMVYITIPRPRHLVTMQDMVQALCTDEHFHRVIGNGDCSLDQRDCFKKTQRRVGSAAKNWNLSCRWKIFQALGFG

SEQ ID NO: 138029 - protein, 131 aa, Glycine max
  Coding DNA Sequence Number=SeqID_21251
  Gene Ontology: Mol. function=phospholipase C activity; Cellular component=membrane; Biological process=intracellular signaling cascade
  Homolog annotation: Hit_ID=Q75PK4; Match level="QueryCoverage=99%, HitCoverage=38%, E-value=4e-55, Identity=76%"; Hit description =Hypothetical protein LjNUF
NGVRGLTLDMNDYKDDIWLCQGPCSKYTAFLPAIYVLREVRAFLKTHPTQIITIFIEDHVTSRNGVNKVFNGAGLRRFWFPASKMPKYGGDWPTVKEMIRRNHRLIVFTSNATKEAREGIAYVWNYVVENQ

SEQ ID NO: 138030 - protein, 441 aa, Glycine max
  Coding DNA Sequence Number=SeqID_21252
  Gene Ontology: Mol. function=phospholipase C activity; Cellular component=membrane; Biological process=intracellular signaling cascade
  Homolog annotation: Hit_ID=Q9LT86; Match level="QueryCoverage=85%, HitCoverage=82%, E-value=1e-145, Identity=63%"; Hit description =MAP3K protein kinase-like protein
KPTLATTLFAVLLLIPSSLALKEGQTCVADKNCDSGLHCETCVANGNVRPRCTRVQPINPTSKIKGLPFNRYSWLTTHNSFAILGKKSMTGSVILSPTNQQDTITSQLNDVDLILHVKEKLSLVNLIRVRLICDKDVDLILDVKEKLSLNGVRGLMLDMYDFQNDIWLCHSFGGQCYNYTAFQPAINVLKEIQVFLDANPSEIVTIFIEDYVTSPKGLTKVFDAAGLRKYWFPVSRMPKNGGNWPTVDDMVKKNQRLVVFTSKSSKEASEGIAYEWRYLVENQYGNGGMKAGSCPNRAESPSMNTKSRSLVLVNFFRDLPDVTKSCKDNSAPLLSMVNTCYEAADKRWPNFIAVDFYKRSDGGGAPDAIDVANGHLVCGCENLASCKANMTFGVCQLPEAEATPPLAAAARNTSFGIRNCKPVYLLWSLATTVFGALLVAF

SEQ ID NO: 138031 - protein, 105 aa, Glycine max
  Coding DNA Sequence Number=SeqID_21253
MSLRTKPLYLSFSHFFLSPQLLHRGTAGDEGDGASTSFRHSLSLSGDVRIVDVKTDMHDMVSLQATLPHPMSSKAHHLPQATLPHPPLLRESPRLLVPKRNRNPF

SEQ ID NO: 138032 - protein, 122 aa, Glycine max
  Coding DNA Sequence Number=SeqID_21254
MTYLTPSLKLERVIQTVDKTFMPNPIVTIVHPYIQQCSTNFSIFLDIDAKRLHDIVLLDLAGQGGRCGTAWNLMAGRCCLVDNVRGWKVGWEGEECKDLVSGQNGDFMFFKKGWGEDSKRWS

SEQ ID NO: 138033 - protein, 211 aa, Glycine max
  Coding DNA Sequence Number=SeqID_21255
VFLPNSDSNTYDVTKTSFLLMSLSKEGHVVAFFDPNRRRSDFKLENRSELVAVDGGDDDVVVVGSRSLLERLMVEIYQRFANPQSPKSDRSRRQRRHIELKWSRHIYILVLKFYEFVDLTMYIALCSIEFDCDDDLFAIVGVSQCVNYQRNGFGGRFRSGINNLISNPKLDVDYRGKSKLDPDSSQLEFFPSKLGPIAIPIMWPPTQNQIF

SEQ ID NO: 138034 - protein, 212 aa, Glycine max
  Coding DNA Sequence Number=SeqID_21256
  Homolog annotation: Hit_ID=Q1SP02; Match level="QueryCoverage=92%, HitCoverage=42%, E-value=3e-24, Identity=33%"; Hit description=IMP dehydrogenase/GMP reductase
MVHMYDQLDEASRTTTRQIAGYLTLLQCWIYEHFPSVHQCATDDTYQEASPRASWWLTSKAHMKGITGAPYRARCDALTVMDVSWLPYTEHRGVRAFELISSFQGQLRWGPMVVTARPERVVRQFGYIQSIPPPPVSARLSYDDIDDRWMHFAEHVLPMGELCLVPGQVSADYIEWFFRISHPFMIPTQAGDQPRDAPAADPEEYIQLPSPQ

SEQ ID NO: 138035 - protein, 106 aa, Glycine max
  Coding DNA Sequence Number=SeqID_21257
  Homolog annotation: Hit_ID=Q1RTB4; Match level="QueryCoverage=38%, HitCoverage=9%, E-value=2e-07, Identity=58%"; Hit description=IMP dehydrogenase/GMP reductase
KEGRIRILSSCEGFPNVPLMGTRGCINYNPVLAIRQLGYPMRGAPLDESIALFITRGFSDPNANVLQGVRKACDAVAAIVSSSSEEVKGIITGQRHDLEGRAKGLP

SEQ ID NO: 138036 - protein, 83 aa, Glycine max
  Coding DNA Sequence Number=SeqID_21258
MPDNQDNIDAQSHPGPLGPSRIFLQKAVASGGSNLARLGELGGNHLPYFAINRGGSEEEKGSAPLALLSLSNLLGKIVSVKKI

SEQ ID NO: 138037 - protein, 76 aa, Glycine max
  Coding DNA Sequence Number=SeqID_21259
SVLFLDGGKGYNSAVECHLDVVEVISSSLIIPKPNRTPVEYEAPGYKLCLGMEENSESALSTNKEAISNATRNLME

SEQ ID NO: 138038 - protein, 259 aa, Glycine max
  Coding DNA Sequence Number=SeqID_21260
MRRLVGVGLGLMSSFAQGEPGADHLGMYTQAQFQTVEGHCQQCQALPQTLWYFRHETFAVPIPGLPVSRLDASKRGADDIQALNPEALPELIWAGSSQYWSRAVLNAAATQVTTAQGEQLNFKLVPKIASNRSYWNADTSAFLSQSPMFIRGEFADQTLVARTVWPQAFKLDLTAGLQPLQSGETLQSLVQFANGGAQSPYQSRLLWEKAPGAAQSSSGKTALGILLNGAQGDDDEAHGGHFALATGVVGAEGEYGTWL

SEQ ID NO: 138039 - protein, 75 aa, Glycine max
  Coding DNA Sequence Number=SeqID_21261
  Subcellular localization annotation: CTP_CleavageSite=21; ConfidenceScore=5.02e-01
MEDFSLPRIHLKPTEMTSSTRARKGNGLRAASIRLTPLDRKKRASRFFELLQALFQRRAWIPLAPLFHSLARLKK

SEQ ID NO: 138040 - protein, 173 aa, Glycine max
  Coding DNA Sequence Number=SeqID_21262
  Homolog annotation: Hit_ID=Q1SKD7; Match level="QueryCoverage=90%, HitCoverage=41%, E-value=6e-15, Identity=31%"; Hit description =Ankyrin
MAPRKLASKRSRKDKAAEGTSSAPEYDSHRFRSAVHQQRFEAIKGWSFLRERRVQLRDDEYTDFQEEIGRRRWASLVTPMAKFDPEIVLEFYANAWPTEEGVRDMRSWVRGQWIPFDADAIGQLLGYPLVLEEGQECEYGQRRNRSDGFDEEAIAQLLYMDDVAPQQHPAHRS

SEQ ID NO: 138041 - protein, 76 aa, Glycine max
  Coding DNA Sequence Number=SeqID_21263
  Gene Ontology: Mol. function=transmembrane receptor activity; Cellular component=membrane; Biological process=apoptosis
  Homolog annotation: Hit_ID=Q947E1; Match level="QueryCoverage=55%, HitCoverage=16%, E-value=1e-11, Identity=72%"; Hit description =Resistance gene analog NBS7
MSSAYGYDDYDIHDDQIEMEMDFLHERYQEDNRNYDVFLSFRGEDTRASFTSHLYTALRNAGIFVFKDDETLPRGK

SEQ ID NO: 138042 - protein, 44 aa, Glycine max
  Coding DNA Sequence Number=SeqID_21264
MKVQQAGLVADLGVAFVVDWVVGNENGRYWLSNDIAGLVGHLAT

SEQ ID NO: 138043 - protein, 66 aa, Glycine max
  Coding DNA Sequence Number=SeqID_21265
MTTAITFWRMAPMRVSISVSKRGKRDCLPAIPLFMQEMGIQRVYCFWRRMTAASGQAQYTGNDNYF

SEQ ID NO: 138044 - protein, 76 aa, Glycine max
  Coding DNA Sequence Number=SeqID_21266
MLVCRPKKRRCKKLFMNSLSEEDWLSEPYPLSEAGCSLRGWETLEEDKLEICMLNAQPTRPARTLSLLTLSAPKLA

SEQ ID NO: 138045 - protein, 236 aa, Glycine max
  Coding DNA Sequence Number=SeqID_21267
MELTSLDEGESLPAYSRYCKMPTDIRLIEAALCIPSRGVLSYSNLAPTSHTSDLTTDRARLIFGLGSQLDMNVGALISGQITSMAQSNSSRLGFPAFITTLCRSRGVASDSLVFKRLSPVINLAYIRKNYWNPADLAFTIGGARRARARPVEAPSTSAAPLPARTSAALSTPSFTQPPLHREDEGLTAQVPQQREDESSESSTLEPLIRRKRVFETQEAAATSEKSLKDTAEPSEP

SEQ ID NO: 138046 - protein, 113 aa, Glycine max
  Coding DNA Sequence Number=SeqID_21268
  Gene Ontology: Cellular component=integral to membrane
  Homolog annotation: Hit_ID=Q7CIN5; Match level="QueryCoverage=52%, HitCoverage=41%, E-value=1e-15, Identity=80%"; Hit description =Putative channel protein
MVTTRIPPAMRNESIEMPNIRRIPSPRKSDVHKMMATDRLARKQTDKELDKAGKIQQRLAHRCSALIAIKKSHRSQLSRMIPNTGKLKGSRTKSAAAQPVPFSSLPAPPVGVG

SEQ ID NO: 138047 - protein, 66 aa, Glycine max
  Coding DNA Sequence Number=SeqID_21269
MVMLVRMIHTHLFAMAWVKPCPGMHSSCAIAFLWLCSHNWPSFEIKGPLKVRTRSPQKARESATLQ

SEQ ID NO: 138048 - protein, 206 aa, Glycine max
  Coding DNA Sequence Number=SeqID_21270
GAAALVHTYKHMNDASQASTRQVGCYITLLQHFPTVHTCVVHDAYDEGSPRAYRWLMGKAHMTGIKGAPYWRRMDALTMTDRVLRQFGFIQTVPPPPVEPNYMEWFFWISHPFVTQTEETAEPRHPPPPHDEEFVEPPIPEVSVASDLSTHSMDLGAIVEDLERVINLRMVTEGTDLYDIMTHCLRRARGDAADGSLRPRQRRRID

SEQ ID NO: 138049 - protein, 278 aa, Glycine max
  Coding DNA Sequence Number=SeqID_21271
  Gene Ontology: Mol. function=hydrolase activity; Cellular component =integral to membrane; Biological process=establishment of competence for transformation
  Homolog annotation: Hit_ID=Q1CGG9; Match level="QueryCoverage=87%, HitCoverage=31%, E-value=2e-50, Identity=45%"; Hit description =Membrane protein
  Pfam annotation: Domain name=Competence; Domain location=157-278; Score=-56.1; E_value=0.0084; Accession=PF03772.6; Description =Competence protein
MLLRYAGLGLLLLSWALIEARQTVDTLEQLTMAPVAATLQITAVNPAKNQLTAQVIRAGDHYVFPPLFVTLRNVSDEVAWCAGQRWQMQLRLRAVHARLNEGEFDLQRFAIANHSALQGRIVSQQAESLRCSWRTRFIDHHLARFTGLTQPAIIQALAFGVREAMTPAQRALLRETGTAHLMAISGMHIALAASVGWLLARVIQLVLPARRIGYLMPLLISGLTAAAYCWISGGHPPAQRAMLALTLWLATRIAGWQLSNWQVWTLCVGSLLWLDPLP

SEQ ID NO: 138050 - protein, 85 aa, Glycine max
  Coding DNA Sequence Number=SeqID_21272
MGQLQWQAFCKAYGKIWDLTTAEVSVEAIASLTQYYDQPLRCFTLEDFQLVPTVEEFEEILGCHWVEGNHIFSQGSIPPWLEFPK

SEQ ID NO: 138051 - protein, 840 aa, Glycine max
  Coding DNA Sequence Number=SeqID_21273
  Gene Ontology: Mol. function=phosphopantetheine binding; Cellular component=nucleus; Biological process=metabolic process
  Homolog annotation: Hit_ID=Q1XME5; Match level="QueryCoverage=99%, HitCoverage=86%, E-value=1e-174, Identity=33%"; Hit description=Non -ribosomal peptide synthase:Amino acid adenylation
  Pfam annotation: Domain name=AMP-binding; Domain location=559-840; Score=87.2; E_value=4.9e-23; Accession=PF00501.18; Description=AMP -binding enzyme
  Pfam annotation: Domain name=Condensation; Domain location=72-369; Score=227.1; E_value=4e-65; Accession=PF00668.10; Description =Condensation domain
  Pfam module annotation: Pfam domain module=AMP-binding::Condensation; Domain location=559-840::72-369
MTVNGVMSINIRFSDKLFTENTIQKLLFAYQSHLEAIVKESEDSSVILTPSDLTYKGLSFSTIEEISKGNDIEDIYELSPMQQGLYYHWLVDPHGSIYYMQTSYRIKSSELNLSLVEKAFGMLLNRHSILRTSFENRYGEVPLQIVHKKAHVDFKHLILESELELDNIKQGDVNRGFVLSEPTQMRLVIVELPDGYYEFIWSHHHIIMDGWCLSILINDFSAILSSLEHGTEINLPETKKYSSYIEWLREVDDQETMKYWESYLSGVNVPAVIPFERDRASANEPKIIVSNKIKIEGDSFKGIEKLCKNIGITINTYIQGVWGYLLSRYNGSEDAVFGAVVSGRPPALEDVENIVGLFINTIPIRVKYKKEDTVKEFFLDLHTKSIQSSPYHYSKLSDIQTISGLGNNMINNIIVFENYPVQDSIMDNYVDNESSSSIEEIKNVEVVDETNYYFLITVFPSEDSVMLDIKYDASVFNRVLMDNIGMHFTNLLKNIFIDGERKILEAGYLGENEKKLLLEDFNNTTSFYPENQSIVSLFEDQVKQTPDHTAIIYEDLKLSYAELNDRASSLAWELQNTHGIKKGDHVGVMLNRGENQVISILGILKLGAVYVPIDANLPESRKEVMTSGLTLLITESYYFFDLDFYSGGSFSIDLELTGEINSEFNSEVLEKDDIAYIIYTSGSTGEPKGVMNTHGGILNMTQFQKEFFGVSAYHNVAQFASFSFDASIFEIFMTLLCGKSLHILSDVVRKDSFAFEEYVEKHSIDIVTLPPAFFNLLNVEKLQNLKAVITAGESAVIGKTKEFLQHGTFYNAYGPTETSICATVHKIEKGSDLALSIIPI

SEQ ID NO: 138052 - protein, 85 aa, Glycine max
  Coding DNA Sequence Number=SeqID_21274
MEGVQIKILKFLNCAFQSVFQSWIASGGSNPARLDELGDNLVPFFPIKRQRGVVLWVPNPPGYAFQLFWVKKIVFVKKIQAEVLP

SEQ ID NO: 138053 - protein, 75 aa, Glycine max
  Coding DNA Sequence Number=SeqID_21275
MTDAYGENLVERGIPPMSAYRNCSCQLVIDALSFNGSFLLSDWNVLKTSGYVDEKQNEACGCIAISKLPKLDQTF

SEQ ID NO: 138054 - protein, 114 aa, Glycine max
  Coding DNA Sequence Number=SeqID_21276
MANCSNNNAKESTNDEVALMSRKFKQDVSDNEKSKSSDDKQANIYLMAYTDKKVKVKTCSKSDTSSSASSDDEEDMPYDALDLLHQWSPLILEDEWKRDEEGRKMIGDTTSRRR

SEQ ID NO: 138055 - protein, 190 aa, Glycine max
  Coding DNA Sequence Number=SeqID_21277
  Subcellular localization annotation: CTP_CleavageSite=63; ConfidenceScore=5.09e-01
MTERYAWGVAALVDMYDQLNDASMSHSRQLGGYITLLAGFMSTFPRSRSPPLIRTTTRLPCECAGHDTGRGVGRGDRDDSNDAPQRRRPTASARRQRVLVTVVDDEPVVLATKADGASVEADVYADEPMAGGDVQDTGADTLADTGAHAAEDELEGFPGGPRDPSVLTEYADHVAGNIWTGDVFIILNFS

SEQ ID NO: 138056 - protein, 144 aa, Glycine max
  Coding DNA Sequence Number=SeqID_21278
MAPKKLLSKHARKDAAREGSSAAPQADIQFDRCWFRSKEHQRHRFEAIKSWSFLKERQSWNSMSMHGPWRRESRISAPRCGCRSKLHDESRLIQRSFDDNKGDDKKFKDQEKLHDNKDDDLKNERMSSRCSRLNQEHFKVQEEI

SEQ ID NO: 138057 - protein, 59 aa, Glycine max
  Coding DNA Sequence Number=SeqID_21279
MKGNAKNESKRAQWRLGVAAKGGSRKLVGGFWGRRWAYITKPSIPRQAEYPSFIRRSLI

SEQ ID NO: 138058 - protein, 100 aa, Glycine max
  Coding DNA Sequence Number=SeqID_21280
MPLPALVSTAQELVTEEPPAAATKDEDELTPPKPFDFDVGTHTAQEEKATPEQILEPSPSPVHALDDATPVVEPEQTIHDSLAAPALDLNEDQPQEEQDV

SEQ ID NO: 138059 - protein, 46 aa, Glycine max
  Coding DNA Sequence Number=SeqID_21281
MPRAQNSIAAIVPILGKEPWKQQRGATCALKPSLGLVLHEGSADGA

SEQ ID NO: 138060 - protein, 134 aa, Glycine max
  Coding DNA Sequence Number=SeqID_21282
  Gene Ontology: Mol. function=RNA-directed DNA polymerase activity; Biological process=RNA-dependent DNA replication
MMISFLWGSGTQPGKGINWLHWYKLTMKKEFGGMGFRNLHALNLAMLENTCEKAKQIWILAKLWDVIQDRFETTESFNDLIFNLLEQLQPHETNQLAILWCIWKIRNQKIWENVDPSPSIVVLTIRLVATVSTL

SEQ ID NO: 138061 - protein, 105 aa, Glycine max
  Coding DNA Sequence Number=SeqID_21283
  Gene Ontology: Mol. function=ribonuclease H activity; Biological process=DNA integration
MAQKIRRAGYYWLTMESDCCIHGIGVIGAIEPKASNGHHFILVAIDYFTKWVEVASYANATRSVVISFIKREIICRYGLLRKIITFNATNLNNKMMKEMCEDFKI

SEQ ID NO: 138062 - protein, 178 aa, Glycine max
  Coding DNA Sequence Number=SeqID_21284
MFQSSYDVRGGTSRLASNHKANKEKKESIIPDDFWAVETSSCDSTADEPIEISSSPSTPTRMKNQCHLRPDKFILQRTVAGRPQTQKKVSNNAVSHVEVRKELLTVKSEKDQKNAQNASLRGNFKNKSQQSSDVNNNGSFFYMETASNRSLFPRSVYLVNVVIGILLLIVISWDVLSC

SEQ ID NO: 138063 - protein, 85 aa, Glycine max
  Coding DNA Sequence Number=SeqID_21285
MKATPDLDSGGVGREVAARVMSELRGEGVEVGKARYSRICHLTQWLPLPRVVQNLPCCCASPPAPCFIFTGTINTCVVLLQQCDE

SEQ ID NO: 138064 - protein, 332 aa, Glycine max
  Coding DNA Sequence Number=SeqID_21286
  Gene Ontology: Mol. function=DNA binding; Cellular component=nucleus; Biological process=regulation of transcription
  Homolog annotation: Hit_ID=Q8L8G0; Match level="QueryCoverage=49%, HitCoverage=29%, E-value=8e-46, Identity=51%"; Hit description=Nam -like protein 1
  Pfam annotation: Domain name=NAM; Domain location=12-142; Score =244.2; E_value=2.7e-70; Accession=PF02365.6; Description=No apical meristem (NAM) protein
MENNIISICDHMPVGFRFRPTDEELVNYYLKHKLLADDFPVHIIPEIDLCKVEPWDVPERSVIKSDDPEWFFFSPVDYKYLKSKRFNRTTKRGYWKTTGNDRNVKIPGTSNVIGTKKTLVFHEGRGPRGVKTNWVIHEYHAVTSHESQRAFVLCRLMKKAEKKNEGGIEAPTFDEGEPSVHLFSDYGNQARAEGIASFMDIFTLCHVDIIPGVDMEEIFQAVDRAEKFSPPVQRSQTGIGLEDFFANSPLFNAHFGSENINMQTSLEVTDDEELVNSFWVDDEEFVINEERRHCFVNSSTQPKSFRRVYNESSEIDAEVVSNLVNIVCIMVM

SEQ ID NO: 138065 - protein, 123 aa, Glycine max
  Coding DNA Sequence Number=SeqID_21287
ITTHRSKLVGGGRMNENAIHGAPKKGENTIQGAPKKGREWRIALTNHYAWLQTRLENGELHKAITTHGSKLVGGGCMNENAIHGAPKKCREWRIALMNHYARFPTLGWRMHEQKLSSWGSKLK

SEQ ID NO: 138066 - protein, 83 aa, Glycine max
  Coding DNA Sequence Number=SeqID_21288
MSGLIRYSPQILTSPHQLDLAPYASGPYNAQWNAPGLLHDKHTLRLSRILGEMEVDEPWLGLWLPLQYQVVFSIGRVVGGFCG

SEQ ID NO: 138067 - protein, 41 aa, Glycine max
  Coding DNA Sequence Number=SeqID_21289
MALNVNHYPPRLEPIDGNWIAVDHEPIPHAFAVNIHRPPDP

SEQ ID NO: 138068 - protein, 153 aa, Glycine max
  Coding DNA Sequence Number=SeqID_21290
MEFFSNENFECFQAFENSNLMPFMSLKLPVYSELVKAFYSNLEIHEGTLMSEVYGIKIVIDQSLFYDLTKLPSEGVPFEGALIDDWKFDFSVHDARRLVCTSQADMTGRLLAGSLAFESRILPYLIVRILLPRSSNLAQVFEEDLIVMCAFHE

SEQ ID NO: 138069 - protein, 93 aa, Glycine max
  Coding DNA Sequence Number=SeqID_21291
MDNTFDDEVESAVTIDEYLEEVEERELERTNVKNNSLSLRPHPYGVNPSQLEQMQIPSFTTRLLLQTIILLSPRINYNPVVPTTQKRQRPPIT

SEQ ID NO: 138070 - protein, 530 aa, Glycine max
  Coding DNA Sequence Number=SeqID_21292
  Gene Ontology: Mol. function=transmembrane receptor activity; Cellular component=membrane; Biological process=defense response
  Homolog annotation: Hit_ID=Q1RVS5; Match level="QueryCoverage=86%, HitCoverage=93%, E-value=7e-82, Identity=42%"; Hit description=TIR; Disease resistance protein
  Pfam annotation: Domain name=NB-ARC; Domain location=154-452; Score= -55.0; E_value=8.8e-07; Accession=PF00931.13; Description=NB-ARC domain
  Pfam annotation: Domain name=TIR; Domain location=9-134; Score=20.6; E_value=6.3e-07; Accession=PF01582.10; Description=TIR domain
  Pfam module annotation: Pfam domain module=NB-ARC::TIR; Domain location=154-452::9-134
MSEPKIRDVLISCAEDTHQGFVGHLFKSLTDLGFSVKVVSGDHRDLKEEEIECFRVFIIVFSHHYATSSSRLDKLTEIINKYGAAEDRRIFPFFFEVEPNHVRFQSGSFEIAFDSHANRVESECLQRWKITLKKVTDFSGWSFNRSEKTYQYQVIEKIVQKVSDHVACSVGLHCRVEKVNDLLKSESDDTVRVLVYGESGIGKTTVVRGVCRSNGGKFAYYCFLEKVGENLRNHGSRHLIRMLFSKIIGDNDSEFGTEEILRKKGKQLGKSLLVFEDIFDQEQLEYIVKVASDCFSFNSKVIITAEKNCFLKCPEIEIYEVERLTKQESTDLFILKAFNCRNPKIKHLKIITQAVTMAPWVPYTLELIASYFREKSAEHCQRILDEYEKIPNEKKKQVIVQMIFDALSCDQKKMLIHIAYNLIGQEKAIVEDRLHRLFGVWAKDGIDMLLHKSLVKIDEQGQVTMHHLTHNMVKDMEYGKKEDQPASNYGSMCDLMELDKNGYVMEEIQPSSNDYEPMEYEYQNCSTSSS

SEQ ID NO: 138071 - protein, 114 aa, Glycine max
  Coding DNA Sequence Number=SeqID_21293
MFRCVDQLDPRKFPADQVNPCNIGGPNADQVNPASMLLHVFKENNVFPCALSPSFLPSIGASPLVHFLAIGLVRCREGEVEGEGEGVAVVIGGIVYEVRSVGCVLVYDRSCGSS

SEQ ID NO: 138072 - protein, 62 aa, Glycine max
  Coding DNA Sequence Number=SeqID_21294
MECTKEDIEHTKDNGGQEPYIGMKFESKEKAYLFYTCYAKIIGFEVSIRPKNSVLKLCNMLE

SEQ ID NO: 138073 - protein, 147 aa, Glycine max
  Coding DNA Sequence Number=SeqID_21295
YLGAKEWKKSQKLNILAQKEMLAPNHGYTDLTKAVRMVILPLPLPCMGSREKFTMAAIHGMLQEKGTRAPVVTKERGYRNTGFCDISEGNVQDIQKRGKMVILGTFSSPCDAILPRKGPVTRTMSKRLQEDWARAAEEGPRVLMNLR

SEQ ID NO: 138074 - protein, 260 aa, Glycine max
  Coding DNA Sequence Number=SeqID_21296
MMPVRARASATVTHTLPRKRRRGRGGSVVIICSPARALGCRHNTPPDDGLRSGVLPRAASADPRCASRRGDRGDGHRACGSVPARCTLGREGRHVEHQRPRLPAVRAGDGDVGRARVAPRRTPRHHDAPATHPRSLPHRLGRLDGHLGVMGGRDPRLSGSPHHPRGTDPARAHPGCDRGRGRAAPHQPTGADGRANLDLGVLRAGAGGRHRRLVGARTALSRHQSAAVLPHRRPPHPARTPPRRAADRAGGRRSGGVCRL

SEQ ID NO: 138075 - protein, 234 aa, Glycine max
  Coding DNA Sequence Number=SeqID_21297
ALEKRGWHERVARSTPTILEPHSRTYIHADWPCDIDVHERFPGFFAEPIEIFDELWERREAVYVGGVAVMIPSLTSSMVIGALHALRNMSIPRHRAEWDAIVTMLDERLDQMQRDDFVRIAEVGRAQWVLRDAIEHMGLGPVAQDVSAAEAQRWTSNLLFGADGGAAGWLIALRRGPMTSRVATLLRAVWVPREFVPRNDKSSPVSRSEVLRYQFERWRRGFRATRNYFRGSRQ

SEQ ID NO: 138076 - protein, 337 aa, Glycine max
  Coding DNA Sequence Number=SeqID_21298
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-41, Identity=30%"; Hit description= UPI00006A17C9 related cluster
RQHVLAFRELHVLTFRGLHALTIRGPHVLAFRGLHVLAFKGQHALTFRELHVLVFRGLHALTFRGLHVLAFKEQHVLTLRTTRLHAIAFRALHVLTIRGLHVLTIRGLHALAFRRLHFLAFRGLCVLTIRGLQVLTFRGMHALAFRGLHVRAFRGLHTIDFRGLHVLAFRGLHALAFIELHSLTFKGLHILIFKRLHVRTFRELHALTIGGLHVLTIRGLRVLTFRGLHALAFRGLHILALRGLHVVPFRGTHALALRGLHVLAFRGLHTLTFRGLHVLAFRRLHVLAFRRLHALPFRGLHVLTLGLHIIAFRGLYVLAFRGLHALGFIEQHTLTFR

SEQ ID NO: 138077 - protein, 191 aa, Glycine max
  Coding DNA Sequence Number=SeqID_21299
  Gene Ontology: Mol. function=catalytic activity; Cellular component =phosphopyruvate hydratase complex; Biological process=metabolic process
  Homolog annotation: Hit_ID=Q7WJ17; Match level="QueryCoverage=76%, HitCoverage=39%, E-value=1e-59, Identity=76%"; Hit description =Putative racemase
MLRRLAVQVVTATGVGRHGLQLDRAEELVQRQAGGLGIQVPQRDVQRADRAHHRALAPLQQGLLVHRLPQPLDRVRILAQQHRRQQALHRGLEDCAAGAADVAEADAFDAVGAADLHQSVVAGGDGAVRKRGDLVQRHGGCANVDGFNDGHGWLLMRGILRVARPARLAPAQRSDAFLPPPKKQTIILNHI

SEQ ID NO: 138078 - protein, 197 aa, Glycine max
  Coding DNA Sequence Number=SeqID_21300
  Gene Ontology: Mol. function=N-isopropylammelide isopropylaminohydrola se activity; Biological process=cytosine metabolic process
  Homolog annotation: Hit_ID=Q39BH6; Match level="QueryCoverage=100%, HitCoverage=50%, E-value=1e-62, Identity=62%"; Hit description=N -isopropylammelide isopropylaminohydrolase
MLVGQAEQHVERLRRVAVDGARVESAQHVRALRQRPVQQRRRARPHQQAGLRKRHGLDLDPAGQRRARAVHALQVTQAGIRIDVDVAADARGAFTQEGQRQRARMAGGVMAAGGAPGTFIVNAVGQRRAHLVHVPRRIPGGLVQVRVPFDQSRQQQRARPGLARHAGGRLQVWPDAFDTAAGNQYVDRRAIEQSNVV

SEQ ID NO: 138079 - protein, 92 aa, Glycine max
  Coding DNA Sequence Number=SeqID_21301
MGLNQAHAFAKKVHQVKLKYGSNHLAKNWGKRWIRKEHALWCPYRTRARARVMGEVKECTGQMKTDMEAMMSMKKIMEANAVAITATSTVAK

SEQ ID NO: 138080 - protein, 108 aa, Glycine max
  Coding DNA Sequence Number=SeqID_21302
  Homolog annotation: Hit_ID=Q1SKD7; Match level="QueryCoverage=91%, HitCoverage=26%, E-value=7e-09, Identity=35%"; Hit description =Ankyrin
MAPKKLSTKRSRRDATEEGSSAASEFDSHRFRSAEHQQRFEAIKGWSFHRERCVQLREDEYPDFQGEIARRHWAWLVTPMAKFDPEIVIEFYVNAWPTEEGVRDMRSW

SEQ ID NO: 138081 - protein, 52 aa, Glycine max
  Coding DNA Sequence Number=SeqID_21303
AKVVVALSELSGLSAYPSLSTASVRLALSAPLALSANPLTRAKRDSAISEPI

SEQ ID NO: 138082 - protein, 94 aa, Glycine max
  Coding DNA Sequence Number=SeqID_21304
  Subcellular localization annotation: CTP_CleavageSite=29; ConfidenceScore=5.05e-01
MVWRTLSVKNTALARRNGLSSVRPVETPRGRMCGKRHRPCKQNISPYVLSRGGYEYLEQKLMAEKTKKILEEAAQSGSTEGIIDPLSPIRQHVK

SEQ ID NO: 138083 - protein, 43 aa, Glycine max
  Coding DNA Sequence Number=SeqID_21305
MSAGIKMFSTSSKKSWFRVLMEEIGDQAARMLTSRAAISDYNI

SEQ ID NO: 138084 - protein, 34 aa, Glycine max
  Coding DNA Sequence Number=SeqID_21306
MASFNQMQSQFQSQMQSQGLALPPEPEVGPSGPR

SEQ ID NO: 138085 - protein, 165 aa, Glycine max
  Coding DNA Sequence Number=SeqID_21307
MRAKVRPRTPFKGHPHPPDHLQGHSYSFQLPLLRSHRSHYPQSFVKEGENPAKKVSKLSFEKGEEIAKVQFLPMNKKVKSITECIKMAYSMLIDMCSVQDSLDEQASQGSFVPHGRQDVLTTAIGRPEHPGRVRAAGAGVTIKQYFGSVPRTSRSSSSMPPEDLQ

SEQ ID NO: 138086 - protein, 80 aa, Glycine max
  Coding DNA Sequence Number=SeqID_21308
  Gene Ontology: Mol. function=transition metal ion binding; Cellular component=cytoplasm; Biological process=fucose metabolic process
MAWVSSDIPIVSQAEPVNVDIGHRLSAVLALVNLKARFGWSDKSFTELLVLLKNMLPEDNMLPKNHYEAKKILCPVGIEY

SEQ ID NO: 138087 - protein, 78 aa, Glycine max
  Coding DNA Sequence Number=SeqID_21309
MEGIIVLTPNSGRHTEIGARVSTNWSNAETSVNPSGEEDVAIVIPIMGLYVQRDHSTHLVALGKIYEGDAILPRKGIG

SEQ ID NO: 138088 - protein, 95 aa, Glycine max
  Coding DNA Sequence Number=SeqID_21310
MDAAIYEKEEACYHSLSYIMIPSDSCNCHNTNKSSCTNTLLPALIEAAEVDTREGTRGSKVQENSVMTGEVATGKAMTIRGDAEKRRQKKNLGID

SEQ ID NO: 138089 - protein, 94 aa, Glycine max
  Coding DNA Sequence Number=SeqID_21311
MDKSLKVGEDEWSKREKGGNEGKEVCIKGGNKGMDNTTQAMDIVVDVIANSRNFWGRIGYEVIDLKEVQWHSDGIWGLCLKGMNCLITPEESMP

SEQ ID NO: 138090 - protein, 132 aa, Glycine max
  Coding DNA Sequence Number=SeqID_21312
  Gene Ontology: Mol. function=hydrolase activity; Cellular component =mitochondrion; Biological process=metabolic process
  Homolog annotation: Hit_ID=Q9LKJ1; Match level="QueryCoverage=60%, HitCoverage=21%, E-value=1e-24, Identity=64%"; Hit description=CoA -thioester hydrolase CHY1
MTPVAFYFAYSLGNGRAFCAGGDVAAVARDGSKGDWRFGANFFQSEFKLNYLMATYSKPQVSILNGIVMGGGAGVSVHGRFRVVTENTIHGLPHGIQSLKRFKSGACPLDSLSSVFWSKFFFIFLSFHHSGW

SEQ ID NO: 138091 - protein, 106 aa, Glycine max
  Coding DNA Sequence Number=SeqID_21313
MSKSLKANANRMKNEEWMKNERRTVKNDVGINHRSASASFFFFFLLLLTNFTKMLSIYEAGPLTPTPSCLFIGNEGMEVEQQLAQASWLLPPEVSLLAQASWFLHS

SEQ ID NO: 138092 - protein, 94 aa, Glycine max
  Coding DNA Sequence Number=SeqID_21314
MEPETAKLGSSLLVDSVKELAKKALIEVPERYVHPNIDPPILVNTDSLLPQLPIIELHKLLSEDLKELEKLDFACKDWGFFQSLLSKLIGTKRD

SEQ ID NO: 138093 - protein, 112 aa, Glycine max
  Coding DNA Sequence Number=SeqID_21315
  Subcellular localization annotation: CTP_CleavageSite=62; ConfidenceScore=5.02e-01
TYQGNHSGVYPDLSSLTGSGVYPDSSSFIGSGVYPDLSSLTGSGVYPDLSSLTGSGVYPDLSSFIGSGVYPDLSSFTGSGVIQISVTCIKRSAPTQVQISYFIFYDKLNLNM

SEQ ID NO: 138094 - protein, 124 aa, Glycine max
  Coding DNA Sequence Number=SeqID_21316
VVPSVVRLMKQANVFPLKNTLKKFTIREINRDKDILKEDFQASNKVLITNKDSRDHILAINSTKTRVTMSNHKITESALKNLEVQVGQLAKQIAESHPTDEDSVMPKKKAAEKKGIDDEKDDVR

SEQ ID NO: 138095 - protein, 240 aa, Glycine max
  Coding DNA Sequence Number=SeqID_21317
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=8e-43, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLASIGLLALTFRGLHVLTFRGLHALAFRGLHALAIRGLHVLAIKGLHVLAFKGLHALTFRGLHVLSFRGLHALVIRGLHVLAFRGLHVLTFRGQHALPFKGLHALAFRGLHTLPFRGLHILTFRGLHVLAFKGLHAFAFRGLHELTFKGLHALIFRGLHVLTFIGLHALTFRGLHALTFIGLHALTLRGLHALAFRGLHALAIRGLHALTFKGLHVLAFKGLHVLTLVSHFCYPDP

SEQ ID NO: 138096 - protein, 108 aa, Glycine max
  Coding DNA Sequence Number=SeqID_21318
NVYTDNHSGISAYHRARRLWMIQGCRMTKFGLCLSSGPPPLDDKKGADNRKNDQTWSLLVIGPRRPLDDKKGADNRKGQYDKDYGAADKSKALAPTYPPMRNSDLRSS

SEQ ID NO: 138097 - protein, 76 aa, Glycine max
  Coding DNA Sequence Number=SeqID_21319
MTVKERLNHEVLKVTVRLSSAFGLSAHTTLSVASTRLARQKNLAEHKYLGYALSAAVVFSQAQRMTGAKLKSTNSC

SEQ ID NO: 138098 - protein, 87 aa, Glycine max
  Coding DNA Sequence Number=SeqID_21320
  Subcellular localization annotation: CTP_CleavageSite=19; ConfidenceScore=5.19e-01
MSSQQRQKQHTQMRKQGSCAEIKPQRPKSSNFENGKFVLKASLSPTTKRARDKGRRKKNVELEQGHEACTEWTVMDLKPAKQNHKIF

SEQ ID NO: 138099 - protein, 93 aa, Glycine max
  Coding DNA Sequence Number=SeqID_21321
MTKARQKGVRKVNEMKIKARETSEDQNLPVEDRRTTKNKRITVENLHEITHGSVTEVPRFGFSSRKQFFSLILSDSQIPGGLNIFVLPSSPCL

SEQ ID NO: 138100 - protein, 98 aa, Glycine max
  Coding DNA Sequence Number=SeqID_21322
MEVKIAASITAVWNGKWKEIHISHSPPDYFPSEYNEINTCSIYECANNKFAYLKKHIKAQFENFNNIQLETENLNCTPFYLEARVYLLPVGHPTLRAA

SEQ ID NO: 138101 - protein, 1395 aa, Glycine max
  Coding DNA Sequence Number=SeqID_21323
  Gene Ontology: Mol. function=ubiquitin-protein ligase activity; Cellular component=ubiquitin ligase complex; Biological process =protein ubiquitination
  Homolog annotation: Hit_ID=Q6H6D6; Match level="QueryCoverage=37%, HitCoverage=55%, E-value=3e-42, Identity=24%"; Hit description =Transducin-like
  Pfam annotation: Domain name=U-box; Domain location=455-528; Score =44.5; E_value=3.6e-10; Accession=PF04564.6; Description=U-box domain
  Pfam annotation: Domain name=WD40; Domain location=1088-1124; Score =15.4; E_value=0.21; Accession=PF00400.22; Description=WD domain, G -beta repeat
  Pfam annotation: Domain name=WD40; Domain location=1130-1168; Score =22.3; E_value=0.0017; Accession=PF00400.22; Description=WD domain, G- beta repeat
  Pfam annotation: Domain name=WD40; Domain location=1197-1233; Score =1.5; E_value=24; Accession=PF00400.22; Description=WD domain, G-beta repeat
  Pfam annotation: Domain name=WD40; Domain location=1286-1321; Score =9.4; E_value=2.9; Accession=PF00400.22; Description=WD domain, G -beta repeat
  Pfam annotation: Domain name=WD40; Domain location=1325-1364; Score =7.8; E_value=4.5; Accession=PF00400.22; Description=WD domain, G -beta repeat
  Pfam module annotation: Pfam domain module=U-box::WD40::WD40::WD40::WD 40::WD40; Domain location=455-528::1088-1124::1130-1168::1197 -1233::1286-1321::1325-1364
  Subcellular localization annotation: CTP_CleavageSite=58; ConfidenceScore=5.69e-01
MARAKQGSHWSFQKLPSESSNSGKLNPITVTSYSYTPRTDQSFTHSPATMTTVTVTTRAQILRHTAAFTSSVLSQSELRRRLIATLLRDTPLSDQKHLNLAADTLESAISFSSPPTRSSSLSLAEKLLLPLPDFPLSSLLLSLIHALRSRPTESAVSLLRIFHSNNNASLARSEIAPALYECLFSLHLFPVFRWFDDQRTRILSSSRNDDDYIYSVTSEEYSVLLPCAKVLSKMSEEQAAKLREVEREYEDVLNQNCMVLAEYFKEVLVNENGDAAVVSPPSLVLKSAAEDGHGGGEIRKEEMMQMNVLENGRYNNFSFFLKKGFQPIWSEREASIEFLSPSTSSRSSQAPFYPQRVLSRILKPQKASKTWTTPVYLNSTADTDFSLDESLLSSSSDSEAENDEEKDKTVALLEPRQSQIKEQMPTIFKQSRGSPDYPMADLDTPLHGIGKHAHPKDFVCPITSYIFDDPVTLETGQTYERKAIEEWFNRGNLTCPITRQKLQNTQLPKTNYVLKRLIASWKDRNPHLVPPSYEIPYEETEEAVKLTIPSTSPNSVITQATVDGMMSELRCAINNLYMSEVLQESEMAVLQIEKFWRGVNVGVDIHSMLSKPAIINGFMEILFNSVEPQVLQASVFLLAEMGSRDNAVIKTLTRVDSDVECIMALFKNGLTEAVVLLYLLNPSTVNLAEMAIVESLITVFNKKEEDLVKMCLKPKTAAVLLLARIIGGSEEIISSSVVNTLFSEKAIGTIVGSLGANLAKERIAAVEILLRCMEEDGTSRNNIADKAELTPLLETLIGATDGDRFKIIQFFSELVKLNRRTFNEQILHIIKEEGPFSTMHTLLIYLQTALQDQCPVMAGLLLQLDLLVEPRKMSIYREEAMDTLISCLRNADFPVTQLAAADTVISLQGSFDFSGNPLTREVLLKRAGIEKSSRSLVQEEEKAADDWERRIASVLVSHEFGTLFEALADGMKSRNPELRSACFISATWLIYMLTILPDTGIQVAARACLLKQFIAKLNSTKDVEDRILSMLALNSFLHFSDGLGDLTSYTKDIIKGLRELKRSCPLATKMLKVLVEENESKADIWIHTQLIKEDCSENGEVLSVICFKDKFFSGHTDGTIKVWTLKDNLFYLLQEIQEHTKAVTNLVILESDDRLYSGSLDRTAKVHDMKDQIHNLVVTNSLACFIPQGTGVKVQSLNGESKLLNSSKYVKCLAHVHGKLYCGCHDSSVQEIHLATGTVNTIQSGYKRLLGKANPIHALQIHGELVYAAGSNLDGSAIKIWNNSNYSMVGSLQTGSDVRAMAVSSELIYLGCKGGTLEIWDKKKHNRVDTLQMGTNCRVNCMALDGNGEVLVIGTSDGQIQLLNLWLTAGLGNELKEDAESATVQEDIDETYLDI

SEQ ID NO: 138102 - protein, 57 aa, Glycine max
  Coding DNA Sequence Number=SeqID_21324
MTRDLKEECRASILSYPIPIHGQGNWKGGLMSYLEEFESRSKGSTTLRAIGLRSTPN

SEQ ID NO: 138103 - protein, 122 aa, Glycine max
  Coding DNA Sequence Number=SeqID_21325
  Homolog annotation: Hit_ID=Q1H4V1; Match level="QueryCoverage=61%, HitCoverage=13%, E-value=2e-08, Identity=42%"; Hit description =Periplasmic sensor signal transduction histidine kinase
LHHCRHQVFQRCVQLHRSVQHGFFQAQQFAGLLVIVFELLVLVYDKDAIRHFACNEGVGFGQMFNVLAALGSQVFAALHASSQGPKLAAKQHAGGSEPIEAVQPQVLAVRSSFCKSVNWCKH

SEQ ID NO: 138104 - protein, 69 aa, Glycine max
  Coding DNA Sequence Number=SeqID_21326
MEKNRRRKTESPQRIARKEKGRVVTCDGEKVVQRRVRFPFETECNDSCIQFALIIVFNLELSVWTVWGN

SEQ ID NO: 138105 - protein, 158 aa, Glycine max
  Coding DNA Sequence Number=SeqID_21327
MHGAPNKSGEWRIALGNHFAWLQTHWWKMNERQSIHGAPNKSGEWRIALGNHYAWLQTRWWKMHERQSIHGAPNKSGEWRIAVGNHYAWLQTHWWWMHERKSMHGALNKCGEWRIALGNHFAWLQTQWWRMHERQSIHGAPNKSGEWTFALGNHFAWL

SEQ ID NO: 138106 - protein, 66 aa, Glycine max
  Coding DNA Sequence Number=SeqID_21328
MEHETFLATWLVEIDFSPNGLRFSNLQPQPRLINHEKPMLCGWHKLHPLKIEGRRFALDSARDYFP

SEQ ID NO: 138107 - protein, 110 aa, Glycine max
  Coding DNA Sequence Number=SeqID_21329
MNFKSSPIFVNAHAWCSFGLAIGTCCADNLCVLNGAFSGISRRFQRVDRGEGFGEEGNAAVVWRWRRNDKVGSTKRGRRKLSRTKNGNVETRLRNSSYASACGPVQRVNP

SEQ ID NO: 138108 - protein, 247 aa, Glycine max
  Coding DNA Sequence Number=SeqID_21330
  Pfam annotation: Domain name=Transposase_23; Domain location=43-113; Score=-6.8; E_value=0.0063; Accession=PF03017.5; Description =TNP1ENSPM transposase
MLSLSHMQSQGLALPPEPGVGPSTARVSTKESCADPSGNNQDTGDSYKCGLYIEEYPPRLVALGRVYEGSTSIHNIPLLHDQVKVGVEEIRDANAPIPVPTKEVKVMGQALNTFLAWPTHLVKRLSEQGVVGPAKPVDRPDDEVDDPLYLMTLTIPQLFLKPLQVMWDATLFGLFYENFPLYIKHEDLSEIAHGGQYLSISVIQLWILHMTETSMRAGNIDVYGFLEPQSIQRSGQSQFESESYIKN

SEQ ID NO: 138109 - protein, 124 aa, Glycine max
  Coding DNA Sequence Number=SeqID_21331
  Gene Ontology: Mol. function=catalytic activity; Cellular component =peroxisome; Biological process=metabolic process
  Homolog annotation: Hit_ID=Q69RG7; Match level="QueryCoverage=93%, HitCoverage=24%, E-value=1e-16, Identity=37%"; Hit description =Putative 4-coumarate--CoA ligase 1
YCENNCGVADVEEARHLGARAERARGGDDYAERKKREVEDRNLEDVWGENKCGVTFGFGAVEELAVGEAVAGGGVDKGNGGVQEQRVAAEAEDEGGGRYGNVGKREAERGLKAVEGSGIAKKIR

SEQ ID NO: 138110 - protein, 57 aa, Glycine max
  Coding DNA Sequence Number=SeqID_21332
MEVMYWFRTNVYAKSPKLFRVLNCWFMDDTLMEMVDQSWNLSKYKESSFCANGEVKL

SEQ ID NO: 138111 - protein, 644 aa, Glycine max
  Coding DNA Sequence Number=SeqID_21333
  Gene Ontology: Mol. function=protein serine/threonine kinase activity; Cellular component=nucleus; Biological process=protein amino acid phosphorylation
  Homolog annotation: Hit_ID=Q9XF36; Match level="QueryCoverage=99%, HitCoverage=98%, E-value=0.0, Identity=74%"; Hit description=Mitogen- activated protein kinase homologue
  Pfam annotation: Domain name=Kdo; Domain location=12-205; Score= -80.7; E_value=0.03; Accession=PF06293.4; Description=Lipopolysacchari de kinase (Kdo)
  Pfam annotation: Domain name=Pkinase; Domain location=16-314; Score =298.7; E_value=1.1e-86; Accession=PF00069.15; Description=Protein kinase domain
  Pfam annotation: Domain name=Pkinase_Tyr; Domain location=16-312; Score=25.1; E_value=5.2e-14; Accession=PF07714.7; Description =Protein tyrosine kinase
  Pfam module annotation: Pfam domain module=Kdo::Pkinase::Pkinase_Tyr; Domain location=12-205::16-314::16-312
MKEVEFFTEYGDANRYKILEVVGKGSYGVVCSAIDTHTGGKVAIKKIHDIFEHISDAIRILREVKLLRLLRHPDIVEIKRIMLPPSKREFKDIYVVFELMESDLHQVIKANDDLTREHHQFFLYQMLRAMKYMHTANVYHRDLKPKNILANANCKLKVCDFGLARVAFSDAPTTTFWTDYVATRWYRAPELCGSFFSKDSLAKIYYTPAIDIWSIGCIFAEVLTGKPLFPGKSVVHQLDLITDLLGTPPPETIAGVRNDKARKYLMEMRKKSPVPFEQKFPNADPLALRLLQRLLAFDPKDRPTAQEALADPFFKGLAKVEREPSCQPISRLEFEFERRRVTKDDVRELIYREILEYHPQLLKDYMNGTEGTHFLYPSAIDQFRKHFAYLEENHGKSGPVIPPERKHVSLPRSIVHSSTIPPSTQPSFTSYENKHMAEEASKVTRSVESNSGSQLRSSRPPPRVPAEFKIKNSVEQQKRNKNELHWLRKAHKSIWHYKVKLNMKPAKPGRIVGPVLHYDNGRTLKDTYDQRIFYRNTLPQAVSPHCFHRVQQPTITKTTSETYKNIPQGKHQLPSQQCSMPARPTIDLNTNPYYQQGKSDHLNDPVASIDAKLLQAQSQFGGVGAAAVAVAAHRHSGSFQYGLS

SEQ ID NO: 138112 - protein, 95 aa, Glycine max
  Coding DNA Sequence Number=SeqID_21334
MSKVEGSKYEELRMWRIVENQAKIEALWLSKLATIVKDKIQKAKKKDKKKANDDDEDYVPEYEGGLRSNSSSENYENDKHDEFAITNDLESRKRK

SEQ ID NO: 138113 - protein, 212 aa, Glycine max
  Coding DNA Sequence Number=SeqID_21335
GTSFVVQVEGTYTWVVVTENKRGYISCGSVLVEGTSTRLFKENKGGYIRCGSLLVKEFTRLKRNLKDHRSLGDWMPLDPTGSSSRIHSISGTVNGKGILARNPAFYCERRWGSQCSSSSAGGGLEMRPNEAASPEPVPVPTDPPSLVVDPSSPAPEVAFPSTPLIISKDPIVPVPGLATTPPATPVLHFADEEEGQTTTRPGTLVLHLDDKE

SEQ ID NO: 138114 - protein, 94 aa, Glycine max
  Coding DNA Sequence Number=SeqID_21336
  Homolog annotation: Hit_ID=Q6ESI7; Match level="QueryCoverage=48%, HitCoverage=3%, E-value=1e-13, Identity=65%"; Hit description =Putative tripeptidyl peptidase II
MSYDDKGPAIDVVVWYDGEVWRVALDTHSLHDDPDCGKLANFIPLTNYSALGPWHGVIANDACVRLCLHAWAMQCMEAPMFLENECALLRDAFG

SEQ ID NO: 138115 - protein, 122 aa, Glycine max
  Coding DNA Sequence Number=SeqID_21337
MDRARLVYGLVFNMDMNIGALISGQISFIAQSNSSRLEFPALIIALCRARGVTSDSLTYESLSPTINMAYNKKNCWNVDDLTINFRGARKVKARPTDAPSSSTPPAPSTSATPTPAPPGLSA

SEQ ID NO: 138116 - protein, 67 aa, Glycine max
  Coding DNA Sequence Number=SeqID_21338
MKRCYGKALAEKNVPNHNKSFRGTKNGGNLHVPKTDTDLTERGAYNKNASFTRPWWCHNDLFVGIQV

SEQ ID NO: 138117 - protein, 224 aa, Glycine max
  Coding DNA Sequence Number=SeqID_21339
  Gene Ontology: Mol. function=structural constituent of ribosome; Cellular component=intracellular; Biological process=translation
  Homolog annotation: Hit_ID=Q9LI88; Match level="QueryCoverage=57%, HitCoverage=70%, E-value=3e-18, Identity=36%"; Hit description =Arabidopsis thaliana genomic DNA, chromosome 3, P1 clone:MYF5
  Pfam annotation: Domain name=Ribosomal_S21; Domain location=116-169; Score=40.8; E_value=4.6e-09; Accession=PF01165.10; Description =Ribosomal protein S21
MPGADKPVRGASAGVAGFRGWLNYAASEQIVLRVHHMRAIGAGLFAITPAGERGMCCKAIKLGNARVFPVTTLSTAEDPPTSASASAHAIGIDNDSLVKSILYPALSLSNILHFNVQIMVGKDEPEDKIINRFKKEVLKASVLQECKHTRFFENKHDKIKRKAHEASRRNRKRKPQSRAWAKNKHGSIKKKKDAANDDIDDWELPHVDIPGTELEFVIMVIAVS

SEQ ID NO: 138118 - protein, 115 aa, Glycine max
  Coding DNA Sequence Number=SeqID_21340
MEFGDIVVHFNILDAMKHPSKDHSVFRAEIIDQIVDDYMFDFDFVLHESEFEFESDSNFLGVVPLDVDFLESECTNHVAGSTYTSDLLYEVQAKSPVLLSLENQAQLSLRFCYYY

SEQ ID NO: 138119 - protein, 420 aa, Glycine max
  Coding DNA Sequence Number=SeqID_21341
  Gene Ontology: Mol. function=lipoxygenase activity; Cellular component=chloroplast; Biological process=electron transport
  Homolog annotation: Hit_ID=Q1S9M9; Match level="QueryCoverage=98%, HitCoverage=49%, E-value=1e-170, Identity=67%"; Hit description =Plant lipoxygenase; Lipase/lipooxygenase, PLAT/LH2
  Pfam annotation: Domain name=Lipoxygenase; Domain location=87-420; Score=43.1; E_value=1.5e-16; Accession=PF00305.9; Description =Lipoxygenase
  Pfam annotation: Domain name=PLAT; Domain location=2-75; Score=29.3; E_value=1.4e-05; Accession=PF01477.13; Description=PLATLH2 domain
  Pfam module annotation: Pfam domain module=Lipoxygenase::PLAT; Domain location=87-420::2-75
DAHKTEEKEDEVYYEATFELPTEFGKVGAVLVENEHHNEMFLKSIVFDGFPDGPVHLTCDSWVQPKYDNPVKRVFFTDKSYLPSQTPSGLRRLREEELELLRGNGEGERKSSDRIYDYDVYNDLGDPDSNINLKRPVLGGSKQYPYPRRCRTGREHTDSDPSSEKRSLDFYVPRDETFSDVKQSQFTMSTISSGLSAILESLDAILTDQNLGFRSFEDIDTIYKEGFKLPPLKGNGLNFLQRTVPRLIEAANDSQNLLRFDTPETLKNEEFARETLAGEWPLRSKLESQIYGPPESAITREVIEPHILGYGTIEEAIKEKKLYMLDYHDLLLPYVSKVREIEGTTLYGSRTLFFLTKQGTLKPLAIELTRPPIDGKPQWKQVFTPASYSISHSTNLWLWRLAKAHVLAHDAGVHELINHW

SEQ ID NO: 138120 - protein, 111 aa, Glycine max
  Coding DNA Sequence Number=SeqID_21342
  Subcellular localization annotation: CTP_CleavageSite=37; ConfidenceScore=5.51e-01
MNIGSCFLSQGKLSFPASSNIRVPREVRIGCVSRHVKAVMRKKSGTSNNNPNKAQNAKAIVIVKRSGGGGLLTNLVRDGVEGIEELVGKTLILELVSNELDSKKLICGLST

SEQ ID NO: 138121 - protein, 127 aa, Glycine max
  Coding DNA Sequence Number=SeqID_21343
MGVGGDGVAKPEVMKGLPKMVEREGGRMRSLPSLFAPPITPSSSPPSTTSPSNLDDVNGSVDMEECGVKEQVSKVDLEYLAQKKLPWPMAHGNGGGVIIVVVDVVNSDDDECDGYLVVRGVMIVEFE

SEQ ID NO: 138122 - protein, 74 aa, Glycine max
  Coding DNA Sequence Number=SeqID_21344
MAGILFLLKQQNSLEITSVIISASLAEEQEKKLLSVFKKHKKAIGWTLADIPVKKEVTELLQAGIIYPISDSQW

SEQ ID NO: 138123 - protein, 64 aa, Glycine max
  Coding DNA Sequence Number=SeqID_21345
MELQMHTYMRHLADYATIAWPRDRPIFQEEAGPTGAQGSAQGDGGRVEDDEDMTDLVDYFIGGD

SEQ ID NO: 138124 - protein, 63 aa, Glycine max
  Coding DNA Sequence Number=SeqID_21346
MWTTTGEKLAAQLAQASQVASSRSNSLLEGPSGPAFEEVTKTHGLRKIPPFDFRHITEFSRIA

SEQ ID NO: 138125 - protein, 105 aa, Glycine max
  Coding DNA Sequence Number=SeqID_21347
MVGAGLKKDLRVSRVVPGGSLNAFLFLLIGVISQRLAMGFLIWDPGEEDQAGPCEQLDALSPFNPLSEMWQKEKESMDRPHRLHPVGTTRSPQGRLRHPGVADRP

SEQ ID NO: 138126 - protein, 96 aa, Glycine max
  Coding DNA Sequence Number=SeqID_21348
MMFLALFGLPLAGMFLQILFSCYPSTFPERFCCQVSSMIQLAAHFKCKAFAHEFLAPLFHWPHLGGNQYFNSQSKWKDERVQKMGRLLHFWIAFEE

SEQ ID NO: 138127 - protein, 304 aa, Glycine max
  Coding DNA Sequence Number=SeqID_21349
  Gene Ontology: Mol. function=transporter activity; Cellular component= integral to membrane; Biological process=transport
  Homolog annotation: Hit_ID=P23958; Match level="QueryCoverage=74%, HitCoverage=88%, E-value=1e-114, Identity=89%"; Hit description =Probable aquaporin TIP-type alpha
  Pfam annotation: Domain name=DUF1550; Domain location=175-237; Score=- 12.6; E_value=0.1; Accession=PF07584.2; Description=Protein of unknown function (DUF1550)
  Pfam annotation: Domain name=MIP; Domain location=13-234; Score =428.0; E_value=1.3e-125; Accession=PF00230.10; Description=Major intrinsic protein
  Pfam module annotation: Pfam domain module=DUF1550::MIP; Domain location=175-237::13-234
MATRRYAFGRADEATHPDSMRATLAEFVSTFIFVFAGEGSGLALVKIYQDSAFSAGELLAVALAHGFALFAAVSASMHVSGGHVNPAVTFGALIGGRISVLRAVYYWIAQILGAIVAALVLRLVTNNMRPSGFHVGQGVGVGHMLILEIVMTFGLMYTVYGTAIDPKRGAVSNIAPLAIGLIVGANILVGGPFDGACMNPALAFGPSLVGWRWHQHWIFWVGPLIGAALAALLSPHLAAQRASDGVAHGHLCQLDSAYALSEHMLKEEKAQVAGVSLSEACSSLSVLGNSRRGSVRDVLAQRAA

SEQ ID NO: 138128 - protein, 591 aa, Glycine max
  Coding DNA Sequence Number=SeqID_21350
  Gene Ontology: Mol. function=protein-tyrosine kinase activity; Cellular component=integral to membrane; Biological process=protein amino acid phosphorylation
  Homolog annotation: Hit_ID=Q1SNC9; Match level="QueryCoverage=99%, HitCoverage=96%, E-value=0.0, Identity=69%"; Hit description=Protein kinase
  Pfam annotation: Domain name=LRRNT_2; Domain location=11-53; Score =24.6; E_value=0.00034; Accession=PF08263.3; Description=Leucine rich repeat N-terminal domain
  Pfam annotation: Domain name=LRR_1; Domain location=104-126; Score =5.5; E_value=27; Accession=PF00560.23; Description=Leucine Rich Repeat
  Pfam annotation: Domain name=LRR_1; Domain location=128-149; Score =7.1; E_value=13; Accession=PF00560.23; Description=Leucine Rich Repeat
  Pfam annotation: Domain name=LRR_1; Domain location=150-171; Score =8.8; E_value=6.4; Accession=PF00560.23; Description=Leucine Rich Repeat
  Pfam annotation: Domain name=LRR_1; Domain location=81-102; Score =12.1; E_value=1.5; Accession=PF00560.23; Description=Leucine Rich Repeat
  Pfam annotation: Domain name=Pkinase; Domain location=306-580; Score =15.1; E_value=1.8e-09; Accession=PF00069.15; Description=Protein kinase domain
  Pfam annotation: Domain name=Pkinase_Tyr; Domain location=305-580; Score=33.2; E_value=1.6e-14; Accession=PF07714.7; Description =Protein tyrosine kinase
  Pfam module annotation: Pfam domain module=LRRNT_2::LRR_1::LRR_1::LRR_ 1::LRR_1::Pkinase::Pkinase_Tyr; Domain location=11-53::104-126::128 -149::150-171::81-102::306-580::305-580
MVLCIELEEYYPEERDALMLIRDSLNSSVNLHGNWTGPPCIDNHSRWIGITCSNWHVVQIVLEGVDLSGYLPHTFLLNITFLSQLDFRNNALSGPLPSLKNLMFLEQVLLSFNNFSGSIPVEYVEIPSLQMLELQENYLDGQIPPFDQPSLASFNVSYNHLSGPIPETYVLQRFPESAYGNNSDLCGEPLHKLCPIEPPAPSPSVFPPIPALKPNKKRFEAWIVALIGGAAALFLLSLIIIIAFMLCKRRTNGKESTRNDSAGYVFGAWAKKMVSYAGNGDASERLGRLEFSNKKLPVFDLDDLLRASAEVLGRGNLGITYKATLETGTVVAVKRINHMNEVSKKEFIQQMQSLGQMKHENLVEIISFYFSEEQKLIIYEFTSDGTLFELLHEGRGIGRMPLDWTTRLSMIKDIAKGLVFLHHSLPQHRVPHANLKSSNVLIHQDSKGYHCKLTDCGFLPLLQAKQNAEKLAIRRSPEFVEGKKLTHKADVYCFGIIMLEIITGRIPGHILGEIEETTNDLSDWVRTVVNNDWSTDILDLEILAEKEGHDAMLKLTELALECTDMTPEKRPKMNVVLVRIEEIEQMRKEND

SEQ ID NO: 138129 - protein, 228 aa, Glycine max
  Coding DNA Sequence Number=SeqID_21351
  Pfam annotation: Domain name=zf-CCHC; Domain location=45-62; Score =17.7; E_value=0.0012; Accession=PF00098.13; Description=Zinc knuckle
MAQAGETLHDKINLQQVAFETMCVWPPNKNKKEKGSKKNKVDLKDICSYCKEPSHWKKDCLKKVKKYFVALVVQNDSSSKNDLVLVVVGEQPQQYSEQWVLDSGYSYHMCPHRSLLVMQFSWVPWIQKVFLAELKLELCKSEEKGSLRKQNQTKFPKVVHTTKATLDYAYFDYWGPSRVPSLGGTRTTASSNPIPLGQAEDVHIGTSLSHDSYKIEQVINEQVTARNP

SEQ ID NO: 138130 - protein, 300 aa, Glycine max
  Coding DNA Sequence Number=SeqID_21352
MAGREVREYTNLSDPKDKKWGKGKDKIDDEDITFQRMVAKVGFDKFLCLWDEHLSMKLGVMDGLLYLSEESILGILLITCPGRDIGFLYWVADASRCKRLLGSAEVTFMDEAFKCAALDSDDLLYLKEQMEAEEDAERLLRRTEKRAFAAFKISFCAVKLRLDDWLVMGLNPETAFLYIQAEYRAASLADSSPASVPLAFRVEPKPKSGIRQQDLLKKVVEIKPKRPRSDANRKPDHDPSKEKEQSLPRTKKVEEQPLSGSKKAEEHAPLGSQEAEAKPKVESSSGGLLGLAYDSSDDDE

SEQ ID NO: 138131 - protein, 487 aa, Glycine max
  Coding DNA Sequence Number=SeqID_21353
  Gene Ontology: Mol. function=monooxygenase activity; Cellular component=membrane; Biological process=electron transport
  Homolog annotation: Hit_ID=Q1SND2; Match level="QueryCoverage=99%, HitCoverage=99%, E-value=0.0, Identity=86%"; Hit description=E-class P450, group IV
  Pfam annotation: Domain name=p450; Domain location=42-478; Score =105.3; E_value=1.8e-28; Accession=PF00067.12; Description=Cytochrome P450
MRENISESWLLVMSTVILATAIFAKLFQFKLRTEDKSKCRLPPGRRGWPLIGDSINWYNAVASSHPPQFVEEMVKRYGKIFSCSLFGKWAVVSADPSFNRFVMQNEGKLFKSSYPKSFRDLVGKNGVITVQGDQQRKLHGIASNMMRLEKLKFHFLNDVQKVMLQTLSNFNNNQVILLQDVCRKVAIHLMVNQLLGVSSESQVNEMSQLFSDFVDGCLSIPINIPGYAYHTAMKGREKIIGKINKTIEVHRQNGASIEGNGVLGRLLEEESLPDDAVADFIINLLFAGNETTTKTMLFAVYFLTQCPRAMKQLLDEHDSLRSSNSGDEFLTWQDYKAMTFTQCVIDETLRLGGIAIWLMREAKEDVQYQDFVIPKGCFVVPFLSAVHLDENVYGGALNFNPWRWMEPENEEKRNWRTSSFYAPFGGGARFCPGAELARLQIAFFLHYFVTTYRWTQIKEDRMSFFPSARLVNGFEIRLMRRHDNETD

SEQ ID NO: 138132 - protein, 615 aa, Glycine max
  Coding DNA Sequence Number=SeqID_21354
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=96%, HitCoverage=60%, E-value=0.0, Identity=61%"; Hit description=Protein kinase
  Pfam annotation: Domain name=LRRNT_2; Domain location=33-71; Score =32.2; E_value=1.8e-06; Accession=PF08263.3; Description=Leucine rich repeat N-terminal domain
  Pfam annotation: Domain name=LRR_1; Domain location=122-144; Score =14.4; E_value=0.41; Accession=PF00560.23; Description=Leucine Rich Repeat
  Pfam annotation: Domain name=LRR_1; Domain location=147-169; Score =12.1; E_value=1.5; Accession=PF00560.23; Description=Leucine Rich Repeat
  Pfam annotation: Domain name=LRR_1; Domain location=171-193; Score =7.7; E_value=11; Accession=PF00560.23; Description=Leucine Rich Repeat
  Pfam annotation: Domain name=LRR_1; Domain location=195-219; Score =13.1; E_value=1; Accession=PF00560.23; Description=Leucine Rich Repeat
  Pfam annotation: Domain name=LRR_1; Domain location=221-243; Score =10.2; E_value=3.5; Accession=PF00560.23; Description=Leucine Rich Repeat
  Pfam annotation: Domain name=LRR_1; Domain location=245-267; Score =14.7; E_value=0.34; Accession=PF00560.23; Description=Leucine Rich Repeat
  Pfam annotation: Domain name=LRR_1; Domain location=269-291; Score =11.4; E_value=2.1; Accession=PF00560.23; Description=Leucine Rich Repeat
  Pfam annotation: Domain name=LRR_1; Domain location=292-314; Score =19.4; E_value=0.013; Accession=PF00560.23; Description=Leucine Rich Repeat
  Pfam annotation: Domain name=LRR_1; Domain location=316-338; Score =15.1; E_value=0.25; Accession=PF00560.23; Description=Leucine Rich Repeat
  Pfam annotation: Domain name=LRR_1; Domain location=340-362; Score =4.8; E_value=36; Accession=PF00560.23; Description=Leucine Rich Repeat
  Pfam annotation: Domain name=LRR_1; Domain location=364-383; Score =6.8; E_value=15; Accession=PF00560.23; Description=Leucine Rich Repeat
  Pfam annotation: Domain name=LRR_1; Domain location=388-410; Score =10.2; E_value=3.6; Accession=PF00560.23; Description=Leucine Rich Repeat
  Pfam annotation: Domain name=LRR_1; Domain location=412-435; Score =6.7; E_value=16; Accession=PF00560.23; Description=Leucine Rich Repeat
  Pfam annotation: Domain name=LRR_1; Domain location=436-455; Score =6.5; E_value=17; Accession=PF00560.23; Description=Leucine Rich Repeat
  Pfam annotation: Domain name=LRR_1; Domain location=458-480; Score =7.0; E_value=14; Accession=PF00560.23; Description=Leucine Rich Repeat
  Pfam annotation: Domain name=LRR_1; Domain location=482-504; Score =10.0; E_value=3.8; Accession=PF00560.23; Description=Leucine Rich Repeat
  Pfam annotation: Domain name=LRR_1; Domain location=506-528; Score =9.9; E_value=3.9; Accession=PF00560.23; Description=Leucine Rich Repeat
  Pfam annotation: Domain name=LRR_1; Domain location=530-552; Score =16.1; E_value=0.13; Accession=PF00560.23; Description=Leucine Rich Repeat
  Pfam annotation: Domain name=LRR_1; Domain location=554-572; Score =4.4; E_value=43; Accession=PF00560.23; Description=Leucine Rich Repeat
  Pfam annotation: Domain name=LRR_1; Domain location=575-597; Score =18.0; E_value=0.035; Accession=PF00560.23; Description=Leucine Rich Repeat
  Pfam annotation: Domain name=LRR_1; Domain location=74-96; Score=7.7; E_value=10; Accession=PF00560.23; Description=Leucine Rich Repeat
  Pfam annotation: Domain name=LRR_1; Domain location=98-120; Score =9.5; E_value=4.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=33-71::122 -144::147-169::171-193::195-219::221-243::245-267::269-291::292 -314::316-338::340-362::364-383::388-410::412-435::436-455::458 -480::482-504::506-528::530-552:...
  Pfam module annotation: =:554-572::575-597::74-96::98-120
MAMPIAQSCKKFPCRIFLLLFFLLGHTSSQSLYDQEHAVLLNIKQYLQDPPFLSHWNSTSSHCSWSEITCTTNSVTSLTLSQSNINRTIPTFICGLTNLTHLDFSFNFIPGEFPTSLYNCSKLEYLDLSRNNFDGKVPHDIDKLGANLQYLNLGSTNFHGDVPSSIAKLKQLRQLKLQYCLLNGTVAAEIDGLSNLEYLDLSSNFLFPEWKLPWNLTKFNKLKVFYLYGTNLVGEIPKNIGDMVTLEMLDMSNNSLAGGIPNGLFLLKNLTSLLLYANSLSGEIPSVVEALNLVYLDLARNNLTGKIPDAFGKLQQLSWLSLSLNGLSGVIPESFGNLPALKDFRVFFNNLSGTLPPDFGRYSKLQTFMIASNGFTGKLPENLCYHGMLLSLSVYDNNLSGELPELLGNCSGLLDLKVHNNEFSGNIPSGLWTSFNLTNFMVSRNKFTGVLPERLSWNISRFEISYNQFSGGIPSGVSSWTNLVVFDASKNNFNGSIPWKLTALPKLTTLLLDQNQLSGALPSDIISWKSLVTLNLSQNQLSGQIPNAIGQLPALSQLDLSENEFSGLVPSLPPRLTNLNLSFNHLTGRIPSEFENSVFASSFLGNSGLVLIHQH

SEQ ID NO: 138133 - protein, 312 aa, Glycine max
  Coding DNA Sequence Number=SeqID_21355
  Gene Ontology: Mol. function=protein serine/threonine kinase activity; Cellular component=integral to membrane; Biological process=protein amino acid phosphorylation
  Homolog annotation: Hit_ID=Q1SND5; Match level="QueryCoverage=100%, HitCoverage=30%, E-value=1e-128, Identity=73%"; Hit description =Protein kinase
  Pfam annotation: Domain name=Pkinase; Domain location=1-277; Score =167.0; E_value=4.9e-47; Accession=PF00069.15; Description=Protein kinase domain
  Pfam annotation: Domain name=Pkinase_Tyr; Domain location=1-277; Score=75.9; E_value=1.3e-19; Accession=PF07714.7; Description =Protein tyrosine kinase
  Pfam module annotation: Pfam domain module=Pkinase::Pkinase_Tyr; Domain location=1-277::1-277
MTEQNIIGSGGYGIVYRIDVGSGCVAVKKIWNNKKLDKKLENSFRAEVRILSNIRHTNIVRLMCCISNEDSMLLVYEYLENHSLDNWLHKKVQSGSVSKVVLDWPKRLKIAIGIAQGLSYMHHDCSPPVVHRDIKASNILLDTQFNAKVADFGLAKMLIKPGELNTMSSVIGSFGYIAPEYVQTTRVSEKIDVFSFGVVLLELTTGKEANYGDQHSSLSEWAWRHVLIGGNVEELLDKDVMEAIYSDEMCTVFKLGVLCTATLPASRPSMREALQILKSLGEPFAYGDQKKFGHYYDAIPLLKSSDKETRLN

SEQ ID NO: 138134 - protein, 125 aa, Glycine max
  Coding DNA Sequence Number=SeqID_21356
MARRARMTKDPSWEDVRKKAQAIQKQNPAPHVLSRRGYDFLEQKQKKRLEVATQSRSTDTVVDPPSPIRRHDVLTAAIGRPKHPSRVHAPRAGVTIKHYFGLASRGSRTSSSMAPEDLEQLTQRI

SEQ ID NO: 138135 - protein, 109 aa, Glycine max
  Coding DNA Sequence Number=SeqID_21357
  Homolog annotation: Hit_ID=Q1SND7; Match level="QueryCoverage=42%, HitCoverage=17%, E-value=3e-15, Identity=82%"; Hit description =Probable tumor-related protein T9L24.46 [imported]-Arabidopsis thaliana
MANNNEEEEEEAVVQMVKLGSYGGERRRCYFGVFRNPHFPNPKPLSLKLPCNSHSTLVATLSPFFNPLPLWAFWTFDLGGTWTNGAMMWDSGIVLEKVLEDFVDSGMLC

SEQ ID NO: 138136 - protein, 214 aa, Glycine max
  Coding DNA Sequence Number=SeqID_21358
MKVDMKAMKEQRITMMEAMMAIRKIMKVNIVAVVATSTATKRDTTHLPIFKQGSHPVIDVEGQGGAMGVASYGPQYTQSHNRSIFPPYGLAPVKRMKFVKASNWCLAKRGFASSAHSARRLSLSVLSAPSSLSGYSLTRTKHEHCTKHDFEDIKPFLKPEVKEKRELGKKRGLERREQNRARRSKTSAFKRILGLGVISRFLKAKFDETSENEV

SEQ ID NO: 138137 - protein, 184 aa, Glycine max
  Coding DNA Sequence Number=SeqID_21359
MDYATMLVSRVLKGANKGSKDKTLISFEWNIIRLINSPTSGTCHSERIEKASGISTYYRTLESDGRNETFSQSRSEDADISRKGAEDDARLPLVDKGADDDKMLTSPGKVQKTTLISACQQAHLPLANRRARTEIVIPGQGSWDVPHYFHDTHATVMIQKFYAKLVTHAPMWTLKHQVFVVTQH

SEQ ID NO: 138138 - protein, 89 aa, Glycine max
  Coding DNA Sequence Number=SeqID_21360
MVITFHTDVRFGRIIHRDARNCTADAIEKFKLSSLFTRMSDSGKKYIMTLEIEQRKLSRNSNIHNISHGCPIQAHNILRSSKLNNGSSR

SEQ ID NO: 138139 - protein, 154 aa, Glycine max
  Coding DNA Sequence Number=SeqID_21361
MNCVFVHASSTHEFGAMRSDCLVQFSILIPFLEPMNCVFIHASSTHEFGAMRSDCLVQFSILNPFPEPMNCVFIHVSSTHEFGALRSDCLVQFSIFNPFLEPMNCVFVHAFSTHEFGAMRSDCLVQFSILNIFSEPHELHFRSCVLHLRVWSHA

SEQ ID NO: 138140 - protein, 45 aa, Glycine max
  Coding DNA Sequence Number=SeqID_21362
EWRSICGHVGCPTRLMTVKSHLEFSSFSGALSLIFPIATMYYLGG

SEQ ID NO: 138141 - protein, 66 aa, Glycine max
  Coding DNA Sequence Number=SeqID_21363
MEVDEAVALVIEELGIDRDRTINEKEFVVGFEKWFSSTLAPAFVAMPTSPLFHLCIYIRLGKRLTS

SEQ ID NO: 138142 - protein, 103 aa, Glycine max
  Coding DNA Sequence Number=SeqID_21364
  Gene Ontology: Mol. function=protein kinase activity; Biological process=protein amino acid phosphorylation
  Homolog annotation: Hit_ID=Q9ZQR0; Match level="QueryCoverage=97%, HitCoverage=8%, E-value=3e-15, Identity=38%"; Hit description =Putative helicase
  Pfam annotation: Domain name=DUF889; Domain location=1-103; Score= -91.6; E_value=2.8e-05; Accession=PF05970.5; Description=Eukaryotic protein of unknown function (DUF889)
MHLEANIDATDREETSASAQWILDIGDGIVGQQNDGYGSIEIPKDLLITKYDDPLYAIVNSTFPNLSHHHNNHEYFQSTAILASTNEIVQQVNDYILSLIPGE

SEQ ID NO: 138143 - protein, 168 aa, Glycine max
  Coding DNA Sequence Number=SeqID_21365
  Gene Ontology: Mol. function=O-methyltransferase activity
  Homolog annotation: Hit_ID=Q84ZM2; Match level="QueryCoverage=39%, HitCoverage=22%, E-value=2e-16, Identity=67%"; Hit description =Putative O-methyltransferase
  Pfam annotation: Domain name=Methyltransf_3; Domain location=1-164; Score=-107.7; E_value=0.00054; Accession=PF01596.8; Description=O -methyltransferase
MDKAKSPGHGGLLIWTWNEEWVVLGKLVKEMVKGKLVYYIVNLTQGYSSLAIALVLPESSRLVACERHAKSLDVAKKYYQLAGVSHKVDVKLGLAMDSLESLILNGERGRNSSTFRRLKLLLLLEYIQVDLNYAWMNVTTKEDGLQNTDPNPTEKWWVAMGHRHEKLF

SEQ ID NO: 138144 - protein, 104 aa, Glycine max
  Coding DNA Sequence Number=SeqID_21366
MQEIQFHFYEDGKEFEGRRVSEKRRRGQSHHVKSGKSNHEKKEEGEWILDLKKETMLRAKLYLSTVASIGRRSSGCPRSRNCQRRTLWPKMGGHGVDLKKSRVQ

SEQ ID NO: 138145 - protein, 243 aa, Glycine max
  Coding DNA Sequence Number=SeqID_21367
  Gene Ontology: Mol. function=heme transporter activity; Cellular component=membrane; Biological process=cytochrome c oxidase complex assembly
  Homolog annotation: Hit_ID=Q2L207; Match level="QueryCoverage=99%, HitCoverage=54%, E-value=1e-103, Identity=77%"; Hit description =Putative cytochrome c biogenesis protein
MSELSIGVQAGQEHVHAQERETRHQQAHQGPVGGGVAAQALDQPHVQPGRVVEPDDQRPGFLRVPLPVGAPGVGRPQRAQHRGHGEEREAHGDGLVHDVVQHLERGQALGKLAAAQQDAADDQRGHAGVGHPVGRHAALAEDHGFDRQQHAQDEQRRQLHPRGGLAVRLDEVGEGDHGRQRERAVADEVGGHVQFHPPALSAGTSGWICCAPRSKVYQIRKATAEAMTSSTKPPRLRVSYLRS

SEQ ID NO: 138146 - protein, 229 aa, Glycine max
  Coding DNA Sequence Number=SeqID_21368
  Gene Ontology: Cellular component=mitochondrion
  Homolog annotation: Hit_ID=Q8TGM6; Match level="QueryCoverage=52%, HitCoverage=97%, E-value=7e-09, Identity=43%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFS

SEQ ID NO: 138147 - protein, 61 aa, Glycine max
  Coding DNA Sequence Number=SeqID_21369
MARTKKIAQMMYKAAKEITDKIDSLEEQASQGSFVSHGRQDILAATIRRPEHPFRVHPTRA

SEQ ID NO: 138148 - protein, 145 aa, Glycine max
  Coding DNA Sequence Number=SeqID_21370
MAPNIVGEEEADDIHANHNDHDEEELINIKWTRKAIHLRPLATRPIGAERLMVHVDPATSKANGPHRKKLRTYLGIIARDKVDLTYGNWKQVLAAQKDLIWEDIHDSVDDIVCEKYGISKQKWTQFCQSRKDPSCEDVRKKARAI

SEQ ID NO: 138149 - protein, 279 aa, Glycine max
  Coding DNA Sequence Number=SeqID_21371
  Gene Ontology: Mol. function=kinase activity; Biological process=D -ribose metabolic process
  Homolog annotation: Hit_ID=Q657Z1; Match level="QueryCoverage=73%, HitCoverage=55%, E-value=6e-75, Identity=66%"; Hit description =Carbohydrate kinase-like
MELTSLDSEEERTHSIECVCLVDDLGNRTMRPCLSNAVKIQAEELTKEDFKGSKWLVLRYAILNLEVIKAAILLAKQEGLLVSLDLASFEMVRNFKQPLLKILESGNIDLCFANEDEATELLRGEQNADPVTAVEFLAKYCQWAVVTLGPNGCIAKYGNEIARVPAIGEAKATDATGAGDLFASGFLYGVIKGLSLEECCKVGACSYEAPTLDTIRTRTRGYRTLIRTRVGYRTQQGTGVFVLHRHAIVGLLFALWRRSHFEELPLNVQTNANKGSSHA

SEQ ID NO: 138150 - protein, 245 aa, Glycine max
  Coding DNA Sequence Number=SeqID_21372
  Gene Ontology: Mol. function=RNA-directed DNA polymerase activity; Cellular component=chromatin; Biological process=chromatin assembly or disassembly
MQQDIRDFVRKCIICQQAKVEQALPAGLLQPLPIPQRIWEDIAMDFITHLPSSHGYSTILVVVDRLSKFAHFIPLKAEFTSKSVANAFIINIIKIVFLSVPIIQSLGHHIGYEFRLSSSVGWPNEGVEQDTRDPGLRCFIGLNFGTTLPFIASLKFIGSSKQPYLPLPLTVGESGLMVQPIAVLDSRWEIAGPEEDTWEDVTWVKASYPHFNLEDKVVFKGEGNVTCGKQEGKLARVSYKGRTCG

SEQ ID NO: 138151 - protein, 109 aa, Glycine max
  Coding DNA Sequence Number=SeqID_21373
  Gene Ontology: Mol. function=DNA binding; Biological process=DNA integration
  Homolog annotation: Hit_ID=Q1SIT1; Match level="QueryCoverage=86%, HitCoverage=32%, E-value=3e-10, Identity=39%"; Hit description =Integrase, catalytic region
MDQTGEERKLQLSELDEICLEAYENSKFYKKKTKKFHDNLIAKKDFVVGQKVLLYNSRLRLMSVEIKSESTDKIFKVNGHQLKPFLTNPSLVDVVVEETSLLHPTSLSP

SEQ ID NO: 138152 - protein, 400 aa, Glycine max
  Coding DNA Sequence Number=SeqID_21374
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=97%, HitCoverage=32%, E-value=1e-92, Identity=61%"; Hit description=Chromo
  Pfam annotation: Domain name=RnaseH; Domain location=268-389; Score= -26.8; E_value=0.018; Accession=PF00075.14; Description=RNase H
MYDGKFTTLQGENDIIPGRAHLHHIRRMLNTDVIAEIFTMQLIEPNSVQFPLLELPTDMEPELALLLHSYSVVFGTPTSLPPPRAHDHSIPLVDGYQTVKVKPYGYPHSQKEEIEKLVNGMLEEGIIQPSKSPFSSPILLDHLSHLEFVLSSLKQHQLFARFSKCAFGVREIDYLRHNLSRASVAMETTKLQAILDWPLPNSLKQLRGFLGLTGYYRRFVKGYATIAAPLTNLLKKDSFKWSASATTAFNKLKEVMTSAPVLAIPNFKEPFVLETDASGIGIRAILSQSEHPIAYFSKKLSSIMQKQSAYIREIHAITEALAKFRHYLLGHKFIIRTDQKSLKELLEQRLQTPEQQQWLPKFLGYDFVIQYKLGRQNILVDALSISFSMAWSEAVGVWMT

SEQ ID NO: 138153 - protein, 191 aa, Glycine max
  Coding DNA Sequence Number=SeqID_21375
  Gene Ontology: Mol. function=threonine endopeptidase activity; Cellular component=proteasome core complex (sensu Eukaryota); Biological process=ubiquitin-dependent protein catabolic process
  Homolog annotation: Hit_ID=Q8H1Y2; Match level="QueryCoverage=58%, HitCoverage=40%, E-value=1e-55, Identity=95%"; Hit description=20S proteasome alpha 6 subunit
  Pfam annotation: Domain name=Proteasome; Domain location=103-191; Score=-42.6; E_value=0.0039; Accession=PF00227.16; Description =Proteasome A-type and B-type
MKVKVSVFIVAVVSSSLTAYEQHNQKKNTQSPHEEHHHHAANNGEKARTTSLGTVEHPPYLSNTEGIGRERVLEEEEKEYDTDVTTWSPAGRLFQVEYAMEAVKQGSAAIGLRSKTHVVLACVNKANSELSSHQKKIFKVDNHIGVAIAGLTADGRVLSRYMRSECINYNYTYESPLPVGRLVVQLADKAQ

SEQ ID NO: 138154 - protein, 201 aa, Glycine max
  Coding DNA Sequence Number=SeqID_21376
  Gene Ontology: Mol. function=nucleic acid binding; Biological process= DNA integration
  Homolog annotation: Hit_ID=Q0KIN0; Match level="QueryCoverage=97%, HitCoverage=11%, E-value=3e-23, Identity=29%"; Hit description =Integrase core domain containing protein
  Pfam annotation: Domain name=zf-CCHC; Domain location=175-192; Score =13.6; E_value=0.0057; Accession=PF00098.13; Description=Zinc knuckle
MDYQLCDVLWQSVEPDVLEILRSFKTYRSFWKKAQDIFANGIQSLFDATMKVTTLKQTSHDMIAHMGKARATVEELKRFLVADSLEEVNRKLDKFYMVLILRSLYSDFDHVHDQVLAGDQVPSMESLITRLLRVPHVLKDENLADVVETSAMVASRGRGGGRKNRRGRGGRGGHPHCTYCKKMGHTQENCYSLHGFPEKVA

SEQ ID NO: 138155 - protein, 93 aa, Glycine max
  Coding DNA Sequence Number=SeqID_21377
  Homolog annotation: Hit_ID=Q1SND7; Match level="QueryCoverage=64%, HitCoverage=22%, E-value=7e-19, Identity=78%"; Hit description =Probable tumor-related protein T9L24.46 [imported]-Arabidopsis thaliana
MRYQGRRGLKNEESGHKSRAKVDRKLERQRHWVWKVWAAECPKAAWSPPQQIPLNQPWTEPHHRKDPTSPLVPLVVVGHGVLALSVSRIQLGF

SEQ ID NO: 138156 - protein, 205 aa, Glycine max
  Coding DNA Sequence Number=SeqID_21378
  Gene Ontology: Mol. function=RNA-directed DNA polymerase activity; Cellular component=intracellular; Biological process=RNA-dependent DNA replication
MTVLCKELEGSTISSHQGLKPNEELFKMQLGPKLGQCTQICRDLTSHEHRRIASVLHKNTDLFSWQLSNMLRIHPNIIYHKHVVYPQAKPISQKKRKMGEEWCKSIKEEVDKLLNANFIEEVRVCPKDAYPLPRIDKLVDGASGFRVLSFLDAYSGYNQIKRHAPNEEKTTLIIEDVDFCYKVMAFGLKNVGATYQRLVDRVFKS

SEQ ID NO: 138157 - protein, 97 aa, Glycine max
  Coding DNA Sequence Number=SeqID_21379
  Gene Ontology: Mol. function=DNA-directed RNA polymerase activity; Cellular component=nucleus; Biological process=transcription
  Homolog annotation: Hit_ID=Q1S957; Match level="QueryCoverage=68%, HitCoverage=16%, E-value=2e-24, Identity=80%"; Hit description=RNA polymerase, dimerisation
  Pfam annotation: Domain name=RNA_pol_A_bac; Domain location=6-95; Score=-3.2; E_value=0.0019; Accession=PF01000.16; Description=RNA polymerase Rpb3RpoA insert domain
MAIERVYITNNTSVVQDEVLSHRLGLIPIRADPKLFEYLENAGDDKNEKNTIVFKLHVRCQVGQPRIIGYSTFNIDADVSTDMETHICYIVHEVTPT

SEQ ID NO: 138158 - protein, 206 aa, Glycine max
  Coding DNA Sequence Number=SeqID_21380
  Gene Ontology: Mol. function=RNA-directed DNA polymerase activity; Cellular component=riboflavin synthase complex; Biological process =RNA-dependent DNA replication
MLLRRKLGQCMQLSRNLTIHEHRCIIDVLHRNADLFAWKPSDMLGIHPSIIFHKLAICPRAKQVSQKKRKMGEERRKAFREEVEKLLNANFIRKVRYSTWLANDKWRMCTNYTDLNRGHALWPKKCRHYIPEIDGPSFQAAYWIKCQDLEEVIGKLCKYDMCLNPEKCTFGVDGGNFLGFMIMHRGIEANPKKCTVIMEMHTPTNV

SEQ ID NO: 138159 - protein, 98 aa, Glycine max
  Coding DNA Sequence Number=SeqID_21381
  Gene Ontology: Mol. function=cysteine-type endopeptidase activity; Cellular component=endoplasmic reticulum; Biological process =proteolysis
  Homolog annotation: Hit_ID=Q1SLM3; Match level="QueryCoverage=79%, HitCoverage=22%, E-value=7e-30, Identity=73%"; Hit description =Peptidase C1A, papain
  Pfam annotation: Domain name=Peptidase_C1; Domain location=4-97; Score=-45.5; E_value=2.1e-08; Accession=PF00112.13; Description =Papain family cysteine protease
MMLTSVSGSCWAFSVVATMEGINKIKLGKLVSLSEQELRDCDVEDGNQGCEGGLMDTTFAFIKKNGGLTTSKDYPYEGVDGTCNSEFYNSALMHDTLL

SEQ ID NO: 138160 - protein, 235 aa, Glycine max
  Coding DNA Sequence Number=SeqID_21382
  Gene Ontology: Mol. function=oxidoreductase activity; Cellular component=cytoplasm; Biological process=retinoid metabolic process
  Homolog annotation: Hit_ID=Q1SND8; Match level="QueryCoverage=69%, HitCoverage=43%, E-value=6e-82, Identity=88%"; Hit description =Alcohol dehydrogenase superfamily, zinc-containing
  Pfam annotation: Domain name=ADH_N; Domain location=92-217; Score =107.7; E_value=3.5e-29; Accession=PF08240.2; Description=Alcohol dehydrogenase GroES-like domain
LGSDVVYSEGDVLDLLETLVQLSGPNTTIFLAGELRNDAILEYFLETATDNFTIGRLDQKLWHPDYCSNPAVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAA

SEQ ID NO: 138161 - protein, 532 aa, Glycine max
  Coding DNA Sequence Number=SeqID_21383
  Homolog annotation: Hit_ID=Q6YRM6; Match level="QueryCoverage=85%, HitCoverage=77%, E-value=4e-95, Identity=40%"; Hit description=Zinc finger (C3HC4-type RING finger) protein family-like
  Pfam annotation: Domain name=DUF23; Domain location=281-528; Score =147.8; E_value=2.8e-41; Accession=PF01697.17; Description=Domain of unknown function
  Pfam annotation: Domain name=Glycos_transf_2; Domain location=286 -447; Score=-20.0; E_value=0.082; Accession=PF00535.16; Description =Glycosyl transferase
  Pfam module annotation: Pfam domain module=DUF23::Glycos_transf_2; Domain location=281-528::286-447
  Subcellular localization annotation: CTP_CleavageSite=6; ConfidenceScore=5.62e-01
MDSSPDQTRKRNQNQTLAQKSLFLYFSFLFFLLFFSSSHHSFYSHTSLQPSAFATPYSTTTKLPVSLYVHDRILFPDHVLLTLSNPQVFPPHKLHCLYYILINNPALSNPVYDVLVRPVLSTDRYDEFRSIARCPLPSRNFSAVELSWRDGDNDNQPFRFPVKPTAQHSFDMLAYEVALDNDTAVIFVKGLNLRPHKISNASLLRCHFGPQNGAFWFTTKAVAAAQEVVRCELPQSIQNNPHKARGISATVSHVRDEAMIPSVAKIGGYREEINRGNKKKNKLELCACTMVWNQARAMKEWVMYHAWLGVEKWFIYDNNSDDEIDHVVRELEVKGYNINRVAWPWIKSQEAGFSHCSLRAKEECKWVGFFDVDEFFYFNEMRRNALISIVGNLSNSIAEIRTGCLNFGPSGLRTHPRNGVSVGYTCRLRTPERHKSIIRPDLLHVSLLNVVHHFELKEGFRSLNMPQSVAVINHYKYQIWEIFKAKFFRRVATYVVDWKEDANIGSKDRAPGLGTEAIEPRDWRLVALGKVF

SEQ ID NO: 138162 - protein, 231 aa, Glycine max
  Coding DNA Sequence Number=SeqID_21384
  Homolog annotation: Hit_ID=Q337I5; Match level="QueryCoverage=35%, HitCoverage=27%, E-value=1e-15, Identity=39%"; Hit description =Expressed protein
MHVFEINPADGKDVEGTNSGCSVQGSTVDSSQLEPSVGKAETQPQLLEENARSGDSFHLELSADETETLAQPTEENIRTNLGNMFCSILMKLCSMANKTSESANPGNLLVETDLVNFDTTSLIALVSGISNCGTEKLLATPESDMRQRFKGNYDFVIGQYHDRVVLDTPSERMMDLPTTRKLALKNKVVFGTGDHWHAPTLTTNMAFVRAVSQTGMSLSTFEHRPRALPGD

SEQ ID NO: 138163 - protein, 70 aa, Glycine max
  Coding DNA Sequence Number=SeqID_21385
MAEHQRLQVHNVEVEAPLPPQYMPLREGLNQVPQDQKSNCRTPLKLPNYSIDRLRISDLRGGILLDLVES

SEQ ID NO: 138164 - protein, 106 aa, Glycine max
  Coding DNA Sequence Number=SeqID_21386
  Homolog annotation: Hit_ID=Q9FFX3; Match level="QueryCoverage=57%, HitCoverage=14%, E-value=2e-07, Identity=40%"; Hit description =Arabidopsis thaliana genomic DNA, chromosome 5, P1 clone:MAC12
MALTYHFIFYLFKKNNTIGVIGCRNPPPWGTVKYLSEKIPKDTSSKVRINRDLYSYERIMETAPTLPDFSLALKPDEYQLPQVDSSWRTENIKVGQTDPNHLKGDK

SEQ ID NO: 138165 - protein, 217 aa, Glycine max
  Coding DNA Sequence Number=SeqID_21387
  Gene Ontology: Mol. function=DNA binding; Biological process=DNA integration
  Homolog annotation: Hit_ID=Q1SAI8; Match level="QueryCoverage=61%, HitCoverage=11%, E-value=3e-24, Identity=40%"; Hit description =Integrase, catalytic region
MAETSKFHSALAITNVKTLIPTLDLESGQYHSWAVSFKVHARVHNELEHIIPPTDAKEKVVYDKVKSDDLPLWKRLDAAHNVVDLFHDNKNSRALYLNKAFTNISLADFLTTNAYCNRLKSLAEQLANVGTLVNDQMAQMMAPILVVDMENTNNSGSLGLGCSGLHGLALLLHILSTFSPRPPQPGLLRPKPQQATYNANVPSPTDIEAALHTLSLA

SEQ ID NO: 138166 - protein, 56 aa, Glycine max
  Coding DNA Sequence Number=SeqID_21388
MTTKTITESSNVNHKKVRRPWSCGSTPSQETEQTLPLSGHRASLQAMRPQSQTAPG

SEQ ID NO: 138167 - protein, 164 aa, Glycine max
  Coding DNA Sequence Number=SeqID_21389
MSVALSGRSLSQQIGLARRLRFPALIIALCRARGVVSNSLTFERLSPAINLAYIRKNCWNVDDLTVAFRGAKRARARPADIPSTSAAPAPTPASTSAAPSVPAHVDYERFKAMLQISVATYPSAGGRRGTHGMRVPQKEYARSRHQRLFEENVGKTGKGAIYEL

SEQ ID NO: 138168 - protein, 120 aa, Glycine max
  Coding DNA Sequence Number=SeqID_21390
MAKHACAPKPQCLSVEAELSASIWLIGKERHHLHPPKLDLTDQDSLPKRLGKDTDIIVPRKLLPERNMAVYYIEFDEFKEELERSHWDEELTDFGDGNIDVAIVKEFYANLYDPEDKSPK

SEQ ID NO: 138169 - protein, 109 aa, Glycine max
  Coding DNA Sequence Number=SeqID_21391
MNKHSFPPYGLPPNYTPPNVAHTPDENVDNSAPMPIESQQPQSDHAHVSQPMGETHEAPRDHNLVDFELHVGYAAEGQAFCSVPLPNTLGAPQYLPQPQPLQSPCFYLS

SEQ ID NO: 138170 - protein, 146 aa, Glycine max
  Coding DNA Sequence Number=SeqID_21392
MKVGKGDYEVEWRENPTIGNAGGLVTSWKKGILEVENTYVGDGLVRFLEERRGDQNVEVGNFEMEEFNLFIEEMEVGDIPMIWEVVRVTGFVCSSHTPNSHLPRTLLGLYLYTQQPLTPNTFGTLFIHPAATLMQSYPARGLDRRL

SEQ ID NO: 138171 - protein, 87 aa, Glycine max
  Coding DNA Sequence Number=SeqID_21393
MESSSVATYTTTEVRAKSQSASSHEENAWSRHQRLLKGNVRKTKKGLWILKIRVRELFTHGEGKWTIGAMAARPGELMLTPEVTGSP

SEQ ID NO: 138172 - protein, 589 aa, Glycine max
  Coding DNA Sequence Number=SeqID_21394
  Gene Ontology: Mol. function=protein serine/threonine kinase activity; Cellular component=mitochondrion; Biological process =protein amino acid phosphorylation
  Homolog annotation: Hit_ID=Q1SB26; Match level="QueryCoverage=93%, HitCoverage=93%, E-value=0.0, Identity=59%"; Hit description =Tetratricopeptide-like helical
  Pfam annotation: Domain name=PPR; Domain location=107-141; Score =17.8; E_value=0.04; Accession=PF01535.11; Description=PPR repeat
  Pfam annotation: Domain name=PPR; Domain location=142-176; Score =17.6; E_value=0.045; Accession=PF01535.11; Description=PPR repeat
  Pfam annotation: Domain name=PPR; Domain location=177-211; Score =33.8; E_value=6.2e-07; Accession=PF01535.11; Description=PPR repeat
  Pfam annotation: Domain name=PPR; Domain location=213-247; Score =39.7; E_value=9.8e-09; Accession=PF01535.11; Description=PPR repeat
  Pfam annotation: Domain name=PPR; Domain location=248-282; Score =46.4; E_value=9.5e-11; Accession=PF01535.11; Description=PPR repeat
  Pfam annotation: Domain name=PPR; Domain location=283-317; Score =27.7; E_value=4.2e-05; Accession=PF01535.11; Description=PPR repeat
  Pfam annotation: Domain name=PPR; Domain location=318-352; Score =42.3; E_value=1.7e-09; Accession=PF01535.11; Description=PPR repeat
  Pfam annotation: Domain name=PPR; Domain location=353-387; Score =44.3; E_value=4e-10; Accession=PF01535.11; Description=PPR repeat
  Pfam annotation: Domain name=PPR; Domain location=388-422; Score =45.4; E_value=1.9e-10; Accession=PF01535.11; Description=PPR repeat
  Pfam annotation: Domain name=PPR; Domain location=423-457; Score =26.2; E_value=0.00012; Accession=PF01535.11; Description=PPR repeat
  Pfam annotation: Domain name=PPR; Domain location=458-492; Score =33.6; E_value=6.9e-07; Accession=PF01535.11; Description=PPR repeat
  Pfam annotation: Domain name=PPR; Domain location=493-527; Score =52.0; E_value=2e-12; Accession=PF01535.11; Description=PPR repeat
  Pfam annotation: Domain name=PPR; Domain location=528-562; Score =16.6; E_value=0.081; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=107-141::142 -176::177-211::213-247::248-282::283-317::318-352::353-387::388 -422::423-457::458-492::493-527::528-562
  Subcellular localization annotation: CTP_CleavageSite=31; ConfidenceScore=5.51e-01
MLRGRARASLHWFPLLLLPHFGSLSNSTHFRSSSNFTNRAQFLDSMRDLKSEEAALSFFHKMVVMNPLPREKDFTKLFGIIVKMKHYATTISLIKHIYSLGIKPDVYTLTIIINCLCHLNHTVFGFSVLGVMFKIGVDPTVVTFATLINGLCAEGNVARAARFADSLEDMGHQSNSYTYGAIINGLCKAGDTSGAILYLEKIKGRNCDLDVVIAYSTIMDSLCKDGMVCEALNLFSGMTSKGIQPDLVAYNSLIHGLCNFGRWKEATTLLGNMMRKGIMPNVQTFNVLVDNFCKDGMISRAKTIMGFMVHVGVEPDVVTYNSVISGHCLLSQMGDAVKVFELMIHKGFLPNLVTYSSLIHGWCKTKNINKALFLLGEMVNSGLNPDVVTWSTLIGGFCKAGKPEAAKELFCTMHEHDQHPNLQTCAIILDGLFKCQFHSEAISLFREMEKMNLELNVVIYNIVLDGMCSFGKLNDAQELFSCLPSKGIKIDVVAYTTMIKGLCKEGLLDDAENLLMKMEENGCLPNEFTYNVFVRGLLQRYDISRSTKYLLLMKGKGLSADATTTELLISYFSANKENSALHVFLQEFV

SEQ ID NO: 138173 - protein, 130 aa, Glycine max
  Coding DNA Sequence Number=SeqID_21395
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=96%, HitCoverage=8%, E-value=2e-33, Identity=53%"; Hit description=Chromo
MAEIPILTVPDFCQTFCIETDASNKGLGAVLMQQGRPVAFLSQTLPERAQKKSVYERELIAIVMAVQKWQHYLLGRKFVIHTDHRNLKFLKDQRVLGSEQFRWTSKLVGFDFEILYKPGSDNRAADALSR

SEQ ID NO: 138174 - protein, 163 aa, Glycine max
  Coding DNA Sequence Number=SeqID_21396
  Homolog annotation: Hit_ID=Q1SL48; Match level="QueryCoverage=48%, HitCoverage=60%, E-value=6e-13, Identity=45%"; Hit description=Zinc finger, GRF-type
  Pfam annotation: Domain name=zf-GRF; Domain location=40-86; Score =26.0; E_value=2.1e-05; Accession=PF06839.3; Description=GRF zinc finger
MFATSSSCLPSPRRDCHLLDGIVPMERSASSYNFKFQTRVMCLCNVKAPLVTLWTKDNPRRHFYGCGLYGVTGRKWCQFFEWHDPVVNSHEKRIIVALMKKVDELKVREKGEYDVMVTYIDPMVQFCLDRKKDKFSLQVVKELKKSDVGFMKHVEELQEHVCL

SEQ ID NO: 138175 - protein, 159 aa, Glycine max
  Coding DNA Sequence Number=SeqID_21397
  Pfam annotation: Domain name=Chromo; Domain location=33-84; Score =21.0; E_value=0.0033; Accession=PF00385.14; Description='chromo' (CHRromatin Organisation MOdifier
MEIQAEDKLWSIMQDLSSNSSAHPVTLFRIGSYEPLAVKAVHNHPFGTAEVLIQWKDLPDFEATWESVTSIQQQFPAFHLEDKVALLGGSIVRPPIRETYTRKTHKKIEGEEKGYQGTHCPIGGFIKKNTVLAHSFQLNNSFSFSNYNWGTLKSENNFL

SEQ ID NO: 138176 - protein, 154 aa, Glycine max
  Coding DNA Sequence Number=SeqID_21398
MGRISEWGYGVSRRLVRPQTHCLRSWSPFPFMVSKANARMETCMKAVEKAIEENHRARELGLTSIKLVSMKMVKGTMLEVDQGFNVEVKRVEEEKTREAVYGLVAQVLTQFEQVFQEPQGLPPHRERERSCYYYPGGHKDTQFKALQIPQSPEG

SEQ ID NO: 138177 - protein, 70 aa, Glycine max
  Coding DNA Sequence Number=SeqID_21399
MLQPTLRREGDARAHGCIFQDRKMSGVATNVYSRKTSENPKRCGLRTLIVKGCFPRSYVFLNWDEEIRPT

SEQ ID NO: 138178 - protein, 125 aa, Glycine max
  Coding DNA Sequence Number=SeqID_21400
MVVLMVGDKDSISGGSNGSGGNNCGSGADIGGSDSNDDGSRDGIGGGCDNNIGGDGSSGGYDNDGDGDSNVDGWWHYGNKSDTSGDGDIGGGGSNIINVGDDGSSNDGGDIGGSDNECVTSDIYR

SEQ ID NO: 138179 - protein, 426 aa, Glycine max
  Coding DNA Sequence Number=SeqID_21401
  Homolog annotation: Hit_ID=Q2R3L0; Match level="QueryCoverage=94%, HitCoverage=78%, E-value=7e-51, Identity=34%"; Hit description =Expressed protein
MGCVVSTTKDSGGNRRRPGSIGEVSVYVPGLRIPKPVDFAQSLGNYLSKNIVEHLSALRMRIVIMAGQEGPTITRTKRKTQHGGSMLADLLQALEDYLPVVLGLVKDGSHLQYKVQFTWVNQEDDKEETTMSNAWYEVLSVLHLMAMLSLSQANLLLLPRSSSSDGHLPKVSEESRRTSVDIFLKAAGYLDCAVKHVLPQLPVELRRNLPVDLAEGVLRALCLQALGQNLCDGIYLYGESSWEKSSVIPILNGSLEKENGIDIQLGMAIDSTKATLAVKRRLACEMVKCWQQAQDNIMNLPLANGWGEKHCLFVKWKYVEAKTFLVVRNSVIWIYEIRYLHGSCGVVVNAQAAAYYYHGLILDEGNTEKSHGMAVAALQAADEYYKESKKLCEAFNAASPLSRKQGLAFFKNLLYQQLDVMYMFSK

SEQ ID NO: 138180 - protein, 97 aa, Glycine max
  Coding DNA Sequence Number=SeqID_21402
MRHDKGCPCQRLNVTTREKASKAQWWQIEEAEEVNGKHKSAIQFNSKSKKAEILKGSQKHNHPEGEDEDRTTKISKEWDSITFASKRATETDRENLP

SEQ ID NO: 138181 - protein, 488 aa, Glycine max
  Coding DNA Sequence Number=SeqID_21403
  Gene Ontology: Mol. function=transcription factor activity; Biological process=regulation of transcription, DNA-dependent
  Homolog annotation: Hit_ID=Q75G59; Match level="QueryCoverage=76%, HitCoverage=57%, E-value=4e-33, Identity=31%"; Hit description =Expressed protein
  Pfam annotation: Domain name=CDT1; Domain location=72-201; Score =130.8; E_value=3.9e-36; Accession=PF08839.1; Description=DNA replication factor CDT1 like
MGIKPWVLTIEYFFNHYSRMEQNACEELSKIASDFKCEKKVLETVDESIVCPTPQKNEEPLIVKFREGQTNLPEKYSALVDLFGHTSCSLRLLRLCKKSPTFQNVCRQVEVLSKREFSHAHLAQMKYILPKSVCIDKVLVHDKKSLCMVPDMKITLRFEVVKDCSGESDDLALRRYFKSKLIDFFDMHPEVADIPEAPLPEPFGKKTCRLNFEEFTGQSPHVNSSTELLSISNQTEMLPEQLQLYPSFRRHFSRKNNTDQAEKAQCFLPTKTSPSSHASDCLDNEESEKTLQKECVPLFDGVANPITERGHQKESFSMSLQPSFINTPVQMIRPPYSVTCSNSESPDMKNISCVADSFIAETPAQSAPARLLPISDVKLQDMPTQKSTSSHKPAKRVLDFSLMGDNDGLGIGVDKLESSRALHEFDSFPESSRGCYEDCNSFGSVSAPQEEGTHACGDEKSGINEMFMGTGKIMMKIRSEKCVERLKL

SEQ ID NO: 138182 - protein, 144 aa, Glycine max
  Coding DNA Sequence Number=SeqID_21404
MAEMGKLDHLEERLRAIEGGEDYAFAKLEELFLVPNIITSPKFKVPDFVKYKGTTCSKNHLKIYCQKMGTYAKDEELLIHFFQESLTGVAVTWYTNLEPSRVHSWKDQMVAFVKQCQYNSDMAPNRMQLQNMCKKGHESFKEYA

SEQ ID NO: 138183 - protein, 206 aa, Glycine max
  Coding DNA Sequence Number=SeqID_21405
  Homolog annotation: Hit_ID=Q1RTS7; Match level="QueryCoverage=99%, HitCoverage=28%, E-value=3e-40, Identity=47%"; Hit description=IMP dehydrogenase/GMP reductase
MQQNSVKETNLPDDNDILSNIESSLHKQQHNDVNVLYGDGEHAKESLQMFDAKDGEQNEANNMSLQIHEAQSNSNVARQVEHPDQKGDFSDDLVNAIKRVESRILSFQLSSNLSDSTNAGHHTTHEAANSDSPVIQTNNGALGSQMSGGKSLLEGHSLMNQKTCKASCEGENSISANAFVETFCAVNQNHWLHNSAKYANSMDEPK

SEQ ID NO: 138184 - protein, 135 aa, Glycine max
  Coding DNA Sequence Number=SeqID_21406
  Gene Ontology: Mol. function=ATP binding; Cellular component =membrane; Biological process=defense response
  Homolog annotation: Hit_ID=Q6Y4S2; Match level="QueryCoverage=67%, HitCoverage=73%, E-value=8e-19, Identity=46%"; Hit description =Resistance-like protein RNEAU-2
MLLSEIVGEKDIEIGSVSKGSSIIKHRVIVTTRDKHFLESHGVDRKYEEEDLNEEEALELLNWNAFKDDKVDPCYKDISNQAVAYASGLSLALEVVVMEVMGKEIDRQESPKELRKHMSYRREKSKLSMTVLKSS

SEQ ID NO: 138185 - protein, 60 aa, Glycine max
  Coding DNA Sequence Number=SeqID_21407
MAIDGLALLSYAICTNGYFERPSLEKHAKRLKTFTQLKEDKKLNIQVMQSYPARALDKRL

SEQ ID NO: 138186 - protein, 260 aa, Glycine max
  Coding DNA Sequence Number=SeqID_21408
  Homolog annotation: Hit_ID=Q1RTS7; Match level="QueryCoverage=98%, HitCoverage=38%, E-value=6e-42, Identity=40%"; Hit description=IMP dehydrogenase/GMP reductase
IQVRYCKKRKATTSSDGNETNSIGPEIKRRTHKTDHLEPWKTRVLPQDHKLEEANSKSDSSRLSSRQGSANSSSDSEDYSLLDGTQCPSSGRMVDEAYEGSSEESNNLYLEKDDGPSRLRRLKNKLGLIFHHHHHHDDVHGHRHTIWNQLQNMFHHKDKHGVTTNKVDKTRRRDVGRVLPWRNQVGQFHRIAEGVLRHIQHSKKPKPSKLDGMKQLRNTTHGHSQKKPCWWQILRPHRRVKLKKKGRVKMGFMSQKSLKN

SEQ ID NO: 138187 - protein, 96 aa, Glycine max
  Coding DNA Sequence Number=SeqID_21409
  Homolog annotation: Hit_ID=Q1SR77; Match level="QueryCoverage=77%, HitCoverage=9%, E-value=6e-22, Identity=70%"; Hit description=AMP -dependent synthetase and ligase
MVDCRGKSAMQHYVAARPMFIDVEIMNADTKLVLGDQAAQASPSNVVRGLSSLYKEITEAATITTIFPSPSEVMSILVQMSYRMSRHHASEHADYI

SEQ ID NO: 138188 - protein, 212 aa, Glycine max
  Coding DNA Sequence Number=SeqID_21410
MGGLLHHLTSRNRVKVGLEDLKKGVRERILRDDERWLSFFKGFGMWGKREMQKGFSCALVKKEAYSQLNYPTKGIRDCPLRLEKATMEEYNGCRKHIKMIKNACMSPFEMQDILLPSGTNGVKDLHISASHSSSLALFASLGKKLSVLSLDSGNLVVNYDLQIGIACLMEACLWGFYGGWIFELQWGPLMVIFHHGDAAEDKGEEVRGGTIH

SEQ ID NO: 138189 - protein, 135 aa, Glycine max
  Coding DNA Sequence Number=SeqID_21411
MVEVVVGEMCVVALLSMVVEGNSIVIVAKVVVSGGWEQAEVVTATRRRNLDAKREIGCHGEGGANTVAEESTAITNHDRKGVNGGGGKNEELRDPSLHEIMGSAANGLSKLVTMSGTGEDSKSSELSSAMKKCRR

SEQ ID NO: 138190 - protein, 526 aa, Glycine max
  Coding DNA Sequence Number=SeqID_21412
  Gene Ontology: Mol. function=DNA binding
  Homolog annotation: Hit_ID=Q1RTS4; Match level="QueryCoverage=79%, HitCoverage=84%, E-value=1e-159, Identity=69%"; Hit description=Zinc finger, BED-type predicted; Prefoldin
  Pfam annotation: Domain name=Syntaxin-6_N; Domain location=283-368; Score=-6.1; E_value=0.1; Accession=PF09177.1; Description=Syntaxin 6, N-terminal
  Pfam annotation: Domain name=zf-BED; Domain location=28-71; Score =56.6; E_value=8.1e-14; Accession=PF02892.5; Description=BED zinc finger
  Pfam module annotation: Pfam domain module=Syntaxin-6_N::zf-BED; Domain location=283-368::28-71
MTNENTTGIEIDYEYEDCSNSKRPKMTSKVWEEMQRIQTTEGSKVLCRHCGKLLQDNCGTSHLKRHLIICPKRPKPLDIITQDSMPTVCFRGPSSVKDSGLNTVLMVRPLKVEPESQIPCFSQTPNIRVPTAIASIENSPSPVQELHPKTSSALLLPSIESPKNQGELTLDDVEMKAFYASLDAQTSDMSPSQDTAVITELSNSTPCEETKKALTTLKDLLCKDFSDLLHTGQSGSIKSSIEYLSKLSADDGVSAEMRLLILEVSREFTRWSCDYNDASRKIESASTNISKADKLEGNLEANKNEFKEVMSLENELSNQLSCLEKRKKELEEQINAIKANISVFQSAKVTSTKRKREVFEEAKILKVQRDELREQVPHLRNELEVAKKNQAHIRAEWSKLGEKFNKSLNEMNCEHLHGKSIEDWEIDHVPTLTDLTIDFPVVTLCNQPTVWRLSKVGSGFWFVSTSDLSFKFCHSVPGVLCAPVGTFEDADGTKVMAVGDNIEPYYVRLERVSTFGKEKKLPFSIV

SEQ ID NO: 138191 - protein, 50 aa, Glycine max
  Coding DNA Sequence Number=SeqID_21413
MEGWTFHVKRCHRQAFVVQHALVAKELGDFKNPPQWKERSECDGSGEGRW

SEQ ID NO: 138192 - protein, 91 aa, Glycine max
  Coding DNA Sequence Number=SeqID_21414
CGYVSMNYFQYIYVVYTNEHILKAYSTQWWPLGNEATIPPSDDAWTLIPDPTTIRAKAGVDVQYNLNVELDFFCPDVSPLQLGQPQQKIGD

SEQ ID NO: 138193 - protein, 60 aa, Glycine max
  Coding DNA Sequence Number=SeqID_21415
MFAFKSALKGLDDTPQPKSKAGARWIIVKYFNDARPLEPERLKALRIQWEKYYLKVRSET

SEQ ID NO: 138194 - protein, 95 aa, Glycine max
  Coding DNA Sequence Number=SeqID_21416
  Pfam annotation: Domain name=zf-CCHC; Domain location=23-40; Score =29.9; E_value=8.7e-06; Accession=PF00098.13; Description=Zinc knuckle
MRGSQRRQNFKPKRRTEESSQIPKCFECNQPGHMRADCPIFKRKIEKSEKKTIGDKKAKKAYITWDDNDLESFDDSEKEMVNLCPMGKNYESNEE

SEQ ID NO: 138195 - protein, 203 aa, Glycine max
  Coding DNA Sequence Number=SeqID_21417
  Gene Ontology: Mol. function=[acyl-carrier-protein] S-malonyltransfera se activity; Cellular component=mitochondrion; Biological process =fatty acid biosynthetic process
  Homolog annotation: Hit_ID=Q2VA66; Match level="QueryCoverage=86%, HitCoverage=51%, E-value=2e-87, Identity=93%"; Hit description =Malonyltransferase
MQDAANAAKSAMVSVIGLDSEKVQQLCDAANQEVPEAEKVQIANYLCPGNYAVSGGLKGVEVLESKAKSFKARMTVHLAVAGAFHTSFMKPAVSRLEAALATTEIRTPRIPVISNVNAQPHTDPDSIKKILACQVTSPVQWETTVQTLLTKGLKKSYELGPGKVIAGIIKRTDKGSVCHFAICRAPNIGSCIPKQQNKANREK

SEQ ID NO: 138196 - protein, 158 aa, Glycine max
  Coding DNA Sequence Number=SeqID_21418
MEHRGVRAFQEIASFQGQLRWGPMMVTARPERVVSADYMEWFFRISHSFMISTQAGDQSRDAPAADPDDYIQPSSPQVPVAFDPPLHVVRFFARLMFDELMITTDETIAQRLERVLNLRIVTAGTELYDIMQDCLTIAKGGPSADGTVRARQRRRTDH

SEQ ID NO: 138197 - protein, 74 aa, Glycine max
  Coding DNA Sequence Number=SeqID_21419
  Gene Ontology: Mol. function=calcium ion binding; Cellular component =flagellin-based flagellum; Biological process=ciliary or flagellar motility
  Homolog annotation: Hit_ID=Q7F0J0; Match level="QueryCoverage=89%, HitCoverage=39%, E-value=2e-23, Identity=82%"; Hit description =Putative caltractin
MIADVDKDGSGAIDYEEFEYMMTAKIGERDSKEELMKALHTIDHDKNGKISASDNNRIAKELGQNFTDRDSGDD

SEQ ID NO: 138198 - protein, 82 aa, Glycine max
  Coding DNA Sequence Number=SeqID_21420
  Gene Ontology: Mol. function=catalytic activity; Cellular component =cellular_component; Biological process=metabolic process
  Homolog annotation: Hit_ID=Q2WGL6; Match level="QueryCoverage=97%, HitCoverage=11%, E-value=1e-26, Identity=65%"; Hit description =Cycloartenol synthase
MFASALNYVTLRLLGEDIDGGEGAIEKARTWILDHGGATYIPSWGKLWLSMLGVYEWSGLKPIPPEIWLFPYFVPFHPGCHE

SEQ ID NO: 138199 - protein, 81 aa, Glycine max
  Coding DNA Sequence Number=SeqID_21421
MESARVVAARAMKGVRRADDVVEYEEVRVIGLSVIGALNEILTPEHQSEIRGYVFNHQVNIGYCQWRIQDPAGLLGANYKK

SEQ ID NO: 138200 - protein, 88 aa, Glycine max
  Coding DNA Sequence Number=SeqID_21422
  Subcellular localization annotation: CTP_CleavageSite=59; ConfidenceScore=5.07e-01
MTIPCTSEKPAPLHLCTLLCKPPLLRLRPVAGNSPIKLAKSIAPNSPAPVAKTTGYFASGSEGKATCPFQGGIASSSDEILHAWLGST

SEQ ID NO: 138201 - protein, 97 aa, Glycine max
  Coding DNA Sequence Number=SeqID_21423
  Gene Ontology: Mol. function=transferase activity, transferring hexosyl groups; Biological process=metabolic process
  Homolog annotation: Hit_ID=Q1RTR9; Match level="QueryCoverage=81%, HitCoverage=16%, E-value=5e-15, Identity=55%"; Hit description=IMP dehydrogenase/GMP reductase
MYDCPFIQAKQSARASSFIGDDIKIAGIASPPRSSVLSLLLQPKSLFESIFMEDSGNLMKLNGIFINSFEELEGEALATLNGGIVVKGLPPVYGVGY

SEQ ID NO: 138202 - protein, 122 aa, Glycine max
  Coding DNA Sequence Number=SeqID_21424
  Homolog annotation: Hit_ID=Q1ST43; Match level="QueryCoverage=22%, HitCoverage=2%, E-value=4e-07, Identity=71%"; Hit description =Integrase, catalytic region; Peptidase aspartic, catalytic
  Pfam annotation: Domain name=zf-CCHC; Domain location=23-40; Score =5.7; E_value=0.11; Accession=PF00098.13; Description=Zinc knuckle
  Pfam annotation: Domain name=zf-CCHC; Domain location=70-87; Score =10.1; E_value=0.022; Accession=PF00098.13; Description=Zinc knuckle
  Pfam module annotation: Pfam domain module=zf-CCHC::zf-CCHC; Domain location=23-40::70-87
MSEEQDESLSVHSPYYLHPKSPNSCSYCGRDNHIVDTCYRKNGFPPNFSSNRGGGGFGRWGTGGKNNNGKVCTHCGITSHIVDECYKKHDYPPGQKFYKPQGASVNNIVKEKENVLETNDNG

SEQ ID NO: 138203 - protein, 70 aa, Glycine max
  Coding DNA Sequence Number=SeqID_21425
MVDGPILESQAASLMKNLLEAAAHCHCLVVAHHCTLQTLPHSLALFLLQIEPKNCFFSLSHDLSCEAEAE

SEQ ID NO: 138204 - protein, 188 aa, Glycine max
  Coding DNA Sequence Number=SeqID_21426
MRCTMLIYFFIPDTESAKVSRQQLKEAIYASLFDINVPVVCAINQNLFLLLSILSHRCKKVRSPKHLIKCSRSFTLCRLMSLDIGAKNLVYNYSNYHLLNATLALYAAKRTFGIVPNAALQKLILLLLWPSYSLMTISRSQASSLSNPLIQALHNPYLSLVKGLYNQIGFVMLMWWRLLMMTQHCWRI

SEQ ID NO: 138205 - protein, 188 aa, Glycine max
  Coding DNA Sequence Number=SeqID_21427
  Gene Ontology: Mol. function=endopeptidase inhibitor activity; Cellular component=vacuole
  Homolog annotation: Hit_ID=Q1RTR7; Match level="QueryCoverage=88%, HitCoverage=90%, E-value=2e-46, Identity=51%"; Hit description =Calcium-binding EF-hand; Kunitz inhibitor ST1-like
  Pfam annotation: Domain name=Kunitz_legume; Domain location=29-187; Score=139.9; E_value=7e-39; Accession=PF00197.9; Description=Trypsin and protease inhibitor
MKMTLVTLVLMVALSTKALLGAAGPAPEQVLDTSGKIVRARSSGLDMASTGADCPLDVVAVDGYQGQPLIFTPVNFNKGVIRVSTDLNIYFPVGTSCPQTTVWKLKDYDYSASQWFVTTGGDFGNPGSQTMANWFKIEKYEDAYKLVYGPSVCNDCSYPCSDIGIYQDEYGKRLALSSEPYKVKFQRA

SEQ ID NO: 138206 - protein, 107 aa, Glycine max
  Coding DNA Sequence Number=SeqID_21428
  Homolog annotation: Hit_ID=Q9LRS3; Match level="QueryCoverage=39%, HitCoverage=23%, E-value=3e-07, Identity=65%"; Hit description =Arabidopsis thaliana genomic DNA, chromosome 3, P1 clone:MMG15
MSIIGLCMGETPFLSSVCEFVFTRECSMLSEPDSPRLGLDLKKDWKHKERKRPTVESLFHDGSFKIWGLKTAMARESEERDSDVSLSEACALSENHALSEALSPLSE

SEQ ID NO: 138207 - protein, 230 aa, Glycine max
  Coding DNA Sequence Number=SeqID_21429
  Gene Ontology: Mol. function=endopeptidase inhibitor activity; Cellular component=cellular_component; Biological process=biological_ process
  Homolog annotation: Hit_ID=Q1RTR7; Match level="QueryCoverage=83%, HitCoverage=97%, E-value=1e-52, Identity=53%"; Hit description =Calcium-binding EF-hand; Kunitz inhibitor ST1-like
  Pfam annotation: Domain name=Kunitz_legume; Domain location=29-200; Score=178.5; E_value=1.6e-50; Accession=PF00197.9; Description =Trypsin and protease inhibitor
MKMTLVTLVLIVALSTKALLGAAGPAPEQVLDTSGKIVRARSSYYIVPASPDLGGLDMATTGADCPLDVVVVDGYQGQPLIFTPVNFNKGVIRVSTDLNIYFPVATSCPQTTVWKLKDYDYSTSQRFVTTGGDFGNPGSQTVANWFKIEKYEDAYKLVYCPSVCNDCSYPCGDIGIYQDEYGKRLALSSEPYKVAVRVVENGQNTLFWRGFHGKWRESVFMGVEIAIPQE

SEQ ID NO: 138208 - protein, 95 aa, Glycine max
  Coding DNA Sequence Number=SeqID_21430
MTVSSPPTLTYYQTTSVPLTLYSCITKTGPRMTDVVVVDIQRHLEQRRCGARRRYRFSTDFGEGRGPKNEGEFVVCNGGLHRGGGNVWRLSEGSS

SEQ ID NO: 138209 - protein, 69 aa, Glycine max
  Coding DNA Sequence Number=SeqID_21431
MKEAARKAAGGVGGSCEANKTEPPTKLRDVDKHRSGFIHQPRKRDQVWGHFTMETKNNAIPVVLLSPLP

SEQ ID NO: 138210 - protein, 103 aa, Glycine max
  Coding DNA Sequence Number=SeqID_21432
MGTKSILRLMRILGPSPASLAQSSWSLLSNALGGFLDYFNVDVSNEIVDFTEASSEITERHLKKLGMRFVQHEWIMAGEPAAGNLEQMEEDDEAEAPQEPTHQ

SEQ ID NO: 138211 - protein, 136 aa, Glycine max
  Coding DNA Sequence Number=SeqID_21433
  Gene Ontology: Mol. function=nucleic acid binding; Cellular component= mitochondrion; Biological process=DNA integration
  Homolog annotation: Hit_ID=Q1SAK3; Match level="QueryCoverage=89%, HitCoverage=11%, E-value=3e-36, Identity=48%"; Hit description =Integrase, catalytic region; Zinc finger, CCHC-type
MEEELSQFTKNKVWNLVPPPKNHSIIGTKWVFKNKLNEKGETSSYIRRMSRVFFLNGFTNEEVYVRQPLGFEDKEKPQHVYKIVKALYELKQALKAWYERLSSFVVQNGLSRGIVDTTLFRKILQRYDWFPFRCLP

SEQ ID NO: 138212 - protein, 93 aa, Glycine max
  Coding DNA Sequence Number=SeqID_21434
MTLCRDSNKIPAPHSVPLNNPLTIQLPMLPFFPPGRHFSYEIKKQSKKEWQNGLFKNIFDPKFAQASIQLVWAKDVTSTLSKQLAWASGCLHH

SEQ ID NO: 138213 - protein, 45 aa, Glycine max
  Coding DNA Sequence Number=SeqID_21435
MARESEERDPKERGVESDREEVANQHVIYYINEEPFPRRDNLHNL

SEQ ID NO: 138214 - protein, 52 aa, Glycine max
  Coding DNA Sequence Number=SeqID_21436
MVVAKKRNLTPSVPSIKVDAIVSADAFENLKPAPDIFLAASRILNVPPMRMQ

SEQ ID NO: 138215 - protein, 52 aa, Glycine max
  Coding DNA Sequence Number=SeqID_21437
MASEWGLEDNLRDPKDKWEMEAARKAAGGVGGSCEVIIKRQIEEWNRNSQAT

SEQ ID NO: 138216 - protein, 68 aa, Glycine max
  Coding DNA Sequence Number=SeqID_21438
  Subcellular localization annotation: CTP_CleavageSite=55; ConfidenceScore=5.10e-01
MTLWLPLHSSHTMNLKPPQESQVLFWLERKRRLMSWWSSSRKSVMLLCGRERVAKARVKGSAKEWREK

SEQ ID NO: 138217 - protein, 216 aa, Glycine max
  Coding DNA Sequence Number=SeqID_21439
  Gene Ontology: Mol. function=protein kinase activity; Cellular component=cell surface; Biological process=protein amino acid phosphorylation
  Homolog annotation: Hit_ID=Q1S8T9; Match level="QueryCoverage=86%, HitCoverage=28%, E-value=7e-66, Identity=65%"; Hit description =Protein kinase
  Pfam annotation: Domain name=Pkinase; Domain location=3-199; Score =30.1; E_value=2.4e-10; Accession=PF00069.15; Description=Protein kinase domain
  Pfam annotation: Domain name=Pkinase_Tyr; Domain location=5-199; Score=-44.7; E_value=1e-09; Accession=PF07714.7; Description=Protein tyrosine kinase
  Pfam module annotation: Pfam domain module=Pkinase::Pkinase_Tyr; Domain location=3-199::5-199
MAGGFKDKLGEGGYGSVFKGKLRSGSCVAIKMLVARGIAYLHYGCEMQILHFDIKPHNILLDENFTPKVSDFGLAKLYPIDNSIVPRTAARGTIGYMAPELFYNNIGGISHKADVYSYGMLLMEMAGKRKNLNPHAERSSQLFFPFWIYNHIRDGEDIEMEDVTEEEKKMVKKMIIVALWCIQLKPNDRPSMNEVVEMLEGDIENLEIPPKPTLYP

SEQ ID NO: 138218 - protein, 47 aa, Glycine max
  Coding DNA Sequence Number=SeqID_21440
MVVIVTPLLGRKDATCLILTNQYSNEVDNQGMIPVLVLSALRFSCGV

SEQ ID NO: 138219 - protein, 239 aa, Glycine max
  Coding DNA Sequence Number=SeqID_21441
  Gene Ontology: Mol. function=oxidoreductase activity
  Homolog annotation: Hit_ID=UPI00005F76B5; Match level="QueryCoverage =96%, HitCoverage=26%, E-value=2e-65, Identity=50%"; Hit description =COG3210: Large exoproteins involved in heme utilization or adhesion
MACRWRWPQPLALTLNWQQRQGELVVRQQQEPQPLLQLPWQVDAQQIRITAGHWRWPFGSQPLSGGVALTLDDWQQGLEQTQIRGRFNLLTAGRGGKGNLVLSVGPGKLSLTDSALPFQLTGESKFADLQLYGTIPGQLHGMLSDPQLSLQPGALLRLRGRLLSTLEVDEARWPLAGVSVASRGINGRLQAILNAHDPSFGRFRLHLDGRASDFWPDSGRWNWRYWGEGVMAPLSAKWD

SEQ ID NO: 138220 - protein, 164 aa, Glycine max
  Coding DNA Sequence Number=SeqID_21442
AELERHNFHKHLNNLADSSIDLALVKEFYDNLYSPEGPSPKQVRIRGHLIRIDADNLNAILETLVVLAEGESLPDYSRYCRMPTDIREIKVSRCIPGRGFILNAEGHLGKILRKDLITLAQVWSVLSYSNLALTSHTLDLAVDRARLIFGLVTQLDMNVEALIS

SEQ ID NO: 138221 - protein, 123 aa, Glycine max
  Coding DNA Sequence Number=SeqID_21443
LCCLNVVLLGCCGSLGGLMGTRGWWVYARFVDVENLLCTIARPPPSTTCDGVKLPAFIVDLRVVPGDMSRGSGDLGDVRRAPGSQQIKGKQDHKARRLVVAGQLLENEVRKLGKPLVIDYQGV

SEQ ID NO: 138222 - protein, 119 aa, Glycine max
  Coding DNA Sequence Number=SeqID_21444
MVELAKINTKRGVKDKVNPKSVWMTTFMVPNLSLTILRKNCQKLLHKWKFGNLLEAPNTLPMKGLFVTKLESNEVLLSPIALKVVGPFLLDSNSSRDDTNPPCNSLYGNPKTRKQRDKQ

SEQ ID NO: 138223 - protein, 51 aa, Glycine max
  Coding DNA Sequence Number=SeqID_21445
VFLPRPTVFGGGWCVVARRVGSASTTELTAVAMVIEAVPESNNHENAVTRK

SEQ ID NO: 138224 - protein, 137 aa, Glycine max
  Coding DNA Sequence Number=SeqID_21446
  Homolog annotation: Hit_ID=Q00M75; Match level="QueryCoverage=22%, HitCoverage=5%, E-value=2e-08, Identity=93%"; Hit description=PPR -repeat containing protein
MEQKKVLTMVLFVMAHGLLAITVHASQQLPAACDCKRVSDPQCLPLGVLHEIPKSRMCPGPNPSTILSQAQEEVELCFFKKKLLTPLSGSSSLCEGMREGNCTQPYPCICKETVSRFEPMTNKSPRHNFTAAPGLAL

SEQ ID NO: 138225 - protein, 232 aa, Glycine max
  Coding DNA Sequence Number=SeqID_21447
  Pfam annotation: Domain name=DUF1442; Domain location=1-228; Score =386.7; E_value=3.5e-113; Accession=PF07279.2; Description=Protein of unknown function (DUF1442)
MKLVWSPESALQAYIDTVKSCEKFKETGVPELLSAMAAGWNTKFIVESWSYGGPIAASVGLAVAARNTGARHVCIVPDERSKMQYITALAEMGVSPPPEVVAGEAEAAVARLAGLDFLVVDCKRKEFARVLRVAEVGPKGAVLACKNAWQRNFCGGFRWNMVLQKGVRIVRSVFLPVGKGLDIAYIGSSRSGVSPAPPPPPATTSKTRPSRWIKHIDQQSGEEHLFRDSSSH

SEQ ID NO: 138226 - protein, 574 aa, Glycine max
  Coding DNA Sequence Number=SeqID_21448
  Gene Ontology: Mol. function=catalytic activity; Cellular component =integral to membrane; Biological process=metabolic process
  Homolog annotation: Hit_ID=Q024C6; Match level="QueryCoverage=53%, HitCoverage=78%, E-value=4e-58, Identity=36%"; Hit description =Mandelate racemase/muconate lactonizing enzyme, C-terminal domain protein precursor
  Pfam annotation: Domain name=DUF1228; Domain location=119-190; Score=- 19.5; E_value=0.016; Accession=PF06779.4; Description=Protein of unknown function (DUF1228)
  Pfam annotation: Domain name=MFS_1; Domain location=97-405; Score= -30.6; E_value=0.0079; Accession=PF07690.6; Description=Major Facilitator Superfamily
  Pfam annotation: Domain name=MR_MLE; Domain location=416-519; Score =70.1; E_value=7e-18; Accession=PF01188.11; Description=Mandelate racemase  muconate lactonizing enzyme, C-terminal domain
  Pfam annotation: Domain name=MR_MLE_N; Domain location=307-414; Score= 36.2; E_value=1.1e-07; Accession=PF02746.6; Description=Mandelate racemase  muconate lactonizing enzyme, N-terminal domain
  Pfam module annotation: Pfam domain module=DUF1228::MFS_1::MR_MLE::MR_ MLE_N; Domain location=119-190::97-405::416-519::307-414
MTGIPIALIIGTPVSSLLLELHGWLGLHGWQLMFLLEAIPAIVLGLIVPFALPDRPEDARFLSADEQHWLVTTLAAERQKLPSRGHGGLLKALFSPLVLLFSLTYYGLANLNGAVSTFLPLIISETGLSHVQTGFITIIPYVFGLAGMLVLGRIADRPGSRLLANYLALIFSFVGLLCVAWFDNSLVKMMFLCCSAFGFFGAMPVFWGLPAQFIPASVVAGGLALINALGSIASVVNPWVIGVIRDRSGSYNGGFYWLAAMAMLSIITLSLIFRRQRLPAYQASNEQRVMPGEGDFWEERLARPTDIYAQFRTVNNHDGGVQLEDGFAITTVFLEIVSDEGVDGLAGPVPHAVASIIHGQLRPLLLGQDPRDTERLWDQMYRAQIHGRQGDGMLAISAVDCALWDLRAKWMQQPDMARVHERALEYKALGYRGQKWFFRHGPMSGREGLKKNIELAKTLREAVGDDYDLMFDCWQSMDVTYLLELAKGIEPYRPRWLEECVMADRISSMQRLKDKLSIPMAGGEHEYTRWGFKRFFESGALDVIQPDIYWCGGLSETLKIAAIATQKRSAGDPA

SEQ ID NO: 138227 - protein, 243 aa, Glycine max
  Coding DNA Sequence Number=SeqID_21449
  Gene Ontology: Mol. function=transporter activity; Cellular component= integral to membrane; Biological process=transport
  Homolog annotation: Hit_ID=Q82MF2; Match level="QueryCoverage=71%, HitCoverage=38%, E-value=9e-50, Identity=58%"; Hit description =Putative integral membrane transport protein
  Pfam annotation: Domain name=CsbD; Domain location=9-61; Score=86.0; E_value=1.1e-22; Accession=PF05532.3; Description=CsbD-like
MRRTLMNEDRISGNWKQFKGKVKEKWGQLTDDDLDVAEGKRDQLVGRIQERYGYGKDQAEKEGSAVIVLIERKQRDKTHYGGGHHIPGGNVGVAGLLHQAGNDQTRAAGKQRVGERIGQPQPGVTYAGREHLGQHRRSRSGQHAHQRTGDKYHQRLDRHTALRMLQHFQQRESQHQQQKRRQQHYCAAAIAIAEYAGRQDGGGKAEVRDHRNQQRLVEAGVQRGLQIGRHDHQVGITGGRPYH

SEQ ID NO: 138228 - protein, 89 aa, Glycine max
  Coding DNA Sequence Number=SeqID_21450
MLSVRPRFLCSSRFSHPAKRDVAALSGRCTLSPQCWIYEHFPSVHDSVTDDGYAEMSPRAYRWLTMKAYMKGLTASTYRTRIDALKITD

SEQ ID NO: 138229 - protein, 491 aa, Glycine max
  Coding DNA Sequence Number=SeqID_21451
  Homolog annotation: Hit_ID=UPI00005F8EC2; Match level="QueryCoverage =42%, HitCoverage=76%, E-value=1e-75, Identity=67%"; Hit description =COG3741: N-formylglutamate amidohydrolase
  Pfam annotation: Domain name=FGase; Domain location=1-203; Score =288.0; E_value=1.8e-83; Accession=PF05013.3; Description=N -formylglutamate amidohydrolase
  Pfam annotation: Domain name=SBP_bac_3; Domain location=316-491; Score=82.0; E_value=1.8e-21; Accession=PF00497.10; Description =Bacterial extracellular solute-binding proteins, family 3
  Pfam module annotation: Pfam domain module=FGase::SBP_bac_3; Domain location=1-203::316-491
VDAGLSEAARGLPDTDWHIPLLYDFVRDLGASVLIGHYSRFVIDLNRPPDNQPLYSTATTGLYPETLFDGTPTFKPGMTPDSAARQRYLETIWQPYHQQIQQELARLKAEHGYALLFDAHSIASVIPRLFDGQLPDLNIGTNDGASCSAASIAAIEQVCAAQSDYSWVVNGRFKGGYITRAYGQPAQGVQAVQLELAQLNYMDEAPPRLIDAGRHHGDPVSHVADVHPLPHSPMLCNPCPERVHDAFRLTPIPSVYRLCRSGTALASFQQRQPDLLTTRRRRMTHRAPFRRFCLTTLFASLMLAGVAAEAKEWKSITIATEGSYEPWNLTLPGGKLGGFEPELMEDLCKRMSIQCKLVVQNWDGMIAGLNAGKYDVIMDAIVITPDRKKVVNFTTPYASTPATFITSKDNPLLPADKNIIKLHDDEAAINAAIAPLKAALKGKTIGIASGTVYTPFIDKYFKDVADVREYTASADAILDLQAGRIDAVFDD

SEQ ID NO: 138230 - protein, 305 aa, Glycine max
  Coding DNA Sequence Number=SeqID_21452
  Gene Ontology: Mol. function=ATP binding; Cellular component =chromosome; Biological process=DNA metabolic process
MEMLMVITKLIIEGFKGFKDRFCIEFNESVNIIVGDNEAGKRKPVKNNISQYLFNDQLVKEYLASLATAVRLPPPALFVELHFQKTPDTVFLEGDGNCLKSSSVGVVFKIKFNEDYKAAYEALLKVGDIRTLPIEYYDIEWKSLSRDSLLSRNIPLKSAFIDSSSARGNNGSDVYISRIIKDLLTDDEVISVSQSHRKMKEAFISDQSIETINKKIISASKITSKKVTISVELSSQKAWESSLITCLDDVPFNYIGKGEQSIVKTNLALSHNKAKESNVILIEEPENNLSHTKLNLLIKTIKDNL

SEQ ID NO: 138231 - protein, 378 aa, Glycine max
  Coding DNA Sequence Number=SeqID_21453
  Gene Ontology: Mol. function=catalytic activity
  Homolog annotation: Hit_ID=P23831; Match level="QueryCoverage=31%, HitCoverage=86%, E-value=4e-35, Identity=60%"; Hit description =Protein samA (EC 3.4.21.-) [Contains: Protein samA']
  Pfam annotation: Domain name=HD; Domain location=47-155; Score=37.9; E_value=3.4e-08; Accession=PF01966.12; Description=HD domain
  Pfam annotation: Domain name=Peptidase_S24; Domain location=293-360; Score=68.9; E_value=1.7e-17; Accession=PF00717.13; Description =Peptidase family S24
  Pfam module annotation: Pfam domain module=HD::Peptidase_S24; Domain location=47-155::293-360
MGKTTQAIPLSRFNGELPATLAGVTIPHTRFTDGATELVASCSSAPLFNHVVRTYLFAASIGKKLGKAFDEEMLYLGCIMHDLGLTEKFIKDARFELDGADAARQYLVDNKFPEEKAEVIWDAIALHATMELPERKRPEIALVHLGAFMDGGMNANIFPLSFFEEVFEELPQNGNKTHFIELVANVLRKKPHTAYLSFEKDIGVKMEEFYARFTQHFRSHTAVWPGHQIMNPGSYTAGLTLLWPPIFTPRVRVPLYADPCAAGFPSPAQDYVEKELDLNELCIRRRASTFFVRASGNSMRDLGLCDGDVMVVDRAEEAAHGDIVIAEVNGEFTVKRLQLQPRLALLPMNPAYPVIYPEELQLLGVVTWFFNSTRGRRR

SEQ ID NO: 138232 - protein, 567 aa, Glycine max
  Coding DNA Sequence Number=SeqID_21454
  Gene Ontology: Mol. function=transposase activity; Biological process= transposition, DNA-mediated
  Homolog annotation: Hit_ID=Q8FC53; Match level="QueryCoverage=44%, HitCoverage=94%, E-value=1e-140, Identity=93%"; Hit description =Transposase insF for insertion sequence IS3A/B/C/D/E/fA
  Pfam annotation: Domain name=DJ-1_PfpI; Domain location=2-132; Score =24.8; E_value=1.8e-05; Accession=PF01965.14; Description=DJ-1PfpI family
  Pfam annotation: Domain name=Transposase_8; Domain location=164-241; Score=70.8; E_value=4.3e-18; Accession=PF01527.10; Description =Transposase
  Pfam annotation: Domain name=rve; Domain location=320-480; Score =190.5; E_value=3.9e-54; Accession=PF00665.16; Description=Integrase core domain
  Pfam module annotation: Pfam domain module=DJ-1_PfpI::Transposase _8::rve; Domain location=2-132::164-241::320-480
MRGGAVTCTAGFSIESQKLYPEQSFDLLLVVGGQGGRNISRDSQEGRALKKACLSSKSFGSICTGAFVLAELGLLDGKTATTHWKYRHIFSDLYPDVVLSTDALFVKDGGVWTSAGISSGIDLALAIIEDNLGTAVSLKVAQELVVAQRRTGGQSQFSPVPMSGKRYPEEFKIEAVKQVVDRGHSVSSVATRLDITTHSLYAWIKKYGPDSSTNKEQSDAQAEIRRLQKELKRQPHSQRHQADQMLTGQIKQFWLASGCVYGYRKIHLDLRDSGQQCGVNRVWRLMKRAGIKAQVGYRSPRARKGEASIVVPNRLQRQFNPDSPDERWVTDITYIRTHEGWLYLAVVVDLFSRKVVGWSMQPRMTKEIVLNALLMAVWRRNPQKQVLVHSDQGSQYTSHEWQSFLKSHGLEGSMSRRGNCHDNAVAESFFQLLKRERIKKKIYGTREEARSDIFDYIEMFYNSKRRHGSSDQMPPTEYENKYYQRLETKAADVDAIFYVRTSVTENHLSREEMRRIGVTENVVADLIEKSHCAWVATENEKIIGFSMILPDEACLFAAFVLPEYEGR

SEQ ID NO: 138233 - protein, 75 aa, Glycine max
  Coding DNA Sequence Number=SeqID_21455
  Pfam annotation: Domain name=DUF1471; Domain location=3-75; Score =26.0; E_value=4.5e-06; Accession=PF07338.3; Description=Protein of unknown function (DUF1471)
MTMKNVKTLTIAAVAALSMISFGSFAAESISVHGSTLDSAEAQVAAQAKASGADSYKITSARADNGVDMTAELYK

SEQ ID NO: 138234 - protein, 402 aa, Glycine max
  Coding DNA Sequence Number=SeqID_21456
  Gene Ontology: Cellular component=integral to membrane; Biological process=transport
  Homolog annotation: Hit_ID=Q3BM75; Match level="QueryCoverage=74%, HitCoverage=39%, E-value=1e-31, Identity=29%"; Hit description =Putative membrane protein
  Pfam annotation: Domain name=FUSC; Domain location=68-186; Score =46.9; E_value=7.1e-11; Accession=PF04632.3; Description=Fusaric acid resistance protein conserved region
PVRDRLTGAQEQLQQAWRAGRLNSEESILLIGLLERLLNFVRIADAYHSVSERVSDWTPAVKPGKASRAHKHVDKGLLLLSCFTAFIATFASCLFWIGSGWRDGSTAPMMAAVLCSFFAGLDSPIAPMKLFLKGVLISMAISLIYVTLLIPQAVTFEALVICLAPGLFALGLVIANPSTNLIGLIVATQIPGLIGMSHHFKPDLQLIVNAMISTLVGIAVALVLTLLIRNKRPAWTATRALRKGIRDLLQFITALRMNTATLTARQQFVARTLDRVNVILPRKRVDPAPELVAGGNLIAEAWLGANCYDYYTRHRHLLLANQIESATMFHELSQFLKQRLKTLYSTPSPALLHELDVLLLRLEAATQQENALFAPLFHLFNIRLSLFPGARWPQPLAEQNRT

SEQ ID NO: 138235 - protein, 181 aa, Glycine max
  Coding DNA Sequence Number=SeqID_21457
WNRYTDNILGRNILPKRNVHIYHTEFDEFKAELERRNLHKHLTNLQEGSIGVAIVKEFYANLYNPEDPSPKQARVRGHLIKIDANNLNDFLETPVVLEEGETLPTYSRFCRLRSNPQEIEARPCIPRKGFVLNAEGQPWKLLRKDLTILAQTWSVLSYSNLAPTSHTSDLNMGRARLVYGL

SEQ ID NO: 138236 - protein, 49 aa, Glycine max
  Coding DNA Sequence Number=SeqID_21458
MKMKMFPPGIASRASLYHYKECQYKSLLAIYIALCKKACLNNVSAKALI

SEQ ID NO: 138237 - protein, 141 aa, Glycine max
  Coding DNA Sequence Number=SeqID_21459
  Subcellular localization annotation: CTP_CleavageSite=71; ConfidenceScore=5.06e-01
MWVVPIATSKMQWQMTMQCLRVLLGAPSIIAGAPSTYCEKLFFFFLSLLPRDSSSSFFSASIFSFRETLPSAALSSSFLILPRGGCASPTRATTSPSFECASSILPRASALLFFIELTHHLIRTHFPDQLDPEDAYRSGDP

SEQ ID NO: 138238 - protein, 117 aa, Glycine max
  Coding DNA Sequence Number=SeqID_21460
MAAVTISSSDHPSIFSVARCELLDIFIISSIRLDVAPCGACKPWIFFINGVLCFLKSDGSGMEKEKDDWRRQFKEKMSLEEAHHHKKPWIRARSPLIQDQFQDSPLSVLRCHEACKA

SEQ ID NO: 138239 - protein, 54 aa, Glycine max
  Coding DNA Sequence Number=SeqID_21461
  Homolog annotation: Hit_ID=Q8H3G8; Match level="QueryCoverage=77%, HitCoverage=5%, E-value=1e-09, Identity=69%"; Hit description=Myosin heavy chain-like protein
WEKAENEGTGLKKQVQALTLRNSTLEDRVTHLDSALKECVRQLISHTKRIEQHC

SEQ ID NO: 138240 - protein, 96 aa, Glycine max
  Coding DNA Sequence Number=SeqID_21462
MGEELATQLALASKVASYISNSLLEEESGRPNFRRSYGNSQIAQQHLLLVSATLRNFTDRITLLPFDFRRVSRLTYCATKGAKYLETTNQRLHVIK

SEQ ID NO: 138241 - protein, 170 aa, Glycine max
  Coding DNA Sequence Number=SeqID_21463
MDKVLRGLSRKWRLQVTVLIAVKNLESMSLEELVGTLKVHEHKLQQDGVNDSFDEDSDEDELAFISRKICKIWRNKNQEKSQDKKKFFKTKEKKGIMSMWEDLDDTSLDEDDEEPNKFLIADTTSEGSELDQDNEELENKWKDLQKDLKELNELDNHQKKERYDLWRKCA

SEQ ID NO: 138242 - protein, 58 aa, Glycine max
  Coding DNA Sequence Number=SeqID_21464
MVSLDSMTFTPKTLEAMSLLVDKLSTSPEGPYQLWVDGLSFSDEGVCKGHLRGMKAKV

SEQ ID NO: 138243 - protein, 208 aa, Glycine max
  Coding DNA Sequence Number=SeqID_21465
  Gene Ontology: Mol. function=calpain activity; Cellular component =intracellular; Biological process=proteolysis
  Homolog annotation: Hit_ID=Q1S2E0; Match level="QueryCoverage=94%, HitCoverage=63%, E-value=4e-16, Identity=28%"; Hit description =Cyclin-like F-box; F-box protein interaction domain; Galactose oxidase, central
MKPLIQFKCVCKEWNSLISEPYFIKLHLSKSAAKDDLEHLQLIKNVCLGSIPEIHMESRDRNTRRILCLFLEQGDKVISRESQTLSFSPGIGRRTMFGFGYDPSSDKYKVVAIALTMLSLDVSEKTEMKVYGEGDSSWRNLKGFPVLWTLPKVGGVYLSGTLNWVVIMGKETIHSEIVIISVDLGKETCISLFLPDDFCFFDTNIWSF

SEQ ID NO: 138244 - protein, 302 aa, Glycine max
  Coding DNA Sequence Number=SeqID_21466
GVRDMLSWVRGQWIPFDADALSQFLGYPLVLEEGQEWEYSQRRNRADGFDEEAIAQLLCIPGQDFARTAAGRQVRIIRTNMTTLTQTWMTLLLSNILPSDHNSDLPLPKCQLVYAILTRMGVHVAQLIADAIYLFTGMPPTRHPLDPDKSNRALGFPALITGLCQSFGVPVAPSKVIRPPITRACIEKYCTPRQAQGDAPQAAYAPPPPHQADPTGSFGMERYLQHLVRQQAANHRGHVQTHVYLYQLSLSQQSQGFAPFACPTPDQFRAEVAWPGDWPEAHAGERLQRLPAIQRTHAWMRR

SEQ ID NO: 138245 - protein, 952 aa, Glycine max
  Coding DNA Sequence Number=SeqID_21467
  Homolog annotation: Hit_ID=P24188; Match level="QueryCoverage=30%, HitCoverage=84%, E-value=1e-143, Identity=81%"; Hit description =UPF0176 protein yceA
  Pfam annotation: Domain name=Rhodanese; Domain location=503-600; Score=95.7; E_value=1.4e-25; Accession=PF00581.10; Description =Rhodanese-like domain
MTGWMRKKSSTRAGYIIFCGKCRTGRTDSRNTERTDEYHILLNRQTFTLFPMQQMVTLLIGTDRHCRRVEGIAAQAGPFLARHSADNHRRCSHIYCSGASSTVSSTTLFITIAAACQKRHHARISQTNQHMRAGGGRGFLNGKERGEYTAARAVVVIGRIPDDVVVLHGADHAFQIFAIQHAFIGTHASPGLQPVQAIHANARVVHAKYARTQLQRQEVHANQQDAALLGQRLGNVLQAAGADPFTNTPVRPEPRHAGLNQPHSHRFEIVLHHGFTFAGRHIREAQRQIALRDLNTTLHKTHGKASQPAASHVQQRVGQQHQYIEETDAQPGQPVAWMKEFAGKLRKLRHGNINVLRRVPESPVFTMPVLHNLVSNKELKERMLAETEPRTTVSFYKYFQIADPQAFRDRLYVALTQLKVFGRVYVAQEGINAQISVPASRYEAMKAMLYAFDPALDNLRMNIALDDDGKSFWVLRLKVRDRIVADGIEDGSFDASNVGNYLKAAEVNAMLDDPDAVFVDMRNHYEYEVGHFDNALEVPADTFRDQLPMAVDMLQAQKDKKIVMYCTGGIRCEKASAWMKHNGFDDVYHIEGGIIEYTRRAREQGLPVRFKGKNFVFDERMGERISDDILSSCHQCGAPCDSHTNCVNDGCHLLFIQCPSCRTEIFADVELFQHNFAAGGKAGAITAPRILAFTNQLRIQRDRLRYAVERQVACDLIILALFFNLSRAEAGLREFAGIEEIRAAQMLVALGMVGIEAVSIDGHVDLVRGGIGFIKGKAAIKIFKAAVQPAVAKMLNAELDKRVLTLFIKLILSRAGTQAGRKEGSGAERQQGFPDHITFPFQRLRGCGNRASDSASCRDRQNGVSARPGRAGQTTAPEPTPAINGPHRRHRPAHPCRGRDQIAADQQHQQQAIQQPVRSMGDTAYVRRVTVERCRRRRYHAPAQAQQQSSKQ

SEQ ID NO: 138246 - protein, 104 aa, Glycine max
  Coding DNA Sequence Number=SeqID_21468
MSYSCLVVLTGGVLHMTTEKPEEAMTFGELLAFIAEQQRRLTVLENAFATLTFCLDDRASQLLAHNLTLEAQNQNHDAQLQQHFARLADEIHRRKGQLPAESQG

SEQ ID NO: 138247 - protein, 170 aa, Glycine max
  Coding DNA Sequence Number=SeqID_21469
  Gene Ontology: Cellular component=membrane
  Homolog annotation: Hit_ID=P25738; Match level="QueryCoverage=64%, HitCoverage=88%, E-value=6e-45, Identity=74%"; Hit description =Acidic protein msyB
MNKGIYYYVTISTDQEGYHLLHRKECKRLPVKEDMELQMSLYSTLEEAIEAAREEFLASQPELEQDDASVSQFALQKYVMQDGDIMWQAEFFADEDGQGECLPICSGEAAQAVFDGNFDEIELRQEWQSENTLHEWDEGEFQLEPPRDLEEGEAAAEEWEDDDSPSDNWA

SEQ ID NO: 138248 - protein, 81 aa, Glycine max
  Coding DNA Sequence Number=SeqID_21470
  Gene Ontology: Biological process=response to DNA damage stimulus
  Homolog annotation: Hit_ID=UPI0000E44F37; Match level="QueryCoverage =98%, HitCoverage=64%, E-value=8e-26, Identity=65%"; Hit description =DinI
  Pfam annotation: Domain name=DinI; Domain location=13-79; Score =107.5; E_value=3.9e-29; Accession=PF06183.3; Description=DinI-like family
MRVEITVAKTQPLPAGALDALSAELTRRISRDFPDDNHHVKVRYAGGNQLSVFGGCKESRDRISDILQETWESADDWFITD

SEQ ID NO: 138249 - protein, 257 aa, Glycine max
  Coding DNA Sequence Number=SeqID_21471
  Gene Ontology: Mol. function=transcription factor activity; Cellular component=intracellular; Biological process=regulation of transcription, DNA-dependent
  Homolog annotation: Hit_ID=Q9UXS2; Match level="QueryCoverage=48%, HitCoverage=76%, E-value=2e-53, Identity=73%"; Hit description =Putative resolvase
  Pfam annotation: Domain name=Resolvase; Domain location=23-129; Score= 14.7; E_value=2.7e-05; Accession=PF00239.11; Description=Resolvase, N terminal domain
LVKWRFKEEDVERLMGVVRKRKVVLYARVSSNTQKDDLINQVKYLEENVKDYDQVITDIGSGLNMKRKGFLKLLRMILNNEVSKVVIAYPDRLDKTPEQELIEDLISILVSFSGKLYGMRSHKYEKEEYVYLTYSLKNNKKVKSKILLENYKHLLQKALDWLWERTKIERKEVKKGKKIFAKVKVTLPKKKEVYKVLRDELEKVNNLASHYVDKAINDAYSILNSWRRRAEKGQASLRKPRLKKVYVRVKSTLRKVE

SEQ ID NO: 138250 - protein, 146 aa, Glycine max
  Coding DNA Sequence Number=SeqID_21472
MVIPKFKVPDFGKYKGTTRSKDHLKMYCRKMGAYAKDEKTADTFFLRKNLLESILGKDLMVAFIRQCQYNSDMAPDRMQLQKVCKKGARIIQRTRPKGGGIWRPRWVPPIMERETIIVMVDTLSVLYYEKMVGCAPSKLCRFGLRQ

SEQ ID NO: 138251 - protein, 97 aa, Glycine max
  Coding DNA Sequence Number=SeqID_21473
MVIWNYTGQTLERLGFITFAGQDLVGLTSWSRESKDWGQPSFSHLRRRLEIPLKHEMHRVAKGFNQRRASLEGRVSDLRKGDKDTKCDNIDKVVKEA

SEQ ID NO: 138252 - protein, 53 aa, Glycine max
  Coding DNA Sequence Number=SeqID_21474
MPTSLERAQMTHIGPLLINHTRGADNRKVWSTKARLLAPTYPPMRNSDLRSSG

SEQ ID NO: 138253 - protein, 190 aa, Glycine max
  Coding DNA Sequence Number=SeqID_21475
  Gene Ontology: Mol. function=DNA binding
  Homolog annotation: Hit_ID=Q1S0F5; Match level="QueryCoverage=78%, HitCoverage=31%, E-value=1e-23, Identity=37%"; Hit description=IMP dehydrogenase/GMP reductase
ERFAQAWSAIRRLNRSQLGKKSDHVHESYTQWVIDRTKSFGLPYHLPRYLSSTIPPSSLPIPFDTKEEFHEQLTKERQEKETWKRRCQELERENETLKGKIAQQSRELFIQNQRVIEKDDLLRRKDALLHQDARRKRRFMDLFSRAHSDSEDPSTPGEGQSAAAQGKWPGEFSTNQLAFTTPGPIGRGWI

SEQ ID NO: 138254 - protein, 246 aa, Glycine max
  Coding DNA Sequence Number=SeqID_21476
  Homolog annotation: Hit_ID=Q10SV0; Match level="QueryCoverage=42%, HitCoverage=52%, E-value=2e-08, Identity=40%"; Hit description =Expressed protein
  Subcellular localization annotation: CTP_CleavageSite=29; ConfidenceScore=5.35e-01
MARLSIVAIVAAVLLLALSATPATARPCRSFIISSYSFRNPNSNTFATITEIRSFTPLYITDKPPSYALFFPHATQLPQHESVRPRAPLGFASAYDFSSLRDRTKDILSVALALLFGVGCGALTAATMYLVWSVFSTRHRASSFDDFSSDDEDEIESPKKLGYVKIPAIETTTAVAPAAPAPAKGSRLFAMRRYGGGILYAALPLHMQRGCFRIRTHDQQVTKAQLYRCIKARPHFTAAFCKIVFD

SEQ ID NO: 138255 - protein, 198 aa, Glycine max
  Coding DNA Sequence Number=SeqID_21477
  Pfam annotation: Domain name=NC; Domain location=63-141; Score=32.8; E_value=1.2e-06; Accession=PF04970.4; Description=NC domain
MVIHFTRGSSQETETRTMLGGFYLSSPHHASRDTPCPKCGYQTKTEGVTQTCLDCFLYGGYLYLFEYGVSPAFFLAKARGGTCTIASSDSTEAILRRAFFLLKKGFGGYHLFKNNCEDFAMYCKTGLLLVRTSIMSVGQSGQATSLLAAAGAIVSSSLVFMITSLCGLALVGCAMYCVSRYVSDIGVRCDVTKVSVKK

SEQ ID NO: 138256 - protein, 250 aa, Glycine max
  Coding DNA Sequence Number=SeqID_21478
MQDEDPAAALRLLLNTSQANTSSEKIPGASSSSDADITSSVRQDCLLLKLSMEYARADVLKSIEENPSAAFGHLNFLKKLHNPLTSDEILGKVIQIESIIDQFASTVQKKRENGARLDAQKQAHILLLEKAQAAQHEVERLNKEAKEGSSEIKACDDNISSWEATITDLLSQVDDLRQKIVTEQAKRKELQEKAANSIQKLIAEKGREGLKAFSASQAVADEARVMESADQVLTKEMATLKKLYEDLVMH

SEQ ID NO: 138257 - protein, 185 aa, Glycine max
  Coding DNA Sequence Number=SeqID_21479
  Gene Ontology: Mol. function=thiosulfate sulfurtransferase activity; Biological process=glycerol metabolic process
  Homolog annotation: Hit_ID=Q664J2; Match level="QueryCoverage=58%, HitCoverage=99%, E-value=1e-46, Identity=78%"; Hit description =Thiosulfate sulfurtransferase glpE
  Pfam annotation: Domain name=Rhodanese; Domain location=87-176; Score= 63.8; E_value=5.6e-16; Accession=PF00581.10; Description=Rhodanese -like domain
MAEQKMLNYVGKLVVLVDSSKVGQRAGMLFSRTEQIAMVITGRAANPAIVEQLRQQGVEVLLLVTIAASPNYEAVSSMEQFEAINVEQAYARWKEGSAALVDIRDPQSFEAGHTPGAFHLTNATLSAFMQQNDFERPVMVMCYHGNSSRSAAQYLLHQGFDAVYSIDGGFEAWARQYPQDVETSA

SEQ ID NO: 138258 - protein, 138 aa, Glycine max
  Coding DNA Sequence Number=SeqID_21480
MEFKYCDCQNQRTSSPTPRPFPTLTYKNSDISKGSSQDMPSITPRIRENADTAGVGERRDRREIIANEMIWRRGLKEKVLGISMQGLGMFSFGEPISMSFNPRMNSINHVNNADKDTRQFSTLTNKDKIIILDKPDAN

SEQ ID NO: 138259 - protein, 86 aa, Glycine max
  Coding DNA Sequence Number=SeqID_21481
MGAKYLEVVKRGSHPNNRWSPDEIKVCGMTKGAEFVSARLPPNLQNLNDKGHIICFYAFTHSACLFLNDKGRRICIYAFTHSACCS

SEQ ID NO: 138260 - protein, 146 aa, Glycine max
  Coding DNA Sequence Number=SeqID_21482
  Homolog annotation: Hit_ID=Q9FIV5; Match level="QueryCoverage=85%, HitCoverage=81%, E-value=3e-07, Identity=29%"; Hit description =Arabidopsis thaliana genomic DNA, chromosome 5, P1 clone:MLF18
MEEHAKEELKLLEAQYPNQHEHLKNELRSFIFQLQTNHQDSEQLPENNNFSTHLAFFDTEESTSLGEQRKRSDYDLELALADRLVIEKIGGSSELETPKSVVVKHFSSRKNNKRKDRVDLVLERAQVCLKKIKHLKTFLLSPPPEI

SEQ ID NO: 138261 - protein, 361 aa, Glycine max
  Coding DNA Sequence Number=SeqID_21483
  Gene Ontology: Mol. function=catalytic activity; Biological process =protein amino acid phosphorylation
  Homolog annotation: Hit_ID=Q9FK64; Match level="QueryCoverage=84%, HitCoverage=69%, E-value=2e-56, Identity=38%"; Hit description =Tyrosine-specific protein phosphatase-like protein
  Pfam annotation: Domain name=DUF860; Domain location=2-333; Score =467.6; E_value=1.6e-137; Accession=PF05898.4; Description=Plant specific of unknown function (DUF860)
MDNYKNLVKVIAVQDLILANPKNPSVSIDFLSKLSQKLHLNRGATAFLRKFPHIFHIYYDPSKLKPFCRLTDAALDVSRQEAVAINASLPDVVGRLVRILSMSASRMVPLRAVFKVWKELGLPDDFEDSVISANSGVFQLFEAHEPNTHLLKLVDGACNNGFRAAVEDWRVVECCKEDCSVDRMEMQFNFKQGYPPGMRLTKNFKAKVKEWQRLPYVGPYEVVGEKKKSKAGMMALEKRAVSIVHEFLSLTVEKMVEVEKISQFRNWFGIDLNIRDLFLDHPGIFYLSTKGKRHTVFLREAYERGCLIEPNPIYDARRRLLDLVVLGRRGLPAVNSKFQDTSGCNETGQEENQQSHDSLPS

SEQ ID NO: 138262 - protein, 207 aa, Glycine max
  Coding DNA Sequence Number=SeqID_21484
  Gene Ontology: Mol. function=metal ion binding; Cellular component =integral to membrane; Biological process=metal ion transport
  Homolog annotation: Hit_ID=UPI00005F919E; Match level="QueryCoverage =99%, HitCoverage=69%, E-value=4e-44, Identity=46%"; Hit description =COG2215: ABC-type uncharacterized transport system, permease component
GDQHLSRYPSGAAENQHEADAAGGAVAGHGGDWSGDADAGGAANLLAPAASHQLLAGERQLFAGDSARRLGGLARAAGVTPRVPSGDRAPDSRAGRCGERQNPGAGGAVDGAAALFRCHHDAVVCQSDWRVWLGRGLGADHGAGHRAHRVAAGFAGAALARACGASRQGQQQRGSAMVVAGRDAGWQPAVAAGRLYFMAQCYARLRW

SEQ ID NO: 138263 - protein, 394 aa, Glycine max
  Coding DNA Sequence Number=SeqID_21485
  Gene Ontology: Mol. function=nitric oxide dioxygenase activity; Cellular component=membrane; Biological process=xenobiotic metabolic process
  Homolog annotation: Hit_ID=UPI00005F7499; Match level="QueryCoverage =99%, HitCoverage=100%, E-value=1e-130, Identity=58%"; Hit description=COG1018: Flavodoxin reductases (ferredoxin-NADPH reductases) family 1
  Pfam annotation: Domain name=FAD_binding_6; Domain location=154-254; Score=38.1; E_value=3e-08; Accession=PF00970.14; Description =Oxidoreductase FAD-binding domain
  Pfam annotation: Domain name=FAD_binding_9; Domain location=165-252; Score=-28.0; E_value=0.015; Accession=PF08021.2; Description =Siderophore-interacting FAD-binding do
  Pfam annotation: Domain name=Globin; Domain location=6-131; Score =75.7; E_value=1.5e-19; Accession=PF00042.12; Description=Globin
  Pfam annotation: Domain name=NAD_binding_1; Domain location=263-371; Score=56.5; E_value=9e-14; Accession=PF00175.11; Description =Oxidoreductase NAD-binding domain
  Pfam module annotation: Pfam domain module=FAD_binding_6::FAD_binding_ 9::Globin::NAD_binding_1; Domain location=154-254::165-252::6 -131::263-371
  Subcellular localization annotation: CTP_CleavageSite=35; ConfidenceScore=5.17e-01
MLDAQTIATVKSTLPAIAQLGPQLTGHFYQRMLTRHPELKNVFNMNNQRSGNQREALFNAICAYGSNLENLEVLLPAVEKIAQKHASLNIQPAQYAIVGENLLATIKELLNPGDEVLAAWGKAYGVLAEVFIQREAAIYRASEEKVGGWRGARDFRIRAITAQSSVIKSIELVPNDGETVADFLPGQYLTLSLRPADSDYIQHRQYSLTHLPDGKAYRIAVKHEAQGSVSGWLHQHAKVGDIVQCAAPAGDFFLQAAAQTPVTLISAGVGQTPLLAMLASLAEQQHPAAVCWLHAAENGAQHAFADEVAALGAQLPHFSRHVWYRQPQADDAGRYDAQGLMDLATVSTALTQSDGQFWICGPLAFMQFVARQLTDAGISAERIHYEVFGPHKVL

SEQ ID NO: 138264 - protein, 240 aa, Glycine max
  Coding DNA Sequence Number=SeqID_21486
  Pfam annotation: Domain name=Transposase_23; Domain location=30-100; Score=-5.4; E_value=0.0044; Accession=PF03017.5; Description =TNP1ENSPM transposase
LPPEPEVGPSATCASTKESCVDPLGNDPDTGDLDKCRLYIEENPPCLVALGRVYEGSTIVHNIPLLHDQVKVGVEEVRDADASIPVPTEEVKLVGQTLNTFFALPTHLVKGLSEQGVVGPTKPADRPHHDVDDPLYLMTLTILQLFLKPLQVMWDAIMFGVFNEDFPLYIKYEDLSEIAHGGQCLSISFIQLWILHMNETSIRAGNADVYGFLKPQSIQRSGQLKFESESYIKNWMQNSK

SEQ ID NO: 138265 - protein, 128 aa, Glycine max
  Coding DNA Sequence Number=SeqID_21487
MSCGSVQVEGTSTWLFKENKGGYIPCGSLLVKDFTRLLEISRTGGWFGTGFDQDTTLSLIVLTHLRVENYVSHHSLADWNTTLSLIVFTRPRLEDCTVSIANRPGHYFKPPLELVGLGSSSSMESIAS

SEQ ID NO: 138266 - protein, 226 aa, Glycine max
  Coding DNA Sequence Number=SeqID_21488
  Homolog annotation: Hit_ID=UPI0000E478AA; Match level="QueryCoverage =40%, HitCoverage=26%, E-value=8e-10, Identity=35%"; Hit description =PREDICTED: similar to cortical granule protein with LDL-receptor -like repeats
GLHVLASRGLHILSFRGLYVLIFGGLHILTFRGLHVLAFRGLHVLAFRGLSVLAFRGLHILTFRGLHVLAFRGLYILAFRGLHVLAFRKLKRPRLQFPPAKVSAGLCHHDIGIVPTRHPVDPKKSNKVLGFPALITGLCQFYGVPVATSKVIRPSINRAFIEKYSAPRRAQGEVPQQLRDGQQQATDAPPPPLGSTSAHLQRLECCPRPMADRQATKSKAKCKKKY

SEQ ID NO: 138267 - protein, 44 aa, Glycine max
  Coding DNA Sequence Number=SeqID_21489
MNGASQSFVEGNWKGGLMSYLEEFESRSKGSTTLRAIGLRSTPN

SEQ ID NO: 138268 - protein, 267 aa, Glycine max
  Coding DNA Sequence Number=SeqID_21490
  Homolog annotation: Hit_ID=Q47522; Match level="QueryCoverage=23%, HitCoverage=83%, E-value=9e-22, Identity=75%"; Hit description=LacZ protein
LPGINRDTRIYLFCEVISVTGIYSAQSASAVPPVQLLTGWCVTAKAPPDISAGKCSGHAARRVPFAIQAAQLLGRAIGAGLFAITPAGERGMCCKAIKLGNARVFPVTTLNSMSWLDLPILMAALLVLIALHEFKIPIITPRDLELLLTGNVEKWVSNKDHKALGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138269 - protein, 302 aa, Glycine max
  Coding DNA Sequence Number=SeqID_21491
  Subcellular localization annotation: CTP_CleavageSite=16; ConfidenceScore=5.48e-01
MPNPGLAKASPLIQTLATTVRVCLNVVAVFGLTMFLFFIGFSFMGSSISNLTIRPVKPDGDLGLTPHSSGTPNGAPYFNQQEEAFACQHIANSLLTGVPVGFFWPEESQQKHPDAWCQLCEDARLEAGGDWTPEVEKLLSVKLLCASSNVSWIVSSRDYQGFPLLTRHPVGLNFDKLQVIYPIRLIVDLTFAKVQENGLPENHYNETLEIFDNFITEYFKHRSNGQCVLVETYGGKRHFYLYVSRWADTEAFKIEISEIFPQHQVEFDVRPDENWSLIRKYSHDILSDISRDANSAESYIAP

SEQ ID NO: 138270 - protein, 230 aa, Glycine max
  Coding DNA Sequence Number=SeqID_21492
  Gene Ontology: Mol. function=metalloendopeptidase activity; Cellular component=membrane; Biological process=proteolysis
  Homolog annotation: Hit_ID=Q0LLG8; Match level="QueryCoverage=98%, HitCoverage=34%, E-value=3e-63, Identity=53%"; Hit description =Hypothetical protein precursor
NDDAYTLIDESQAQIDALIGNANYDIGHTFSTGGGGLAGLGVICSTGNKGSGITGSSNPVGDPYDIDYVAHEVGHQFGGPHTFNATTGSCAGNRSASNAVEPGSGVTIMAYAGICGATNNLAPNSIPTFHTKSFQSITTKVQSTSCQVTTPVTNTAPVVNAGNDYTIPKGTPFKLTGSATDAQNNALTYSWEQNDVGPAGNWNAPTGNAAIFRSFLPVTVPYRYFPKLQT

SEQ ID NO: 138271 - protein, 233 aa, Glycine max
  Coding DNA Sequence Number=SeqID_21493
  Gene Ontology: Mol. function=1-acylglycerol-3-phosphate O -acyltransferase activity; Cellular component=integral to membrane; Biological process=phospholipid biosynthetic process
  Homolog annotation: Hit_ID=O80437; Match level="QueryCoverage=87%, HitCoverage=50%, E-value=5e-77, Identity=62%"; Hit description =Glycerol-3-phosphate acyltransferase 6
MECVMQRFVQRPTSLAALLTFLWLPIGIILSILWVYLNIPLPERIAWYNYKLLGIRVIVKGTPPPPPKKVVALSREREKDAANIKRLLEEGDLVICPEGTTRREPFLLRFSVLFAELTDRIVPVAINTKQSVFYETTVCGHKLLEPYFVFMYPMTTYEITFLNQLPKELTCSGGKSAIEVANYIQRVLAGTLGFECTNLTRKSKYAMLAGTLLSIIFSYIIFNYYHRHLCTSI

SEQ ID NO: 138272 - protein, 54 aa, Glycine max
  Coding DNA Sequence Number=SeqID_21494
MLGIGSTFGRPPDLGYLASPTGIERVLTEKDLLADSYSNLEASILDEKEFLLLK

SEQ ID NO: 138273 - protein, 110 aa, Glycine max
  Coding DNA Sequence Number=SeqID_21495
MPLEGKQFGGIPMPNTLEGPQFCPQPQPLHFAVGRAPPAMAEKGKLDHIEERLKDIEGGEDCAFANLEELFLVPKHGHSQGTTCSKNHLKMYCRKMGAYAKDEKLQIHFS

SEQ ID NO: 138274 - protein, 74 aa, Glycine max
  Coding DNA Sequence Number=SeqID_21496
GNTGSNKDRRKSLKVYQSHAVRGEKVASAQDFVGNQRERTTLGRGLTFSPWVKVYDKLGFWLKACRTAGHDICQ

SEQ ID NO: 138275 - protein, 32 aa, Glycine max
  Coding DNA Sequence Number=SeqID_21497
  Homolog annotation: Hit_ID=Q2HRM7; Match level="QueryCoverage=93%, HitCoverage=4%, E-value=4e-09, Identity=83%"; Hit description =Polynucleotidyl transferase, Ribonuclease H fold
ILISLSICLRMTSGRENEFCAQFGPQGLPKLA

SEQ ID NO: 138276 - protein, 212 aa, Glycine max
  Coding DNA Sequence Number=SeqID_21498
  Homolog annotation: Hit_ID=Q5XM22; Match level="QueryCoverage=19%, HitCoverage=22%, E-value=3e-09, Identity=69%"; Hit description =Resistance-like protein HAAS-2
  Pfam annotation: Domain name=DUF1723; Domain location=43-92; Score =53.9; E_value=5.5e-13; Accession=PF08330.1; Description=Protein of unknown function (DUF1723)
EHPDLKLVSHGRKVTLIGRPVPEIEGLVAATGLSPLIDCLVITGDPGLISAFVERWHGETSIFHLPIGELTITLDDVSSLLDLSITGALHSFHALSTKEARFLLTELLEVSAEEARAETTLTRGAYLDEASRTTTRQLARYLTLLQCWIYEYFPSLHQCVTDDTYQETSPRASRWLTSMAHMKGITGAPYRAHCDALTVTDVSWLPYKEHRG

SEQ ID NO: 138277 - protein, 89 aa, Glycine max
  Coding DNA Sequence Number=SeqID_21499
MEGLRRISRWSTEGLLPISLFATKETSGTPADLFALLYAGKTTWSFGKDGHSSCAATRFVATRGEEDTSMKPNQDVNKGHCSNSSICAS

SEQ ID NO: 138278 - protein, 124 aa, Glycine max
  Coding DNA Sequence Number=SeqID_21500
TLFLQHFNIPLDSEPYVPIKRSFLIGASVIASFGYQKEHDGSWVKKGARHVGEEGHDGEDSSLLSKILDRFDGLQTFVGERFDTLELQVDMSFNEMESRITKVKEDVSYIRSSFDLPPPPSPSS

SEQ ID NO: 138279 - protein, 114 aa, Glycine max
  Coding DNA Sequence Number=SeqID_21501
MEHFLEQVAWPEAQLPLVRPNEVAPPEPTPVQVNSEPANPQSPVVNPPSSPELEAVPPSPPLIVIYDASSDEATALLDSPTVETADPPVSPIGGIANLSDSSSGEVVALTDSPV

SEQ ID NO: 138280 - protein, 62 aa, Glycine max
  Coding DNA Sequence Number=SeqID_21502
MSSRTRCMLLSSFVMGSRKVYITFLTTHMGHCVPECAKYFSELDCFWPGRAGQQHPPPFSYK

SEQ ID NO: 138281 - protein, 57 aa, Glycine max
  Coding DNA Sequence Number=SeqID_21503
MEWILPTPTPYRLVEPVQVIEVTSSKEDPEEDPEELPPEPAVDALDFLEGDEDPLPE

SEQ ID NO: 138282 - protein, 130 aa, Glycine max
  Coding DNA Sequence Number=SeqID_21504
  Subcellular localization annotation: CTP_CleavageSite=63; ConfidenceScore=5.01e-01
KPPYYLSHFDLPFLRSFWHLYSVCLWDKASLLGLTSGAARMPEAGGANEVRTRSRVQFSVTSRSKAIGNKATLLTEGHSGYSNHKEKEGEKVAHFTSSVGERRAKRSRSPTFKKKAFTKGTSRVYEVKAR

SEQ ID NO: 138283 - protein, 102 aa, Glycine max
  Coding DNA Sequence Number=SeqID_21505
  Subcellular localization annotation: CTP_CleavageSite=37; ConfidenceScore=5.45e-01
MFAHSIKGCRPLGADVWGANTFPVRKYNSRTFHVKVRRSRLFQFFRRFPQINVGGDSARIPFVEHASRESRVALPPKGPYTRVHGSIRSGGESVIMLGLRLA

SEQ ID NO: 138284 - protein, 54 aa, Glycine max
  Coding DNA Sequence Number=SeqID_21506
  Subcellular localization annotation: CTP_CleavageSite=15; ConfidenceScore=5.12e-01
LSMMDSNSPFLPHCNSDTKNAFRKPSGDAANRNYRRRSPVEGSPSPDGWDLLSC

SEQ ID NO: 138285 - protein, 222 aa, Glycine max
  Coding DNA Sequence Number=SeqID_21507
  Gene Ontology: Mol. function=nucleic acid binding; Biological process= DNA integration
  Homolog annotation: Hit_ID=Q1S7C5; Match level="QueryCoverage=61%, HitCoverage=11%, E-value=3e-24, Identity=37%"; Hit description =Integrase, catalytic region
MRILRCVKGTLGYKLFSNHGRNVTEKVQQGMCWSSWWCSKEESMVALSSCEAGYIVTSMGACQGLWFEDLMSKSKIRRGDYEDANRQQLQRFVVNPIVPPLYLTKDDRISDHVNPDYETWEVQDQTPLVWLQSTLSKSVLLCALGSNHSYQVWEKIHEYFSLHTKSRARQLCTAMRAVTLDGKSIDEYLRKIKGYVNELAGVRVPVRHEEYVDALLEGLSSD

SEQ ID NO: 138286 - protein, 412 aa, Glycine max
  Coding DNA Sequence Number=SeqID_21508
MDKLDDSNYSTWASDILLWISEAERAKWQKIDAQLCSHQIHHSPFYQTDFSPSCYVRIDLLRSKSSLYTNDTQHLYALCQEFMTLLLHNGLMARCAPILANSMTIMNLSFLMLRNLKKPRRNLKTTVPSSQHLPRREMVCCDKKQYLGGFSSLLLNDNGASLGHLVRKAREFDSSSRQREDLRTFNRSFEGQEIIDTNSQLFALRTRQLLRRVVLISTEAQVTQYKDGVVDLVVTKLYKVVLAVDFSSCFLCKLLSHYKRDSWVLRVNTTLFQIFSISNPSQCSSLNFSKVDIRAGQSRSACGSLPAAVLGFSQCLLPTTVIGAAVLVFDNFSGEFQIWLALLCLSFLEDVYGRRSHHHMRLSPISPGHLLPFLSDLLLSDEIQQTHCHHCAHLLLASLTMLSATTAGVVTV

SEQ ID NO: 138287 - protein, 432 aa, Glycine max
  Coding DNA Sequence Number=SeqID_21509
  Gene Ontology: Cellular component=ribonucleoprotein complex
  Homolog annotation: Hit_ID=Q8W5I5; Match level="QueryCoverage=82%, HitCoverage=78%, E-value=3e-19, Identity=27%"; Hit description =Putative small ribonucleoprotein
SPRHGHSSSPNLVRENSARVSHHSRKYDDREQDQQYGRNHYGRSSDSLRHSDRQSFKSSYGHSRHDKYANEDRYREKLLSRSGHETRDDHMRDESDSRSKNYQRSVEKYSHDKYDRSDHRSKEKRRETYLEHQKYKDMDSSYDKSASSKRHALYDEVEREGHSRDWDGRNERRDSRRSSGDYRSDQAVCYSESRNQRDESGPQRDCGKSSLKEGYKSEQKESNDQNLPWEEKRKHDDTETGKGKDWKTRQASEQCGIEDKESSGKKLKLFDLDKDDNYRKDDESKTSSSKLSHESKADVRAAKTSGFDGDNDLDAAKVAAMRAAELVNRNLVGAGCLTTDQKKKLLWGGKRSTPTEEAIGFLGPSGIYQHGLVRTSPNLSNYQVNNSIFVLGYLGFGTYQYHPSEELPCPQCKKLGIGINDLDATNVVAEKD

SEQ ID NO: 138288 - protein, 91 aa, Glycine max
  Coding DNA Sequence Number=SeqID_21510
  Gene Ontology: Cellular component=ribonucleoprotein complex
  Homolog annotation: Hit_ID=Q8W5I5; Match level="QueryCoverage=82%, HitCoverage=20%, E-value=2e-15, Identity=55%"; Hit description =Putative small ribonucleoprotein
MYLWSRLHVISGRVVSGHRWDTAMFSDRERQEKFNKLMGMRGETKVEQNFNNQSSNDSLRAEKEKELQMDLEKQYTAGLRRRDGRTVGLGL

SEQ ID NO: 138289 - protein, 70 aa, Glycine max
  Coding DNA Sequence Number=SeqID_21511
  Subcellular localization annotation: CTP_CleavageSite=49; ConfidenceScore=5.01e-01
MGGRIFEVEQGAKMGISFLIVLPGIVFIRPRFKAGCSTGSASLTVLEAVAVALSSMVFWSFNMTSEMEAI

SEQ ID NO: 138290 - protein, 351 aa, Glycine max
  Coding DNA Sequence Number=SeqID_21512
  Pfam annotation: Domain name=Transposase_23; Domain location=135-205; Score=12.3; E_value=5.2e-05; Accession=PF03017.5; Description =TNP1ENSPM transposase
DSFEEQATLGSFVPHGRQDVLAAAIGRPEHPGRVRAVGAGVTIKQYFGSAPRTSRNASSVPPDELQQLTQQIRDPLEESITMKVTRQVMASFSQLQSQMQSQGLAVPLKPLVGPSGPQVSTKGSCVDPSRNDPETGDSDRCDLYIEADPDRLVAMGRVYEGSTVVHSTPLLPGQVKVSVEEVTDSDAPVPVPTDEVSLVGQALHTFLAWPTHLLQVFITAAVSPAKPPPKPDPEVDDPLYPMTLTIPELFLRPYQVRWDATVFGVVNPDFPLYIKHKNLSEIAYGGECLSISVLQLSILHLTETCIRVGNSDIYGFLEPRSIQRSRQSQFESESSTAVDTGRWWSSCPRNT

SEQ ID NO: 138291 - protein, 266 aa, Glycine max
  Coding DNA Sequence Number=SeqID_21513
  Gene Ontology: Mol. function=endopeptidase inhibitor activity; Cellular component=vacuole
  Homolog annotation: Hit_ID=Q1RTR7; Match level="QueryCoverage=69%, HitCoverage=84%, E-value=2e-53, Identity=55%"; Hit description =Calcium-binding EF-hand; Kunitz inhibitor ST1-like
  Pfam annotation: Domain name=Kunitz_legume; Domain location=29-216; Score=146.8; E_value=5.6e-41; Accession=PF00197.9; Description =Trypsin and protease inhibitor
MKITLIPLLLLSVLGIKSLLEGAYDSPHQVVDTSGNILRVGANYYIIPNPTTKCSIFSKYKGNNGLVLAKVAANKTFPLDVLVVEGQQLGQPLTFTPIHDQKKGAPVRVSTDLNIEFSMQTSCSQSNVWKIDHFDRATRKWFVTTGGVVGHPSWRTISNWFKIEKYDGDYKLVSCPTFCAYCKVQCRDIGVYEDQNGNKRLALTDAPYKGIVPFAEPEVAPSTARVSTKGSYIDPSGQDLDMTTSDRHGLYIDDNPSCLVLLTRWQ

SEQ ID NO: 138292 - protein, 71 aa, Glycine max
  Coding DNA Sequence Number=SeqID_21514
MGGANSYFQILNWAFQNNFLKLDCFWNCFREENPSQGASVTLPRCFRKQIREGFPPLFTVLHPFFVLQRLK

SEQ ID NO: 138293 - protein, 136 aa, Glycine max
  Coding DNA Sequence Number=SeqID_21515
  Gene Ontology: Mol. function=endopeptidase inhibitor activity
  Homolog annotation: Hit_ID=Q1SMD6; Match level="QueryCoverage=97%, HitCoverage=76%, E-value=2e-30, Identity=50%"; Hit description =Calcium-binding EF-hand; Kunitz inhibitor ST1-like
  Pfam annotation: Domain name=Kunitz_legume; Domain location=8-135; Score=-12.4; E_value=0.00028; Accession=PF00197.9; Description =Trypsin and protease inhibitor
MQTITKCGKYECLNAEGLPLASIGESCPLDVVVVQRSFGLPLSFSPVNPDEGVVIPMSTDLNFIFSIGRTICAEYSPVWKLDHFHAIGYPGWKTIHNCVYLYFKHFCKDVGVFVDENGCRRLALSDVPYKVMFQRA

SEQ ID NO: 138294 - protein, 85 aa, Glycine max
  Coding DNA Sequence Number=SeqID_21516
MMLSYNLRKGRWRLQFNRLRKINDSPVITHPALVSDHPKVKKGHPDAILPRKGPVTRAMSKRLQEDWARAAEEGPRVLMNLRVDF

SEQ ID NO: 138295 - protein, 61 aa, Glycine max
  Coding DNA Sequence Number=SeqID_21517
MGKRWLRWRLPEDPFRVLLKLSEECALEDFRKNWVLSDDLSVLPEALSGRTPSSGKLLVVF

SEQ ID NO: 138296 - protein, 153 aa, Glycine max
  Coding DNA Sequence Number=SeqID_21518
  Gene Ontology: Mol. function=RNA-directed DNA polymerase activity; Biological process=RNA-dependent DNA replication
MVAFIRQYQYNFDMALNRMQLQNICKKEHESFKEYAQKWRDLTAQVAPPVMEREMITMTVDTLPLFYYEKMVGYMPSSFADLVFAGKRIEVGMRRGKFEYPALMNRMTGANEENKKEGGTYVVTAVPTLSNFPPAQQYQYSANISPSHYPPPY

SEQ ID NO: 138297 - protein, 123 aa, Glycine max
  Coding DNA Sequence Number=SeqID_21519
  Gene Ontology: Mol. function=structural constituent of ribosome; Cellular component=ribonucleoprotein complex; Biological process =translation
  Homolog annotation: Hit_ID=Q3ZIZ5; Match level="QueryCoverage=95%, HitCoverage=46%, E-value=5e-39, Identity=64%"; Hit description =Ribosomal protein S2
  Pfam annotation: Domain name=Ribosomal_S2; Domain location=2-119; Score=32.7; E_value=2.2e-09; Accession=PF00318.10; Description =Ribosomal protein S2
MKLSIAKLKELEARETDGGLDRLPKKEAALCKKQKERLEKYLGGVKDMMRLPDVVVIVGQPEEMNAVRECRKLGIRSITVLDTNCDPTVADLFIPANDDSVTSLRFLLQIFSDAILKGQNLVR

SEQ ID NO: 138298 - protein, 631 aa, Glycine max
  Coding DNA Sequence Number=SeqID_21520
  Gene Ontology: Mol. function=DNA-directed RNA polymerase activity; Cellular component=chloroplast; Biological process=transcription, DNA-dependent
  Homolog annotation: Hit_ID=Q20EX1; Match level="QueryCoverage=71%, HitCoverage=31%, E-value=1e-170, Identity=64%"; Hit description=DNA -directed RNA polymerase beta chain
  Pfam annotation: Domain name=RNA_pol_Rpb2_6; Domain location=142-545; Score=559.4; E_value=3.6e-165; Accession=PF00562.18; Description=RNA polymerase Rpb2, domain 6
  Pfam annotation: Domain name=RNA_pol_Rpb2_7; Domain location=547-622; Score=144.0; E_value=4e-40; Accession=PF04560.10; Description=RNA polymerase Rpb2, domain 7
  Pfam module annotation: Pfam domain module=RNA_pol_Rpb2_6::RNA_pol _Rpb2_7; Domain location=142-545::547-622
MFRHGDGEQGSLFWYYLVTNSYSMKLAAKPFQAGLTGLTGLTGAGLTGLTGLTGLTGAGLTGLTGAGRSVGRVQPNDLALQASQASQGQGPTPKGVPLDGFRVSLNKTGPLPPHWPGSDAQGHQARVAFQPLKGKSLSLKGVVDPSAGPTRQCPPNSQADLPSAAFSRDYHLQRYHRSNQETCLTQTSAVSEGDWVQSGDLLADCSASRFGELALGKNILIAYLPWEGYNFEDAVVISERLISDDVYTSIHVQKYDIETRETRFGVEKITRQIPGITDREKEHLDWRGIAKIGSWVKEGDILVGKVSPKSSQPLSPYERLAYDIANVEAATTEDTSLRVPKSVEGRVINCQFFEGPGVTIEKQGPSTGRVRIYLAEKRKLQVGDKVAGRHGNKGIVSTVLPRQDMPYLPDGTIVDMVLNPLGIPSRMNVGQVFECLLGLAGVQLGQQFKITPFDEIYGAEASRSLVYLKLYQARLRTNQDWLFNSRFPGKTPLLDGRTGRLFDQWITVGYAYMLKLVHLVDEKIHARSTGPYSLVTKQPLGGRSKHGGQRLGEMEVWALEGFGAAYTLQEMLTSKSDDVVGREQVVEAILFKGRMSLGNPEAFKVLVRELQSLCLDVGVYVISPGRLQRES

SEQ ID NO: 138299 - protein, 124 aa, Glycine max
  Coding DNA Sequence Number=SeqID_21521
MVYVYRRPALKKELSALAWVEGNQFTGNRIDRIGGRSAKHRTRPCIPMGCTGRRKRSAKRPCLTGLTRLTEAGAHAQRRSVGRGCIASQCTPTPKGVSLNGQASQALVRPMRSLGHHGTLFNDQ

SEQ ID NO: 138300 - protein, 541 aa, Glycine max
  Coding DNA Sequence Number=SeqID_21522
  Homolog annotation: Hit_ID=Q20F10; Match level="QueryCoverage=41%, HitCoverage=91%, E-value=9e-59, Identity=53%"; Hit description =Ribosomal protein S3
  Pfam annotation: Domain name=Ribosomal_L16; Domain location=477-541; Score=8.7; E_value=2.1e-06; Accession=PF00252.8; Description =Ribosomal protein L16
  Pfam annotation: Domain name=Ribosomal_S19; Domain location=83-155; Score=131.5; E_value=2.3e-36; Accession=PF00203.11; Description =Ribosomal protein S19
  Pfam annotation: Domain name=Ribosomal_S3_C; Domain location=346-429; Score=156.9; E_value=5.2e-44; Accession=PF00189.10; Description =Ribosomal protein S3, C-terminal domain
  Pfam annotation: Domain name=Ribosomal_S3_N; Domain location=204-265; Score=101.3; E_value=2.9e-27; Accession=PF00417.9; Description =Ribosomal protein S3, N-terminal domain
  Pfam module annotation: Pfam domain module=Ribosomal_L16::Ribosomal _S19::Ribosomal_S3_C::Ribosomal_S3_N; Domain location=477-541::83 -155::346-429::204-265
TYWPPRPPRPGRQGRSVGRVRRPLHCLQCKDLHPVGMHVQRFAKSTLPKGLFAEQFAVPWEDSNARVKNPCRAEFLHPTLVKRSEEADERHPIREREGEKRVVVTWSRASMIVPIMIGHTIAVHNGREHIPVFITEQMVGHKLGEFSPTRTFRGHVKSDKRSRRVTQARDGPVRLPWNEFENNPNTKEWSTDENNETTFYYILMGQKVHPLGFRLGITQQHRSQWFAKPKQYSFLVVEDHFLRQTISAKFPEAGIVSVGIQRKVDQIRIDICAARPRAIVAFGGQDLDNLRRYLSQSLRGHREDTLGKARAFNPPTPGIAKPMPQIAIYITKLSNPNVSAGFLSDFLVEQLEKRIPFRRAMKSAVQRAQRAQIKGIKIQVAGRLNGAEIARSEWIRKGQVPLQTLRANVDYSYRTASTIYGLLGIKNKDAIACTSARRNALGLALLCNACIPTGCKARSTKRPWAWAPARPTERPWAWAPAPVRPRGRMKGKALRGNKVSFGDFALQALEPCWITSRQIEAGRRAMTRYARRGGKLWSGIL

SEQ ID NO: 138301 - protein, 144 aa, Glycine max
  Coding DNA Sequence Number=SeqID_21523
  Gene Ontology: Mol. function=RNA-directed DNA polymerase activity; Cellular component=intracellular; Biological process=RNA-dependent DNA replication
MALVALFHDMIHREIEVYVDDMIAKSKTEEEHLVNLRKLFERLRKYRLRLNPTKCTFGVKLGKLLGFIVSQKGIEVDPEKDCQEAFGRIKQCLMNPPMMMSPVPRRPLILYMTILDESMGCMLGQHDESGKRECVMLWSGRPTV

SEQ ID NO: 138302 - protein, 181 aa, Glycine max
  Coding DNA Sequence Number=SeqID_21524
VSAYPNTMHPKNSTTWLIHIIKGSIKEDLFDTIREKLFLKAKVGDPILGIISIKIDNPSISPSNQGPNLYERTTKLEDTLTQFMQVSLSNHKSTELAIKKLEDVSNKEGKNKEREEDDEKKDVSKEKSDNVLPIKTKMQLAREARREIIVALVKDIPYPLMPSKKAREHYFARFMDIFKNL

SEQ ID NO: 138303 - protein, 89 aa, Glycine max
  Coding DNA Sequence Number=SeqID_21525
  Homolog annotation: Hit_ID=Q1SM26; Match level="QueryCoverage=70%, HitCoverage=15%, E-value=8e-08, Identity=46%"; Hit description =Nucleic acid-binding, OB-fold
MDLKENCTYVMHNFKVLKNNGQYRVCDHQFKLVFIGVTVIRECVLEDIPFRKYMFAGFADVVAGQFEPGLLVDVIGVVEEVVFRQVSGK

SEQ ID NO: 138304 - protein, 157 aa, Glycine max
  Coding DNA Sequence Number=SeqID_21526
MASRGGNSYFEKSVQLVLKEPMNDMDHADGFSGEPMDGRIEDDALHDLFSAKRKMRFISELELKVQTLQTETTTLSTQFTKLQGTVKTLAAKPWLKKIQQARPLISMVNKVASLSTPMAAPNVDVRNLDLDLALERVSTVGRCRFIAKSPNSKELQK

SEQ ID NO: 138305 - protein, 93 aa, Glycine max
  Coding DNA Sequence Number=SeqID_21527
  Gene Ontology: Mol. function=DNA binding; Cellular component=nucleus; Biological process=regulation of transcription
  Homolog annotation: Hit_ID=Q0PJL5; Match level="QueryCoverage=70%, HitCoverage=21%, E-value=1e-27, Identity=87%"; Hit description=MYB transcription factor MYB57
MNINLEFELPFDVPSRLFLLGLKKYGKEDTNRSTSPHVLSQKQQPNSTPTTPRTHFQWSNQSNIGVAMTLNPAHEKVFISHYSANSFGVKIEG

SEQ ID NO: 138306 - protein, 60 aa, Glycine max
  Coding DNA Sequence Number=SeqID_21528
MSTPRYQQKGKQGKGSQELPRLLAKAKAMADTYSAPKKIHGLLSYCQHMIDLMDHMIRNR

SEQ ID NO: 138307 - protein, 163 aa, Glycine max
  Coding DNA Sequence Number=SeqID_21529
  Gene Ontology: Mol. function=methyltransferase activity; Cellular component=cellulose and pectin-containing cell wall
  Homolog annotation: Hit_ID=Q1S1Q1; Match level="QueryCoverage=76%, HitCoverage=19%, E-value=2e-40, Identity=70%"; Hit description =Generic methyltransferase
  Pfam annotation: Domain name=DUF248; Domain location=1-163; Score= -361.7; E_value=0.00057; Accession=PF03141.7; Description=Putative methyltransferase
MWGNPRRGSVTDARAQRATSSLNESFVPSRAQLANKGITSKLDTCLTTLLEVKDIKEVSGGGALANLPKRLTSIPSRNRSESLEGITTEMFTENTKLWIKKVAYYKKLDHQLAERGRYRNLVDMNAYLGGFAAALLDNLVWVMKIVLVEAEKSTLLVLYMSVD

SEQ ID NO: 138308 - protein, 124 aa, Glycine max
  Coding DNA Sequence Number=SeqID_21530
  Gene Ontology: Mol. function=racemase and epimerase activity, acting on carbohydrates and derivatives; Biological process=carbohydrate metabolic process
  Homolog annotation: Hit_ID=Q9M0B6; Match level="QueryCoverage=74%, HitCoverage=28%, E-value=2e-09, Identity=35%"; Hit description =Nucleotide sugar epimerase-like protein
TSRASKLCQELRVIEVTFDDEDVVLVESDNVVSTHAALTVDLGEGVYLLFPLDLGLGRGGVDTAEINETLEVEIKAEELEGEDFGSDGEAKEGGEDESGREALEEKLGEGVIPNVGGGKVLERI

SEQ ID NO: 138309 - protein, 55 aa, Glycine max
  Coding DNA Sequence Number=SeqID_21531
MDRACLIYELIMKVDMLSCQESNPILYRGDASGTGNDDAAEIGADDDYIILKNKQ

SEQ ID NO: 138310 - protein, 246 aa, Glycine max
  Coding DNA Sequence Number=SeqID_21532
  Gene Ontology: Mol. function=nucleic acid binding
MDAKITLILRHGGRFTPRANDGKVEYIGREFDVWEDISANYMNTFILCDLLQACKKYSRIGDCFWLIDKDLDFNHGLRSCTTNGDILYLMKDALENENEINVYFHHKVYPIPEEVPLMLDLKCHPIPKASNEDDLDDVPVAGHKEGKFLINLYCAKNEHRDYFQIKSFKHEHKCLREIKNKQANREWVVSKLEAKLRIQPSLKCVEVLDYFKQEFGVHIEVTKMWRAMKEAKQLVERSDDKNDQGL

SEQ ID NO: 138311 - protein, 335 aa, Glycine max
  Coding DNA Sequence Number=SeqID_21533
  Gene Ontology: Mol. function=peptidase activity; Biological process =aromatic compound metabolic process
  Homolog annotation: Hit_ID=Q67VK9; Match level="QueryCoverage=67%, HitCoverage=50%, E-value=5e-66, Identity=58%"; Hit description=Cgi67 serine protease-like
MVLFVDGSFRVTLLLPTECNTYADIDAAYKCLKEQYGVEDEQLILYGQSVGSGPTLDLASRIAELRGVILHSPILSGLRVLYPVKRTYWFDIYKNIDKVGAVKCPVLVIHDLQHTILTPRNGHLEHEVYKTKHLWVGTADEVVDVSHGKQLWELCKVKYEPLWVSGGGHCNLELYPEFIKHLKKFVQTIGKSKATANGSKKDTVESDNQGKASKESESGTSVTSELSTEIPEVSRNSLDSRLEKSKKPDKPEKSRMSTDHVDRFRRRKGVLCFALCFNPCLPSFTQVKYGWKEFKAARAADIIYNHQGITWQHNQEMLKSHFVKYKNVPMIYTIS

SEQ ID NO: 138312 - protein, 55 aa, Glycine max
  Coding DNA Sequence Number=SeqID_21534
MQIVEAIGQSQVSTCAAEQATKVHWIAMAMSFGWLTNLEMIEKIMVVVVAIEKVH

SEQ ID NO: 138313 - protein, 97 aa, Glycine max
  Coding DNA Sequence Number=SeqID_21535
MLGAPYPLQLSASDTQCLIHCGDHMTILRRFRAPLQWNVVVLDKGIGDKYVTLLWYKFLQEGDFSNGDELSFYYRHAKKIWEVVIRRAIDRDDSDID

SEQ ID NO: 138314 - protein, 156 aa, Glycine max
  Coding DNA Sequence Number=SeqID_21536
  Homolog annotation: Hit_ID=Q1S3Q9; Match level="QueryCoverage=69%, HitCoverage=21%, E-value=2e-09, Identity=36%"; Hit description =Cyclin-like F-box; F-box protein interaction domain
MESHEDNTSGDFNFFSVSLTFGNSIRAVGGKTEGEGIIHSEIVIISVHLEKETCRSLFHPDDFCFFDTNIGVFRDSLCVWQDSNTHLGLWQMRKFRDDKSWIQLINFSYLHLNIHPYEEKSMILPLCMSNNGDFFMLKFTRNADDEYQTILYNQRD

SEQ ID NO: 138315 - protein, 110 aa, Glycine max
  Coding DNA Sequence Number=SeqID_21537
  Homolog annotation: Hit_ID=Q9SD67; Match level="QueryCoverage=40%, HitCoverage=5%, E-value=2e-11, Identity=75%"; Hit description=FtsH metalloprotease-like protein
INVPSYLLQGIEEKTANLKGSEKALVARHEASNAVVGTAVANLLAGQPHVEKNDNLGLIHSWIVVKFDNHVRNQILNILTVGNCKSMSKLREYPSHRTFLFSRRNPERSQ

SEQ ID NO: 138316 - protein, 130 aa, Glycine max
  Coding DNA Sequence Number=SeqID_21538
  Gene Ontology: Mol. function=protein serine/threonine kinase activity; Biological process=protein amino acid phosphorylation
  Homolog annotation: Hit_ID=Q1T4M8; Match level="QueryCoverage=52%, HitCoverage=10%, E-value=2e-17, Identity=63%"; Hit description =Protein kinase-like
MPELRSRPRRNRLVDNANADEIVSVRGTRARKLKDDQGVKENINKKKVSGRVLEVEGMNEYDSGGRSADKAPEAEDEGTTPPIPEKVQVGGSPLYRVERKLGKGGFGQVYVGRRLGAANSNDGAGAGAVE

SEQ ID NO: 138317 - protein, 101 aa, Glycine max
  Coding DNA Sequence Number=SeqID_21539
MAEESKLQWEGKAGVPGQPGLIRYYCASTVEEGTIMWAKEKLLAVDPVQCCLSYEIVDNNVGFKSNVATLKVLPMNGDGSMIEWGFICDPVEGWSLQDLKL

SEQ ID NO: 138318 - protein, 115 aa, Glycine max
  Coding DNA Sequence Number=SeqID_21540
HLRMSSDSPSLDDKGADDDVSLGVSIGSLASGAEDDVSLCVSTGSLAPGADNHSGIFACHLSSRVRINRNHLCTDNHSGISACHLTSRVRINRNRLCTDNHSDSPSLDDKACRRR

SEQ ID NO: 138319 - protein, 174 aa, Glycine max
  Coding DNA Sequence Number=SeqID_21541
MGTQLPTRSSVQIQWSNLPNTDGLSEVRADLKIYESIIINFFACDDNTVFDLHFTPPLNQQTCGRPILHSRVHAWRTEITQCILGAPQPLEIPSHARKYLKQCENHLTILRKTAPPLQWDVVTLDRDIKDKSIVRPWYKFLRENDFHHEDEVSFYYRPHERIWEIVIRRERKWL

SEQ ID NO: 138320 - protein, 599 aa, Glycine max
  Coding DNA Sequence Number=SeqID_21542
  Gene Ontology: Mol. function=protein serine/threonine kinase activity; Cellular component=integral to membrane; Biological process=protein amino acid phosphorylation
  Homolog annotation: Hit_ID=Q1S8T0; Match level="QueryCoverage=92%, HitCoverage=91%, E-value=1e-151, Identity=48%"; Hit description =Protein kinase
  Pfam annotation: Domain name=Pkinase; Domain location=288-556; Score =125.8; E_value=1.2e-34; Accession=PF00069.15; Description=Protein kinase domain
  Pfam annotation: Domain name=Pkinase_Tyr; Domain location=284-556; Score=79.7; E_value=9.4e-21; Accession=PF07714.7; Description =Protein tyrosine kinase
  Pfam module annotation: Pfam domain module=Pkinase::Pkinase_Tyr; Domain location=288-556::284-556
MLNFLNFSLLLTLLFLLWKPAISKNGCTDKCGRVRIQFPFYLRNNSKLNHTTTAYSSGFDLLCTDADETVLELPSVPIKLFVKSIDYKLQQIQIYDPQNCLPRELIKLGNSSVAPFKFQSFGGNNVSFFRCNSMSSSCPILQLGYDEGDFIDPEIISCTKVSDVFSVQWQVNNYLGNAVVMEWSKPDCSTCEAQGHKCKYKNGTQGETECFICPTNRISTSSVVLIAAGGIVGMILLLVVVKALLHLYDHYMTKGEDRARMEKFLEDYRAMKPTRFTYADIKRITNGFRESLGEGAHGAVFKGMLSREILVAVKILNDTVGDGKDFINEVGTMGKIHHVNVVRLLGFCADGFHRALVYDFFPNGSLQRFLAPPDNKDVFLGWEKLQQIALGVAKGVEYLHLGCDQRIIHFDINPHNILIDDHFVPKITDFGLAKLCPKNQSTVSITAARGTLGYIAPEVFSRNFGNVSYKSDIYSYGMLLLEMVGGRKNTNMSAEESFQVLYPEWIHNLLKSRDVQVTIEDEGDVRIAKKLAIVGLWCIEWNPIDRPSMKTVIQMLEGDGDKLIAPPTPFDKTSSSRTSVVAPTRRQNFELEIINEIEE

SEQ ID NO: 138321 - protein, 95 aa, Glycine max
  Coding DNA Sequence Number=SeqID_21543
MFSFCKKTLASIATPLGLEFIPQVKKLLDEGLVRKSLNPCALLVPKIGIIRHQVPKIGGMMNVLSGATLFCKITRTPNIFMVSREGAQSMKNLGI

SEQ ID NO: 138322 - protein, 223 aa, Glycine max
  Coding DNA Sequence Number=SeqID_21544
  Homolog annotation: Hit_ID=Q41379; Match level="QueryCoverage=23%, HitCoverage=9%, E-value=5e-16, Identity=75%"; Hit description=Lipid transfer protein
MHWMWFIVSDGLKNEWNKWFCDGTALDNEAMTSLRKKWAAYFLQLKNMEVIVIRIMVVLLTVHLTRRKISYRDEVFNESIWHVLLKWGLLYQHGLGRTLEHTRDNLLILHALVASMAYMVYVSLSLASFSLECKRYHHVLNSDKDTNLCLFMPLFDALGNTLNNIHGNHTKGKLHQTWLIPRCGFQYFLPFATEGIKNQIEQAIHRADKIGVKVISLGALNKV

SEQ ID NO: 138323 - protein, 460 aa, Glycine max
  Coding DNA Sequence Number=SeqID_21545
  Gene Ontology: Mol. function=siderophore-iron transporter activity; Cellular component=membrane; Biological process=siderophore transport
  Homolog annotation: Hit_ID=Q09KH7; Match level="QueryCoverage=97%, HitCoverage=63%, E-value=0.0, Identity=77%"; Hit description=FitA
  Pfam annotation: Domain name=Plug; Domain location=47-146; Score =64.4; E_value=3.6e-16; Accession=PF07715.5; Description=TonB -dependent Receptor Plug Domain
MAAENNAAKNTKDVEDTITVVADGRQQNATSGYQPLSSSTATLTSMPLLDIPQVVNTVSDRVLEDQHATSLDEALYNVANVVQTNTLGGTQDAFTRRGFGANRDGSIMTNGLRTVLPRSFNAATERVEVLKGPASTLYGILDPGGLINVVTKRPEHQFSGSVSATSSSFGGGTGSFDVTGPIEGTRLAYRLIGEYQNEDYWRNFGKNKSSFIAPSLSWFGDSATITASYSHRDYSAPFDRGTIFDLDTGHAVNVDRKTRFDEAFNITDGYSDIAQLNAEYRLNSAWTARFDYSYSQDHYNDNQARVMAYDSATGNLTRRVDGTHGSTQKMHSTRADLQGNVVIGGFYNELLTGVAYENYDLLRTDMLRCKNVKGFNIYHPVYGTLDTCNTVSAADSDQRIKQESYATYLQDALYLTDNWIAVAGVRYQYYTQYAGKGRPFNVNTDSRDEKWTPKAGLVYK

SEQ ID NO: 138324 - protein, 116 aa, Glycine max
  Coding DNA Sequence Number=SeqID_21546
  Gene Ontology: Mol. function=protein dimerization activity
  Homolog annotation: Hit_ID=Q1S5E6; Match level="QueryCoverage=86%, HitCoverage=13%, E-value=2e-24, Identity=53%"; Hit description=HAT family dimerisation domain, putative
MKRDVHNSKLAIRNVVRFILYEATRVFSASLNASLHIPFHQLDPIHIALDKTILNLNTILAPTGCDMRQKYDKYWGNVDNINYLMYFGVILDPHYLLELVTWNFAAMYKCDPLKVV

SEQ ID NO: 138325 - protein, 81 aa, Glycine max
  Coding DNA Sequence Number=SeqID_21547
  Gene Ontology: Mol. function=uridine kinase activity; Biological process=biosynthetic process
  Homolog annotation: Hit_ID=Q9LTY6; Match level="QueryCoverage=78%, HitCoverage=16%, E-value=5e-15, Identity=70%"; Hit description =Uridine kinase-like protein
MTSVLLLNSPAVSNDYNHQETLQSKLSLCFSTKSPQGINAVCERFPMIKLVTSEIDASLNEKSHVIPGLGQFGDRYFATDD

SEQ ID NO: 138326 - protein, 55 aa, Glycine max
  Coding DNA Sequence Number=SeqID_21548
AMNTMLDLRQNDGQMENIQLQGMVAKEKKQRLVTMLECDEHDAQMQTGTVSLNGD

SEQ ID NO: 138327 - protein, 199 aa, Glycine max
  Coding DNA Sequence Number=SeqID_21549
  Gene Ontology: Mol. function=uridine kinase activity; Cellular component=cytoplasm; Biological process=biosynthetic process
  Homolog annotation: Hit_ID=Q9LTY6; Match level="QueryCoverage=83%, HitCoverage=35%, E-value=5e-56, Identity=64%"; Hit description =Uridine kinase-like protein
  Pfam annotation: Domain name=PRK; Domain location=39-198; Score=91.0; E_value=3.7e-24; Accession=PF00485.8; Description=Phosphoribulokinase Uridine kinase family
MEMNNFEKEATPLNLNIEDKHTLQSNGFKAPSSPKQPFFIGVAGGTASGKTTVCNMINTQLHDQRVVLITQDSFYHSLSDKMLQKVNEYNFDHPDAFDTKLLLSTLEKLKCGQPVTIPNYDFNSHKRIEAGRQVQPANIIVLEGILVLHDSGVRNLLNMKIFVDEDSDVRLTRRMQRLAIERGRNIENVLDQVSKLTPY

SEQ ID NO: 138328 - protein, 117 aa, Glycine max
  Coding DNA Sequence Number=SeqID_21550
  Gene Ontology: Mol. function=transferase activity, transferring glycosyl groups; Cellular component=cytoplasm; Biological process =nucleoside metabolic process
  Homolog annotation: Hit_ID=Q8VYB2; Match level="QueryCoverage=97%, HitCoverage=24%, E-value=2e-53, Identity=85%"; Hit description =Putative uracil phosphoribosyltransferase
MIVQYSRFVKPSFEDFVLPTKKYADIIIPSGGDNDVAIDLIVQNIRMKLGQHDLCKIYPNIFVICSTFQIKGMHTLIRDVKTTKHDFVFYSDRLIRLVVEHGLGHLPFSEKQVITPT

SEQ ID NO: 138329 - protein, 168 aa, Glycine max
  Coding DNA Sequence Number=SeqID_21551
MASHKRKAPASVSQARYDRSKFTSQNAWDRYADNILGWKIFPEMNVKLFYAEFDEFRREVERRNWHKELTNFSEGSIDVAIVKEFYSNLDGPEDKLPKQVRVRGHLIKFDADTLNTFLKTPVVIEEEESLPAYSRRAASEDLEEESDYSGPDLECSILFKLSPDIPHF

SEQ ID NO: 138330 - protein, 164 aa, Glycine max
  Coding DNA Sequence Number=SeqID_21552
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=74%, HitCoverage=15%, E-value=1e-30, Identity=50%"; Hit description =Leucine-rich receptor-like protein kinase
MQIKFYNNSLSGELPKGMSNLTSLRLIDWRVTAEYCRLANLYELRLFRNKHVWKLLKNLGKNASLKWLDVSTNWFSDWIPGSLSKHDKLEELLMLENEFSGEIPTSLGSYQSLLRVRLGTNRLFVKVLAVGGGALESTRNATIANGERLNDYIEVRDELLMLED

SEQ ID NO: 138331 - protein, 76 aa, Glycine max
  Coding DNA Sequence Number=SeqID_21553
MSFREDHFWKNLLTESFRKTLLPENFRKTLLSKEDFVIPEKIRNTFRKNFIRNVSGRRFFRKITFFFRKEGLLKFF

SEQ ID NO: 138332 - protein, 68 aa, Glycine max
  Coding DNA Sequence Number=SeqID_21554
MRREKSKTRRLTRFPRGSGMGLTRLQPLSQSFWVGEVVERVRDERREKRVEEEVKCLKSSDVEGGRRN

SEQ ID NO: 138333 - protein, 136 aa, Glycine max
  Coding DNA Sequence Number=SeqID_21555
MDQLFTMILAFTSKLQLCLKTKIRNTLQLSDKQFLDEIHYRKPFTDTDGIINLLERTMARTHDVILYYNEKWNMPPQNKFVGCAFTGKNPKKFRIPSTCTIDELKNLIKQVAPKEIPPLGIHESQTVLFDETGERE

SEQ ID NO: 138334 - protein, 198 aa, Glycine max
  Coding DNA Sequence Number=SeqID_21556
MDQLFTMILAFTSKLQLCLKTKIRNTLQLSDKQFLDEIHYRKPFTDTDGIINLLERTMTRTHDVILYYNEKWNMPPQNKFVGCAFTGKNPKKFRIPSTCTIDELKNLIKQVAPKEIPPLGIHESQTVRRLFFCQPARFEYSDMLIKYEINELRTNEELLKVLVQSNYWKKYGPIEILVVFTKYVVKIEDEVTGTSLNN

SEQ ID NO: 138335 - protein, 151 aa, Glycine max
  Coding DNA Sequence Number=SeqID_21557
MAKARGSSESNKRIPEEDVFQKAPGTPLPECFWKNYFFRKHSRRRVLPDDLSVVLEALSGRPLLLECFRKNYFFRKTRGLGRAIGRVVGRDRPGDEDAANVPERRRPTASARRLRVHQMTTEGRDMAKDVADMTDDVPEQAAEAPEMRADA

SEQ ID NO: 138336 - protein, 160 aa, Glycine max
  Coding DNA Sequence Number=SeqID_21558
MGKLMSALGLVRHLRHSLLPKTNSHAWFGRLNSLTWHFPRLNTWGDKFPNSDPDWDLIIASDILLYVKQYANLIQTISFLLNCYKPQERRAVSPTGNDENDGDVVLPRPAFLMSWRRRIGKEDELLFFNGCEKAGLKVKHIGSRVYCINSIENEISETKG

SEQ ID NO: 138337 - protein, 68 aa, Glycine max
  Coding DNA Sequence Number=SeqID_21559
MDIAIFSPSSLFSEDDIPTREEDADSQESYVERKHQFPGMSWCWSSCELCNGAEVVLSHGNAVWFVME

SEQ ID NO: 138338 - protein, 62 aa, Glycine max
  Coding DNA Sequence Number=SeqID_21560
MVKIKHSNHEKHLVLGKRCLVIDYLESQVDIRFGEMDSRITKIEGDITFIKDCFNLPPPPST

SEQ ID NO: 138339 - protein, 78 aa, Glycine max
  Coding DNA Sequence Number=SeqID_21561
MEDAPVSPRVALPLKGEVIGLSAKVRAGRVLQLSLSGPKPCLVNKMIVECNSGPCLACSSRLALFQIEKELGLARAFT

SEQ ID NO: 138340 - protein, 53 aa, Glycine max
  Coding DNA Sequence Number=SeqID_21562
MAAVEFSALAVLYKVCSEIATLRLVPPSRLVRVSGIGLSASLALSLVEGTCCA

SEQ ID NO: 138341 - protein, 64 aa, Glycine max
  Coding DNA Sequence Number=SeqID_21563
MAHNVAQDDASTIASIEGTSETLKEAYDGGVSKIESSPPSCEHKWVVFHVKPSKFKARAQGAAI

SEQ ID NO: 138342 - protein, 77 aa, Glycine max
  Coding DNA Sequence Number=SeqID_21564
MWTVEVTQSMLAAPYPLKLPTSVAPHVDACGQHMTILRRFGSPLQWNVIVLDTGIGDKYIVQPWYQFLANNDFEPWR

SEQ ID NO: 138343 - protein, 52 aa, Glycine max
  Coding DNA Sequence Number=SeqID_21565
MRKKGQSSMMEEVLVGDQEDVGAGKFDGDLGMNNEVKGVVREGKTCTVKEID

SEQ ID NO: 138344 - protein, 83 aa, Glycine max
  Coding DNA Sequence Number=SeqID_21566
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=Q1SSS8; Match level="QueryCoverage=70%, HitCoverage=9%, E-value=4e-19, Identity=86%"; Hit description=GTP -binding signal recognition particle SRP54, G-domain
MPRITGKANLEKSDLEPALKAPKDRLMTKNVAEEIVEKLYELVATSLKGKKLASFTRISSTMHVCSYPYIYASITFILIWFKN

SEQ ID NO: 138345 - protein, 131 aa, Glycine max
  Coding DNA Sequence Number=SeqID_21567
  Gene Ontology: Mol. function=protein dimerization activity
  Homolog annotation: Hit_ID=Q1SYN6; Match level="QueryCoverage=53%, HitCoverage=10%, E-value=3e-14, Identity=52%"; Hit description=Zinc finger, BED-type predicted
MGVFRACVAKVGGITTMVGLHLDAITRWNFTFLMLESALLYHCAFSSLEFEDKSYVNCPTNEEWDREATCNVASSQTSSQGTSSVTTFTSKNSSLQWNIVNEFIQYENESLSGKEDNIIEIGKDDQATSNI

SEQ ID NO: 138346 - protein, 162 aa, Glycine max
  Coding DNA Sequence Number=SeqID_21568
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q9M3V1; Match level="QueryCoverage=61%, HitCoverage=24%, E-value=3e-28, Identity=56%"; Hit description =Protein phpsphatase 2C
MCKERLHEIVKEEVHKAKDNLEWESTTKKCFVGMGEEVLRWSHNKDTPSCRCELQTPHCDIVGSTVVVIIIMPEKIIAANCGNSRAVLCHNNVAVPLSDNHKALQRTLEFEGELAEKFEGGTQNREIGNEIEEIVKGNNSNEYKLQPMKPLCIIIYLSSPST

SEQ ID NO: 138347 - protein, 90 aa, Glycine max
  Coding DNA Sequence Number=SeqID_21569
MIQRFARAAKTLMCERKGGVSATRERTMHEHDGGTTRFGGVARPHRWTGVGATREWTMYKHECMTARECHGGATSVGQKRFGGVTRGIRV

SEQ ID NO: 138348 - protein, 199 aa, Glycine max
  Coding DNA Sequence Number=SeqID_21570
  Subcellular localization annotation: CTP_CleavageSite=15; ConfidenceScore=5.25e-01
MSLLAASNLACWLVVFRHVSSRRSYPPSVNNSLKASKLLINQPVVEIQEFNQSLPELGIEVWLSELGIEVRSVLTPHGQGSSQLSSSSQLSSKDVFLSKAEAKSISEINNISEEIVCVTIGTITKIVMDNHSWYRLEVMVNQKDESTKFLLWDSECTELIGQSVDEVNRLKIADGDVDLNASPEALDKLLGYVLAFKVK

SEQ ID NO: 138349 - protein, 83 aa, Glycine max
  Coding DNA Sequence Number=SeqID_21571
MADALGNENFLRDAMIGAFTTFNFFLWVLQRRSGACKNISTIARKNTGVDYIDDQRLSAYQWRRRNCEDMLNASKEMTFIPSL

SEQ ID NO: 138350 - protein, 55 aa, Glycine max
  Coding DNA Sequence Number=SeqID_21572
MKSEVVLVQDRTISNIEEEHITRASLSRLTPNHSSAPPWSIPPEISFFDNKNGYM

SEQ ID NO: 138351 - protein, 291 aa, Glycine max
  Coding DNA Sequence Number=SeqID_21573
  Gene Ontology: Mol. function=nucleic acid binding; Biological process= defense response
MATNVKTFMPKIDNAREFMKLVKDYSKSDITNKSIMENLSSELTNKKYDWSQSIHDHVTEMTNLATKLNVMGMEEEGRLKKMKDKSIHLMTHDGANIGQSKPRSGHFKKDWPKRMKWFEKKEVNVYNSHKKKFDARTIIGFFISGSEKSRKLNIVETRGESSSPIVFHEDVPSVVLRSNNTQRQCNNVNNPQDEHIGNEPVDNVQVTNEQVIEKAQETTPRRSKRKKRPAISSDYVVHSLEHECELSINDYPISFRQAMESGYSKKWLNVMKEELKSMDDNKVWDLVELLK

SEQ ID NO: 138352 - protein, 115 aa, Glycine max
  Coding DNA Sequence Number=SeqID_21574
  Gene Ontology: Mol. function=L-ascorbate peroxidase activity; Cellular component=mitochondrion; Biological process=hydrogen peroxide catabolic process
  Homolog annotation: Hit_ID=P48534; Match level="QueryCoverage=91%, HitCoverage=44%, E-value=5e-22, Identity=54%"; Hit description=L -ascorbate peroxidase, cytosolic
MDLWKAVEKAKKLRGFIAEKRSLLFTIEFMDYRFDAFWCVSCADGTLLEPLTRAQTLVDPSDIAIRLLEPLKAEFPILSYADFYPLAGVVAVEVTGGPEVPFHPGRESFTGLSTR

SEQ ID NO: 138353 - protein, 137 aa, Glycine max
  Coding DNA Sequence Number=SeqID_21575
MWVFLTGRQIDWAHLMRYRMHKASRSNAPLPYPHLITLFLQHFNVPLDSEPFVKVKRSFSIGANVVSSFGYRKERDGSWVKKDAPVQAAGDRSPSPHSQRDDSSSLMHNILDRLDGLHTFVGECFDSLDSRIDAMDA

SEQ ID NO: 138354 - protein, 38 aa, Glycine max
  Coding DNA Sequence Number=SeqID_21576
MALSVTPRWRTHPPHCVSVNCSQTPSSTCKRCFLVMEG

SEQ ID NO: 138355 - protein, 197 aa, Glycine max
  Coding DNA Sequence Number=SeqID_21577
  Gene Ontology: Mol. function=hydrolase activity, acting on ester bonds; Biological process=lipid metabolic process
  Homolog annotation: Hit_ID=Q9AYM5; Match level="QueryCoverage=86%, HitCoverage=95%, E-value=5e-59, Identity=50%"; Hit description =CPRD49 protein
  Pfam annotation: Domain name=Lipase_GDSL; Domain location=9-129; Score=30.9; E_value=4.5e-06; Accession=PF00657.12; Description=GDSL -like LipaseAcylhydrolase
MVGPVRPQFVLFGSSIVEFSYSDEGWGAILANLYARKDATDQPSLIIVYFGGNDSMHPHPSGLSPHVPLQEYIENMKKIAIHLKLCHEMNVKAIDLWSALRQRHDWLDVCFTDGIHLSNEGSKIVAKEILKVLREADWEPSLDWKSMPVEFAEDSPYEPIGADENTHIDVSNWNNIQGKSQLEMSNCALTKGFSSVD

SEQ ID NO: 138356 - protein, 164 aa, Glycine max
  Coding DNA Sequence Number=SeqID_21578
  Gene Ontology: Mol. function=pyridoxal phosphate binding; Cellular component=integral to membrane; Biological process=transport
  Homolog annotation: Hit_ID=Q1EPF9; Match level="QueryCoverage=50%, HitCoverage=16%, E-value=4e-24, Identity=65%"; Hit description=Gamma- aminobutyrate transaminase, putative
  Pfam annotation: Domain name=ABC_tran; Domain location=56-164; Score=- 36.2; E_value=0.00028; Accession=PF00005.17; Description=ABC transporter
MEASLAKDTSPNDVKNGQGFKGHSMLAPFTAGWQTTDLHPLVIEKSEGSYVYDINGKKYLDALAGLWATSLVDNIQFFVSMYTVDIIGHAGGHDLTEIGERGVNISGGQKQRVSMARAVYSNSHVYIFDDPLGALDAHVARQVTFMPTNFSIASVISILALNEI

SEQ ID NO: 138357 - protein, 158 aa, Glycine max
  Coding DNA Sequence Number=SeqID_21579
  Gene Ontology: Mol. function=oxidoreductase activity, acting on NADH or NADPH; Cellular component=chloroplast; Biological process =electron transport
  Homolog annotation: Hit_ID=Q06FP8; Match level="QueryCoverage=99%, HitCoverage=43%, E-value=3e-67, Identity=74%"; Hit description=NADH -plastoquinone oxidoreductase subunit 7
  Pfam annotation: Domain name=Complex1_49kDa; Domain location=1-158; Score=89.5; E_value=1e-23; Accession=PF00346.9; Description =Respiratory-chain NADH dehydrogenase,
MLRAARIQWDLRKVDNYECYEELIGKSMAKRRRSLARYLVRIGFGRNPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 138358 - protein, 252 aa, Glycine max
  Coding DNA Sequence Number=SeqID_21580
MSSFRDLEQKWAPKVEALLGNNGGGRKEEEGCDVTVRMKGKACGNQMHLLFRIRNVRQGTDSSNKELEGVFGIHDKASVTMLVLAPFLYRRGDSEKVPNIGGSSKYLRAERRPVKGIFCHRPAQRCRDGRVPVNKLMIKFGEALEDYGMGDNWIAWTFTKTGSTPLTETKWPRYSTCDLSTTSIQPRLQFHVSENAGKDMGEHLQAQSWEEDEYGDWVVWVERSYVGIMQIWKNSLAPALWTRRRSYGGVMK

SEQ ID NO: 138359 - protein, 46 aa, Glycine max
  Coding DNA Sequence Number=SeqID_21581
EVVLNCDGVVAEGGTKSVCGGALRDHAVLIAELTAILIGLRMAWHK

SEQ ID NO: 138360 - protein, 424 aa, Glycine max
  Coding DNA Sequence Number=SeqID_21582
  Gene Ontology: Mol. function=solute:hydrogen antiporter activity; Cellular component=integral to membrane; Biological process =regulation of pH
  Homolog annotation: Hit_ID=Q1S3D8; Match level="QueryCoverage=94%, HitCoverage=49%, E-value=2e-50, Identity=31%"; Hit description=WD-40 repeat
  Pfam annotation: Domain name=Na_H_Exchanger; Domain location=32-421; Score=22.8; E_value=0.00014; Accession=PF00999.11; Description =Sodiumhydrogen exchanger family
MDLPPRVNSEMSWSTTKGILPENALPMLQMQMCLIFLATFFLHTFLGRLGVPRFTSMSVVGLIFATTFSEKWAQKCRDLFIFDSQANLGLLSVFGYMLFLFYTGVKTDMSVVHRSRRNATNIGSIAIMAPFLCSMAVVHFHSIKYLDIGQATKLGVISGLFSMTPFSTICTVLSDLKILNSELGRLAQSSTLVTEVFNLFLITILTFSKIVFQEPSRAWFSLAAAVFFVLLVVFIIRPAMFWIIKQTPEGSPVSDHYVYCILILVLLSSYATHRIGFFALFGPCVLGLATPEGPPLGTAITKKIDTFVNWVLVPAFVTTCAMRVDLRDFMNWTEKVNGGVDEFMVQTLIIIVVTSVVKVVACTLPPLYSNMPLNDSVSLALIMNCKGVVEMAGYSMVRDVMVSILFHSSHKSNAHSILGHKSSI

SEQ ID NO: 138361 - protein, 130 aa, Glycine max
  Coding DNA Sequence Number=SeqID_21583
  Gene Ontology: Mol. function=oxidoreductase activity; Biological process=metabolic process
  Homolog annotation: Hit_ID=Q1RST5; Match level="QueryCoverage=61%, HitCoverage=17%, E-value=6e-28, Identity=89%"; Hit description=Nadp -dependent glyceraldehyde-3-phosphate dehydrogenase
MGQDSTVEKSRVASQGRCNTEGAQSALFRRLQSQLRMLSLKSGDLVSYCAEEGVGILGEGEFLISDSFRGNERTKYCLTSKDYPNLMMQAPLELVGLGSSSSMDSFASSKINGSGMEKEEREETPLQGED

SEQ ID NO: 138362 - protein, 168 aa, Glycine max
  Coding DNA Sequence Number=SeqID_21584
  Gene Ontology: Mol. function=oxidoreductase activity; Cellular component=cytoplasm; Biological process=metabolic process
  Homolog annotation: Hit_ID=Q1RST5; Match level="QueryCoverage=95%, HitCoverage=43%, E-value=4e-55, Identity=54%"; Hit description=Nadp -dependent glyceraldehyde-3-phosphate dehydrogenase
  Pfam annotation: Domain name=Aldedh; Domain location=2-168; Score= -228.1; E_value=6.7e-06; Accession=PF00171.12; Description=Aldehyde dehydrogenase family
MWQWGVIPLGVVLAIPPFNYPVNLAVSKVAPALIAGNSIVLKPPTQGSAAALHMVHCFHLVGFPEGLISCVTGKGSEIGDFLTMHRGICGQRCTTIKVALVMESVANTLVMKINDRIAKLTVGLPKIDTDVTPVVTKSSANFIKGLVMDAKEKGATLCQEYIWEGNLI

SEQ ID NO: 138363 - protein, 155 aa, Glycine max
  Coding DNA Sequence Number=SeqID_21585
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q9BBS4; Match level="QueryCoverage=83%, HitCoverage=70%, E-value=4e-48, Identity=76%"; Hit description=ATP synthase B chain
  Pfam annotation: Domain name=ATP-synt_B; Domain location=9-127; Score= 28.7; E_value=2.1e-05; Accession=PF00430.9; Description=ATP synthase BB' CF(0)
MKHLDTRLELEDITNRIMVLRCVDNRKQKILRTIRNSEELREGAIEQLEKAQARLRKVETEADRFRVNGYSEIEREKLNLINSIYTTLEQLENYKNEAIHFEQQRVINQVQQRVLQQALQGALGTLKSCLNNELHLRTVSANIGMFGTMKEKITD

SEQ ID NO: 138364 - protein, 230 aa, Glycine max
  Coding DNA Sequence Number=SeqID_21586
  Homolog annotation: Hit_ID=P49161; Match level="QueryCoverage=27%, HitCoverage=19%, E-value=1e-28, Identity=98%"; Hit description =Apocytochrome f precursor
MDKDKVQAVIDWPVPQNPKQLSASWDLLAIAMAPVLALPNFAKPFILETDASGNGIGAVLRKENIPIDALSRSFFMTWSATDSRPVIQPVSILQTRTIIRGNQQAFPDFNLEDKVNFDGGGIVTSASSKDKDEGAKEENNLAQNELVTCLGRWAPNKRKNTRVKRYWGYENPREATGRIVCANCHLANKPVDIEVPQAVLPDTVFEAVVRIPYDMQVKQVLANDKKGALN

SEQ ID NO: 138365 - protein, 974 aa, Glycine max
  Coding DNA Sequence Number=SeqID_21587
  Gene Ontology: Mol. function=protein serine/threonine kinase activity; Cellular component=integral to membrane; Biological process=protein amino acid phosphorylation
  Homolog annotation: Hit_ID=UPI0000048393; Match level="QueryCoverage =99%, HitCoverage=94%, E-value=0.0, Identity=55%"; Hit description =kinase
  Pfam annotation: Domain name=LRR_1; Domain location=112-134; Score =9.6; E_value=4.5; Accession=PF00560.23; Description=Leucine Rich Repeat
  Pfam annotation: Domain name=LRR_1; Domain location=136-158; Score =18.3; E_value=0.028; Accession=PF00560.23; Description=Leucine Rich Repeat
  Pfam annotation: Domain name=LRR_1; Domain location=160-182; Score =9.9; E_value=4.1; Accession=PF00560.23; Description=Leucine Rich Repeat
  Pfam annotation: Domain name=LRR_1; Domain location=184-205; Score =7.7; E_value=11; Accession=PF00560.23; Description=Leucine Rich Repeat
  Pfam annotation: Domain name=LRR_1; Domain location=208-230; Score =7.6; E_value=11; Accession=PF00560.23; Description=Leucine Rich Repeat
  Pfam annotation: Domain name=LRR_1; Domain location=256-278; Score =4.5; E_value=41; Accession=PF00560.23; Description=Leucine Rich Repeat
  Pfam annotation: Domain name=LRR_1; Domain location=280-302; Score =20.5; E_value=0.0062; Accession=PF00560.23; Description=Leucine Rich Repeat
  Pfam annotation: Domain name=LRR_1; Domain location=304-327; Score =12.3; E_value=1.4; Accession=PF00560.23; Description=Leucine Rich Repeat
  Pfam annotation: Domain name=LRR_1; Domain location=64-86; Score=4.9; E_value=34; Accession=PF00560.23; Description=Leucine Rich Repeat
  Pfam annotation: Domain name=LRR_1; Domain location=88-110; Score =16.8; E_value=0.078; Accession=PF00560.23; Description=Leucine Rich Repeat
  Pfam annotation: Domain name=Pkinase; Domain location=635-902; Score =147.2; E_value=4.5e-41; Accession=PF00069.15; Description=Protein kinase domain
  Pfam annotation: Domain name=Pkinase_Tyr; Domain location=635-906; Score=126.1; E_value=9.6e-35; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=112-134::136-158::160-182::184-205::208-230::256 -278::280-302::...
  Pfam module annotation: Domain location=304-327::64-86::88-110::635 -902::635-906
MDAAWVKLLQAISDKVENLNWKVTQRSCNGDRGFDNRNISRDNKSQIIRNVTCDCSFNNNTTCHVTAIALKGLNISGPIPDEFGNLTRLEILDLTWNNFNGSIPKSLGRLSSVVNLSLLGNRLTGSIPSEIGDMASLQELNLEDNQLEGPLPQSLGKMSNLLRLLLSANNFTGIIPDTYGNLKNLTQFRIDGSSLSGKIPSFIGNWTKLDRLDLQGTSLDGPIPSVISYLTNLTELRISDLKGPTMTFPNLKNLKLLLRLELRNCLITGPIPNYIGEIKSLKTIDLSSNMLTGSIPDSFQDLGNLNYLFLTNNSLSGPIPDWILSINQQIDLSLNNFTKTSANNCQRPDLNLASSLSRTASTSILCLKMGQPCSGKPLFHSLFINCGGPETKFEGNEYEADLSPFGISNYVPGNSGKWAYSSTGVYLGNAKADYIATNQLSLDINGPDYYHTARIAPLYLNYYGLCMLNGNYKVKLHFAEIAFSDDQSYCNHGKRVFDVSIQGFKYLKDFNIAKEAGGVGKGITREFNVNVTESTLEIHLSWAGKGTNAIPIIGVYGPLISAITVTPNFKVYAHGFSTGTIVGIVAGACVIVILMLFALWKMGFLCQKDQTDQELLGLKTGYFSLRQIKAATNNFDPANKIGEGGFGPVFKGVLSDGAVIAVKQLSSKSKQGNREFINEIGMISALQHPNLVKLYGCCIEGNQLLLVYQYMENNSLARALFGKEHERMQLDWPRRMQICLGIAKGLAYLHEESRLKIVHRDIKATNVLLDKHLHAKISDFGLAKLDEEENTHISTRIAGTIGYMAPEYAMRGYLTDKADVYSFGIVALEIVSGKSNTNYRPKEEFVYLLDWAYVLQEQGNLLELVDPSLGSKYSSEEAMRMLLLALLCTNPSPTLRPCMSSVVSMLEGKTPIQAPIIKRGDSAEDVRFKAFEMLSQDSQTHVSSAFSEESIEQRSKSMGGPWLDSSISLPSRID

SEQ ID NO: 138366 - protein, 101 aa, Glycine max
  Coding DNA Sequence Number=SeqID_21588
MAKDTKERMTETYINVLCVAPPLMMANLSDLSNPCLNPDLKLEAVMEVAREEELQGLIEGRAIVGQSNDEVAVNDGMCEVGAVVEDLAVVGDLDWELERKE

SEQ ID NO: 138367 - protein, 222 aa, Glycine max
  Coding DNA Sequence Number=SeqID_21589
  Gene Ontology: Mol. function=RNA-directed DNA polymerase activity; Biological process=RNA-dependent DNA replication
  Pfam annotation: Domain name=AT_hook; Domain location=119-131; Score =14.9; E_value=0.061; Accession=PF02178.9; Description=AT hook motif
MKWRKASGVLCDAKVPIKLKGKFYRTAVRPAILYGTECWAVKSQHENKVGVAEMRMLRWMCGKTRQDKIRNEAIRERVGVAPIVEKMVENRLRWFGHVERRPVDSVVRRVYQMERRQTIRGRGRPKKTIREVIKKDLELNDLDRSMGCVFTRDINKAMLISDATETGTIQINSAPARGPDHFPFHGLKDSGIGSQGITNSINMMTKVKTTVINLPAPSYTMG

SEQ ID NO: 138368 - protein, 94 aa, Glycine max
  Coding DNA Sequence Number=SeqID_21590
MLPLSFIFVFLSSPPKALSFSRRPPNLSQKNDDLGCIHRWIVVQFKHQIIFLEREKESHKESSYEGFNPFSISLTFENSIGVVGGKIGGISGNR

SEQ ID NO: 138369 - protein, 536 aa, Glycine max
  Coding DNA Sequence Number=SeqID_21591
  Gene Ontology: Mol. function=zinc ion binding; Cellular component =membrane fraction; Biological process=vesicle-mediated transport
  Homolog annotation: Hit_ID=Q08ET6; Match level="QueryCoverage=79%, HitCoverage=84%, E-value=1e-175, Identity=70%"; Hit description=RING- finger protein
  Pfam annotation: Domain name=Copine; Domain location=173-331; Score =283.2; E_value=4.9e-82; Accession=PF07002.6; Description=Copine
  Pfam annotation: Domain name=zf-C3HC4; Domain location=493-525; Score= 12.1; E_value=0.0088; Accession=PF00097.15; Description=Zinc finger, C3HC4 type (RING finger)
  Pfam module annotation: Pfam domain module=Copine::zf-C3HC4; Domain location=173-331::493-525
  Subcellular localization annotation: CTP_CleavageSite=50; ConfidenceScore=5.27e-01
MAAVTGVFGSTFQIPQTWFFASAKKLRIELMGGNNSKEDNNNWRQNSSVRSSSSASSWGSYPDPQSGYGHGGYAYEPQQPSYPTQQPYYAQPPPPPPNYGNEPQPHASGRVAGHRNEKRLDRKYSRITDNYNSIDEVTEALARAGLESSNLILGIDFTKSNEWTGKHSFNRKSLHHIGNGPNPYEQAISIIGKTLAAFDEDNLIPCFGFGDASTHDQDVFSFYPDERICNGFEEVLSRYREIVPIIRLAELILTDGFIPGPTSFAPIVEMAMTIVEQTGGQYHVLVIVADGQVTRSIDTEHGRLSPQEQSTVDAIVEASKFPLSIILVGVGDGPWDMMKEFDDNIPARVFDNFQFVNFTEIMSKNIPPSRKEAAFALAALMEIPSQYKATIELNLLGGRNANAPQRVALPTPSYGSASMGISKPYGSASFGASKPYGSASFDAPKPYGSASFSSSKPSHAASFEQSAPSYYDNTDPVGTAPPAPSSSYDNQLCPICLTNSKDMAFGCGHQTCCECGQDLQSCPICRSPINTRIKLY

SEQ ID NO: 138370 - protein, 99 aa, Glycine max
  Coding DNA Sequence Number=SeqID_21592
MYPHYFKLNNIIASNSNHSPTHLLLDANCRDLTRNNFALRAHGYWNQLLSTRVGRVKGDKKLREANDEASTIQYEKETTSTICLLNKRSIGDKWPRFID

SEQ ID NO: 138371 - protein, 75 aa, Glycine max
  Coding DNA Sequence Number=SeqID_21593
  Gene Ontology: Mol. function=RNA-directed DNA polymerase activity; Biological process=RNA-dependent DNA replication
  Subcellular localization annotation: CTP_CleavageSite=42; ConfidenceScore=5.05e-01
MVSQGSIKLFFDGIMFSFASRPCKFVPIHWKIMKAVVRNSISKSMKEPIWVIFATNFFITRQEIVKISKYAPGEG

SEQ ID NO: 138372 - protein, 112 aa, Glycine max
  Coding DNA Sequence Number=SeqID_21594
AAVIWYTNLEASRIRSWTDLITTFIRKYQYNTDMTPDRTQLQNMSKREQESFKEIEVGLKRGKFDYVAPADTSNRRFEASRAKKKEGDIHAVTSAPTWPKPQQTPHNTYQYA

SEQ ID NO: 138373 - protein, 94 aa, Glycine max
  Coding DNA Sequence Number=SeqID_21595
MVASLCMTLGWERIRKFFTGKSFPDWCLCLDWSCRWGEVPFAGWALDWKGFRRGPKSLVDVRHIGAEVTAWMSPSFFFALLASNLLLLVSAGAT

SEQ ID NO: 138374 - protein, 66 aa, Glycine max
  Coding DNA Sequence Number=SeqID_21596
MTKLSVAQSEELRIDIEFQQQGNLGVAMNMTQTLEHKPRGLPPTFKRRYATFTHTNKPTRISMPTF

SEQ ID NO: 138375 - protein, 151 aa, Glycine max
  Coding DNA Sequence Number=SeqID_21597
MRAHVVKIVRRGAWNPKCTTLVAREHPPGLLDDSLEVPGLFAIGQLGEQVCFGVALPGACSRMTLSGTSRIILASLPFMLDAPSTYRLNRVELTASSTIERYRRRGTPGLGPLRTGVVAMVILKACSQNAFAFFVSLGRNLDRDASLPFSF

SEQ ID NO: 138376 - protein, 115 aa, Glycine max
  Coding DNA Sequence Number=SeqID_21598
  Gene Ontology: Mol. function=RNA-directed DNA polymerase activity; Cellular component=mitochondrion; Biological process=RNA-dependent DNA replication
  Pfam annotation: Domain name=rve; Domain location=22-115; Score=-2.3; E_value=0.0092; Accession=PF00665.16; Description=Integrase core domain
MKQYQEFTNIPRTPPDNLHNMSSHWPFDMWEMNILGPLPKASGVVKCILVVIDYFTKWIKARPFTWKHLICNYGLPYAIVTDNDTEFKAQAYEDFLTRLGVKHLVTSIEHPQTNG

SEQ ID NO: 138377 - protein, 642 aa, Glycine max
  Coding DNA Sequence Number=SeqID_21599
MVRAFEDHFFKVLTTDIVANGLSLMFNQDREPRFPFFWQFDHTRLTSFDEDLLTLVERVNKAILEQLSALLDARTIFSLPSMDDPFVALDGWTCWWGCAPYAAIPPIGEGGQPVVGVTEVSPGVASSVLAKRSEMMALRCHAASRLTLDSGILSSLQDLPPAPSIFMASTPAIVVVVAPTVEVSALAASAGSVMSPSSTVAPPLLSAGVVTMSALVMPPPPSSASPVPPSAVLVSVSTSTSSHPRVSLDHIYTSSGLPPMKFGNLGREWAKALRGAKVNACTVWRTEHPKVVNAIVTFNEAVKSNQQLSSKVGSALAKVENTAAKKDELAKVVVDLEVRLKESESRLEESMLWVSKEREVNKELEEELLMYKKEAMEQHEKDFHKAISVLLDEEDIVAEEEAGEEQEVEEQGNDANFPRGELTKGMPWVFIGVRTNGAPWAFVPRADLGFLYQGRTLGSPRADLGIKELWTRDAFILGFGEAHQRWTLDSPRENLGFDEPLEKKDSPRANLRADNGFDEPMEKSHTHQGQTFDLTSLWRSETHQGWIFDLRAFGEARLTKGGPWVWQVFGEGDSPRAYLGFEEPLEKRDSPRVDFGFDEPLEKRDSARVDLGFDEPLEKQDSPKADLGFDESVELGPGMRLS

SEQ ID NO: 138378 - protein, 134 aa, Glycine max
  Coding DNA Sequence Number=SeqID_21600
  Gene Ontology: Mol. function=ribonuclease H activity; Biological process=DNA integration
  Homolog annotation: Hit_ID=Q1S8I9; Match level="QueryCoverage=74%, HitCoverage=20%, E-value=1e-34, Identity=69%"; Hit description =Probable integrase-common tobacco
MTVSYKDWHEMLPFALRGYRTSVRTSTRATPYSLVYGMEAVLPFEVEVPSQKILAESSLEESEWAQTRYDQFNLIEGKHLTAMSHGRLYQQRIKNAFDKKGQTQIEARVTTDRSSSFPCSGQAENAAARQPSIL

SEQ ID NO: 138379 - protein, 84 aa, Glycine max
  Coding DNA Sequence Number=SeqID_21601
  Gene Ontology: Mol. function=phosphotransferase activity, alcohol group as acceptor; Biological process=protein amino acid phosphorylation
  Homolog annotation: Hit_ID=Q9ZPE1; Match level="QueryCoverage=73%, HitCoverage=4%, E-value=5e-14, Identity=81%"; Hit description =Phosphatidylinositol 4-kinase
MASLNSIKSRYPNISSLCEFFIAKYQENSPSFKLAQVLLSGMYYKELRSKCGWIFPGLLPFAGDTALASPFDKYVKRNLERGDI

SEQ ID NO: 138380 - protein, 92 aa, Glycine max
  Coding DNA Sequence Number=SeqID_21602
  Homolog annotation: Hit_ID=Q1RZ48; Match level="QueryCoverage=48%, HitCoverage=14%, E-value=2e-07, Identity=76%"; Hit description=TRNA isopentenyltransferase
MALVFFLAIFFKERQQRYVEQRVDCMMHEGLLNEDYDIYNLNAVYTRDGLHKHFHLNFIGGSKALEIVVQQTKSSRVAIPVSRQKGETTRES

SEQ ID NO: 138381 - protein, 70 aa, Glycine max
  Coding DNA Sequence Number=SeqID_21603
AAPSKPKEDKGKTIEKPTLKTSSQARTSNIKCFKCLGKVEVKMKQRGEEYSEEVYPHEEDGLLMVRKAPR

SEQ ID NO: 138382 - protein, 163 aa, Glycine max
  Coding DNA Sequence Number=SeqID_21604
MVRTRGLRWALGRVLGRALGRQIVDDEKKAPQRQRPTTSTCRQQATVAVVEYVEHVDHVAGDVHEELQEPVTDHVGANTEDFPGGSHDTSVLALYANHVAARVWAREKRTELKLASHKRKVEKFGTPTPKIKGIVAAIGLSSLITCSLEKGTIYEKYQITGIG

SEQ ID NO: 138383 - protein, 439 aa, Glycine max
  Coding DNA Sequence Number=SeqID_21605
  Gene Ontology: Mol. function=ubiquitin thiolesterase activity; Cellular component=intracellular; Biological process=ubiquitin -dependent protein catabolic process
  Homolog annotation: Hit_ID=Q1RSU1; Match level="QueryCoverage=99%, HitCoverage=66%, E-value=0.0, Identity=79%"; Hit description =Peptidase C19, ubiquitin carboxyl-terminal hydrolase 2; Zinc finger, UBP-type
  Pfam annotation: Domain name=UCH; Domain location=177-438; Score =25.8; E_value=4.5e-08; Accession=PF00443.19; Description=Ubiquitin carboxyl-terminal hydrolase
  Pfam annotation: Domain name=zf-UBP; Domain location=59-125; Score =10.2; E_value=0.0085; Accession=PF02148.9; Description=Zn-finger in ubiquitin-hydrolases and other protein
  Pfam module annotation: Pfam domain module=UCH::zf-UBP; Domain location=177-438::59-125
MLPRNPSYTNPEPCQHLAEYKLKHGFNGYKAIQKLLVTSPIGKTSVKKPNTKVPRCGFCNGCEGRFYLCLICSSFSCLDHTLLHPQSESGHAVFVDIERTELYCGVCRDQLYDPDFDQVVMSKHSMGVAGGATGNESIGQRLIKRRRLVSGIVGLDLQKSKCRVSTKDLRGKSCYPLGLRGLNNLGSTCYMNSVLQVLLHAPPFRDYFLSGGQRLEACHHRRATDLMCCLLCDVNAIFSAVYSGDRSPYSPAQFLYSWWQHSANLACYEQQDAHEFFISMLDAIHEKEGKTRNGSKGNGDCQCIAHKVFYGLLRSDVTCMACGFTSTTYDPCVDISLNLDTDVSSTEKGKKLTKQNEDGSMSTLSGCLDLFTRPEKLGSDQKLYCQNCRERQDSLKQMSIRKLPLVLSLHKNRSLPTLPIFLRHDSISVLLNPQSQIWE

SEQ ID NO: 138384 - protein, 96 aa, Glycine max
  Coding DNA Sequence Number=SeqID_21606
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=57%, HitCoverage=29%, E-value=6e-19, Identity=80%"; Hit description =Anaphase-promoting complex subunit 10
  Pfam annotation: Domain name=APC10; Domain location=11-96; Score= -75.8; E_value=0.0082; Accession=PF03256.7; Description=Anaphase -promoting complex, subunit 10 (APC10)
MELLNIGFIKTDVNYLIKPYTALGTVVGAQSSKLSTLPVNKLIMLCVVFKLDESYTPSKVSIRVGDGFHNLKEIKTVELVKPTGWVYLSLFGADPR

SEQ ID NO: 138385 - protein, 91 aa, Glycine max
  Coding DNA Sequence Number=SeqID_21607
  Homolog annotation: Hit_ID=Q84TU4; Match level="QueryCoverage=60%, HitCoverage=7%, E-value=6e-10, Identity=53%"; Hit description=Arm repeat-containing protein
  Pfam annotation: Domain name=U-box; Domain location=4-62; Score=11.7; E_value=2.7e-05; Accession=PF04564.6; Description=U-box domain
MAECPVVKNGQTYERQSIQKWLDHGLNVCPKTHQRLTLTNVIPNYTVKSHVIRLIEDLHRWNLEMSSMLEGSIQIMSKAETGTTMFLVWVS

SEQ ID NO: 138386 - protein, 96 aa, Glycine max
  Coding DNA Sequence Number=SeqID_21608
LVVALPLVAATTVVARHHGASVLPQSLNDASRSHHPLHGGSHPAMYDVYFVQERTKEEEGFLEKGLVFWGREEFLNRRRMKNGFCVLGEKGGGGHK

SEQ ID NO: 138387 - protein, 557 aa, Glycine max
  Coding DNA Sequence Number=SeqID_21609
  Gene Ontology: Mol. function=RNA-directed DNA polymerase activity; Biological process=RNA-dependent DNA replication
  Subcellular localization annotation: CTP_CleavageSite=29; ConfidenceScore=5.22e-01
FLLSCVHCLGLGPSYSLMSSSIGFGPLSEVSSYGSTSNNHPSLLGRRPVLKLETLCPRSLLEYCHPLWGEAWQAPWWEDKVGNFILRCGVKTMIPSSLSVFLPMKAKKEVDIASSLYYFSCEANEWIGVSLDDVSGATLVDEDLGHHEVSHYDGDNDKVVLVDRVDTFEVSIIDVDVPDGMEVTLMGLAGLPFVRESPCNGVDYTSDLLGGLVFPFLRRLSLTSLMVVSLSSLIFCFVSSFSAIAVFMVILLVSFGSHSYCMTYLVLFNPGLGRSGKGSFIGTSALKASSRIVVRLIVRVGLVTSFSLVVLLSRLSDLVLEPGHLFHLDVAFGSFVQLVHATRAPDVIQCDWVVAYYALKRSTRVSKLSMDLGGSPPYQVNVAPLRDVGKTRHRIASSLGVNFHDAIDKGVSTSRPPCRTVYVRETWIILSVNYVLGLFELFLIASLHLRNVVLELLESINIHHGYERRIGAFERDLESKAKLSANHGVGTKCTYRNPKLSHVKVDVNKESMSEYEKSEMEPGTYRAERKLRALVYRGCYGDIIALANNYRLVDNSR

SEQ ID NO: 138388 - protein, 185 aa, Glycine max
  Coding DNA Sequence Number=SeqID_21610
  Gene Ontology: Mol. function=two-component response regulator activity; Cellular component=nucleus; Biological process=two -component signal transduction system (phosphorelay)
  Homolog annotation: Hit_ID=Q71BZ1; Match level="QueryCoverage=45%, HitCoverage=12%, E-value=2e-18, Identity=58%"; Hit description=Type -B response regulator
  Pfam annotation: Domain name=Myb_DNA-binding; Domain location=67-117; Score=28.4; E_value=2.5e-05; Accession=PF00249.21; Description=Myb -like DNA-binding domain
MTTTTRAVATISMAGSGIDLGCQLGSNGHIVGFSEEARGQEKIGTNFKESDSDELDDSFAPPTKKPRLMWRQELHQQFVEDVMQIGLDKAKPKRIVEAMNIPGLTREQVASHLQKHRHELLLNTSKGVTLQQNEKTLSNNIESKRREGAYGRFDLTAFGDTSHLSYAALHPEERMEDQWPYYSLA

SEQ ID NO: 138389 - protein, 247 aa, Glycine max
  Coding DNA Sequence Number=SeqID_21611
MVNPPLSCSEVTLWPWVMGTSFVVQVEGTSTWVVVTENKRGYISCGSVQVEGFYKVDKKSQGPQVAWGLNVGTAPPNLDDCICSQRPRNEDVGQAIDENMLDSDYDDSLDESSSSSSNGDDNEDLNNNGYPLKNKSGKVASSNIEQGKINKKRKLDKKLFSPKASNFENVPISKTFLEKEKDVVGCEKKSRFDVPLPSKKTRNGGAPGDHVKASPISMLMGTDNIFTNLKAMLEATIGSPSTKIPIL

SEQ ID NO: 138390 - protein, 98 aa, Glycine max
  Coding DNA Sequence Number=SeqID_21612
  Subcellular localization annotation: CTP_CleavageSite=34; ConfidenceScore=5.18e-01
MYPLLFSVTTTQVDVPSTCTTKDVPSNVLRQSSQANKVWKPENSEIFLAKEEEEEVQEDVQRDSKVVKEYMKKLLKCKSRSCFYRLFMSGQEKPLEEL

SEQ ID NO: 138391 - protein, 103 aa, Glycine max
  Coding DNA Sequence Number=SeqID_21613
  Subcellular localization annotation: CTP_CleavageSite=45; ConfidenceScore=5.06e-01
MGEINFVGGENNSYNQYPNNFNQGQGFRQSQGMYRPQTMQNQRPRQEERQPTLQETMLQYMAKNDQRMKLDDSFPKFANNVLTKKDHASRKVKVPIDGTNHPG

SEQ ID NO: 138392 - protein, 162 aa, Glycine max
  Coding DNA Sequence Number=SeqID_21614
  Gene Ontology: Mol. function=two-component response regulator activity; Cellular component=nucleus; Biological process=two -component signal transduction system (phosphorelay)
  Homolog annotation: Hit_ID=Q940D0; Match level="QueryCoverage=60%, HitCoverage=14%, E-value=6e-15, Identity=37%"; Hit description=Two -component response regulator ARR1
  Pfam annotation: Domain name=Response_reg; Domain location=29-145; Score=-14.3; E_value=0.045; Accession=PF00072.14; Description =Response regulator receiver domain
MSLRAVAGCGGFGFLGFVMAKRFGFRWVAALRMELWHTLMSHLQCFSDMCASFCSGSQKCRRRHCSLEEYVREKTHCIDVILIEVHMPYVDSLQFLQHVTNETNVPVIMMSLDDAQSTVMKAIRNGACNYWLKPLQESLIKVMWMEYARKLESKYATKKRRF

SEQ ID NO: 138393 - protein, 293 aa, Glycine max
  Coding DNA Sequence Number=SeqID_21615
  Gene Ontology: Mol. function=sequence-specific DNA binding; Cellular component=nucleus; Biological process=regulation of transcription, DNA-dependent
  Homolog annotation: Hit_ID=Q2HRQ1; Match level="QueryCoverage=71%, HitCoverage=87%, E-value=1e-32, Identity=39%"; Hit description =Transcription factor, MADS-box
  Pfam annotation: Domain name=SRF-TF; Domain location=9-62; Score =11.2; E_value=0.022; Accession=PF00319.9; Description=SRF-type transcription factor (DNA-binding and dimerisation domain)
MGRARITLKHISNERSRKTVSKQRKKGLIEKVSKFSTMFGDEACLIVYDDENGDVGPVTWPQHPTLIHAIIQKYYEIQSKNERPQETFVIQDFFANRKKMVEADISKVQKQIASIKYPTWDQSIRNIKEEKLRGLIAHVDSKIRGYDHRINMLKNKHQSEAKFSFVQNMAQASGFSNHPSQILLNDDNRRVNFTNSMDQFDGACNYGINNMMRNMQQGDACFSFVPNMAQESSNATSSHVSHPSQLNCLQNISQSQPVLEALKPLSDKNEIVDSSNQVDVPLYSTNQLGESID

SEQ ID NO: 138394 - protein, 125 aa, Glycine max
  Coding DNA Sequence Number=SeqID_21616
  Subcellular localization annotation: CTP_CleavageSite=61; ConfidenceScore=5.27e-01
MNLTHGNSSQFMTGEDSSTNFSSNTNMTYANQYSFDSRVSGGCINRGGGGFNHSGGGSSVKCQVCFEYNHTSLTCYNHFNPQYQASNNGNNGNDSRALFHVTNNSQNIRQNSPFEGPDQIFIGNR

SEQ ID NO: 138395 - protein, 134 aa, Glycine max
  Coding DNA Sequence Number=SeqID_21617
  Gene Ontology: Mol. function=RNA-directed DNA polymerase activity; Biological process=RNA-dependent DNA replication
MGTKRKAEVKNQRFLHIIPEHTTVPILGKELWRQQDEQLLQRYLGLVIRERLEVYVDDMIVKSKQVDEHLANLLELLMQLRKYNMRLNPRKCTFGVQVGKFLGYMLTERGIKVNPDKCKATLEMRSPKMLKKIQ

SEQ ID NO: 138396 - protein, 148 aa, Glycine max
  Coding DNA Sequence Number=SeqID_21618
  Gene Ontology: Mol. function=RNA-directed DNA polymerase activity; Cellular component=mitochondrion; Biological process=RNA-dependent DNA replication
MICVDGSSHKKGSGERFLLKSSDGLIMEQALTFAFPKTNNQAEYEDCIVGMRLAKELGAKKIKACRTTSHSTTGESPFRLTYGMEAMIPIEIGEHSWRVLNYDKENIEDNIRSELDLAEERKEVACIREALLKRRLDAQYNRHYLCQG

SEQ ID NO: 138397 - protein, 55 aa, Glycine max
  Coding DNA Sequence Number=SeqID_21619
MELDESNGGIVEPANTLMFKLTHLLLSHYANFWNGSIDGFCPFSFLDNALSLVNS

SEQ ID NO: 138398 - protein, 69 aa, Glycine max
  Coding DNA Sequence Number=SeqID_21620
  Gene Ontology: Cellular component=membrane
  Homolog annotation: Hit_ID=Q1RSU2; Match level="QueryCoverage=97%, HitCoverage=21%, E-value=2e-13, Identity=49%"; Hit description =Biopterin transport-related protein BT1
MEEENQEDPCSESMEEDESKRGGLGGALAEVGTKYYMKDVQKVQPSEAQIYKGNHIHSLDCEASLGSSH

SEQ ID NO: 138399 - protein, 112 aa, Glycine max
  Coding DNA Sequence Number=SeqID_21621
MEKQHRRMEKQLCVPKQLQQLPMMEIYDESSDPNDHFSRFKSALSHRGANGLQMCKAFLLSLKQVALKWFQWLSRSSISSWSDLRVKVHYAFATSKERPKTQADMKKIKQGV

SEQ ID NO: 138400 - protein, 231 aa, Glycine max
  Coding DNA Sequence Number=SeqID_21622
MTRKEIQEGRMMEKILESSKMEDMLTLLEKGFVAGGPISNAQKRYAREISRDKDLDGFSSHAITPFGYLKLRVTFRKYPLAKAIMVCFLVVSTMSLFNVLIERPTLNALGVVISTPHLTMKFFNDDLKVVVSREVPSPEKLVPIPGKKEILVAVLDYGVEEHDNKFDRPILEGELIQVKNRLEEIKVVKVGFKLPTPILDKLSCFGADNACIFAWTPAYIVEASFMMMNQV

SEQ ID NO: 138401 - protein, 94 aa, Glycine max
  Coding DNA Sequence Number=SeqID_21623
  Gene Ontology: Cellular component=membrane
  Homolog annotation: Hit_ID=Q1RSU2; Match level="QueryCoverage=53%, HitCoverage=10%, E-value=7e-17, Identity=80%"; Hit description =Biopterin transport-related protein BT1
MMPTSFIGVIAMLLLSLHENLHLVLALLALTAGSAGGAIADVTIDACVAQNSISQPSLAADMQSLCAFSLSVGSLIGYFISGIFVHFLGPMVSL

SEQ ID NO: 138402 - protein, 59 aa, Glycine max
  Coding DNA Sequence Number=SeqID_21624
MKTSIFETSGSDLAKVVVGGMGLEASALLTDIDLKGLSAVSYTNLPGYNRNVLTENSQR

SEQ ID NO: 138403 - protein, 61 aa, Glycine max
  Coding DNA Sequence Number=SeqID_21625
MTPLPPPLTIRNGALYSNLNGEEHMTEQVEAEEEEDRAADEGEREQTGSCQPSRIPFTILS

SEQ ID NO: 138404 - protein, 128 aa, Glycine max
  Coding DNA Sequence Number=SeqID_21626
  Gene Ontology: Mol. function=two-component response regulator activity; Cellular component=nucleus; Biological process=two -component signal transduction system (phosphorelay)
  Homolog annotation: Hit_ID=Q9FGT7; Match level="QueryCoverage=78%, HitCoverage=17%, E-value=2e-14, Identity=40%"; Hit description=Two -component response regulator ARR18
  Pfam annotation: Domain name=Myb_DNA-binding; Domain location=40-90; Score=28.9; E_value=1.8e-05; Accession=PF00249.21; Description=Myb -like DNA-binding domain
MEGLFLDAIARVQEKISSNFKESNSDELDDSFAPPTKKPRLVWKQELHQQFVEAVMQIALDKAKSKRIIEAMNILGLTREQVASHLQNEKTLSNNIESKRREGAYGRFDLTAFGDTNHLLYVALHLEE

SEQ ID NO: 138405 - protein, 84 aa, Glycine max
  Coding DNA Sequence Number=SeqID_21627
MTRAMLCRMDLYGVGGLTTVGCTNLAATILGLDVGVGGQQKGDEVASVTQIDNANAWNSTLCMQSGGVGMGEGWPDGSRFGLGL

SEQ ID NO: 138406 - protein, 125 aa, Glycine max
  Coding DNA Sequence Number=SeqID_21628
  Homolog annotation: Hit_ID=Q6ASS1; Match level="QueryCoverage=86%, HitCoverage=24%, E-value=2e-34, Identity=64%"; Hit description =Unknow protein
QSRYAARAGSLNRVSGLRFFSVSTEEYSKRNYANNVAEYNTVLGSLTAQRRNFLLRDVYDDMMLDGVKPTRDTFHSLAVGTMKAARMQDAFYFADQMKIMGLLPDLACITFCCGDVWNDASDKDH

SEQ ID NO: 138407 - protein, 155 aa, Glycine max
  Coding DNA Sequence Number=SeqID_21629
  Homolog annotation: Hit_ID=Q6ASS1; Match level="QueryCoverage=92%, HitCoverage=31%, E-value=4e-46, Identity=60%"; Hit description =Unknow protein
MEYLKKEDMCYCHAGDIERGLQNFENHLRQDRSVPAELFVTLAEGAMVGYTEKGMQMAQDILVRMNERNIFLNNKLGSELLFTAAGEKTGGYITANYIWDLMQARGITPSFPAVEAYYQGLKDREIPEDDPRLVLVSRIHKNLSVRFGNRTNINL

SEQ ID NO: 138408 - protein, 188 aa, Glycine max
  Coding DNA Sequence Number=SeqID_21630
  Gene Ontology: Mol. function=protein serine/threonine kinase activity; Cellular component=chromatin; Biological process=protein amino acid phosphorylation
  Homolog annotation: Hit_ID=Q0ZCC5; Match level="QueryCoverage=93%, HitCoverage=19%, E-value=3e-42, Identity=60%"; Hit description=CCHC -type integrase
MGFENLLQGPRTKHMIGVKWVYRTKLHPNGFVHKHKVRLVVKGYSQMTRVDYGDTFALVAKHETNRLIVVLSTQCGWRIFHLDVKLAFLNGVLEEEIYVKQSIGFIVESHEDKVYRLHKVLYRLKQAPRAWYNIIVSGVFTWNSKKQDVVVQSSAEVEHIVAAVASNQAIWIRKILAYLVCVQEESTV

SEQ ID NO: 138409 - protein, 99 aa, Glycine max
  Coding DNA Sequence Number=SeqID_21631
MAKHPISPRPAAVQRVPPAPPATQHCVSLGETHSCRVPPTHLAKRPCIHAFLPMHGCMSCITWVPPAWLAKRVQWVLPTPLAKHEKLDTYSKNSKGGNF

SEQ ID NO: 138410 - protein, 64 aa, Glycine max
  Coding DNA Sequence Number=SeqID_21632
MIRFTVNKWKATPWEVKGEGTSADFTGRVGAPFIQKPFDFRSRTIPEGDLTNISPIIPFAVVMG

SEQ ID NO: 138411 - protein, 216 aa, Glycine max
  Coding DNA Sequence Number=SeqID_21633
  Gene Ontology: Mol. function=protein serine/threonine kinase activity; Cellular component=integral to membrane; Biological process=protein amino acid phosphorylation
  Homolog annotation: Hit_ID=Q1SAZ3; Match level="QueryCoverage=99%, HitCoverage=28%, E-value=5e-42, Identity=40%"; Hit description =Protein kinase
  Pfam annotation: Domain name=LRR_1; Domain location=166-188; Score =1.4; E_value=1.6e+02; Accession=PF00560.23; Description=Leucine Rich Repeat
  Pfam annotation: Domain name=LRR_1; Domain location=190-211; Score =20.4; E_value=0.0065; Accession=PF00560.23; Description=Leucine Rich Repeat
  Pfam module annotation: Pfam domain module=LRR_1::LRR_1; Domain location=166-188::190-211
YDKDDYDRMWYPYNLPDSTPLNTSFTVDSLNHTAYHLPSAVMKTAVRPTNENDSLEFEFDTGQPTSESYVYMHFAEIEVLNENESRAFDITLNGKLWAEYVTPTYLQSNTIDGNQSIRGIKAIIDIKSHYKLTSSVGKSWQGDPCAPSKYSWNGLNCSNNGYNPPTITALYLASSGLGGTIIASFLELKFLESLDLSNNSLTGPIPDFSQLQHLKA

SEQ ID NO: 138412 - protein, 92 aa, Glycine max
  Coding DNA Sequence Number=SeqID_21634
  Homolog annotation: Hit_ID=Q6CQF3; Match level="QueryCoverage=59%, HitCoverage=58%, E-value=6e-08, Identity=71%"; Hit description =Kluyveromyces lactis strain NRRL Y-1140 chromosome D of strain NRRL Y- 1140 of Kluyveromyces lactis
MPERGEARGNSVSLRIAGARGRVLSGRCGCSVEPRHGIESSKWAIFGKQNWRCGMNRKLGYGAQLRANLDPTKGVGRLRQQDGGHGSRNPLR

SEQ ID NO: 138413 - protein, 115 aa, Glycine max
  Coding DNA Sequence Number=SeqID_21635
MMIWKQRAKLVMAIARRALKHPIYGIVILRSGIYTNRPIVSQLCSFISSMNSSILISDDVPKWKTPHDSGISKNTIDNNETSTNVTTQTICMYKTKVNQNETNVSPSVKQKIAYK

SEQ ID NO: 138414 - protein, 142 aa, Glycine max
  Coding DNA Sequence Number=SeqID_21636
MIMRGQDIYSSQDEATTSPSSSESEEAKGEESSEEIYPQEEGQPLMVKEECKEVSVSYKRLAKKESHFEIKTNIKETSPLRQPPHLLLCKKTLVSTATPLGLEVIPQVKELLDEGLVRKSLNPCALLVPEIVIKGFPQTLRE

SEQ ID NO: 138415 - protein, 67 aa, Glycine max
  Coding DNA Sequence Number=SeqID_21637
MNFRKYFFRNLNHQLPEEVLPEIHNSHSRTTSSFKVLLGIAFYCSSSLTIYPENAKEKIDKCVPPTK

SEQ ID NO: 138416 - protein, 53 aa, Glycine max
  Coding DNA Sequence Number=SeqID_21638
MGCPRSRIILGDGQISGQIQRQRQIEVNGNAATVCCTMSFLAFRYLGTDVSRG

SEQ ID NO: 138417 - protein, 285 aa, Glycine max
  Coding DNA Sequence Number=SeqID_21639
  Gene Ontology: Mol. function=5-formyltetrahydrofolate transporter activity; Cellular component=membrane
  Homolog annotation: Hit_ID=Q1RSU2; Match level="QueryCoverage=99%, HitCoverage=51%, E-value=1e-103, Identity=69%"; Hit description =Biopterin transport-related protein BT1
  Pfam annotation: Domain name=BT1; Domain location=3-265; Score=-53.4; E_value=6.2e-08; Accession=PF03092.7; Description=BT1 family
VKQNFIDAGKAMWTTLRSEDVWGPCLYMYLSLALSLDIREGMFYWYTDSKGGPSFSQVFIHKSLISNSITETIELTTLTTSVNHLSESVGFIFSISSVGALLGAILYQYALKDYAFRNLLFWTQLIYGLSGMLDLILVSRLNLKFGIPDYFFVVIVESIAKMTNRLKWMPMLVLSSKLCPSGIEGTFFALLMSIDNVGLLSASWGGGFVLHMLRITRTKFDNIWLAILIRNILRIAPLWLLFLVPRADRSSSILPCKSMNSEVAIDPSDTKNVELVSLVHSVDGK

SEQ ID NO: 138418 - protein, 54 aa, Glycine max
  Coding DNA Sequence Number=SeqID_21640
  Homolog annotation: Hit_ID=Q8H6S8; Match level="QueryCoverage=55%, HitCoverage=3%, E-value=3e-08, Identity=90%"; Hit description =Translation initiation factor
MASARVKTAGETLVHPTGHHHSCHDFIDIGRVASIENNHLPVDYARKGQKVAIK

SEQ ID NO: 138419 - protein, 94 aa, Glycine max
  Coding DNA Sequence Number=SeqID_21641
  Subcellular localization annotation: CTP_CleavageSite=36; ConfidenceScore=5.66e-01
MVTTSRDYITKGNKAVTSSQTRKRTITSSNNTSLTYLSKVGGRSCLSLSTVGLPQLTNDEINPTDGTLPTLDRKPCESLAGKVEVVRRNEEVVE

SEQ ID NO: 138420 - protein, 166 aa, Glycine max
  Coding DNA Sequence Number=SeqID_21642
  Gene Ontology: Mol. function=helicase activity; Cellular component =mitochondrion; Biological process=embryonic development ending in seed dormancy
  Homolog annotation: Hit_ID=Q10LT2; Match level="QueryCoverage=86%, HitCoverage=26%, E-value=3e-14, Identity=35%"; Hit description =Expressed protein
MVVDLYSEGKIDEADKVIIEMQVRGFKPTHSIFEAKVAALCKVSKVDEAIKVIEEDMVKVNCLPTAKMYNILLKNLCNVGNSTTILESLNKMSSKVGCTGDRDTHSILLEMLCGERRQYEAVMWLENMISQGKLLEISVWNSLASLFCNSEKIKVSSETFSRLRSL

SEQ ID NO: 138421 - protein, 105 aa, Glycine max
  Coding DNA Sequence Number=SeqID_21643
MMQSYPPRVLDRRLQEDWARAAKESPGVLMNLRLSSSFSRNLFKEAYQGSFSRKLLKENPLQGSYPRHILDGEAPSSKAYSLVVGASSNFFSFVFHCTSMVENHH

SEQ ID NO: 138422 - protein, 121 aa, Glycine max
  Coding DNA Sequence Number=SeqID_21644
MVEVVGTRCEAMATCKHTDTQVSVGSNRVTLSSESYIAGGCLLPVYIYMREVGMIRFLIQSVSPLSPSRAISPPSRRCKSKYHPKSINFMSLRDDGSQGHRNGSSQAATRQIDMEKPVFFM

SEQ ID NO: 138423 - protein, 240 aa, Glycine max
  Coding DNA Sequence Number=SeqID_21645
  Homolog annotation: Hit_ID=UPI0000503967; Match level="QueryCoverage =91%, HitCoverage=73%, E-value=5e-07, Identity=27%"; Hit description =UPI0000503967 related cluster
MNCVFVPVSSTFEFGAMRNDCLVQFSILNLFWSPMNCVLVHVSSTFEFGAMRSDCLVQLSILNLFRSPMNCVFVHVSSIFEFAAMRSDCLVQFSILNLFRSPMNCVFVHVSSTFEFGAMRSDCLVKFSILNLFRSPMNCVFVHVSSTFEFGALRSDCLVQFSILNLFRIPMNCVFGQVSSTFEFGAMRNDCLVQISILNLCQSPMTCVYVHVSSTFDFGAMISDCLMQYLHSHPFLDPHE

SEQ ID NO: 138424 - protein, 62 aa, Glycine max
  Coding DNA Sequence Number=SeqID_21646
MALGISEERQKTHVCINGELAVARCPMLLHPKSIKGHASENIGWKLGIVLTVIKHELSNIDV

SEQ ID NO: 138425 - protein, 308 aa, Glycine max
  Coding DNA Sequence Number=SeqID_21647
  Gene Ontology: Mol. function=DNA binding; Cellular component=nucleus; Biological process=regulation of transcription
  Homolog annotation: Hit_ID=Q1T6J1; Match level="QueryCoverage=58%, HitCoverage=71%, E-value=4e-34, Identity=42%"; Hit description=No apical meristem (NAM) protein
  Pfam annotation: Domain name=NAM; Domain location=4-139; Score=183.4; E_value=5.7e-52; Accession=PF02365.6; Description=No apical meristem (NAM) protein
MDDDIVGLGFRPTEEELVDFYLKHMLLGNDPRAHVIPVIDLCDVEPWDVPVMLAKSSSAIRFGDPYWFFFSPVDFKYSRSKRFNRTTKCGFWKATGKDRDIRTGDTNTVIGTKKTLVYYQGRVSCGVKSNWVIHEYHAVTFHESQRTFVLCCLIKKPGKATEGGTDALICDEGEPSRSMVSDFENQATAEGIPSEGTFTGMETIFQATPWAENCFSPIQQSPTSIEQEGASFPNYAFNNAYFRNEDNVMRNPFETTKEDEFLNSILAGESIVINEENKHNFVHSSTQSESLKTILLKTRQLRMMGTKI

SEQ ID NO: 138426 - protein, 207 aa, Glycine max
  Coding DNA Sequence Number=SeqID_21648
  Gene Ontology: Mol. function=nucleotide binding; Cellular component =membrane; Biological process=small GTPase mediated signal transduction
  Homolog annotation: Hit_ID=Q38922; Match level="QueryCoverage=98%, HitCoverage=99%, E-value=1e-101, Identity=90%"; Hit description=ATGB2
  Pfam annotation: Domain name=Arf; Domain location=2-167; Score=-73.1; E_value=0.0004; Accession=PF00025.11; Description=ADP-ribosylation factor family
  Pfam annotation: Domain name=MMR_HSR1; Domain location=7-122; Score =9.6; E_value=0.00013; Accession=PF01926.13; Description=GTPase of unknown function
  Pfam annotation: Domain name=Miro; Domain location=8-122; Score=59.6; E_value=1e-14; Accession=PF08477.3; Description=Miro-like protein
  Pfam annotation: Domain name=Ras; Domain location=8-169; Score=329.0; E_value=8.1e-96; Accession=PF00071.12; Description=Ras family
  Pfam module annotation: Pfam domain module=Arf::MMR_HSR1::Miro::Ras; Domain location=2-167::7-122::8-122::8-169
MSYDYLFKYIIIGDTGVGKSCLLLQFTDKRFQPVHDLTIGVEFGARMVTIDSRPIKLQIWDTAGQESFRSITRSYYRGAAGALLVYDITRRDTFNHLASWLEDARQHANPNMTIMLIGNKCDLSHRRAVSKEEGEQFAKENGLLFLEASARTAQNVEEAFIRTAGKILQNIQEGVFDVSNELAMDVPKVNQVPEMELFQPEVGVAAD

SEQ ID NO: 138427 - protein, 54 aa, Glycine max
  Coding DNA Sequence Number=SeqID_21649
MKHHRKEETGMDRMEETRAEAVTFARNEEGRSFGILSRKHRDRNRARQQSDDEN

SEQ ID NO: 138428 - protein, 258 aa, Glycine max
  Coding DNA Sequence Number=SeqID_21650
  Gene Ontology: Mol. function=nucleic acid binding; Cellular component= nucleus; Biological process=rRNA processing
  Homolog annotation: Hit_ID=Q8H2U2; Match level="QueryCoverage=76%, HitCoverage=78%, E-value=4e-55, Identity=54%"; Hit description=TBP -binding protein-like
  Pfam annotation: Domain name=RRM_1; Domain location=50-133; Score =5.0; E_value=0.049; Accession=PF00076.12; Description=RNA recognition motif. (a.k.a. RRM, R
MNASDSEKEDAEIEATETAPDEENAKLKKKEKKKKKKASSKDAEKKRGVCYMSRIPPHMDHVKLRHILSQFGDIQRIFLAPQDSSVQVSAKRSRGSRDQAYSEGWVEFGNKSVAKRVANMLNGEQIGGKKRSSFYYDLWNIKYLSKFKWDDLTEELALKKAIREQKLAVELSAAKRERDFYLSKVDQSRALSAIEGRLKKKQKIQQDSGLVEKVIRHFPQTKPIAADTKKNKPELSDDILDAVNKALDPYDSLKGIPA

SEQ ID NO: 138429 - protein, 201 aa, Glycine max
  Coding DNA Sequence Number=SeqID_21651
  Gene Ontology: Mol. function=transferase activity; Biological process= DNA integration
  Homolog annotation: Hit_ID=Q1SPQ1; Match level="QueryCoverage=50%, HitCoverage=24%, E-value=2e-10, Identity=46%"; Hit description =Polynucleotidyl transferase, Ribonuclease H fold
MSSSPRTTLSSRLSKKVRSKKEYEEGLLVLVETVEDALEVTTVGFVGWWWTKIRPQKRDVEDIVNVRVGQKLKFIHNIANAASNSIRFKEMASKLFGTTLSEGLLAMIFQMQKNQIIDNKAKLTPVVIVIGTHGRIQEWHNLRYSLKWKGCQEVGVFLESIEMTQITVSPNKVGRWVTKSMASFDEKFGVTANTRPIEGCC

SEQ ID NO: 138430 - protein, 123 aa, Glycine max
  Coding DNA Sequence Number=SeqID_21652
  Subcellular localization annotation: CTP_CleavageSite=47; ConfidenceScore=5.54e-01
MASFVSGKEMTLHCGSQIQKKSTWSSKSCPVCNTFGSSLCPTIMLPLCAKVAPARTISSSSGDSVEEVRDMRVRIVGLAVEACAEVHRRLRGEDTVSGSGSDAVSDSFWTLEMWALPPFLQFE

SEQ ID NO: 138431 - protein, 552 aa, Glycine max
  Coding DNA Sequence Number=SeqID_21653
  Gene Ontology: Mol. function=protein serine/threonine phosphatase activity; Cellular component=protein serine/threonine phosphatase complex; Biological process=protein amino acid dephosphorylation
  Homolog annotation: Hit_ID=O81709; Match level="QueryCoverage=99%, HitCoverage=100%, E-value=1e-123, Identity=46%"; Hit description =Protein phosphatase 2C
  Pfam annotation: Domain name=PP2C; Domain location=227-535; Score =244.7; E_value=2e-70; Accession=PF00481.12; Description=Protein phosphatase 2C
MEEMSFIVVVPLRVVPHMDVSRFKLMADTGLLSNSVTKVFTETVASLDDCHDSGNLEDEVGIAEVIPPKQDREGESPMLDTISQNRSTLAAGDEELTTEIEEDSLSLEGDQFVDSSCSLSVVSENSSVCGEESFCFDATSDVGTPCSADVEKSISAVNIVAEAVDLGESNIDPDIMTDPLAVAVSLEEETGVRSGPKSSAVDLHQLPQEKGVSGTVGRSVFELDYTPLYGFISMCGRRPEMEDAVATVPQFLKIPIHMLIGDRVIDGINKCFNQQMTHFFGVYDGHGGSQVANYCRDRIHLALTEEIEFVKEVMISGSMKDGCQDQWEKSFTNCFLKVNAEVGGQFNNEPVAPETVGSTAVVAVICASHIIVANCGDSRAVLCRGKEPMALSVDHKPNRDDEYARIEAAGGKVIQWNGHRVFGVLAMSRSIVAITKRLMSGDRYLKPWIIPEPEVTFVPRTKDDECLILASDGLWDVMTNEEVCDLARKRIILWYKKNGLEQPSSKRGEGIDPAAQAAAEYLSNRALQKGSKDNITVIVVDLKPYRKYKSKT

SEQ ID NO: 138432 - protein, 334 aa, Glycine max
  Coding DNA Sequence Number=SeqID_21654
LPPLSPIDVSKYKPLGSTWRNAWRPWIKPSEEAIARKKFHVVFFNKNKQNYCKKSEIIHRPLQELVQREHIIVEPTPQTRYDYIHTPFDAYKALSTDAIVPLEIPTWTRPVYPNLALIISLDPFSKTSKYSPLAEPLRIDPSKKNSNSLVQECRHLVPSHKLYVADQATTYSPSLHISKSTYIELVPNRSYPRLPICDEGKKKNFKLYFNMEMPSKKQNASLAAEEKSKKKDSAKRKDEADVAQDQSNKVVPEQSVATKTTQEVDASIPTLIDEALVNKVGEDMTKPKQPETSHEATSKDTANVIVDTTTSRPTPINYAPQKVEEKENKRETQF

SEQ ID NO: 138433 - protein, 101 aa, Glycine max
  Coding DNA Sequence Number=SeqID_21655
MVVPKSEKMQRQAKNNKEQTWNHGYLKGNERVPLSMGLQRRTTMVCGGEWWLWVMEKVLGTHLLKDPNGQMVYKCLVKLQTKFQEDPTVNEGWETFLPKKL

SEQ ID NO: 138434 - protein, 151 aa, Glycine max
  Coding DNA Sequence Number=SeqID_21656
  Gene Ontology: Mol. function=zinc ion binding
  Homolog annotation: Hit_ID=Q0KIL9; Match level="QueryCoverage=53%, HitCoverage=60%, E-value=2e-18, Identity=48%"; Hit description=Zinc finger protein, putative
MSKDSIIFLLENFLLTYQEVAGQYGTPLEFCDPRLLAIAEAERQFLDVEYDEYAASNVRGVAFFRSTTLILFLLHAARFLLPCYIMAWAISILQHRQQRQASKVLMLLRIYYFYYYYYGLNKDQEPEAPPEAQARRPKRNTKRPGHLDDYV

SEQ ID NO: 138435 - protein, 67 aa, Glycine max
  Coding DNA Sequence Number=SeqID_21657
MELGEVVVRVGNNVEARSGVWVQHSIGWRLSVVMKGVIRNKMWVLLAKVESSLKANEAVNKMLAMIS

SEQ ID NO: 138436 - protein, 201 aa, Glycine max
  Coding DNA Sequence Number=SeqID_21658
MAPRSSAKSARSSSISTLKFLEDSSKGPNHPCADVECLVIFQPTSPTSDLNVDCARLIYWLVMKMDMDLGSMISSQITQIAQSISSRLGFPTLIASLCDAKGVISNTLTLESLSPVINLAYIRKNYRNPIDPSIVFPRPQRARARATLDALPFFPPSVVPPPAVPPLLSAPPSLFSTHPDQLLPMLQSLHQGQYLIMKSPH

SEQ ID NO: 138437 - protein, 156 aa, Glycine max
  Coding DNA Sequence Number=SeqID_21659
  Subcellular localization annotation: CTP_CleavageSite=44; ConfidenceScore=5.12e-01
MKRSEFEFPATDFSSAIPSDVVLFGKVITRRTEPGPDKRENRVLSKSESSSGRSNGFMSWLRSPSGKKNRCRRSESGRSRYKTVLKFPLQMELSDIKKRQDRRESLPPPPPPPLPIFTAKDDSDSDGGESCWELVRPSRRQGTLKNAFFGCFLPII

SEQ ID NO: 138438 - protein, 149 aa, Glycine max
  Coding DNA Sequence Number=SeqID_21660
MKRSEFEFPATDYSSAVPNDVVLFGKVITRRTEPGPDKRENRVLTKSESSSGRSNGFMSWLRSPSGKEIRCRRSESGRSRYKTVLKFPLQMELSDIKKRQDRREPLPPLPRVTAECDGDGGESCWELVRPLRRQGTLKNAFFGCFLPIV

SEQ ID NO: 138439 - protein, 95 aa, Glycine max
  Coding DNA Sequence Number=SeqID_21661
  Gene Ontology: Mol. function=DNA binding; Biological process=DNA integration
  Homolog annotation: Hit_ID=Q1SQ35; Match level="QueryCoverage=78%, HitCoverage=71%, E-value=3e-25, Identity=68%"; Hit description=Pol -related
MLLLELEEMRLNAYESSKIYKQKMKAYHDRKLMKRNFQPGQQVLLFDSRLKLFPGKLKSKWSGPFAIKDVKPYGAIERMDPSSTDPDGAKRKQSR

SEQ ID NO: 138440 - protein, 135 aa, Glycine max
  Coding DNA Sequence Number=SeqID_21662
  Subcellular localization annotation: CTP_CleavageSite=57; ConfidenceScore=5.01e-01
MAVFELPTVMAFALSASIALSVARFACDVALSELTNGSFKGAQWLSVSVALSVLRLRGEGIGASSSLFACDENFFLQKYYFANPNGKNVLKWVSKLVSKFHDYPTANESRIIVLLAQVWVYAGKEKTPNGGCVRI

SEQ ID NO: 138441 - protein, 229 aa, Glycine max
  Coding DNA Sequence Number=SeqID_21663
MTIIIATTMISVTLIVTTTVNGDHVNDNDHSHGDNHNDTGGGGENSHDNEGVLKRSLTPQRPDQFPATLSAVAVAFVLRRNYRQRRRRKRLPPVLPLLNVTQFHLQRKLQYRLITSPATLTSPASSFSPGRRPEPRHEPVGPTRRRPGFRQNPVFAFRRWTGRFVFGSNGGMEMSIVVATVAENEVWELMGMMGNLMMVVVVVFKVTNKDDDCGEDCHSVVYERRISNH

SEQ ID NO: 138442 - protein, 63 aa, Glycine max
  Coding DNA Sequence Number=SeqID_21664
MATSSDLEQRHKFVPMAMSMSEFGWGGKTSGNTRMQWCTKKWISSMMWWSWWWRRLRIRLNPN

SEQ ID NO: 138443 - protein, 53 aa, Glycine max
  Coding DNA Sequence Number=SeqID_21665
  Homolog annotation: Hit_ID=Q1RYE4; Match level="QueryCoverage=66%, HitCoverage=3%, E-value=1e-07, Identity=69%"; Hit description =Cytochrome cd1-nitrite reductase-like, C-terminal haem d1
MKIATFFYDFELLKKVNGRGVRSESVIEHEVSVEEANDDVIKSDDGKVPQSAN

SEQ ID NO: 138444 - protein, 368 aa, Glycine max
  Coding DNA Sequence Number=SeqID_21666
VISIGSSSEEDTYHDAFDTESSSSKRLRVLCCAGGCTSRLRKRAQPSIASLVREPVPVAMILAPSISGGARRSGGRDIKASPLMRHSHSDYVLKYRSFITSAVSIAALQHQVKLENPEDSCKIVVQACGSNPEDSCKIVVGLVAGVVESRAPLNLRALRQAVGLTHGSGHPSSFQDLPLAPSIVETHVVVVVVVVTHAPPPPLAILVQEVAPAVEVDAPAVSTGLVVAPPSTVIAPLLSALTLLQVSLYADNDYDGPSIPVLAKKPFCDTKGSDNDLNDQGSEHPLLPGRLENSSLKIASTGNGNLKERMGQLRSKSSASETEGLARDLKRQKNLDFKPGKEPGAPLPKIDSCPTGRICSFCQSSKIS

SEQ ID NO: 138445 - protein, 74 aa, Glycine max
  Coding DNA Sequence Number=SeqID_21667
  Gene Ontology: Mol. function=prephenate dehydratase activity; Biological process=L-phenylalanine biosynthetic process
  Homolog annotation: Hit_ID=Q1RXT6; Match level="QueryCoverage=65%, HitCoverage=12%, E-value=2e-13, Identity=71%"; Hit description =Prephenate dehydratase with ACT region
MESLMDDDENITRFLVLAREPIIPGTNRPHKTSIVFSLEEGPGSIIQRQSKIDPSLSNDVANTTTITHTPVVIL

SEQ ID NO: 138446 - protein, 107 aa, Glycine max
  Coding DNA Sequence Number=SeqID_21668
MDTRLRVIGDPMNGVQRSKSIGVHKVWGSFRCTRSEPTGCRILGEERNQNFLPVQWRRFLSKDSVYALQPRLYLFSPNFFFLVLIARVTLAPSLQKLYMTLWTPLVI

SEQ ID NO: 138447 - protein, 118 aa, Glycine max
  Coding DNA Sequence Number=SeqID_21669
  Homolog annotation: Hit_ID=Q9ZQ38; Match level="QueryCoverage=83%, HitCoverage=57%, E-value=3e-39, Identity=75%"; Hit description =Expressed protein
  Pfam annotation: Domain name=DUF1068; Domain location=1-118; Score =23.1; E_value=4.1e-08; Accession=PF06364.3; Description=Protein of unknown function (DUF1068)
MSNMDYIGSGDYFQNICKYCGSNDPDLKEEMEKQFVDLLSEELKLQESVTEANTRHMNITLAEAKRVASQYQREADKCIAATETCEQARERAQAILTKEKKMTLVWEKRARQMGWEGE

SEQ ID NO: 138448 - protein, 120 aa, Glycine max
  Coding DNA Sequence Number=SeqID_21670
MGETHEAPRDHNLVNFKPHLGCAIEGQAFGGIPLPNTLGGPQLPPTVVEKEKFDHIEERLRAIEGGRDYAFTDMEELCLVPDVVIPLKFKVPDFDKYKGTACSKNHLKNVQQENGGILKK

SEQ ID NO: 138449 - protein, 169 aa, Glycine max
  Coding DNA Sequence Number=SeqID_21671
  Subcellular localization annotation: CTP_CleavageSite=51; ConfidenceScore=5.38e-01
MFILTPIAINSSLTSKRAHVSSDSDSGVSSKFLRFLKVSPHIALIGFPNVRENEKGLKPLSSCDSIISLHEYYLINPIGEDHFGFLRERKRLRCERYFSHIKNDIKIPNGENSRNWVTNLVFKFHNDPTVNDSEIVVFLRQIWWAVGKIEGFERSKEKNKNEAKRRHLT

SEQ ID NO: 138450 - protein, 90 aa, Glycine max
  Coding DNA Sequence Number=SeqID_21672
  Subcellular localization annotation: CTP_CleavageSite=70; ConfidenceScore=5.69e-01
MALLGRGTVATIRRSALIFTSNSNNSLFRSHPFSAPISLNVSNSNTIHRHFSSTKKPFIGTFIRYLSKICGTGKQNSTNNIMHNATFKGE

SEQ ID NO: 138451 - protein, 377 aa, Glycine max
  Coding DNA Sequence Number=SeqID_21673
  Subcellular localization annotation: CTP_CleavageSite=16; ConfidenceScore=5.24e-01
MEEPSKKRNGSSSTTTAARQRRHNTSDDPPAPPNLSFSSPRSLTLFSSDEQHQRYYSLFSNRVILDAKYLDIEFFDGENFDCYQVHKIPIVVDQSLFYSLTKLSSQGVPFEGTLVNDWKHIYSSHDARKMVCNDHADMTGRLPGSFTFECRIMHYIICRVLLPRSTNLAQVPYKSADEWLLGGTEVPMNRVGRYDVLLQLCLCQAKPFSSILFSETCARKKSHLITHFTRVGKPSRIFGWQIGLHNEDLILLWALQTGRQIDWAHLVRYRMHKVLRANAPLPYPHLVTLFLQHFNVPLEDEPFVKVKHLPPPIPDKRTPSLPPQRDSSSSLLNDVVTELRDLRAFIGDHFDAMDSCITRLEDDMNFIRRCLDPPADP

SEQ ID NO: 138452 - protein, 178 aa, Glycine max
  Coding DNA Sequence Number=SeqID_21674
MVLKIVNDNKLPSPIVSSSSVPLCVVQRSLSFMLEKGLEVKITSEKLQNEGFGGNFLHRKLEEDFEDFSDYNVLLGVEVRRQATTTHGGHWWSWVVENKVLGFGWAFGEEERGKNHVFHVEERIYNLYIFLSKLVSLSGSLIFALSMTIHAERNSFRTNSRSAQFPLGLELCLAPPRA

SEQ ID NO: 138453 - protein, 267 aa, Glycine max
  Coding DNA Sequence Number=SeqID_21675
  Gene Ontology: Mol. function=hydrolase activity, acting on acid anhydrides, catalyzing transmembrane movement of substances; Cellular component=membrane; Biological process=cation transport
  Homolog annotation: Hit_ID=Q1SI33; Match level="QueryCoverage=85%, HitCoverage=25%, E-value=7e-54, Identity=51%"; Hit description=Ca2+ -transporting ATPase (EC 3.6.3.8), calmodulin-stimulated-wild cabbage, putative
MGPKFALRLMRTLRPSLASLTQSSWSLLSNSLWGFLQEKGKVVAFIGTRLITSYISILKVADVGIVLDSVSRIVDRDSSDITIKRFNALEPILMAGRSKYHNIQNFIQLHLTFTISGLVITLITTICTGDFPLAQFQLIWVNVLVCILGGLMMVMKLTHEEQLAKQQSAHRNHPIITTEIWKSIVIQVLYQASVSMILEFGGHVTADRLCLLFNLLNIMQLLKKEVLKVVVQSFCFLGALGGCFLMQVLLIEYAKGRADCMRLNATR

SEQ ID NO: 138454 - protein, 245 aa, Glycine max
  Coding DNA Sequence Number=SeqID_21676
  Gene Ontology: Mol. function=RNA-directed DNA polymerase activity; Cellular component=intracellular; Biological process=RNA-dependent DNA replication
MGNGNLEMSVEDQKVTFNLFKAMKHPSDERNCFNVKAIEHEVENVMQQFTDDKKLVVISNALSPKEEAKLVELLKKHKEEIECHIFDLKGINPSYCMHKIMMEEDYRLVRQPQRRLNPTMKQEVREEVLKFLEVGRMPFGLCNAPATFQRCMLAIFANLAEKCIEVFMDDFLVFGSSFKHCLSNLELVLTWCVETNLVLNWEKCHFMVQEGIGLGHKISSRWIEVDKTKIDVIEKLPPSINVKGI

SEQ ID NO: 138455 - protein, 76 aa, Glycine max
  Coding DNA Sequence Number=SeqID_21677
MAPPLPFSPLSSATTLWAVFVGKALIDLGASINLMPISICRRIGNLEIMPTPMTLQLADHSITIPYSVVEDVLLKV

SEQ ID NO: 138456 - protein, 75 aa, Glycine max
  Coding DNA Sequence Number=SeqID_21678
MSFLNTRERDSLGVQKLLTVGILKIINFGLSLSEYGALSATPTKGNYAERPKAALSPTPTEGNCTEWPKGALSEP

SEQ ID NO: 138457 - protein, 232 aa, Glycine max
  Coding DNA Sequence Number=SeqID_21679
  Gene Ontology: Mol. function=unspecific monooxygenase activity
  Homolog annotation: Hit_ID=O04892; Match level="QueryCoverage=53%, HitCoverage=33%, E-value=2e-34, Identity=52%"; Hit description =Cytochrome P450 like_TBP
NWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 138458 - protein, 148 aa, Glycine max
  Coding DNA Sequence Number=SeqID_21680
  Homolog annotation: Hit_ID=Q1T493; Match level="QueryCoverage=68%, HitCoverage=20%, E-value=5e-08, Identity=28%"; Hit description =Nucleic acid-binding, OB-fold, subgroup
  Subcellular localization annotation: CTP_CleavageSite=70; ConfidenceScore=5.16e-01
AFASFASNHHDHHQNIKVICFYTVLTPIGQGSSQVSGSSQLSSKDVFLSKAKAKNISQINAISEITTIVMDNHSWCHPACSQCHKKADIETMSFTCPCGKDNDQPILRYRVEVMVNHKGEQTKFLLWDRECAELIGPSADEVNRLKID

SEQ ID NO: 138459 - protein, 97 aa, Glycine max
  Coding DNA Sequence Number=SeqID_21681
  Subcellular localization annotation: CTP_CleavageSite=53; ConfidenceScore=5.13e-01
MTMQNMQFHQETRASIQSLTNQMGQLATQLNQQQSQNSDRLPSESVQNPKNVSAITLRSGKQCQEPQLANEPAQPHSTPEKDVGSSGLRIIKKGGLN

SEQ ID NO: 138460 - protein, 622 aa, Glycine max
  Coding DNA Sequence Number=SeqID_21682
  Homolog annotation: Hit_ID=Q1SFC5; Match level="QueryCoverage=23%, HitCoverage=19%, E-value=9e-21, Identity=39%"; Hit description =Asp/Glu racemase
MRIFLSFDKFLPQHAPFISREVGPAWFTDYFPTVDPDNEEEVNEIWSFYLNPQILSCRTGVQSNYLGLVGYQPNLVSRQFGLSQIRPKSLFEDPQDFIRGANLSEKTFKKYLKISLDENYDLHPFEFNHSHFCTMGFVTWWEKYYSTRSIGDTTAMISRLESGFAQPTVENIRSSLQARGKAPMTKRSAETSRADVRPKKPTGVKIQEGKQEEKEEEERPLIRKRKLPTTSTKSADQTEAGNSQAQTPKKKKKAKQVEPEPSVAVEGGEPAKKKKKKTKSLKEQGDNQPVDIQPPSTDIGGTEVEAAPSVAEMGNPVENPDLPQEQPAIEVQQNVTAEEMPSWARTSPAPEANAVNAEEWGEGQGIGSSSPHGWAEVDGQYEPNQSDNTIPHESSQKSSSEGNFFDEDAIKEAEAGGSDIHPVSSTSKLSASIGIAEDTFIQMQNEDPAAALRLLLNTSQANTSSDKIPGASTPSDAEINSSVRQDSLLLKLSTEYALKDVLKSIEENPSTAFGHLNFLKKLHNPLTYDETLGKVIQIEAIIDQFASAVQKKRENGTRLDAQKQAHTLLLEKARAAQHEVERLTKEAKEGSSEIKDCDDNISSWEATITDLLFHVDDLRQKI

SEQ ID NO: 138461 - protein, 177 aa, Glycine max
  Coding DNA Sequence Number=SeqID_21683
MNLSKYDYHVIYECHTLISSGDLCLMTCDLSLVLVRCLAPIIRQFVKFQDMPENQKILMHNPKIESKCFCNASVSDSVEILHRSSSFFTVLHPFFVRSSFFNGLPSLGADVWGANTFPVRKYNSRTFHLKVRRSRLFRFFRRFPQINVGGDSARIPFVEHASRESRVALPPKGRLRQ

SEQ ID NO: 138462 - protein, 169 aa, Glycine max
  Coding DNA Sequence Number=SeqID_21684
  Gene Ontology: Mol. function=transferase activity, transferring glycosyl groups; Biological process=sucrose metabolic process
  Homolog annotation: Hit_ID=P13708; Match level="QueryCoverage=90%, HitCoverage=44%, E-value=6e-33, Identity=85%"; Hit description =Sucrose synthase
MSWGTLTLVDRLSGMVKIVDSIIQVVYILDQVRVSENEMLNRIKKHGLDITLRILIDVALELAKELQANPDLKTDHNKPIIFTMARLDRVKNITGLVMWYGKNARLCELVNLVVVVGDKRKESKDLEEKAEMNNMYGLIETYKLKDQFRWISSQMYARNNYGFNTISWI

SEQ ID NO: 138463 - protein, 55 aa, Glycine max
  Coding DNA Sequence Number=SeqID_21685
  Subcellular localization annotation: CTP_CleavageSite=31; ConfidenceScore=5.01e-01
MPISPCGSIGWDRAHKTPSGPGRAQQGPGVSSSGYGPLSVLQGARSPRQGHAIMT

SEQ ID NO: 138464 - protein, 118 aa, Glycine max
  Coding DNA Sequence Number=SeqID_21686
  Gene Ontology: Mol. function=transferase activity; Biological process= DNA integration
  Homolog annotation: Hit_ID=Q1T0C4; Match level="QueryCoverage=77%, HitCoverage=14%, E-value=1e-15, Identity=46%"; Hit description =Polynucleotidyl transferase, Ribonuclease H fold
MATYLLNILPNKVIVCLHVLFEENEFPFSKLHTSYSSTYDFPDNGLSPYVINHLQNQSTPYIQVQNHPSLAPAQSLGQPCSPNHANPSSPQLAQPTSSPPQLAQSTSTNPESSSSTLG

SEQ ID NO: 138465 - protein, 159 aa, Glycine max
  Coding DNA Sequence Number=SeqID_21687
MSLKFPYYPELVKVFYCNLKIQDGIISSEVHGISMIIDQSLFFSLTKLPSQGAPFEGTIVDDWKFDYSSHDARRMVCNDQAEMTGRLLARSLTFDNHIMHYIIVRILLPRSSNLAQASEEDLILMWAFLIGCQIDWAHLVRYRMHKALRADAPLPYHLI

SEQ ID NO: 138466 - protein, 667 aa, Glycine max
  Coding DNA Sequence Number=SeqID_21688
  Gene Ontology: Mol. function=two-component response regulator activity; Cellular component=nucleus; Biological process=two -component signal transduction system (phosphorelay)
  Homolog annotation: Hit_ID=Q6K8X6; Match level="QueryCoverage=94%, HitCoverage=89%, E-value=2e-93, Identity=38%"; Hit description =Putative response regulator 9
  Pfam annotation: Domain name=Myb_DNA-binding; Domain location=200 -250; Score=52.9; E_value=1e-12; Accession=PF00249.21; Description =Myb-like DNA-binding domain
  Pfam annotation: Domain name=Response_reg; Domain location=24-124; Score=62.5; E_value=1.4e-15; Accession=PF00072.14; Description =Response regulator receiver domain
  Pfam module annotation: Pfam domain module=Myb_DNA-binding::Response _reg; Domain location=200-250::24-124
  Subcellular localization annotation: CTP_CleavageSite=40; ConfidenceScore=5.63e-01
MDTVFGGLYILTLPSNSNSKFGFFFFARFANSYFFKVTTTNQAVEALKMLRENRNKFDLVISDVNMPDIDGFKLLELVGLEMDLPVIMLSAHGDTKLVMKGVTHGACDYLLKPVRIEELKNIWQHVVRRKNFDSRDQNKASNEEKAPNIAGEGSQGLRSENSADQNKRLGKKRKDQSEEEEEDGEENGDDEDPSAQKKPRVVWSVELHRKFVAAVNQLGLDKAVPKKILDLMNVEGLTRENVASHLQKYRLYLKKAAQQANMVAALGGSDSYLRMGSIDGYGDFCTSSGSGRITNTTSPSYASTGIFSRLNSPAALNMRAISSSALIRPVQSQNINCSLNTLGNIQPSVFPANHSSSLLQGIPTSIELNQSKQSNCTTGISQLSQVDSSGFAVASGFPDSRATVNGPNNSLPCVSNNHIMLQGNPQQMHGPGAFRNQSSVRAASLCAESFDAGLCSSSNLLDYNRCNENWQNAAQLSKFPAHSLPLCEAFSNDQLPPTRINVSNSRTHIVNSPVDFSSRMGISVPLEDTRNELACQEGLIGNIVKPSSYTPQQRWEEHKLDYNQNVGHSFNPVNSHASSSGVKSSMGHGLNQNNTICSNRVDASLVGQLNGASPSISRCTEVEKFSSDIRLKPNEAYILEQMKSQDGFMQNTFGTLDDIMGAMVKRV

SEQ ID NO: 138467 - protein, 144 aa, Glycine max
  Coding DNA Sequence Number=SeqID_21689
MTGSKRVEEDSNKNKGSSLKATNDVLTEDDQAPKKIEIPTGENQVHDKEGNIDISLEEELLSVDALTVIILELPVEETLHTSDKPKPLELKSKKVFKFSDLVVDELCKEMESFLNVFNNAFEAHKLCDQYAFDIAEIESSTEQD

SEQ ID NO: 138468 - protein, 162 aa, Glycine max
  Coding DNA Sequence Number=SeqID_21690
MAKESAQTLMDYLTFTLGKSNTIILLDLSEEVNFDFKHGFSQMLENNTFSGTHEAPIQNLKKFLKISNTVRQNCVLAEYVNLYAFIFSLNGRDRRNIKKGVHQIEKDESQTELGTQIQTLTLKIGSLMRAQAQMPINTPHFQTSEKCGIVHGPGECVVWVMH

SEQ ID NO: 138469 - protein, 101 aa, Glycine max
  Coding DNA Sequence Number=SeqID_21691
MPSRLINFVTNTLLTLLKLSLRRNKIETNLFKLKKDSRKLRKISCYDTRTNRDIMEELKVLLEKQRQLKYAKKEFMNALSTWIKAFNDKKKNHYVKYAKSL

SEQ ID NO: 138470 - protein, 77 aa, Glycine max
  Coding DNA Sequence Number=SeqID_21692
MKNFHRIAYGSVTEALRLDFSSRKCIGKKGGAYQGGEGEANLDGIMQGPQRWNMTTHHNFGVGMWHDDPTCGTISVA

SEQ ID NO: 138471 - protein, 148 aa, Glycine max
  Coding DNA Sequence Number=SeqID_21693
MDVSLACQISRGVRHTHSTFANVSHMEWARTGVTVMLILWDREVISIGGSPSKDTRRGASDSESSSSKRVRASHRTGWGAAFHYYRGAYPDYCEPPPICFRGCTGSPASHSTSSLIPPCLKSYNEDLLTLVERVDKAIFKQLLASLEA

SEQ ID NO: 138472 - protein, 111 aa, Glycine max
  Coding DNA Sequence Number=SeqID_21694
  Subcellular localization annotation: CTP_CleavageSite=26; ConfidenceScore=5.25e-01
MIRLKGLTSHFNLQLSHSSRLPNLTSDNTRPYLGVNKLVTLCLLRLLPKTFDRLPRRRTIYFDIDNLFWPQLRAWGLMYCPGPTKSMWHLTWHSETRIHPPCQPCYKSIYA

SEQ ID NO: 138473 - protein, 135 aa, Glycine max
  Coding DNA Sequence Number=SeqID_21695
  Homolog annotation: Hit_ID=Q5N9U4; Match level="QueryCoverage=50%, HitCoverage=15%, E-value=5e-08, Identity=47%"; Hit description =Endosperm specific protein-like
MTSQKNQVSATDDMSLSARRKFSAICRSAVALSDFFGIVTLLYEGEECGVGGGVRRRGADLDDARLGVAGEVHGVEVVNGAASGLKEHGDELAGGGEGAEVGLREELEEDNEERGAVREIRDEGYSGVKEGDELG

SEQ ID NO: 138474 - protein, 51 aa, Glycine max
  Coding DNA Sequence Number=SeqID_21696
MTITSTHSGDRWRWTKEFYQQNLLVPRDEKLDIYCGSGHNGEILQNKVPAG

SEQ ID NO: 138475 - protein, 66 aa, Glycine max
  Coding DNA Sequence Number=SeqID_21697
  Pfam annotation: Domain name=zf-CCHC; Domain location=28-45; Score =11.3; E_value=0.013; Accession=PF00098.13; Description=Zinc knuckle
MEEKNESKWKNSSKKVFMERNDEDKSSIICYEYNKPEHFKPECLELEKFHDKEYYKSKEKKGLMST

SEQ ID NO: 138476 - protein, 109 aa, Glycine max
  Coding DNA Sequence Number=SeqID_21698
MVKMRQQHFKSNGLLCEVFRDVTKPLMYLEPSKRVQTHVPTQPTSGSGQDGLKKCGLVVGQARPFLQDSTLSELDWVDPYRVGLAQWIGSIRFDNYKCTNIQNLSFWGS

SEQ ID NO: 138477 - protein, 66 aa, Glycine max
  Coding DNA Sequence Number=SeqID_21699
  Homolog annotation: Hit_ID=UPI0000196C59; Match level="QueryCoverage =45%, HitCoverage=3%, E-value=1e-07, Identity=86%"; Hit description =triacylglycerol lipase
MANSLAARDERKALPGFKAHLYNFLKGEKELIEKLLQTEINIFRSIRDGSALMQHMEDFYYITLLE

SEQ ID NO: 138478 - protein, 54 aa, Glycine max
  Coding DNA Sequence Number=SeqID_21700
MIQQRFALTRLASNSLTWPTKTRKMSAMQYAQYSLQMELIRHDELLETARRKTY

SEQ ID NO: 138479 - protein, 71 aa, Glycine max
  Coding DNA Sequence Number=SeqID_21701
MKKKGVLVDIRVIEIVLEIVEEIGVGEFVVGGDDALGEDLERVDVVHVHCHRRYLLVHLSEQGQKARKEKK

SEQ ID NO: 138480 - protein, 94 aa, Glycine max
  Coding DNA Sequence Number=SeqID_21702
MRRALRSGDGRKWKKVRQERGGGGWGRRGHGVVEEGKDYGVGELEVLWGWRREGGEFAEDSREGLPGMGTHWFSFSLQKRKGGGKIMGKRVQEF

SEQ ID NO: 138481 - protein, 420 aa, Glycine max
  Coding DNA Sequence Number=SeqID_21703
  Gene Ontology: Mol. function=DNA binding; Cellular component=beta -galactosidase complex; Biological process=DNA integration
  Homolog annotation: Hit_ID=Q1S1B7; Match level="QueryCoverage=92%, HitCoverage=65%, E-value=2e-52, Identity=34%"; Hit description =Integrase, catalytic region
MTTRVKAGVFKPKTYASYKEGSYDHTVEPHIVKEAMAKPEWLKAMKEEHDALIRNDTWSLVDPPPGCKPIGCKWVFKSNFNVDGSFQRHKARLVAKGYHQREGFDFKETFSPMIKPTTIRTILSLVVFLAYSSSGYQQYLFAWRPSRNCIYDSTTRLCFIQQTQSMQIAQSSLWLETGPQVLVSQTQFDFEVKHYSDGGILLSQSKCIRDLLHKTNLLDSKSQPTPMVFGLKLTVDGSFSLQDPTHYRSIVRALQYITVTRPEISFSVNKTLMIESLPQVTVCILDQILYHGLLGSKLLFLEVALRLSIEDLLLSLQIFYGCRICSESCVPVALPRIYCDNLGVVHLATNPVMHSRTKQFESDLHFVHNKVLSHELVVVHLPAEFQVANILTKAVSNPQFTIFRSKLKVSSASTMSLKGV

SEQ ID NO: 138482 - protein, 162 aa, Glycine max
  Coding DNA Sequence Number=SeqID_21704
  Gene Ontology: Mol. function=solute:hydrogen antiporter activity; Cellular component=integral to membrane; Biological process =regulation of pH
  Homolog annotation: Hit_ID=Q1SCX4; Match level="QueryCoverage=57%, HitCoverage=17%, E-value=2e-09, Identity=29%"; Hit description =Probable Na/H antiporter [imported]-Arabidopsis thaliana
MADFRPPYSISNLPPDAIPELACYNSTVDLSDNIWKRGNVIGEAVPLLSIQIAYIVLLSSIFHRIFKPFHLPLMVSQILNDIVLRSSKKAITIALVCILIPMLAGASFLALEHRVSGGSPNPTVSTKGISFVVQFLLSRGFQSLLGSYQGSRSSTEGLAKMP

SEQ ID NO: 138483 - protein, 449 aa, Glycine max
  Coding DNA Sequence Number=SeqID_21705
  Homolog annotation: Hit_ID=Q1SSZ2; Match level="QueryCoverage=99%, HitCoverage=100%, E-value=1e-146, Identity=60%"; Hit description=C2 calcium/lipid-binding region, CaLB
  Pfam annotation: Domain name=C2; Domain location=11-95; Score=55.2; E_ value=2.2e-13; Accession=PF00168.20; Description=C2 domain
MSNVLACYQLLELNVISAQDLAPVGRSMRTYAIAWIDPDRKLSTRVDSQGGTNPTWNDKFVFRVDEDFLYDEESVITIDIYALHWFRDIHVGSAQVLSGDLFPPPTQPQKNTYKSTGMQFMGLQVQRPSGRPKGILNIGAAIIDSSMRSMPLYTQNSPAVGYSHDDLNKPSHQAKSELRRTKSDSSSMLGSEAIAPEHQAKARKGKASSQITPSEVSTKSKNKTSSTLSDSNVKATPKRGKLGRKKTKITSHDSQNNLNARLYVDYQVKSTPKREFQNTPSRTYNNNNNNYKGNLRATPLHAFAVTNAALEYGTPYRSNLGRRPFMTDSELGPSASEVAAVVARLPIEEGENSTVGGWSLDDSVEGLQPKVERWQTELPPVYDGSERSNMTTSSKKGKHSRRQTDGGNGLFSCFSVICGVECSIVCGGGDNNKKNRRRRVQSVDNESFL

SEQ ID NO: 138484 - protein, 156 aa, Glycine max
  Coding DNA Sequence Number=SeqID_21706
MTDKVFQERNDFLNWDQRTGKEYEFVVFIHKSEVIVSNRDLAFMNALKTVFPSSPNLLCTDSSACDCALRVTHGLLRACELNEFINTYGYIPLKSIHVTLGGDLSLTHKVDALCKRFSELDVFGKITLKTKLCELEFLDTTSMCSPAMNIKTKGAP

SEQ ID NO: 138485 - protein, 70 aa, Glycine max
  Coding DNA Sequence Number=SeqID_21707
MWTTTAFEEVTETHGLRKNTSFRLPPHYGISRIAQACFLLISKTSRDFIYCATKDTKYLKAANQRLHVIK

SEQ ID NO: 138486 - protein, 94 aa, Glycine max
  Coding DNA Sequence Number=SeqID_21708
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=25%, E-value=5e-12, Identity=43%"; Hit description =Integrase, catalytic region
MVDEQRIVIKNQTLGHFMELSDNIHKENDDSVGSMNGDVSMKGRQTDDEVEGKIFLWPERNRQGTEQPNDLSSLILCMLTIHAYDCQWVMSGTP

SEQ ID NO: 138487 - protein, 59 aa, Glycine max
  Coding DNA Sequence Number=SeqID_21709
MVQVGDRLKQVCKYRRWPEWLAAQRAPQCGVRSPYVVTRGPQVYPLNLPNTIPLNIYPR

SEQ ID NO: 138488 - protein, 188 aa, Glycine max
  Coding DNA Sequence Number=SeqID_21710
  Gene Ontology: Mol. function=chromatin binding; Cellular component =chromatin; Biological process=chromatin assembly or disassembly
  Homolog annotation: Hit_ID=Q1SAV4; Match level="QueryCoverage=98%, HitCoverage=51%, E-value=3e-34, Identity=44%"; Hit description =Integrase, catalytic region
MSSVYHPQTDRQIKVLNRVIEQCLRAFVHKKPSSWGKASPYEITFGKKPFNFPQYLAGTTNLDGVDDLLTNRESVFTKFKKKLLKAQAIMKQITDTKYKDVNFNEGDRVMVKLLPHCQSIVSRNHASYSKLAKRYYGPYQILECIGKAAHILNLPEVVVFTMYFIVPYSSHFIIPPGTPSLLCHYQPL

SEQ ID NO: 138489 - protein, 112 aa, Glycine max
  Coding DNA Sequence Number=SeqID_21711
  Gene Ontology: Mol. function=protein dimerization activity
  Homolog annotation: Hit_ID=Q2HTZ2; Match level="QueryCoverage=85%, HitCoverage=73%, E-value=1e-19, Identity=47%"; Hit description=HAT dimerisation
  Pfam annotation: Domain name=hATC; Domain location=6-87; Score=64.6; E_value=3.2e-16; Accession=PF05699.5; Description=hAT family dimerisation domain
MTDGNHILDFMEREHGQSPNFDILNWWKLISTKFPILGNIAREVLAMSTSTVPFESTLGTRGWVLDQYLNYLSPKIVEALVCLEDWLKGSPTTFPSKEDLEEIEKIEQGDIK

SEQ ID NO: 138490 - protein, 231 aa, Glycine max
  Coding DNA Sequence Number=SeqID_21712
  Homolog annotation: Hit_ID=Q4U0C9; Match level="QueryCoverage=48%, HitCoverage=57%, E-value=2e-24, Identity=44%"; Hit description =Stress responsive protein
MSFPFNHSHRRDDDDDDDDKRPAVYPPPGNTFNNPPPPFYGVHQPETHVSHVFNNSNYSAPPPPPPSHNHHHDSFTHGGGSTVHHTPHNNAPPTTSVHHLSHQVNTGVLSSKPTVRVFTKANPNFSLTIRGGQVILAPSDPTNEYQHWYKDEKYSTRVKDEEGCPAFSLINKATGEALKHSIGATHPGICVLNWYVMSVTAIGCQSVILMFCYKHDGFVSFSVSNNVEKNG

SEQ ID NO: 138491 - protein, 221 aa, Glycine max
  Coding DNA Sequence Number=SeqID_21713
  Homolog annotation: Hit_ID=Q9AVH2; Match level="QueryCoverage=20%, HitCoverage=15%, E-value=4e-18, Identity=95%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLLSLCLGGGSSCHTWQTQGHTHTHTHTLTQAQGGGGLGRFVGDLEGRDESKRQGLNLSGSWQQGHSATYNTPSRLIRLTRVTNGTCLWGAEAPYCWSANGRRGARVASSPDSDLEAFSHNPTHGIFAPLAFQPSAMTNCANQRFLSY

SEQ ID NO: 138492 - protein, 92 aa, Glycine max
  Coding DNA Sequence Number=SeqID_21714
  Gene Ontology: Mol. function=transcription regulator activity; Cellular component=nucleus; Biological process=regulation of transcription, DNA-dependent
  Homolog annotation: Hit_ID=Q9FK48; Match level="QueryCoverage=95%, HitCoverage=10%, E-value=2e-36, Identity=74%"; Hit description =Similarity to transcription regulator
  Pfam annotation: Domain name=NOT2_3_5; Domain location=1-87; Score =34.6; E_value=9.3e-09; Accession=PF04153.8; Description=NOT2  NOT3 NOT5 family
MWAYIHFFLQNTYQQYLAAKELKKQSWRYHRKYNTWFQRHEEPKVATDEYEQGTYVYFDFHIANDDMQHGWCQRIKTEFTFEYNYLEDDLLV

SEQ ID NO: 138493 - protein, 155 aa, Glycine max
  Coding DNA Sequence Number=SeqID_21715
  Gene Ontology: Mol. function=hydrolase activity, hydrolyzing O -glycosyl compounds; Cellular component=membrane; Biological process =carbohydrate metabolic process
  Homolog annotation: Hit_ID=Q6NKW9; Match level="QueryCoverage=96%, HitCoverage=29%, E-value=2e-37, Identity=54%"; Hit description =Putative glucan endo-1,3-beta-glucosidase 8 precursor (EC 3.2.1.39) ((1->3)-beta-glucan ...
  Homolog annotation: Hit description=endohydrolase 8) ((1->3)-beta -glucanase 8)
MEKNWVLRWIFVVGLMCLSVEGIGVNWGTQATHKLPPDTVVQMLKDNGIKKVKLFDSDDSTMSALAGTGIEVMVAIPNNQLAEMNDYGRAKQWVKKNVTRYNFNGGVNVKEALWIGRFPRIRSFFLVVMPDKSFVTLYVAEEKDICSKNNFAVLG

SEQ ID NO: 138494 - protein, 281 aa, Glycine max
  Coding DNA Sequence Number=SeqID_21716
  Gene Ontology: Mol. function=nucleic acid binding; Cellular component= intracellular; Biological process=DNA integration
MGCYNNEIFSPVVRRTSTCVLLDLVTTLDMELEHLDVKTVFLHGRLEEDILMQQLEGFKVKGKENFVYTLKRSFYGLNKVVDGSYIYLKEYIQKVLNPFESCRKLVCTPLTAFIRLTKPNATQSKSEREYMSRNPYASVVGSLTYAMMSTKLDLAKAVRCIGDISCVPAGYLDSDYAANFDARRSVTRYAFIIGNSLVSLKATLQLMIVLYTTKAKYMVLVEETKEGIWLKGLISNLMFPQDKAIIYCDSLSATCLAKDQAHHGRSKHIDHFIHTKKHIAI

SEQ ID NO: 138495 - protein, 279 aa, Glycine max
  Coding DNA Sequence Number=SeqID_21717
  Subcellular localization annotation: CTP_CleavageSite=72; ConfidenceScore=5.65e-01
MASTNNFQPPSPPPPLFSSTLVADSIPQPILVSQPMILTPVAAASLSLQSHPSTLFSHAIYAKLTNRNYWLWCQQVEPVLKGVTISLDEHLDVVLEGLPREYVSTMSLICRASTSNNSAYVQPIQVVQNFQSSSNGSSTTQNFDAQANITQGNYNNSNNTNNGNIFFNFDQVGCGYGGRNGGRSNVGRGDGRGRGSDSQPIPTPLTILPTIPIFVGAQSSQLSTASIQHQHSSYHPTPEPSISPPTTFAFASVSEPKPILEPVNPSPIITFSRLSPEVT

SEQ ID NO: 138496 - protein, 270 aa, Glycine max
  Coding DNA Sequence Number=SeqID_21718
  Gene Ontology: Mol. function=RNA-directed DNA polymerase activity; Cellular component=extracellular region; Biological process=RNA -dependent DNA replication
MESSMAYQGLPITIGRSKTQVFQSVREKSSAGQQLILEIGNMQQLTHDQSFKSKTFSPFESYGGRSWTLAEFYMGKYSFSLGYPRGRTWDEQKIRRLFPQNIAANILDIPLRINSSVDQLTWKHTNDGFYPVKSGYNQVFQKNYRCKASSISNTGTLWQKKYGRFKWNQNAKALFGEYAKIVFVRGNLQTKMDIDHVCPCCGEEYESLEYALLLRKEVQPIWFASPVSGRMRNAHQSSSNQWLVDCLQLQDEEFMKQIFGIIWSILLRNE

SEQ ID NO: 138497 - protein, 74 aa, Glycine max
  Coding DNA Sequence Number=SeqID_21719
MQTLLSSHLQPAVPMLAHDMPPIFFPDVVLHTSLFPTGKITLLEPATLEEWRKRKMERARQRELEKNGTTSSQA

SEQ ID NO: 138498 - protein, 150 aa, Glycine max
  Coding DNA Sequence Number=SeqID_21720
  Homolog annotation: Hit_ID=Q1T283; Match level="QueryCoverage=70%, HitCoverage=52%, E-value=4e-08, Identity=29%"; Hit description =Nucleic acid-binding, OB-fold
YRLEVMINHGDESTKFLLWDRECSELIGQSANAVNKLKIEDGDVDLTASPQALDKLLGYELAFKIKVQPKFRNSAVLKCSTDSSLINVVMDMLADAEQSMSVTADHDQLLGLPLTPTKRQTFQDCDDEAGSSQISPAQLSSNKLKKHGTI

SEQ ID NO: 138499 - protein, 112 aa, Glycine max
  Coding DNA Sequence Number=SeqID_21721
  Gene Ontology: Mol. function=nucleic acid binding; Biological process= DNA integration
  Homolog annotation: Hit_ID=Q1SS67; Match level="QueryCoverage=88%, HitCoverage=50%, E-value=6e-13, Identity=33%"; Hit description=Zinc finger, CCHC-type
MGSTKYEGLVKDLEGEVKLEKLMFEKDKKAMLEKPHNAIILSLGDKVLIQVFKEKTIVGVWAKFDRLYMTKSLMMRIKLCYLLKTHVHFKETLLFGRESLTLDDVQPSLNSK

SEQ ID NO: 138500 - protein, 124 aa, Glycine max
  Coding DNA Sequence Number=SeqID_21722
MLRQLIPPHRMTVRLRDNSNCDILITVWEDYAIQLHDAIDKNLLLQEPLVVMLTLGKIKDATDKYPLSVQNIKFGSKLYVNADITEIHEFRQSLSAPFYFGGIINDKDGSQSQSSQSNVVENFL

SEQ ID NO: 138501 - protein, 88 aa, Glycine max
  Coding DNA Sequence Number=SeqID_21723
  Gene Ontology: Mol. function=transferase activity, transferring hexosyl groups; Biological process=carbohydrate metabolic process
  Homolog annotation: Hit_ID=Q1T0K1; Match level="QueryCoverage=87%, HitCoverage=19%, E-value=2e-35, Identity=87%"; Hit description =Probable UDP-glucose,sterol glucosyltransferase [imported] -Arabidopsis thaliana-related
MGLQEPTYEFPHPLERVPQSASYWLSYIIVDLLIWWGMRRIINKFRKTTLKLAPIAYFSMYRGSISHLPTSYMWSPHVVPKPSGMDKD

SEQ ID NO: 138502 - protein, 96 aa, Glycine max
  Coding DNA Sequence Number=SeqID_21724
ALKGLDDTPQPKSKAGARWIVIKCNRQKGSTECGYYVMYWMSMIILGIFKNNWEAYFNDVRPLEASRLKEIIKAFDTFGLGKSLTNEGFCKNELKL

SEQ ID NO: 138503 - protein, 178 aa, Glycine max
  Coding DNA Sequence Number=SeqID_21725
  Gene Ontology: Mol. function=protein binding; Cellular component =ribonucleoprotein complex; Biological process=rRNA processing
  Homolog annotation: Hit_ID=Q6ZJR6; Match level="QueryCoverage=84%, HitCoverage=68%, E-value=4e-56, Identity=60%"; Hit description =Putative U3 snoRNP protein IMP4
  Pfam annotation: Domain name=Brix; Domain location=86-171; Score= -30.0; E_value=0.048; Accession=PF04427.8; Description=Brix domain
MLRRNIRLRREYLYRKSLEGKERLLYEKKRKIREALQEGKPIPTELRNEEAALRRAIDLEDENTAVPRTHIDDEYAYAAEKDPKILLTTSRDPSAPLQQFVKELSFVFPNAQRMNRGGQVTRHEIKDKKAIGTMPEAYPHLILNNFSTKVFEIRNCITEILIGIDLLGGFMGGGARQL

SEQ ID NO: 138504 - protein, 78 aa, Glycine max
  Coding DNA Sequence Number=SeqID_21726
MFVCVCCKELVCGTRGRCKDLVRGSRVNGDTAFLIIKLVMQSYPARPLDRKLEVDWARDTREGPRILMSLTVDFGPMG

SEQ ID NO: 138505 - protein, 126 aa, Glycine max
  Coding DNA Sequence Number=SeqID_21727
  Gene Ontology: Mol. function=endonuclease activity
  Homolog annotation: Hit_ID=Q01GM1; Match level="QueryCoverage=66%, HitCoverage=18%, E-value=1e-09, Identity=37%"; Hit description =Homology to unknown gene
MVILPFKYCSSHENLTIDHVMPTALGGEWTWENLNWRIRNVIGIGFESQGLLSFNLHYLPQVTACAKCNCKKGRKTLEEAKMKLIKPPKVPKDYDILAIPLTAAALRMLTLRKGTPEEWRQYLRSP

SEQ ID NO: 138506 - protein, 115 aa, Glycine max
  Coding DNA Sequence Number=SeqID_21728
MVPQLLQVVKRRIVKNNLSRKNILFRDNYTCHTINRNSFFPSPSKSRVKEEGCVRPWAANIKLNISNTLVGQMNWERIQGNEFRQNPTRACSIMKRETNGGEIFLLVLFAFTQAI

SEQ ID NO: 138507 - protein, 128 aa, Glycine max
  Coding DNA Sequence Number=SeqID_21729
  Homolog annotation: Hit_ID=A0EXV6; Match level="QueryCoverage=40%, HitCoverage=32%, E-value=2e-11, Identity=74%"; Hit description=LRR repeat protein
MPLGQNLVFSNLKVFVYPCQQSEQRFNPKVVKSTQEAADAGSVMESSQCVPISYILDISRVKMSVFVSCSMFVLHRLFHLQALKGTGVSTTIMALQHDHQKLEIIGFPFGFDAVAGFLITIAICFTSG

SEQ ID NO: 138508 - protein, 328 aa, Glycine max
  Coding DNA Sequence Number=SeqID_21730
  Gene Ontology: Mol. function=oxidoreductase activity; Cellular component=membrane; Biological process=metabolic process
  Homolog annotation: Hit_ID=Q3LHL1; Match level="QueryCoverage=75%, HitCoverage=94%, E-value=6e-83, Identity=64%"; Hit description=Short chain dehydrogenase
  Pfam annotation: Domain name=Epimerase; Domain location=19-261; Score= -29.6; E_value=0.00031; Accession=PF01370.11; Description=NAD dependent epimerasedehydratase family
  Pfam annotation: Domain name=KR; Domain location=18-209; Score=-24.8; E_value=6.5e-06; Accession=PF08659.1; Description=KR domain
  Pfam annotation: Domain name=adh_short; Domain location=17-192; Score= 100.1; E_value=6.4e-27; Accession=PF00106.15; Description=short chain dehydrogenase
  Pfam module annotation: Pfam domain module=Epimerase::KR::adh_short; Domain location=19-261::18-209::17-192
MASSSESQSQSKPLQDRVAIVTGSSRGIGREIALHLASLGARLVVNYTSNSAQADSVAAQINAGSATTTPRAVVVQADVSDPAQVKSLFDSAERAFDSPIHILVNSAGVIDGTYPSVADTTVESFDRTFAVNARGAFACAREAANRLKRGGGGRIILLTTSQVVALRPGYGAYAASKAAVEAMVKILAKELKGTQITANCVAPGPIATEMFFEGKTEEVVNRIVQESPLGRLGETKDVAPVVGFLATDASEWVNGQIVRVNERASKPWWWNYHIIVHIIDGCFEAKTHTPVKEQGTKITAKCVAPTGPIATDMYFDEQVKGNCRVCTR

SEQ ID NO: 138509 - protein, 39 aa, Glycine max
  Coding DNA Sequence Number=SeqID_21731
MSEVFVMRSMRLTFSSGVICLIMVVAIKLVNPEQSPTTN

SEQ ID NO: 138510 - protein, 90 aa, Glycine max
  Coding DNA Sequence Number=SeqID_21732
  Gene Ontology: Mol. function=sugar binding
  Homolog annotation: Hit_ID=Q4U0C9; Match level="QueryCoverage=83%, HitCoverage=38%, E-value=1e-28, Identity=69%"; Hit description =Stress responsive protein
VRLIPYKPDYLDESILWTESRDLGDGHRAIRMVNNVHLNVDAFHGDKNSGGVRDGTTIVLWDWNKGDNQQWKILPYCKFSSILLPFCGSF

SEQ ID NO: 138511 - protein, 257 aa, Glycine max
  Coding DNA Sequence Number=SeqID_21733
  Gene Ontology: Mol. function=sugar binding
  Homolog annotation: Hit_ID=Q4U0C9; Match level="QueryCoverage=58%, HitCoverage=76%, E-value=3e-58, Identity=64%"; Hit description =Stress responsive protein
  Pfam annotation: Domain name=Ricin_B_lectin; Domain location=57-202; Score=6.2; E_value=0.0077; Accession=PF00652.12; Description=QXW lectin repeat
MGGSFKNYDNQSHEVSEEESENYPYHHHAPLVMHVNVNNNSHSNIATTTSALSNKRSTVRILCKAAPNFSLSIRDGKVILAPADPSDAYQHWYKDERYSSMVKDEEGYRAFCLVNKATNEVMKHSIADSHPVRLVPYNPEYLDESIMWTEASDLGNGYRAIRMANNIHLNMDALKGIKELGGVQDGTIVALWKWNDGDNQKWKVVPYGDEDSAIDADHSLMRRLDRLELNMQAMFDAQQKYLEGLSKRFGNEKLSGY

SEQ ID NO: 138512 - protein, 488 aa, Glycine max
  Coding DNA Sequence Number=SeqID_21734
  Gene Ontology: Biological process=nuclear mRNA splicing, via spliceosome
  Homolog annotation: Hit_ID=Q2R240; Match level="QueryCoverage=99%, HitCoverage=86%, E-value=2e-72, Identity=35%"; Hit description =Expressed protein
MRTIVKTLASSAGSFPLQQACSKVVPAVARYGIDPSTPEDKRRHIIWSLCTPLSNSLSSSQESLTSGAALCLKALVDSDNWRFASDELVNRVCQNVAAALDGKSGQTNSHLGLVMSLARRNALIIEAYARLLIQSGIRILNAGLVEGNSQKRLSSIQMINYLMRSLDSRSIFSEIELIIEEMDKCQSDKMAFVQGAALEALQTAKRIASDKKPRYAKSPASVTGSNFSRREEDYMEGENTSSGDGEHTPSSLTPESRTFDFFPGYEYVDSPISSNFGRRSVTRKLWRKESALLEHSLIPEFSDGEGDYTEEFAGFMGRNTSHGVSKSTTTSPLRSRTQATVDSIKIFETPRKLIHSLQDSSDLSLGCSKKEQNGRYRSLSSDDNMEWSPSCKYNQNGFSDDMNKCDSEVIEGCAEVEFQGGSESVSSTNDNNILVDVEKQMHTKVVPENRNAKTKYKLVCGLSCVLLAVATPLLWINNQDEGHYLVPT

SEQ ID NO: 138513 - protein, 667 aa, Glycine max
  Coding DNA Sequence Number=SeqID_21735
  Gene Ontology: Mol. function=protein serine/threonine kinase activity; Biological process=protein amino acid phosphorylation
  Homolog annotation: Hit_ID=Q9FK52; Match level="QueryCoverage=99%, HitCoverage=100%, E-value=0.0, Identity=68%"; Hit description=Casein kinase-like protein
  Pfam annotation: Domain name=Pkinase; Domain location=139-363; Score=- 26.8; E_value=5.8e-07; Accession=PF00069.15; Description=Protein kinase domain
MPELRSGARRSKRLGDLQPGPLPVDQGENWQQPAAPNRTRRRVGGGRGRGGNATAVGKGPSPAVPTRRTAAGRGRGARLIDLDPEPCEVLPEPVALGAPEPVYNNVEVVANNNIVMEGGSGDKVAGAEEEPSTTPVPERGGFGQVYVGRRLSGGSDRTGPDAVEVALKFEHRNSKGCNYGPPYEWQVYRMSPNMVACIAVEAISILEKLHLKGFVHGDVKPENFLLGQPGSAEDKKLYLIDLGLASRWKDASSGLHVDYDQRPDIFRGTIRYASVHAHLGRTGSRRDDLESLAYTLVFLIKGRLPWQGYQGDNKSFLVCKKKMATSPELMCCFVPAPFKQFLEAVTNMRFDEEPNYAKLISLFESLIEPCTPLRPIRIDGALKVAMVGQKRGRMLINLEEDEQPKKKVRLGSPATQWISVYNARRPMKQSLLNSSIDIKNMRMEGDVHTSYTRLRQHVDKGIEDGLYISCVASAANLWALIMDAGTGFSSQVYELSPAFLHKDWIMEQWEKNYYISSIAGAVNGSSLVVMSKGTPYTQQSYKVSESFPFKWINKKWKEGFHVTSMTTAGSRWGVVMSRNAGYSDQVVELDFLYPSEGIHRRWENGYRITSMAATSDQAAFILSIPKRKLLDETQETLRTSAFPSTHVKEKWAKNLYIASICYGRTVC

SEQ ID NO: 138514 - protein, 84 aa, Glycine max
  Coding DNA Sequence Number=SeqID_21736
MDAPSNLLIFVELPHRPRNRRLMQSLPSNFTPKNSWSRCWFWHGQWSYVATMRWGARKGKPYKVHNEKSWYEVGSHRLYIRSMQ

SEQ ID NO: 138515 - protein, 38 aa, Glycine max
  Coding DNA Sequence Number=SeqID_21737
GGLFLKGTRQWGWRVGHVAAPGGLASGVGELLPFVRTT

SEQ ID NO: 138516 - protein, 214 aa, Glycine max
  Coding DNA Sequence Number=SeqID_21738
  Gene Ontology: Mol. function=protein dimerization activity; Biological process=transposition, DNA-mediated
  Homolog annotation: Hit_ID=Q1SIN2; Match level="QueryCoverage=92%, HitCoverage=32%, E-value=2e-23, Identity=34%"; Hit description=Zinc finger, BED-type predicted
  Pfam annotation: Domain name=hATC; Domain location=107-189; Score =84.8; E_value=2.7e-22; Accession=PF05699.5; Description=hAT family dimerisation domain
MAENMKAKFDKYLDIDGGNINYPVVVAVFLDPRYKWNYIEFYFNSMYTKERTVDYVEWHPVPIDTHDVSSSEKKVTQSLRGGGGRANIMDEYKLWVRKLQGKLQKNELERYMEDRPKFDYPGFDILNWWRIMTTRYHAFSRVARDILAIPVSTVSFDSVSSTGGCVLDPYHSLLSPNTAEALICPQNWLNPFTNDSGLDPQLVNVTPLPHTYMY

SEQ ID NO: 138517 - protein, 322 aa, Glycine max
  Coding DNA Sequence Number=SeqID_21739
  Gene Ontology: Mol. function=heat shock protein binding; Biological process=protein folding
  Homolog annotation: Hit_ID=Q9FK56; Match level="QueryCoverage=59%, HitCoverage=68%, E-value=1e-21, Identity=35%"; Hit description =Arabidopsis thaliana genomic DNA, chromosome 5, P1 clone:MRG7
  Pfam annotation: Domain name=DnaJ; Domain location=127-162; Score =9.3; E_value=0.00055; Accession=PF00226.21; Description=DnaJ domain
MAWEWNSLKEINNKKVVTRDFCGKTSTGGITRAERQQILGSRMGKWGKDGEVVEDEPVFGDDSLTWGIVGDAIGVGDPARLTRQHTRLTTVAPIEEEKEEEHIFNDGEQEMRKKLEVEIVILFKESLYHPDVSKDPQAAELFKSIHDAYKVLSNEAARVQYDQELQFGHKPYREKWSYGPEFEDQARFYSETDEEEDEVVDLDEERGSLVEVLRSAFVSLFLLQTPGSRFSLTFSSLTALFDKKLDTGYKMGYIITWILGGRGGILLTLCLLVASWVCGKTVVAFVVVAIWVGSYLARYAPLPQGALLALLYMSIKLQSDLI

SEQ ID NO: 138518 - protein, 102 aa, Glycine max
  Coding DNA Sequence Number=SeqID_21740
  Homolog annotation: Hit_ID=Q1SRN1; Match level="QueryCoverage=73%, HitCoverage=5%, E-value=7e-14, Identity=45%"; Hit description =Integrase, catalytic region
MATSNPSPSAPQSFPNLIAEKLDDSNYLHWKQQIEPVIKSHKLQRFVVNPSIPQRYLTDEDRIANKVNPAYEAWEVQDQTLLTWLQSTLSKSILSRVIGSIH

SEQ ID NO: 138519 - protein, 218 aa, Glycine max
  Coding DNA Sequence Number=SeqID_21741
  Gene Ontology: Mol. function=transferase activity, transferring phosphorus-containing groups; Cellular component=chloroplast; Biological process=sulfate assimilation
  Homolog annotation: Hit_ID=Q9SRW7; Match level="QueryCoverage=99%, HitCoverage=99%, E-value=4e-71, Identity=60%"; Hit description =Putative adenylylsulfate kinase
  Pfam annotation: Domain name=APS_kinase; Domain location=29-172; Score=228.2; E_value=1.8e-65; Accession=PF01583.10; Description =Adenylylsulphate kinase
MATLSNSTNIFWQDCQVGRLERQKLLNQKGCVVWITGLSGSGKSTLACSLSRELHSKGKLSYVLDGDNLRHGLNKDLGFKAEDRAENIRRTGGVCKRKYRQIVHTKWEHITMPRPKLIFVFMNMPLELCEARDPKGLYKLARAGKIKGFTGIDDPYEPPINCEVCVHGATKVVYTFLLPCMVCYVHIEIKQENGDCPTPTLMAGQVVTYLENKGFLES

SEQ ID NO: 138520 - protein, 151 aa, Glycine max
  Coding DNA Sequence Number=SeqID_21742
MQTKQRQIKCITRIKNGTYRERGDMNGNWNFNRSVDDDRQEEEAQNDVAAQPLGIASNELAKMRRCVRHSRHHVAVQHHPCLVLDLFYCATWSFSSPFTLSLILDPYSHQSQTLFSDSPLFIGTDALLGCLVIVLFGFGLCHFTFLLFKFI

SEQ ID NO: 138521 - protein, 137 aa, Glycine max
  Coding DNA Sequence Number=SeqID_21743
  Gene Ontology: Mol. function=FMN binding
  Homolog annotation: Hit_ID=Q9M7D2; Match level="QueryCoverage=98%, HitCoverage=47%, E-value=1e-63, Identity=79%"; Hit description=Root border cell-specific protein
VPENEREAVRAAYLARHPNAFWVDFGDFRFLRIEPKVVRFVSGVATALLGSGEFSGDEYKSAKVDPIAQFSKPVASHMNKDHAEDNKVIVQHWTSVPAGYQGDTFKLRVPFPRRAEDRKDVKTLIVEMLQAARPKVD

SEQ ID NO: 138522 - protein, 407 aa, Glycine max
  Coding DNA Sequence Number=SeqID_21744
  Gene Ontology: Mol. function=DNA binding; Biological process =regulation of transcription
  Homolog annotation: Hit_ID=Q9SQQ6; Match level="QueryCoverage=99%, HitCoverage=98%, E-value=1e-74, Identity=44%"; Hit description=NAM -like protein
  Pfam annotation: Domain name=NAM; Domain location=16-143; Score =301.4; E_value=1.6e-87; Accession=PF02365.6; Description=No apical meristem (NAM) protein
MEEPIVVNKGEEPLDLPPGFRFHPTDEEIITYYLTEKVKNSIFSAIAIGEADLNKCEPWDLPKKAKIGEKEWYFFCQKDRKYPTGMRTNRATESGYWKATGKDKEIYKGKGNLVGMKKTLVFYKGRAPKGEKSNWVMHEFRLEGKFASYNLPKAAKDEWVVSRVFHKNTDVKKSSIPGLLRINSIGDDLLDYSSLPSLMDPPYGNNTNTTNNNNNNANPLSSTKLSQSEGYYLPSFSINNNHHQLLIKPEDHHNHRIYEFPTINFTSNQTNLSSNNVNPMGNNNTLSSQPLNMFSADYYVHQNRIKSSIMPSVAGSGFVSDNNNHDEAILRAFAAKNNEHIQCKMEQFSSNHSQDTGLSNDRNTTDTSSVVSMGRNNNNRALYEDLEGPSSVAPLSDLECLQWDDDY

SEQ ID NO: 138523 - protein, 187 aa, Glycine max
  Coding DNA Sequence Number=SeqID_21745
  Subcellular localization annotation: CTP_CleavageSite=44; ConfidenceScore=5.74e-01
MMRVRPPDVAPTPSPPPTEARPSSSHVNAHGPSLVSASTPSPSSVDARGPSLVPTSTPSPSPSVDNLPIDEDDVNLAIEDPPLNNRPMVMLINGAFHPSKVAAKAVTLSIRQQFGQPWPTWEAIPKEYQELFFQRFKMRSFNKLIYKRILVNLSMIDLDGHMKNLRLDYLKLGLMLHQVLVNPNSLP

SEQ ID NO: 138524 - protein, 236 aa, Glycine max
  Coding DNA Sequence Number=SeqID_21746
  Gene Ontology: Mol. function=helicase activity; Biological process =viral genome replication
  Homolog annotation: Hit_ID=Q9LW42; Match level="QueryCoverage=95%, HitCoverage=13%, E-value=4e-47, Identity=45%"; Hit description =Helicase-like protein
MSQYSGIQSHIVSGLSHMLNQHNSHAKSFRMARDRLAGDQANNIKLQLIAARGKDGRVYNMPNVPEIVALIVGDFHLGSKRDIIVETQNGELQRIHELHASYLPLQYPILFPYGEDGYRADILHRSTSSSKKRKRNRLTMREWLSYRLQSRSNEAQTLFHSRKLFQQFIVEGYTMVKSERLSYIRNNQKKLRVDKYSSLQSSLDTGTAKSLTKGKRVILPSTFVGSPRYMNQLYFD

SEQ ID NO: 138525 - protein, 107 aa, Glycine max
  Coding DNA Sequence Number=SeqID_21747
  Homolog annotation: Hit_ID=Q2HRX8; Match level="QueryCoverage=91%, HitCoverage=13%, E-value=2e-09, Identity=37%"; Hit description=IMP dehydrogenase/GMP reductase
MSMVLLAPAREGYLSLGSKGRLGAAEHDHLAEDLMPGLAPTAGDQNSMKSYGSPGLVDAPHMGSNKHPESGVGPGTPCTPVYVCSSRSSSWQSTYRHAVNPHRSPNQ

SEQ ID NO: 138526 - protein, 87 aa, Glycine max
  Coding DNA Sequence Number=SeqID_21748
MAVEWRWKKDDWRCHNRVFYPMPLRGDLNINHLDKLEVIKNEFKNTMEQDPFAIDMDDILIDERVVFSSPQKIDFDKRGKGTDRHIT

SEQ ID NO: 138527 - protein, 187 aa, Glycine max
  Coding DNA Sequence Number=SeqID_21749
MRGAPTEESLSPFLVRDLGAQGLKVIQRVHKAWRSPLRKDKELRGIRNGVIGGYHGWLRIHTRGLDWLSKLKVIDEENFEAPEEDEEVRALKLELGKARLAKEKFKSAATHIRKECTELQEENAATARALEQETKRARKEEYGREKFRGALWGSNNELKLRREERDRSRVHGMILKEELVACASKAC

SEQ ID NO: 138528 - protein, 115 aa, Glycine max
  Coding DNA Sequence Number=SeqID_21750
MKKQNNKKEKPNLGFEIRIIPPKCVKDFASNLKICVSLKRQQPFVKKLSCEVKTRDDGVRTRDGKLERIRAVEWRRERKIRDGWGLLSERTCPQSNGYGLGPGLWFGPGPLLGLC

SEQ ID NO: 138529 - protein, 80 aa, Glycine max
  Coding DNA Sequence Number=SeqID_21751
  Gene Ontology: Mol. function=O-methyltransferase activity; Biological process=lignin biosynthetic process
  Homolog annotation: Hit_ID=Q2HTB5; Match level="QueryCoverage=90%, HitCoverage=19%, E-value=3e-19, Identity=65%"; Hit description=O -methyltransferase, family 2
MNGARSGGKVIVVDGILPFEPETTGALKSISQFDVLMMTTNPGGKERSEEEFMALAKGAGYSGIRFTCFVSHLWLMEFFK

SEQ ID NO: 138530 - protein, 127 aa, Glycine max
  Coding DNA Sequence Number=SeqID_21752
MESSEPNGSVCCTISLRVYELFYAFAIIGFGGLMRSNQGCGCRIVPHGRKEKLCVVESGALLNGVANVTTVVEEHEVVDFRLEYEKLGKVVSRMKIHGSKMQVIVVSGSTVVSLVWCGGVGCDSGGV

SEQ ID NO: 138531 - protein, 157 aa, Glycine max
  Coding DNA Sequence Number=SeqID_21753
  Pfam annotation: Domain name=zf-GRF; Domain location=20-65; Score =33.5; E_value=7.3e-07; Accession=PF06839.3; Description=GRF zinc finger
  Subcellular localization annotation: CTP_CleavageSite=45; ConfidenceScore=5.34e-01
MSQRSNASSSRTRVSSQVVLFCGCGRRVVRRVVGTNINRGKAFFTCSINKDEVGYCGYFIWVDQLIEALGVDDSLGTFFMEQRRQFGREEDKTMWKAQVNSKLDCVSRRPPNWIPPPPDEDVTPLMVSCPMPSSQLVMMTFMQTPRLPPSGHGQNQG

SEQ ID NO: 138532 - protein, 465 aa, Glycine max
  Coding DNA Sequence Number=SeqID_21754
  Gene Ontology: Mol. function=nucleic acid binding
  Homolog annotation: Hit_ID=Q10M15; Match level="QueryCoverage=95%, HitCoverage=92%, E-value=1e-124, Identity=55%"; Hit description=RNA recognition motif family protein, expressed
  Pfam annotation: Domain name=RRM_1; Domain location=26-93; Score =31.4; E_value=3.2e-06; Accession=PF00076.12; Description=RNA recognition motif. (a.k.a. RRM, R
  Pfam annotation: Domain name=RRM_1; Domain location=378-453; Score =38.9; E_value=1.8e-08; Accession=PF00076.12; Description=RNA recognition motif. (a.k.a. RRM, R
  Pfam module annotation: Pfam domain module=RRM_1::RRM_1; Domain location=26-93::378-453
MACSQFAFQGTESKPCDAESAVPVTLLIKHLPEAIPHDTLSRIFANFGASFVRPCSSARLRNCAFADFKNEIVASQAQRQLNGLRFLGKVLSAERASNPTENGEKSSGDQLGKDPKTSMLMNANVTKPIDGDTKSGGLPIPEPIADRLGVNYPFPPHLEMLKGCQPARYAYPPPDGNILTNIVNALIAVPRFYTQVLHLMNKMNIPAPFRMALPTPPLPPEVPALPPPPPAPTVTVNPRSADLSSGESEMESSDEEVEARTKKSGQKRARRETIVGPAIDKGVAHESVGVKPATLVPKEIPVIKKNHVLKINIVPKATVKEHKDDDTTQELQEPEKDVPDPNKFFTPDELERGKLPPEEILSLPMFKNYTAGNPAPVLYIKNLAKDVIADDFYFIFGSLFGSIEAAKSGLQVKLMQEGRMRGQAFITFPSIELAHHALNLVNGYVLKGKPMIIQFGRNPAAAKAT

SEQ ID NO: 138533 - protein, 137 aa, Glycine max
  Coding DNA Sequence Number=SeqID_21755
  Gene Ontology: Mol. function=zinc ion binding
  Homolog annotation: Hit_ID=Q1S5Q3; Match level="QueryCoverage=68%, HitCoverage=65%, E-value=9e-09, Identity=33%"; Hit description=Zinc finger, GRF-type
  Pfam annotation: Domain name=zf-GRF; Domain location=20-65; Score =37.7; E_value=4e-08; Accession=PF06839.3; Description=GRF zinc finger
  Subcellular localization annotation: CTP_CleavageSite=30; ConfidenceScore=5.39e-01
MSQRSNASSSRTRVSSQVVLFCGCGRRAVRRVAGTNINRGRMFFTCSINKDEVGYCGYFIWVDQLIEALGVDDSLGTFSMEQRRQFGREEDKTMWKAQVNSKLDCMGIEMKMFRTIVYGMFLIQLLSMVVFVCIHKY

SEQ ID NO: 138534 - protein, 601 aa, Glycine max
  Coding DNA Sequence Number=SeqID_21756
  Gene Ontology: Mol. function=transcription regulator activity; Cellular component=nucleus; Biological process=regulation of transcription, DNA-dependent
  Homolog annotation: Hit_ID=Q9FK48; Match level="QueryCoverage=96%, HitCoverage=54%, E-value=1e-122, Identity=63%"; Hit description =Similarity to transcription regulator
  Pfam annotation: Domain name=Not3; Domain location=2-246; Score =535.0; E_value=8.1e-158; Accession=PF04065.5; Description=Not1 N -terminal domain, CCR4-Not complex component
MGASRKLQGEIDRVLKKVQEGVEVFDSIWNKVYDTDNANQKEKFEADLKKEIKKLQRYRDQIKTWIQSSEIKDKKVSASYEQALVDARKLIEREMERFKICEKETKTKAFSKEGLGQQPKTDPKEKAKSETRDWLNNVVGELESQIDSFEAELEGLSVKKGKTRPPRLTHLETSITRHKAHIKKCEFILRLLDNDELSPEEVNDVKDFLDDYVERNQDDFDEFDDVDELYSSLPLDKVETLEDLVTIPPGLSKVAPSLSLKNTLTVSASQSASASQTSFIFFCLDAPVRYFCVNEVDFTPPPIVFGWVRLRTISLPHNPSPIPSHSEEPPGNGINVIVNSQSWRLISNHQDTSVQEQADDTESQDSNSDIVAKTPPPKSGGISSATSTPVGNHATPVSVNISGHNLSGAPVAALPSSNSVRNVLENTNVTNSSSVNQSTSTKEEDINSFPSRRPSPSLSDATLLRDRNSLSNQATASVPLGSGNMVSSNVALGSVSSASEIAKRNIMGADDRLGSSGMVQPLVSPLSNRLILPQAAKANDGIVSVDSSTVNEAAAGRVFSPSGVPGMQWRPGSPFQNQNDAFVPAIAYQYIRFWIKIKAEI

SEQ ID NO: 138535 - protein, 269 aa, Glycine max
  Coding DNA Sequence Number=SeqID_21757
  Gene Ontology: Mol. function=transcription regulator activity; Cellular component=nucleus; Biological process=regulation of transcription, DNA-dependent
  Homolog annotation: Hit_ID=Q9FK48; Match level="QueryCoverage=98%, HitCoverage=30%, E-value=2e-40, Identity=39%"; Hit description =Similarity to transcription regulator
GQLRGRTEIAPDQREKFLQKYQQVQQGHSTLLNMPSLVGGNHKQFSAQQQNPLLQQFNSHGSSVSSQSGIGLGVQSTSLGGISSASLQQPPNPVHSPSSQQPLMPGVSKDASMFCVSYTSCVLLKNDVGNSKIEEQQQHQNFPDDSTIESIASTGIGKNLINEDDSKSAYTVDSPAAVSASLPESAQTSRDIDLSPGQPLQSNQLTGNLGVIGRRNGAEHGAIGDNFSGSNVSSGGVRDQLYNLQMLEAAHFKIPLPKDSERPRTYTPV

SEQ ID NO: 138536 - protein, 312 aa, Glycine max
  Coding DNA Sequence Number=SeqID_21758
  Gene Ontology: Mol. function=DNA binding
  Homolog annotation: Hit_ID=Q1S0F5; Match level="QueryCoverage=93%, HitCoverage=58%, E-value=4e-40, Identity=35%"; Hit description=IMP dehydrogenase/GMP reductase
MGTNQNGKRFYQVKVKGLDVTSLKELGRLMGPLQRQAFRKVYGKILDLAAAEVFTEAVVSLTQYYDQPLRCFTFGDFQMVPTIEEFEEILGCPLGGRKPYLFSGFLPSLSKIAAVVGDSAKELDRTKQTRNDVVGLPRKYLEGKARDMASQEKWGPFADILALLIFGVVLFPNIDGLVDLAAIDTFLAYHHSKESPVVAILADLFDTFDRRCEKNSARIVCCLPALYVWLISHLFRQDTRHPCPLQSYRSCAEKGRVDWDQHLAGIGGSAINWFPRWKEGKEGVLFSCGDYPNVPLIGTRGCINYNPTLAIR

SEQ ID NO: 138537 - protein, 93 aa, Glycine max
  Coding DNA Sequence Number=SeqID_21759
  Gene Ontology: Mol. function=protein kinase activity; Biological process=protein amino acid phosphorylation
  Homolog annotation: Hit_ID=Q9ZQR0; Match level="QueryCoverage=92%, HitCoverage=7%, E-value=3e-12, Identity=41%"; Hit description =Putative helicase
  Pfam annotation: Domain name=DUF889; Domain location=1-92; Score= -133.7; E_value=0.02; Accession=PF05970.5; Description=Eukaryotic protein of unknown function (DUF889)
MCLQGNAQLIDDQETNKFAKWILDIGDGVIGNQNDGYATVEIPEYLLITEYNDPIDAIVKSTFPNLYQHQSNPDFFKSRAILASTNETVERGQ

SEQ ID NO: 138538 - protein, 177 aa, Glycine max
  Coding DNA Sequence Number=SeqID_21760
EVQEQMKADMEAMKEQMATMMETMMSMKKIMEANAVTIAAASTVAKVNPMPPSGLNQMNHPTLAMVGKDLGSTNGPMMCKFKTSTPSRHMACLPTYTSQCGAHKMPHYNLADFEPCLGYATEGQAVGDIPLQNTLEGPQYHPQPHLLHSTVGKNPHAMAEMGKLDHLEERLRAIKGG

SEQ ID NO: 138539 - protein, 185 aa, Glycine max
  Coding DNA Sequence Number=SeqID_21761
MQQQWADIIGNIKEQVRNEYEEQHKRSLEEFKKELSSQIFIQLSQMGSQYSPLIEVDLQALAARLSTKGSNVETADVDPSGDKNVSLKPTMGLYVQRQNTTVLVALGKICEGGSAIHNVTYADDVVRVSVDKVIEGFWMSGALLWVMLPCMDSLSHNRYTMQRIDVLNVSITYKHGSRNRNERCT

SEQ ID NO: 138540 - protein, 266 aa, Glycine max
  Coding DNA Sequence Number=SeqID_21762
  Gene Ontology: Cellular component=nucleus
  Homolog annotation: Hit_ID=Q1RYJ5; Match level="QueryCoverage=57%, HitCoverage=27%, E-value=9e-75, Identity=88%"; Hit description=WD40 -like
  Pfam annotation: Domain name=WD40; Domain location=115-153; Score =5.8; E_value=7.6; Accession=PF00400.22; Description=WD domain, G -beta repeat
  Pfam annotation: Domain name=WD40; Domain location=217-254; Score =12.9; E_value=1.1; Accession=PF00400.22; Description=WD domain, G -beta repeat
  Pfam module annotation: Pfam domain module=WD40::WD40; Domain location=115-153::217-254
MKSANTTADGTNNPATPKWVEVKSHVQSGGYECGYYVMHWMWNIVGGGLKNDWSMWFLDGTALDNETITTIRQKWAAYFLKVQSIQCRIAGPRQTTPRNCTMIGLIWTYDTSTPVSRNATIYCSTEILSLDWECKSDRLLLIGTSDGCIKAWNVDAKRVVCDLNTTEAFPSVLDIKCSPVEPIFVSAAASGGAGSNYIDNLGFASLTVWNMKTWKAMTVLPLGEDPPAITSLCFNHNGKILAASAVDGMIHMFGILNFVHLIVSLV

SEQ ID NO: 138541 - protein, 181 aa, Glycine max
  Coding DNA Sequence Number=SeqID_21763
MSKRLAEDAKAYFDECVSLSTFDSSDFSSPEDPPVNFVGPPTPSGSPELGTRGQSMNIHYDISQPPANIDTVGAFHGQVSSITDSTETGSKPCFSFAQKPSETSALQQDIQQYIKKFEKNVLKSSAMRSNYCDPHEYSFQSSAESLLNDRVLLKRRIESGSLILCGGGGNNLLSKFSGIGI

SEQ ID NO: 138542 - protein, 45 aa, Glycine max
  Coding DNA Sequence Number=SeqID_21764
MVEGTVIDEKSKEKRGCHQGLIKKKSSHMATDSKLLTRHPIPWTY

SEQ ID NO: 138543 - protein, 196 aa, Glycine max
  Coding DNA Sequence Number=SeqID_21765
  Gene Ontology: Mol. function=transcription factor activity; Cellular component=nucleus; Biological process=regulation of transcription, DNA-dependent
  Homolog annotation: Hit_ID=Q2EPY6; Match level="QueryCoverage=86%, HitCoverage=38%, E-value=2e-57, Identity=73%"; Hit description =AP2/EREBP transcription factor
  Pfam annotation: Domain name=AP2; Domain location=54-124; Score =120.2; E_value=5.8e-33; Accession=PF00847.10; Description=AP2 domain
  Subcellular localization annotation: CTP_CleavageSite=33; ConfidenceScore=5.43e-01
MKRSPASSCSSSTSSVGFEVHHPIEKRRPKHPRRNNLKSQKCKQNQTTTGGRRSSIYRGVTRHRWTGRFEAHLWDKSSWNNIQSKKGKQGAYDTEESAARTYDLAALKYWGKDATLNFPIETYTKDLEEMDKVSREEYLASLRRQSSGFSRGISKYRGVASKSSIMILINTYHILWIGIIIMVAGKLALEEYVETN

SEQ ID NO: 138544 - protein, 292 aa, Glycine max
  Coding DNA Sequence Number=SeqID_21766
  Gene Ontology: Mol. function=helicase activity; Biological process =protein amino acid phosphorylation
  Homolog annotation: Hit_ID=Q1S3G1; Match level="QueryCoverage=87%, HitCoverage=69%, E-value=7e-42, Identity=38%"; Hit description=AAA ATPase
  Pfam annotation: Domain name=DUF889; Domain location=78-292; Score =133.1; E_value=7.8e-37; Accession=PF05970.5; Description=Eukaryotic protein of unknown function (DUF889)
MLISNSIERPNHVWAETWECLIDDIVHQQRRIRNMPDELRHIFNLIINVVNQQAGGMLFLYGYGGTGKTFMRKTLTSPLCSKGDIVLTVASSGIASLLLPNGRTTHSKFAIHVPILDNSTCNIHQDVGDGRLGKGDDGLYNIEIPSELLITNFINPIEAIVIYTYPDIQHKYKDAEFLKSITILASTNEIVDQKNDYILNIIAGEEKEYFSCDLIDMRDVAASEFYESVTPEFLHSLKTSGIPNHKIRLKTNTPIMLIRNLDQAEGLCNGTRLIVSRMTNHVIEAWIISGKT

SEQ ID NO: 138545 - protein, 48 aa, Glycine max
  Coding DNA Sequence Number=SeqID_21767
MKKESCLEDEDGPSHAQQQCPPPPMPLLIIVNRTPNTCRSTAPTKIVA

SEQ ID NO: 138546 - protein, 212 aa, Glycine max
  Coding DNA Sequence Number=SeqID_21768
MAAIEYRGVNAKKNDQTLQQQQTEVQTETVPNSSDSEEAEVEQQHTTTITTPPPSENLHMLPQEHQVQYTHHVTPRDEESSSLVTIMEHVLEQDLPWSFMYTGLSQFQDPNLALSKGDDDLAGMFDGAGFEEDIDFLFSTQPGDHETESDVNNMSAVLDSVECGDTNGAGGRSMVYHHVDNNNKQKKMLSFASSSSPSSTTTTVSCDYALDL

SEQ ID NO: 138547 - protein, 123 aa, Glycine max
  Coding DNA Sequence Number=SeqID_21769
  Gene Ontology: Mol. function=helicase activity
  Homolog annotation: Hit_ID=Q9LW42; Match level="QueryCoverage=63%, HitCoverage=6%, E-value=3e-14, Identity=49%"; Hit description =Helicase-like protein
MENVLDIFLKNGNMKLLLTKRAILFTKGIMMAYLNIEWCNQSASIKYLFKYINKGYDCITATLVPAQNDDGTTGQTIGEIKHYLDVIFKDDVDIDALLFKPTIKESMFTSWLQANNIFQEEKD

SEQ ID NO: 138548 - protein, 222 aa, Glycine max
  Coding DNA Sequence Number=SeqID_21770
MRAIQRSPKSIVELILVDKKTSITSCPLWESLALEFKDCFDRHVYGPMVLLLSLAKIKEARDHFLHNAHVKCFDELSQLKKECMYVIVATISKLLVANGWIYDGCPKCNKKAYGEGSSFVCVGCGNKSASIVAKFHVDVRVGQPHDSAIFTLWDCECYALIKEIATEIKLKMLMSNVYKPVLSLSNATGIHHRLSAFCHSLIVNCMEYHSKIYRPYNYPQLG

SEQ ID NO: 138549 - protein, 720 aa, Glycine max
  Coding DNA Sequence Number=SeqID_21771
  Gene Ontology: Mol. function=zinc ion binding; Cellular component =nucleus; Biological process=transcription
  Homolog annotation: Hit_ID=Q1S9M8; Match level="QueryCoverage=93%, HitCoverage=89%, E-value=0.0, Identity=57%"; Hit description=FAR1; Zinc finger, SWIM-type
  Pfam annotation: Domain name=FAR1; Domain location=1-156; Score=49.3; E_value=1.3e-11; Accession=PF03101.5; Description=FAR1 family
  Pfam annotation: Domain name=SWIM; Domain location=432-468; Score =44.3; E_value=4.2e-10; Accession=PF04434.8; Description=SWIM zinc finger
  Pfam module annotation: Pfam domain module=FAR1::SWIM; Domain location=1-156::432-468
MLRVERKDGNWIVTKFVEDHNHSLASSRKVQNLQPGRHFVGAARNVTTETFDARNESYVSVNGNHLEPIGSVRSSSLAEKCHPMRNIESLTYARSSRKRTLGRDAQNLLNYFKKMQGENPGFYYAIQLDDENRMTNVFWADARSRTAYNYFGDAVIFDTMYRPNQYQVPFAPFTGFNHHGQMVIFGCALLLDESESSFTWLFKTWLSAMNDRPPVSITTDQDRAIQAAVAHVFPETRHCICKWHILREGQERLAHIYLAHPSFYGDLYSCINFSETTEDFESTWKSLLDKYDLQKNDWLQAVYNARKQWAPVYFHDTFFAAITSNHGVSSFFDGYVNQQTTISLFFRQYERSLEHSLEKEIEADYETVCNTPVLKTPSPMEQQAANMYTKKIFAKFQEELVETFAYTANNVEDDGVISKYRVAKYEYDHKAYMVTLNISEMKANCSCQMFEYSGILCRHILTVFTVTNVLTLPSHYILKRWTTNAKSDIRTYEKITDPLDIENLTVRFNSLCREAIKLAEEGAIAVETYNATMNALREGAKRVGIMKKNVAKVTPPNTHGNGSCLEDNSKKRPSSISDVIPSLWPWQDSVPHHFNLNDLGLPVTDLNTPSMAPVSIHRDGGPLDNTVVLTCFKSMTWMIENKNSSSSSKIAVINMKLQDYGKGPLGETEVQFRVTRVTLEPMLRSMTYINQQLNAPVNRVAIINLRVCKLGSRSCTLPRS

SEQ ID NO: 138550 - protein, 388 aa, Glycine max
  Coding DNA Sequence Number=SeqID_21772
  Gene Ontology: Mol. function=nucleic acid binding; Cellular component= intracellular; Biological process=chromatin modification
  Homolog annotation: Hit_ID=Q9ZVD0; Match level="QueryCoverage=91%, HitCoverage=49%, E-value=1e-138, Identity=69%"; Hit description =Expressed protein
MDMIIMVVMNGEWVEEVVMQMRSPMAGIESNRGYGDMPSGGAQREGLMSYKQFIQELEDDILPAEAERRYQEYKSEYISTQKRAYFNAHKDEEWLKDKYHPTNLVTVIERRNENARQLAKDFLLDLQSGTLELNPGLNASISKSGQASEPNSEEEADTGGKRRRQGRGSNKENDFSAAPKAHPISTEPRRIQADVQQAQALVRKLDTEKGIEDNILCISDHNRNDDKAHSASVAPIVIIRGLTSVKGLEGDELLDTLVTYLWQIHGVDYYGMIETNEAKGFRHVRPEGTAHEVVAGKSGSEWEKKLDLFWQGRLNGQDPLEVMTAKEKIDAAAMEVLDPYVRKIRDEKYGWKYGCGAMGCTKLFHATEFVLKHLKLKHPELVVEQTSK

SEQ ID NO: 138551 - protein, 87 aa, Glycine max
  Coding DNA Sequence Number=SeqID_21773
  Subcellular localization annotation: CTP_CleavageSite=68; ConfidenceScore=5.55e-01
MKSADMQSYLMVTCTFRQPGANKPIDARRLTLSSAPFVVLTREVSQVTCGVTLWFPGPFVNYGQTSVDAQRLTSSSAPFVVLTREVR

SEQ ID NO: 138552 - protein, 74 aa, Glycine max
  Coding DNA Sequence Number=SeqID_21774
MALAWWFSDETPLELEKITTNCNKWATYFNAYVTSQHKDPLSDIGDLMTRSKTKRMRYVLQRPNNRDQVCSKVD

SEQ ID NO: 138553 - protein, 100 aa, Glycine max
  Coding DNA Sequence Number=SeqID_21775
  Gene Ontology: Mol. function=nucleic acid binding
MEKNKESVLCQGSKKPPDEGGSDDTQKQYFKERLIRKTSMPTETKEPLKNGMTHLDYEGGSHLLPNFMLTPIAFEQLCLPWKQCLIVKLLGKNIGYFVRY

SEQ ID NO: 138554 - protein, 184 aa, Glycine max
  Coding DNA Sequence Number=SeqID_21776
  Gene Ontology: Mol. function=structural constituent of ribosome; Cellular component=ribonucleoprotein complex; Biological process =translation
  Homolog annotation: Hit_ID=Q6ZLP8; Match level="QueryCoverage=58%, HitCoverage=78%, E-value=7e-24, Identity=57%"; Hit description =Putative ribosomal protein S12
  Pfam annotation: Domain name=Ribosomal_L7Ae; Domain location=56-146; Score=17.9; E_value=0.00051; Accession=PF01248.16; Description =Ribosomal protein L7AeL30eS12eGadd45 family
MIYTKEMKERLSGQDNRYAFMNLILKDSGLFHIKNLFIEELAWIERLHKNAWIGFQSWRATTRKLMVVLHVAFMKVQKGSRSMLCNYVLAEDCDQPDYVKLAKALCVEHNVSLLTILGAKTLGKWAGLCKIDSEGKARKLFSILLVLMVYFGSSLFIVEISRDWKEERMLATSWSMEHDEQGYL

SEQ ID NO: 138555 - protein, 101 aa, Glycine max
  Coding DNA Sequence Number=SeqID_21777
MWKPLRQQLALTSLSQQTYATSGESLRDFPKENLGSACKGLKNIGVKLERLFEKKYLGRAYIGLENTCCWSLWRLSRKKEYLKVIGLSIKPTGVVTGRSLG

SEQ ID NO: 138556 - protein, 128 aa, Glycine max
  Coding DNA Sequence Number=SeqID_21778
MAQVVFGILIGLRAGYRFVRSLGWGNDTWSNYFLPFLMIYARKFKMHVHLHMHDNVLDLLTWEPCLAGNYTTNPGYSSSDPTCKMISDRHISISSPCPRCNHGEEASLLECEDAPASMRLVLDSNDKD

SEQ ID NO: 138557 - protein, 379 aa, Glycine max
  Coding DNA Sequence Number=SeqID_21779
  Gene Ontology: Mol. function=protein serine/threonine kinase activity; Cellular component=integral to membrane; Biological process=protein amino acid phosphorylation
  Homolog annotation: Hit_ID=A0AAR7; Match level="QueryCoverage=99%, HitCoverage=71%, E-value=1e-178, Identity=84%"; Hit description =Calcium calmodulin-dependent protein kinase
  Pfam annotation: Domain name=Pkinase; Domain location=12-308; Score =277.3; E_value=3e-80; Accession=PF00069.15; Description=Protein kinase domain
  Pfam annotation: Domain name=Pkinase_Tyr; Domain location=12-306; Score=30.3; E_value=2.5e-14; Accession=PF07714.7; Description =Protein tyrosine kinase
  Pfam module annotation: Pfam domain module=Pkinase::Pkinase_Tyr; Domain location=12-308::12-306
MGYETRKLSDEYEVSDVLGRGGFSVVRKGTKKASNDTKTHVAIKTLRRVGTASNSNNHSGFPRPKGGEKSTAAMMGFPTWRQVSVSDALLTNEILVMRRIVEKVSPHPNVIDLYDVHEDSNGVHLVLELCSGGELFDRIVAQDRYSETEAAGVVRQIASGLEAIHKANIVHRDLKPENCLFLDVRRDSPLKIMDFGLSSVEEFTDPIVGLFGSIDYVSPEALSQGKITTKSDMWSLGVILYILLSGYPPFIAQNNRQKQQMIMNGNFSFYEKTWKGITNSAKQLISDLLTVDPSRRPSAQDLLSHPWVVGDKAKDDAMDPEIVSRLQSFNARRKLRAAAIASVWSTAIFLRTKKLKSLVGTHDLTEEEIENLRMSFKKM

SEQ ID NO: 138558 - protein, 51 aa, Glycine max
  Coding DNA Sequence Number=SeqID_21780
MLERLHRESHKAGGLEDGLRTGVAHSVRQHPLNARSQLGSQLSRASTLEPT

SEQ ID NO: 138559 - protein, 92 aa, Glycine max
  Coding DNA Sequence Number=SeqID_21781
  Gene Ontology: Mol. function=hydrolase activity, hydrolyzing O -glycosyl compounds; Biological process=carbohydrate metabolic process
  Homolog annotation: Hit_ID=Q8RU06; Match level="QueryCoverage=95%, HitCoverage=17%, E-value=2e-16, Identity=52%"; Hit description =Putative Glucan 1,3-beta-glucosidase
MTRKYLCAESGRGTILVANCTVASGWETFRLWRINKDTFILRVFNKQFLGLDRINDVVVSNICTHSETFHIVKESDNSSQIQIKASNGYFLQ

SEQ ID NO: 138560 - protein, 626 aa, Glycine max
  Coding DNA Sequence Number=SeqID_21782
  Gene Ontology: Mol. function=RNA-directed DNA polymerase activity; Cellular component=chromatin; Biological process=chromatin assembly or disassembly
  Pfam annotation: Domain name=rve; Domain location=402-544; Score= -5.5; E_value=0.017; Accession=PF00665.16; Description=Integrase core domain
ECDNSLPVCYLCWDPVMISNFMFVGADGKVDDYEEPHVGNGQIMETEGWVRQLTVDIQGQKLSVPVYLLPVSRAYLILGSPWLATLGPQVVDYAALTLKFFYHGKFLTLQREGSSTPTQAHLHRLQRLHATSAISDNFVVHLMQHDGLDASLTELPVDIAHEIATLLHTYSMVEYLGHIVSRAGVTMDVGKVQAVLDWPKPANVKQLKGFLRLTEALCWTNATEQAFIKLKHAITSTPVLALPDFTQPFVLETDEFEIGVEAVLSQNGHPIAYFSKKLLPRMQKQFAYTREFIHCKDNVAADALSRVFFMAWSKPQFQLIDKLNREVLHDEQTQVIMNDCQNAQPPNYPYNVKDGTVARISVQFYWPKLKQDVKEFVRTCTICQQAKSKHVLPAGLLQPLPIPNQAWEDIAMDFITGLPNSSGFTVIMVVIDRLTKYSLFVVMKSDYTSKTVDEAFMCHIVKLHGVPKSIVSDRDKALYGREPPALLRYNDSSQDPPTVREVLHNRQMLLNRLKGNLIKAQTAMKIQANKKRLDRKFQVGDEVLKIGEVFLKYSFNGKVVARQRQLWRMLQKFKPVTPQFNLEDKVPFKGGGNVMNLSGNGKPKSAKEREKDKLVTNGPRNVGVRK

SEQ ID NO: 138561 - protein, 132 aa, Glycine max
  Coding DNA Sequence Number=SeqID_21783
MYPPLFSLNLVDVPFTRTDPQEMYPLLFSVKPKEWEESKEFSDCVVLNSLTREKGDTKEFRRLVLRSFGKGRRETQKEFRRLVLGEFFLAKGEENEKMNNTSFQGLENQKTSESFWYKEEEEVQRHSRLVKD

SEQ ID NO: 138562 - protein, 93 aa, Glycine max
  Coding DNA Sequence Number=SeqID_21784
MSVGIVKDFELSMPYMTKLSNYKWNLCLPVQGFEDILLGFFKEGEDVREAISVTVYDKGCHEFDMMLKKMGKGFQPLLCAKPEGGSFSATNSA

SEQ ID NO: 138563 - protein, 130 aa, Glycine max
  Coding DNA Sequence Number=SeqID_21785
MKCPLIKESKDCVVLSKATQALGGSAYSANDITPSNFIKAVTQVTNYEYEDGTFWVLRIFGTLDGASTYLIINDLHTGANEMSERWEKQSKCEPHHKSPLRQCKGYNGEAEEEACVTNDLHTGTIEMSER

SEQ ID NO: 138564 - protein, 182 aa, Glycine max
  Coding DNA Sequence Number=SeqID_21786
MGHWWGVMLVVVMMTTTLVVVGDRGGINDGDGGDGDRGSSISGIVVAMSMVLVATVMTMIVVVAVLVVVVVVIVVTKVILLMVLVAISMVMVMSVVIMVTMTVVLMVARSGDCDNTGVGCGDNDTNGGSNIGGDSNVGNHCGGNNGIWRNEKWERKGEAVDVLLKRKGEAVKGEGLGENGKR

SEQ ID NO: 138565 - protein, 99 aa, Glycine max
  Coding DNA Sequence Number=SeqID_21787
MSLYLIVGKRRRGCRKTDLKVFKIRCIKKGGIAPSSCSCRISPLGKWMSTPMSNVCGGGFKIQKLEFGDDDSEESLGGSHGLEDKRGFGERMGREEWRT

SEQ ID NO: 138566 - protein, 90 aa, Glycine max
  Coding DNA Sequence Number=SeqID_21788
MKTEKQGEKTEQQHKHGERDRERGLRADQEKRPVFAEDAVRKVANGRREGVIVELFPVEKRELARCSGCDRGREMKRRGTNGKHLVGDHS

SEQ ID NO: 138567 - protein, 406 aa, Glycine max
  Coding DNA Sequence Number=SeqID_21789
  Gene Ontology: Mol. function=zinc ion binding
  Homolog annotation: Hit_ID=Q69L44; Match level="QueryCoverage=99%, HitCoverage=88%, E-value=8e-86, Identity=48%"; Hit description=SWIM zinc finger family protein-like
MAIVESVGKIPLQDPPEEEFCAADLTWTKFGNSEHHDEVPFIPYDRVDAFIIGECSNVECTTRFHIERGKKPTIGSLKDYKDDEYLEYRLYWCSFGPENYGEEAYYLVEDAKVSSLASQYVHKLGMIIKRILQSLTLSSWGSKQNGSCKKMIHFGHRSVVAADSTFGVNRLKYPLFTLVFYSRQHALPVAWVITRSFAKPVGGFLIDDTAAEIDLLRSWLRNIVKKCSNIEIQWEIFKRLGTIVYSIWGAINASLALEQFMLDFVDQTAFMEYFKVAWLPNLALQRVDWLVPKLTTELHSSCWLDWYADESDSFQNVKEKYIASTSWHRALQIPDYAVSLDDKDHLFAKVVSQKDSSLTHIVWNPGSEFASRGYQPSMSFQSFEEVLMDLWKKPVDDSFALDLSLA

SEQ ID NO: 138568 - protein, 229 aa, Glycine max
  Coding DNA Sequence Number=SeqID_21790
  Gene Ontology: Biological process=response to biotic stimulus
  Homolog annotation: Hit_ID=Q53HY7; Match level="QueryCoverage=69%, HitCoverage=76%, E-value=3e-63, Identity=73%"; Hit description =Hypothetical protein c17
  Pfam annotation: Domain name=Bet_v_I; Domain location=72-209; Score= -34.7; E_value=0.0024; Accession=PF00407.9; Description=Pathogenesis -related protein Bet v I family
  Pfam annotation: Domain name=Polyketide_cyc; Domain location=82-212; Score=33.3; E_value=8.5e-07; Accession=PF03364.10; Description =Streptomyces cyclasedehydrase
  Pfam module annotation: Pfam domain module=Bet_v_I::Polyketide_cyc; Domain location=72-209::82-212
  Subcellular localization annotation: CTP_CleavageSite=48; ConfidenceScore=5.40e-01
MPSSLHFDRFNPITHAATTVAIANGVNCPKQPQAPPSSTAARRLVVPSLSSGRGIAAPDTVALHHAHVVDPNQCCSIVTQHINAPVSAVWAVVRRFDNPQGYKNFVRSCHVITGDGIRVGAVREVRVVSGLPAETSTERLEILDDERHVISFSMVGGDHRLRNYQSVTTLHANGNGTLVIESYVVDVPQGNTKEETCVFVDTIVRCNLQSLAQIAENRTNNCEHTAQHC

SEQ ID NO: 138569 - protein, 112 aa, Glycine max
  Coding DNA Sequence Number=SeqID_21791
  Homolog annotation: Hit_ID=Q10MS9; Match level="QueryCoverage=65%, HitCoverage=28%, E-value=2e-17, Identity=48%"; Hit description =Expressed protein
MVARQKLKTKGNMKVTELKHPSGCAIIVNVHGGGLGWFGTLLIIVLCLFAAYLLAGIVYRFFFLGIRGIDIIPNLDFWVSLPRRTQSLCASLARKFKGPSEGHRSTYSPVNF

SEQ ID NO: 138570 - protein, 439 aa, Glycine max
  Coding DNA Sequence Number=SeqID_21792
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q10BH4; Match level="QueryCoverage=78%, HitCoverage=87%, E-value=1e-112, Identity=54%"; Hit description =Expressed protein
  Pfam annotation: Domain name=DUF231; Domain location=265-436; Score =298.6; E_value=1.2e-86; Accession=PF03005.6; Description=Arabidopsis proteins of unknown function
  Subcellular localization annotation: CTP_CleavageSite=6; ConfidenceScore=5.02e-01
MMKPPSSSSFPSLLRVKPRLSSYLFTLLAFILFAAILYGHDFVFIFRPRLHSNDHTTQTLFSTPVDVRSSTTKKENTEENKTAGTKSKREEEEECDVFNGRWVRDELTRPLYKESECPYIQPQLTCEEHGRPDKEYQRWRWQPHGCDLPTFSARLMLEKLRGKRMMFIGDSLNRSQYASLICLLHQLIPEHAKSEETLDSLTVFSAKEYNATIEFYWAPFLLESNSDNAVIHRVTDRIVRKGSINTHGRHWKDADIVVFNTYLWWITGSKMKILLGSFNDEVKEIIEMSTEDAYRMAIKSMLRWVRLNMDSNKTRVFFISMSPSHAKSIEWGGEAGGNCYNETTPIDDPTYWGSDSKKSIMQVIGEVFRKSKIPITFLNITQLSNYRKDAHTSIYKKQWNRLTPEQLANPASYADCTHWCLPGLPDTWNELLFAKLFYP

SEQ ID NO: 138571 - protein, 43 aa, Glycine max
  Coding DNA Sequence Number=SeqID_21793
MANKDSSNEKDKDSSNEKDNYSNLINQNHPQAYVRSSPSQSRQ

SEQ ID NO: 138572 - protein, 46 aa, Glycine max
  Coding DNA Sequence Number=SeqID_21794
MEKRPTRMRRWPICWILGREWRYVTGRSPDSYYCVSVDDVWNSGTV

SEQ ID NO: 138573 - protein, 169 aa, Glycine max
  Coding DNA Sequence Number=SeqID_21795
MCHLTAYVCVYYDGQICNTNEGTTFISNNTKTFMVDKVITFTQLLELVHQKLNIDPEQHIQHLHFRCPIFESGQRYMYTSFILRDDADIRQMFNIFDNNPSLPFVELFAIICHNNDPPGNQHGSTSNLEDLGEYETCWLKNHDSDTDSSSGPEGSNLSPSHEPIFKRDL

SEQ ID NO: 138574 - protein, 98 aa, Glycine max
  Coding DNA Sequence Number=SeqID_21796
MEIMVCRINRLNYFVSRVPQNWDDIVNLCAKDRATSHGAIVMDVDNEAMSRETNEGEFMGLGATTSIDLEEPNSNTEGKRQGSTYFDTHSHKKIGKKK

SEQ ID NO: 138575 - protein, 58 aa, Glycine max
  Coding DNA Sequence Number=SeqID_21797
MSILQVLSCNWLLHLCLSHHNHTFEKAGRVVSIRIVGKISPNEQTNKRGSGKITRDPF

SEQ ID NO: 138576 - protein, 118 aa, Glycine max
  Coding DNA Sequence Number=SeqID_21798
MERRNLHKCLANLQDGSIDVAMVKEFYANLYNLEDQSPNQGRVRGHLIKIDANSLNTFLETLVVFEEGETLPTYSRFTRMRIDPQEFASRLCIPGRGFVLNAEGHPWKLPRKDLTTLA

SEQ ID NO: 138577 - protein, 160 aa, Glycine max
  Coding DNA Sequence Number=SeqID_21799
MYVTEILISWCKIAGTYVGEGMVIHFSRGEGKESGTGTILDRLLISSSPLHANFDIPCPRCEYGATASSDPTEYFLHRSLFLLENEFGGCHVFMNNCEDFAIYCKTSLLVVTNICVGQSGQAASCLAAASAVVSLLLRFMTASFGAKVPVEKISEMAKED

SEQ ID NO: 138578 - protein, 350 aa, Glycine max
  Coding DNA Sequence Number=SeqID_21800
  Homolog annotation: Hit_ID=Q01DI1; Match level="QueryCoverage=65%, HitCoverage=86%, E-value=3e-27, Identity=34%"; Hit description =Homology to unknown gene
  Pfam annotation: Domain name=DUF1517; Domain location=21-340; Score =100.4; E_value=5.5e-27; Accession=PF07466.2; Description=Protein of unknown function (DUF1517)
MAMLRRYVTASAIALFALLLLLVTCNLNMALASSGGVMGGNFFDSDSESSSSESYTRDSESYRMKHHPHRYYDAPSPDTDAAKGSHSGLVLFLIFASGMFLVAFYKGSTGNSVTVIKLQVAMFGGGMGSPILRDLTRIAETADTSSRDGLTYLLADTIQSLVRHLRYCIAGYTFEIVAVKRLSLMSILWQMNLKRSKEDGEKYYNQLSNEERDKFDEETLVNLNNTEKRSKKTQSDVFSNEYSMFDQKGIKEGTKKIEEEKLLNEFGDEYIVITILVAAKGAHKLPNINGTEDLKEALQKLRTVLSSKLLAGKVLWTPQNEDDTLSKRRLLEDYPQLAKGMANFLVKKRE

SEQ ID NO: 138579 - protein, 83 aa, Glycine max
  Coding DNA Sequence Number=SeqID_21801
MASLLPCSLVPLLALCLIGSSGHALNTGCMLSVLAHDSCLLMWLFALSELLKLNDFDSLSEEVELSMTIQFFNPLSCLCYNFT

SEQ ID NO: 138580 - protein, 116 aa, Glycine max
  Coding DNA Sequence Number=SeqID_21802
MVIDYMLMLVEAYADQIKIGFVISSKGISMDEEKGKAIREWHVPKNANEDYKSVTYFSEKLPGDWVWIYMKKERMNPFEDRGNDEGATNPSNDPLQEMGGPMTRSKTKSMKKYYEA

SEQ ID NO: 138581 - protein, 44 aa, Glycine max
  Coding DNA Sequence Number=SeqID_21803
MLRSEFETKDLGATQKNLTKNSVYYEICQGGELLRSLELMYLTP

SEQ ID NO: 138582 - protein, 477 aa, Glycine max
  Coding DNA Sequence Number=SeqID_21804
  Homolog annotation: Hit_ID=UPI000034F5B3; Match level="QueryCoverage =34%, HitCoverage=16%, E-value=3e-58, Identity=65%"; Hit description =transcription factor
  Pfam annotation: Domain name=JmjC; Domain location=291-425; Score =16.8; E_value=2.2e-05; Accession=PF02373.13; Description=JmjC domain
MGRMFKELLNVNILTHTEEVTFSSQHLTKIEMLKQKYVADSAVKCKSTLEENISVQANDLSVLNWSSLIQMSKMENVGPCRKHATAKPPNDSILEKNGKAMASDRELNSSTSGVEVLVGVNAPVLHENISLNSSSALTANHAESLMKEDEMDLSKCDVNMVDVEAKEKWSSPKDIKVGDGKEDFISSLCIIRNDEVQDDIVNEIGAKSGISFEIENGEMINSEERNAIIEREIVVKSSHDLDLKSELNALSSKLQIGKKDWKEENVEEVKKSNTVSSVVHTSMNEAPQQDAGYISQPVDSGNMDSGQEFAKGGAVWDIFRRQDVHRLEEYLKKYCREFRHLHCSQVEKVFHPIHDQVFYLTSYHKSKLKEEFEFHHLCIYAFEEPFTGVEPWTFIQNLGEAVFIPAGCPHQVRNLKSCIKVALDFVSPENIQECIRLTEEFRSLPKNHKAKEDKLGVKKMCLYALRKAADDLEKLEG

SEQ ID NO: 138583 - protein, 508 aa, Glycine max
  Coding DNA Sequence Number=SeqID_21805
  Gene Ontology: Mol. function=nucleotidyltransferase activity; Biological process=aromatic amino acid family biosynthetic process
  Homolog annotation: Hit_ID=Q2XPY5; Match level="QueryCoverage=93%, HitCoverage=94%, E-value=1e-150, Identity=64%"; Hit description=YSL transporter 1
  Pfam annotation: Domain name=OPT; Domain location=38-481; Score =196.0; E_value=8.9e-56; Accession=PF03169.6; Description=OPT oligopeptide transporter protein
MGTSERIDLEHGGEEVAEAAASVEKAFEGKEVPPWERQVTVRSMVVSLVLGAWTKLLAKSGMLMQPYTRQENTVIQTCVVASSGIAFSGGFGSYLFGMSSDIAKQSPEATAQDIKDPGLGWMIAFAFVVSFLGLFSLVPLRKVFIAIAMILGDGLYNFIKVLGRTLLGLYNQFYRKSLGTSSSSSDPNSPPLLSYDDERRIDMFLKDQIPVWFAVIGYVVIAVASIVIVPHIFPQLKWYYIVVIYIIAPALAFCNAYGCGLTDWSLASTYGKLAIFTIGAWAGASQGGVIAGLAACGVMMNIVSTASDLTQDFKTGYMTLASPRSMFLSQVLGTAMGCVISPCVFWLFYKAFGNLGIPGSAYPAPYALVYRNMAILGVDGFSALPQYCLTLCCVFFVAAIGINLVRDLVGEKWAKFIPVPMAMAIPFYIGSYFAIDMCVGSLILFIWQRIDKVNADTFGSAVASGLICGDGIWTLPSSFLALAGVKPPICMKFLSRGVNTKVDGFLES

SEQ ID NO: 138584 - protein, 72 aa, Glycine max
  Coding DNA Sequence Number=SeqID_21806
MCVCVKEHGNPNSLMGYHEPITVNNRVQTKHEFDIAICNWKENPQMIHDHADELPWRKRKIFFFLNLAHLDV

SEQ ID NO: 138585 - protein, 1166 aa, Glycine max
  Coding DNA Sequence Number=SeqID_21807
  Gene Ontology: Mol. function=transcription coactivator activity; Cellular component=nucleus; Biological process=regulation of transcription, DNA-dependent
  Homolog annotation: Hit_ID=Q1SG77; Match level="QueryCoverage=97%, HitCoverage=66%, E-value=0.0, Identity=71%"; Hit description=Zinc finger, TAZ-type; Zinc finger, ZZ-type; Transcriptional coactivation; Zinc finger, FYVE/PHD-type
  Pfam annotation: Domain name=DUF902; Domain location=963-1020; Score =110.2; E_value=5.8e-30; Accession=PF06001.3; Description=Domain of Unknown Function (DUF902)
  Pfam annotation: Domain name=PHD; Domain location=1044-1095; Score =23.6; E_value=0.00024; Accession=PF00628.19; Description=PHD-finger
  Pfam annotation: Domain name=zf-TAZ; Domain location=656-735; Score =69.5; E_value=1.1e-17; Accession=PF02135.6; Description=TAZ zinc finger
  Pfam module annotation: Pfam domain module=DUF902::PHD::zf-TAZ; Domain location=963-1020::1044-1095::656-735
MKLQAHIPGEMSGQVPNQAGSQLSGLTQLNGNALPHQMPPLGGVPRSTINMDPDFLRARTFIHDKIFDMLLQRQQQPVTDVQRKKLKDLAKRLEEGMLKAALSKEDYMNLDTLESRLSNFLRRASMNNHNQQYPQLVNSSPIGTMIPTPGMSHVPNSTMMVASSMDASMISASGCNSIASTSFNSVNMLPAGGMLGSTLNRFDGLSNGYQQSSTSFSVASGGSISSMGLQRIASQMIPTPGFTVSSNHSHMNIDSNNTNGGAFSSVESTMVPLSQLQQQKQHVGGQNSHILQNLSGQMGSGMRSGLLQKPFTNSNGAINCGSGMIGNNMQLANEPGTSSDSYASTYANSPKHLQQHFDQNQKPVVQGDGYGMNNVDNFASGNFYASATSSGSMMNNQNTNSVKLPSMPKTSSLISGSNLHGMQQAAHIKSQPINQLEKFNFQSSLTSRDGFLHSQQQYQQRPQQLQQPDQYSQQQFQSMQSQQPQHVINSDTFSQSQLSSNIENRVKPEPGIEHHKVPNSHVSEQFHISEMQSQFQQNSSEDCSRGAQHLQFPSGHHDLSSSTPQNSQQMLHHHQLVAESQNNFNKSVILNQWPQSQDCNHILDSISHDQHLHMDFHQRISGQDEAQCNNLSSDGSIIDRAVLSRGSAEQLDCGIAIKKAHRNQQRWLLFLLHARRCSAPEGRCKERFCSSAQKLCKHIEGCTLRHCLYPRCHHTRVLLHHFMNCKDPCCPVCVFVRKYRRAFQLKPQIRPEAESSLPTAVNGSSKPYNIVGASPRLISKPPLVVETSEDLHPSIKRIKIEHCAQPINPENDHSASSFTANCESLVSRDAQSQRQAYPNVEKSISIQSELTEVKAEASAHVVHEKLSEMKMDNSNADYKMPSAEPVKYEEPPNLARPENMKTEKETGQDRQENVVQASENAAGTKSGKPKIKGVSLTELFTPEQVREHITGLRQWVGQSKSKAEKNQAMEHSMSENSCQLCAVEKLTFEPPPIYCTTCGVRIKRNNMYYTTGTGDTRHYFCLPCYNDARTENIIVDGTPIAKSRLEKKKNDEETEEWWVQCDKCEAWQHQICALFNGRRNDGGQAEYTCPNCYILEVERGERKPLPQSAVLGAKDLPRTILSDHIEQRLFKRLKQERLERARLQGKSYDEDMYVEVMFSVRTQGRP

SEQ ID NO: 138586 - protein, 111 aa, Glycine max
  Coding DNA Sequence Number=SeqID_21808
  Gene Ontology: Mol. function=catalytic activity; Biological process =cellular metabolic process
  Homolog annotation: Hit_ID=Q5Z8V8; Match level="QueryCoverage=75%, HitCoverage=12%, E-value=2e-40, Identity=94%"; Hit description =Putative UOS1
MPLVLFYSFPPGWVGTWQRSCGGQSQMEEPGGQRALIFDQGNRISQGISCADVADICVKALHDTTARNKSFDVCYEYIAEDGRELYELVAHLPDKANNYLTPALSVLEKNT

SEQ ID NO: 138587 - protein, 71 aa, Glycine max
  Coding DNA Sequence Number=SeqID_21809
  Gene Ontology: Mol. function=oxidoreductase activity; Cellular component=membrane; Biological process=electron transport
  Homolog annotation: Hit_ID=P93147; Match level="QueryCoverage=97%, HitCoverage=23%, E-value=1e-12, Identity=42%"; Hit description =Cytochrome P450 81E1
MTFNTIMRMVSGKRYHGEDCDVELARQFREIINELRLKRLSKRTDAFLHGLIEEHCNGKNTDQIIKGLALW

SEQ ID NO: 138588 - protein, 186 aa, Glycine max
  Coding DNA Sequence Number=SeqID_21810
  Homolog annotation: Hit_ID=Q1S5N2; Match level="QueryCoverage=47%, HitCoverage=17%, E-value=3e-17, Identity=53%"; Hit description=Viral capsid/hemagglutinin protein
  Pfam annotation: Domain name=DUF659; Domain location=61-186; Score= -35.7; E_value=0.00018; Accession=PF04937.6; Description=Protein of unknown function (DUF 659)
MSSAREATGSYSVAGSISRYCSYEVIKNAPGSRIDVAGNHGVSIDGNPRKIKCNECGKLDPARKVNEKIKGGRGVGTQYTISNIFNNLREEASQEISLLFYNNVIPFNVTKIEEFDKKLEFGCSTWVSEDNIVLVVTDNAANYKASREIMMEKRKRLHMTPFAAHCIDLMLEDLKKIPIHKETVER

SEQ ID NO: 138589 - protein, 157 aa, Glycine max
  Coding DNA Sequence Number=SeqID_21811
  Gene Ontology: Mol. function=catalytic activity; Biological process =cellular metabolic process
  Homolog annotation: Hit_ID=Q5Z8V8; Match level="QueryCoverage=76%, HitCoverage=14%, E-value=1e-25, Identity=57%"; Hit description =Putative UOS1
MIPHWSYKVAILHELELRDAEKIRLRPVEGNATMKQDLRSFKLILEYIKALPANGSSRTYIKARPGSKNRLVTGFETGQETDFVLVSCSGLGIEPSRREQVLKAKRAGEDSLRRSGLGYTIVRPGPLQGIPRLIFLQRGDAERVPIITTANFTSTKG

SEQ ID NO: 138590 - protein, 38 aa, Glycine max
  Coding DNA Sequence Number=SeqID_21812
MVGSSSSHSLTSETSAVTRSWVLEKLCTPLPRGSSLCE

SEQ ID NO: 138591 - protein, 72 aa, Glycine max
  Coding DNA Sequence Number=SeqID_21813
MAMADHVHVQHDGDLPFELIFWGIGVPIRAYINEGQMGGFLENTCVSLKKTIQCRVGVNSGSGCDVGRGGWG

SEQ ID NO: 138592 - protein, 506 aa, Glycine max
  Coding DNA Sequence Number=SeqID_21814
  Gene Ontology: Mol. function=chromatin binding; Cellular component =chromatin; Biological process=chromatin assembly or disassembly
  Homolog annotation: Hit_ID=Q1SAV4; Match level="QueryCoverage=76%, HitCoverage=99%, E-value=1e-126, Identity=57%"; Hit description =Integrase, catalytic region
  Pfam annotation: Domain name=Chromo; Domain location=409-459; Score =11.6; E_value=0.041; Accession=PF00385.14; Description='chromo' (CHRromatin Organisation MOdifier
  Pfam annotation: Domain name=rve; Domain location=109-265; Score =84.1; E_value=4.3e-22; Accession=PF00665.16; Description=Integrase core domain
  Pfam module annotation: Pfam domain module=Chromo::rve; Domain location=409-459::109-265
MTYQELLLKVQQSPADHPGFTVNQNWLLFRGKIWLPAGHDLSKVLLDEYHLTLLGGHMGVSKMLHRIQQHFWWPNMRKDIRQYIAACITCQQIKTETRKPVGLLQPLPTPSSLWSDLSMDFITGLSASQGYTTIMVIVDRYSEGTHFGPLPTHYTAHKVALPFMDTICKHHGFPNNIISDRDPIFISGFWRELFRIIGTKLRFSTTYHPQTDGQTEAINCVLEQYLRAFVHDHPQQWFKFLSLAEWSYNTSVHSGTGFSPFEYGTPPPAPSFYSTGTSTVEAVNAIRTSRDVIHQTLTHRLQKYQASMKHLADSHRWDLTYNIGDWVYVRLHLYHQTSLQPAYTKLSKRFYGPYRIQARVGNVAYRLELPPTSKIHPVFHVSLLKAHHGPIPLNIPTLPPFSTANHPIVRPLQLLDWKMDESSRPPTPQVLVQWARLALEDTSWEYWTQLKDIYDLEDKVCFQTGGIDSNSPLQPITQEPPIDKYQGPTRKSAHTHTRPTYLHNYE

SEQ ID NO: 138593 - protein, 77 aa, Glycine max
  Coding DNA Sequence Number=SeqID_21815
  Gene Ontology: Mol. function=ATP binding
  Homolog annotation: Hit_ID=Q1SL65; Match level="QueryCoverage=91%, HitCoverage=12%, E-value=1e-09, Identity=48%"; Hit description=Heat shock protein Hsp70; Actin/actin-like
MTLWRFTMEDTNIGLKKITTNNKHERLNLEEIRRMVRDSKRYKAEDEVAKKKVKVNYAYEMREKARKIEEAVEETIE

SEQ ID NO: 138594 - protein, 241 aa, Glycine max
  Coding DNA Sequence Number=SeqID_21816
  Gene Ontology: Mol. function=RNA-directed DNA polymerase activity; Cellular component=chromatin; Biological process=chromatin assembly or disassembly
MSIPQAVALAKLQEEKIQDRLRHSCTSYTPSGLLPSPPPPTTVPSTIKRLSAEELVVRRDKGLCYHCDEKWILSHRCRPRLHLLIADDDDDDCTNLPPTNPHLHNDDHGDPLESLQGPQISLNALAGMLTQETICLYGTIAHHQVIILMDGGNTHNFIQTRLASFLHPAQVPTVAMRVMIGNGSTIDCDTKHSARSSVVETARSGHHGLFLVDNELHVREPTHYATCRRTHPSQPSFDLTG

SEQ ID NO: 138595 - protein, 266 aa, Glycine max
  Coding DNA Sequence Number=SeqID_21817
  Gene Ontology: Mol. function=RNA-directed DNA polymerase activity; Cellular component=chromatin; Biological process=chromatin assembly or disassembly
MPTIDELLDEIGTTSWFSKLDLHQGFHQIRMNEEDIPKTAFRTHHGHFEFKVMPFGLTNAPSTFQATMNDLLWPFLRKFAAIFFDDILVYSPSFHAHLQHLQAILDTLAQGSFYLRRSKCTFAEQQLNYLGHIVSSQGVALDPEKIHAMTAWPTPTTPSDLRSFLGLTGFYRKFIHNYVSTAAPLTTLLCKDSFMWTPEAHTAFPHRKTLMTQALILASPNFTEPFILETDAFSTAIGAVLLQKSRPVAFFSKQLCPRMQQASTYV

SEQ ID NO: 138596 - protein, 102 aa, Glycine max
  Coding DNA Sequence Number=SeqID_21818
MMCNTLRTLTIVFTREGVMVEEMCLDYIFIVTDRVAAIENGLFSHKATPLFDKLAFEKTQQALGGHLDHHYHLEDKVFFNGIGDVRKGIMAQQDTTSKHRHE

SEQ ID NO: 138597 - protein, 487 aa, Glycine max
  Coding DNA Sequence Number=SeqID_21819
  Gene Ontology: Mol. function=transporter activity; Cellular component= integral to membrane; Biological process=transport
  Homolog annotation: Hit_ID=Q1SG73; Match level="QueryCoverage=99%, HitCoverage=97%, E-value=0.0, Identity=74%"; Hit description=Major facilitator superfamily
  Pfam annotation: Domain name=MFS_1; Domain location=30-447; Score =112.0; E_value=1.7e-30; Accession=PF07690.6; Description=Major Facilitator Superfamily
  Pfam annotation: Domain name=Sugar_tr; Domain location=21-486; Score =57.3; E_value=4.9e-14; Accession=PF00083.14; Description=Sugar (and other) transporter
  Pfam module annotation: Pfam domain module=MFS_1::Sugar_tr; Domain location=30-447::21-486
MTGAEGPTYTVDDALVALGFGNFQILVLAYAGVGWVSEAMEMMLLSFVGPAVQTAWNLSAHEESLITSVVFAGMLIGAYSWGIVSDKHGRRKGFLITATVTALAGFLSAFAPNYIFLIVLRSLVGIGLGGGPVLSSWFLEFVPAPNRGTWMVVFSAFWTLGTIFEASLAWIVMPKLGWRWLLALSSLPTSFLLLFYKVTPESPRYLCLKGRTADAINVLEKIARVNGRELPSGILVSEHEIELHKIDNPTEDARLLSPRTNEDEHPKGIVSNLGAISSLLVLLSPKLARSTLLLWAVFFGNAFSYYGLVLLTTELNGHSKCMSDKLQTEKSQDVRYKSVFIASFAELPGLLLSAAAVDKLGRKLSMSIMFFMCCIFLLPLLFYLPEGLTTSFLFLARICITATFTIVYIYAPEMYPTSVRTTGVGIASSVGRIGGMICPLVAVGLVHGCHQTAAVLLFEIVSLVSGICVMFFPIETMGQELRNNVQV

SEQ ID NO: 138598 - protein, 87 aa, Glycine max
  Coding DNA Sequence Number=SeqID_21820
  Homolog annotation: Hit_ID=Q6K7P0; Match level="QueryCoverage=75%, HitCoverage=6%, E-value=5e-08, Identity=42%"; Hit description =Putative DNA-binding protein PD3, chloroplast
MTKEAIEKSCPYCQGNCNCKSCLRRKDVYVDSGDLGVPQNKDEKIRHLKHLVRALYPFLEQFNHEQQSEMEMEAKTKARLASAAISN

SEQ ID NO: 138599 - protein, 154 aa, Glycine max
  Coding DNA Sequence Number=SeqID_21821
MAPVLRDLISNTLNIVHAPSLGKYLCLKFIHGRSKIVDFLLVERIHNPWPRGRGSFLTKQSIQKAIVSFQVGFGVRLGDSQSPLWHLDYLGRGNLVSRFLTFIFVTRELWLRVSNGNGSLLSHTNLFAWTQAVLSNNDCAYKVLEAWWAWKWCN

SEQ ID NO: 138600 - protein, 359 aa, Glycine max
  Coding DNA Sequence Number=SeqID_21822
VSVLRVQFPGKHSRSGFFKEYCCPDTWCVEEGLSSFLPCHIISFMGEWIVGAFINLFGSIAINFGTNLLKLGHNERERHLLGSDGVNGKMNLKPIIYFQSWRIGIVFFFLGNCLNFISFGYAAQSLLAALGSVQFVSNIAFAYFVLNKMVTVKVLVATAFIVLGNVFLVAFGNHQSPGGENFCLQYQDMTSDPIGACYCPFHMLQLLQHVAMPHDTIAIVPNVNFLAVLTYYDWLCPMVISCTADNMDFLLNLYRIYLFSRISETPWGMGSTYKTRPSLDNHKQAKRTFQFKFSNFKSETLKNRCQGARYRRELENREPSSQQKTDVKENHPANSANISAEEKRNNEGEEDSMQQWFQL

SEQ ID NO: 138601 - protein, 201 aa, Glycine max
  Coding DNA Sequence Number=SeqID_21823
  Homolog annotation: Hit_ID=Q676U0; Match level="QueryCoverage=99%, HitCoverage=96%, E-value=1e-28, Identity=37%"; Hit description =Disease resistance gene
MEAHSPVIAKKLWNVLRITFFMIRKGLVSKRKLIMDMNLMMKKGKLLRKSMSNFMSSHHHHHHHHSKSLARGYGMQEYEFSCSNSPSPVFFHVPKKKHHFNFPCMNTTEVVEEPRPVVLVPNMTPEYTFNHRFDNASDFAPGERISPFTVRISNYSSEDEENEQEGGNGNAQVDDQAEAFIRRFYEQLRMQSRMQLLEYQE

SEQ ID NO: 138602 - protein, 86 aa, Glycine max
  Coding DNA Sequence Number=SeqID_21824
MVPPACPSHFQFGERCLARALRRAGLGTAIATTLFCMESRCYNFDFGDHIMPNSLNPAWEALFLLTACMISRETVALLCDHRKTSK

SEQ ID NO: 138603 - protein, 103 aa, Glycine max
  Coding DNA Sequence Number=SeqID_21825
  Subcellular localization annotation: CTP_CleavageSite=56; ConfidenceScore=5.53e-01
MGSPAPKGDSSSTPPPKPPNRLPNANFMKPSFKEKVVGQPLEPNVVHNLVEETFLRLELKEEADREKVMNDALGWCLIITSQVQPWSPKLSVADATIDKTLVW

SEQ ID NO: 138604 - protein, 358 aa, Glycine max
  Coding DNA Sequence Number=SeqID_21826
  Gene Ontology: Cellular component=membrane; Biological process =transport
  Homolog annotation: Hit_ID=Q013R1; Match level="QueryCoverage=73%, HitCoverage=67%, E-value=6e-62, Identity=48%"; Hit description =Homology to unknown gene
  Pfam annotation: Domain name=DUF6; Domain location=128-252; Score =79.8; E_value=8.7e-21; Accession=PF00892.11; Description=Integral membrane protein DUF6
  Subcellular localization annotation: CTP_CleavageSite=63; ConfidenceScore=5.76e-01
MASWWCSSPSATLTVAAAAATTATCHSSLIPHTSQFRIQTLTFPLSSFPLSTTASSSLRFRLPCSNKTAFETELPEDGVDCVGTGQDVECLVNTEEKQSEPTSSSSSSSMLCLAEALWEGAVLVSPFFFWGTAMVAMKEVLPKCGPFFVSAFRLIPAGFLLVAFAASRGRSLPSGFIAWLSITLFALVDATCFQGFLAEGLQRTSAGLGSIIIDSQPLTVAVLAALLFGESIGVVGAAGLVLGVIGLVLLELPALSFDESNFSLWGSGEWWMLLAAQSMAVGTVMVRWVSKYSDPVMATGWHMVIGGLPLVLFAVLNNDPALSLSLKEYSSTDILALLYTSVFGSAVSYGVFFYSATK

SEQ ID NO: 138605 - protein, 37 aa, Glycine max
  Coding DNA Sequence Number=SeqID_21827
MVQLAGVGANSTLVIASPNANFDSLVLKDSGKVQIAP

SEQ ID NO: 138606 - protein, 738 aa, Glycine max
  Coding DNA Sequence Number=SeqID_21828
  Gene Ontology: Cellular component=ribonucleoprotein complex; Biological process=mRNA metabolic process
  Pfam annotation: Domain name=Vicilin_N; Domain location=172-283; Score=-72.8; E_value=0.076; Accession=PF04702.3; Description=Vicilin N terminal region
  Subcellular localization annotation: CTP_CleavageSite=34; ConfidenceScore=5.57e-01
MGACLSKKKGSSTATTKSAASSTVPELKNNSPFSVSGVVNVSKPNVEEVKLKKDNSKKGKEEKKHETVPPEPEGHVKKEIFIIKHRKNHDDNNNRVRNNSNSKSPPFTEESTICDKTAPTANMGGGGGGVGVRTSSCTKEEVDAILIQCGRLSRSSSGNAIAAEHKRRYSGSKRSYDFDHCDNDTVSNDDDSKKVNANESNSDLCEEERHQHQHRPRHRQSPSPNRRPSSSSQERRRRTPSREREQQQQRSSSRERRVSRSPGRRSSENTTPSNARNNNSSNNTSSRPGKMVSVPATVSSLVMDKSNNNGSGESGATTGIKRIAVKRNVGAASPRSQSPARANGNGANGNKAFSENQQQPSLSRSNSRKAEQSPYKRNPLSEIEPNSLAFPHSTTNNSSSRVQNRPKKEFETEANQCFSLQQKTNGNRTASDKGVTINCKTKVQQEEDVKVQSSITDNVVVKTMVPPGVDNLKPPYTLTRSRSSRRSQELDINCEALLNPPPQSYASLLLEDIQNFHQKNTPPVSLPACVTKACSILEAVADLNSNAGLNFCSGEDRRSPLAFQCSRNDYNVPLTTNDYGKREPDAEDPVVESMLVFNDDDVMEPNLHKYVTVNRGGSLGGADMDDQESSGSNSFTVSSGQQHWGVSSSSWEPSSVESKDCWTSRSNYSKEECQRSPLGLEGTVASEVAGRDAGGAKKKLNSQRRECDHQHGSGIGRGRLGANKVLHNIPVVTAAAST

SEQ ID NO: 138607 - protein, 81 aa, Glycine max
  Coding DNA Sequence Number=SeqID_21829
MHDCHSSRGRQVRNTKMVAKESKEVRDLKTNKEINDSDGRCKSSKTLGIEAPYLDLKKAGPRSPCNSDVIYLLPDLKALRV

SEQ ID NO: 138608 - protein, 355 aa, Glycine max
  Coding DNA Sequence Number=SeqID_21830
  Gene Ontology: Mol. function=oxygen transporter activity; Cellular component=chloroplast thylakoid membrane; Biological process =chloroplast organization and biogenesis
  Homolog annotation: Hit_ID=Q8GT66; Match level="QueryCoverage=63%, HitCoverage=47%, E-value=4e-54, Identity=59%"; Hit description =Chloroplast protein translocon component Tic40
  Subcellular localization annotation: CTP_CleavageSite=46; ConfidenceScore=5.19e-01
MEKLNLALVSSPKPLMLGHVPARDVFRRKHFSFGRVLIAPHRCRFRVSALSSSHHNPKSGIQFLNFFLLFCFYEKRFIESLDSDGVNQMKCVFLKLKSHGYTWLTISKGLRECLDKRLVKKRTFYYITLFRVTSLLDWCWCWAFCTVFSGSFKTEGLGAWIKRLRLSLQRKSYKFIHKYAMQQAFKTMMGQMNSQNNQFGNAAFSPGSPFPFPMPTAAGPTAPASSATTQSRAPSASSASQSTITVDLPAAKVEAAPTTNVKDEVELKNEPKKIAFVDVSPEETVRESPFESFKDDESSSVKEAWVPDEVSQNGAPSNLGFGDFPGSQSTKKSALSVDALEKMMEDPTVQKMVYP

SEQ ID NO: 138609 - protein, 75 aa, Glycine max
  Coding DNA Sequence Number=SeqID_21831
MTIHSDVLLKLTMYIPATVTKAPTSCTGEKEIPGAKVVKRSLFLLKDLKLLENPESIPLSGSLTQKLKQTLGSKT

SEQ ID NO: 138610 - protein, 254 aa, Glycine max
  Coding DNA Sequence Number=SeqID_21832
MSTSSVPHGKLMTLIFRHFGMPLDDEAKNDKVLTWGEKNVTALKPSSLPIDLIKSGKRLKVRVGRCPRSKFEEVKESSKKEEEENVIPSSVVAAKVYVLEKEVFKQNENFGDEENDLNMEIITDVLTGLRTVDSSLEKEDTEKEEDKQEKSSKKANKVEVATKIAQIVLEVAAGERTPNGFVKDSLFNINNMQNLLSSPIFDTYVKIACGLGPLDGKPLTFSIPFPQFPSESTTVQPSKVQEEVPYVHVSSPPL

SEQ ID NO: 138611 - protein, 55 aa, Glycine max
  Coding DNA Sequence Number=SeqID_21833
MTDSDANHNDPSLDTDAEAPNEPFRREGNTSGMELRFGVQTSTALQDCQIVVSTT

SEQ ID NO: 138612 - protein, 172 aa, Glycine max
  Coding DNA Sequence Number=SeqID_21834
  Subcellular localization annotation: CTP_CleavageSite=57; ConfidenceScore=5.72e-01
CSLGTWTSSPPSGPSSGPGSTAPAASFAAAAAGAPPPASARATSPAPCLPRRPRSPPAAAERTHNPTRPSVLSRQLGTGFLAGTRKSSLRFKIFVHINTMPPGRWKIWHNYRPRHHDSEVNRGAGDEEEEFFEDEECKGMMVALGSDGGSCCIRETSGIKASLVLSEIDSSR

SEQ ID NO: 138613 - protein, 86 aa, Glycine max
  Coding DNA Sequence Number=SeqID_21835
  Subcellular localization annotation: CTP_CleavageSite=53; ConfidenceScore=5.10e-01
MATPSRSNSGSARNPVPSWRLSTDGRVGLCVLSAAAGGDRGRRGRHGAGEVARADAGGGAPAAAAANEAAGAVLPGPLLGPDGGDE

SEQ ID NO: 138614 - protein, 612 aa, Glycine max
  Coding DNA Sequence Number=SeqID_21836
  Gene Ontology: Mol. function=pepsin A activity; Cellular component =cellulose and pectin-containing cell wall; Biological process =proteolysis
  Homolog annotation: Hit_ID=Q9SJG1; Match level="QueryCoverage=88%, HitCoverage=99%, E-value=1e-132, Identity=47%"; Hit description =Putative chloroplast nucleoid DNA binding protein
  Pfam annotation: Domain name=Asp; Domain location=188-556; Score= -126.9; E_value=4.1e-06; Accession=PF00026.14; Description=Eukaryotic aspartyl protease
KFSKLYIVYAIKQGESSTMVMKVSLILVLLSIFCVTFKPYTEDDDQNYHNNDPTLTNKEFYKGAKSSESTRLNKEEDGDDATSAKPDKRSAKLQLRRRPINHGNEPKTHALDSAIRDLVRIQTLHRKIIEKKDTKSMSRKQEVKESITIQQQNNLANAFVASLESSKGEFSGNIMATLESGASLGTGEYFLDMFVGTPPKHVWLILDTGSDLSWIQCDPCYDCFEQNGSHYYPKDSSTYRNISCYDPRCQLVSSSDPLQHCKAENQTCPYFYDYADGSNTTGDFASETFTVNLTWPNGKEKFKQVVDVMFGCGHWNKGFFYGASGLLGLGRGPISFPSQIQSIYGHSFSYCLTDLFSNTSVSSKLIFGEDKELLNNHNLNFTTLLAGEETPDETFYYLQIKSIMVGGEVLDISEQTWHWSSEGAAADAGGGTIIDSGSTLTFFPDSAYDIIKEAFEKKIKLQQIAADDFVMSPCYNVSGAMMQVELPDFGIHFADGGVWNFPAENYFYQYEPDEVICLAIMKTPNHSHLTIIGNLLQQNFHILYDVKRSRLGYSPRRCAERLPSPLSPMSSDVLHHHFTTALVPLKLLAGLPMCNKRWSLKWNNWLRPDFKR

SEQ ID NO: 138615 - protein, 790 aa, Glycine max
  Coding DNA Sequence Number=SeqID_21837
  Gene Ontology: Mol. function=protein binding; Cellular component =cytoplasm
  Homolog annotation: Hit_ID=Q6Z0T2; Match level="QueryCoverage=76%, HitCoverage=94%, E-value=1e-147, Identity=48%"; Hit description =Putative rubisco subunit binding-protein beta subunit
  Pfam annotation: Domain name=YTH; Domain location=597-682; Score =187.2; E_value=4.1e-53; Accession=PF04146.6; Description=YT521-B -like family
DMKIFKDKKWQPWFIINQAKTTYDIAFSPPPNPKAQKQPLAVSRSSLAENSIKLDVDGSSLGNPGKAGFSEILCDNLGQWLSSFLGSCGFATSLNAELHVLFHGLSLAWNSGYKSVEEANICANWLSKKGSSSTEPMSTLVPCPISLSPMSLVDALRIFMAATQPPQGPDRTTEEIPAEPDNLKEQGTTTIGHSRETTSQSGSLGSVGDCPLYPPNVYAPQAQAFYYRGFDNGNGEWDEYSSYVNSEGLDIGSPGVYNENPSLIFHSGYGFNPQVPYGPYSPVTTPLPSVGVDTQLYSPQQFPYTGPPYYHQLVPPSLPYLNSPTPVSQPELTNLVGIDQQVDNMFFGPRAGYPSVGSFGRGNFPVAPGSFGFHESQQGFEGSRSGGIWSDCSKPSERQRSLMPLSPSVSPQPMGSLGSFGPSVGMASHQQQSLYGFGSGSNSYGRGYLPNQGSSFGGTSISNLNDRSFASLENSRRQGRPTASLCNCNGTLDILSEQNRGPRASKLKNQISTENNSVDSSKNSASTAKFQNESLNRSDFATDYKDAKFFVIKSYSEDNVHKSIKYGVWASTPNGNRKLDDAYRQAMEKQDACPIFLFFSVNASAQFCGVAEMVGPVNFDKSVDFWQQDKWSGQFPLKWHIIKDVPNSQFRHIILENNDNKPVTNSRDTQEGVEMLTIFKNYETDVSILDDFDFYEDRQKAMQERKARQQSSMVATGLVGENEHRSSANTTGDFMKQMSKSFALVVRLDENNKEVVADRDSLVSHGHGPIGNVVKPDDGQSVTASSTQTS

SEQ ID NO: 138616 - protein, 286 aa, Glycine max
  Coding DNA Sequence Number=SeqID_21838
  Gene Ontology: Mol. function=ATP-dependent helicase activity; Cellular component=nucleus; Biological process=translation
  Homolog annotation: Hit_ID=Q3EBD3; Match level="QueryCoverage=92%, HitCoverage=52%, E-value=1e-95, Identity=65%"; Hit description=DEAD -box ATP-dependent RNA helicase 41
  Pfam annotation: Domain name=DEAD; Domain location=1-82; Score=-24.2; E_value=0.00062; Accession=PF00270.19; Description=DEADDEAH box helicase
  Pfam annotation: Domain name=Helicase_C; Domain location=152-228; Score=89.2; E_value=1.2e-23; Accession=PF00271.21; Description =Helicase conserved C-terminal domain
  Pfam module annotation: Pfam domain module=DEAD::Helicase_C; Domain location=1-82::152-228
MAGQLHRIQQGVELIVGTPGRLVDLLMKHEIDLDDVMTFVVDEVDCMLQRGFRDQVMQIYRALSQPQVLMYSATMSNDLEKMINTLAKGMVVMSIGEPNTPNKAVKQLAIWVESKQKKQKLFEILASKKHFKPPVVVYVGSRLGADLLANAITVATGIKAVSIHGEKSMKERRETMQSFLVGEVPVVVATGVLGRGVDLLGVRQVIVFDMPNNIKEYVHQIGRASRMGEEGQGIVFVNEENKNVFAELIDVLKSGGAAVPRELANSRYATRVFSGGKGSKKRKHTG

SEQ ID NO: 138617 - protein, 463 aa, Glycine max
  Coding DNA Sequence Number=SeqID_21839
  Gene Ontology: Mol. function=RNA-directed DNA polymerase activity; Biological process=RNA-dependent DNA replication
GNASFLALIPKVNDPQGLNDYRPISLIGCIYKIVAKLLSNRLEKVLPGIIDECQYALRRAAEGLASLMREAQEQKLYERIKIGKDEVDISLLQYADDTIFFGKASLENVKAIKVLLRSFELVSRLRITFAKSKFRAIGMSHHWIQNAANYLSCKVLVIPFLYLGIPIGANSRCSVIWDPIVERCERKLSKWNQRHLSFRGRGPKEGGHQIGEATAMVLKGWKFRPKENCLGKMEDNCLPKEKGGLEMRDIAKFNCVLLRKWHWNLFHHKGELWARVLDSKYRSWRSLDESRSNTSDSIWWWDLRHVCNASGEEGWFRGSIEWKIGCGAKYILAATEFNSADGDSNNGRMGMAPRVERRFREVEVDTVAKFMEDIQAVTMQVNQQDSWEWRLDSWGVYTVASAYKVWKLKIPSKVSHFIWRLIQERLPTKVNMRRRNVELNDILCPFCRLNEEEELAQKFGKRI

SEQ ID NO: 138618 - protein, 219 aa, Glycine max
  Coding DNA Sequence Number=SeqID_21840
  Gene Ontology: Mol. function=protein kinase activity; Biological process=protein amino acid phosphorylation
  Homolog annotation: Hit_ID=Q1SG68; Match level="QueryCoverage=59%, HitCoverage=34%, E-value=2e-56, Identity=76%"; Hit description=Lipid- binding START
  Subcellular localization annotation: CTP_CleavageSite=77; ConfidenceScore=5.42e-01
MTMSVLNIYGYGYGVVAVVVFLILLLWQRHRFFFASSPSSPSTSLLLFDSINSNSNSRSRTSNFVTDADLKFLMEILDEKLGSDKWEDVLDKRNHHLSYSVKCCRPKNGPLKYLSKTVFNDISSEMLRNFYMDNDYRKQWDKTLVEHKQLQVDKSDGTEVGHTIKKFPLLKPREYVLAWKLWEGSDKTFYCFMKKLLTIAKLGLVELSYALLILANSSA

SEQ ID NO: 138619 - protein, 78 aa, Glycine max
  Coding DNA Sequence Number=SeqID_21841
MPLHFIFLPHCPWSLLLFLISLSLCIEQGYVEEAGYCLLKAIKADPKDVTFRGHLARLLIGVKKLSCFRGCQCQCPQR

SEQ ID NO: 138620 - protein, 66 aa, Glycine max
  Coding DNA Sequence Number=SeqID_21842
  Gene Ontology: Mol. function=catalytic activity; Biological process =carbohydrate metabolic process
  Homolog annotation: Hit_ID=Q8GTM7; Match level="QueryCoverage=98%, HitCoverage=20%, E-value=2e-23, Identity=71%"; Hit description =Putataive glucan 1,3-beta-glucosidase
MTVAIKIVVEHWSTFIVENDFKFIASNGLNATRIPIGWWITSDPNPPWSYVGGSLHALDNAFLWAQ

SEQ ID NO: 138621 - protein, 114 aa, Glycine max
  Coding DNA Sequence Number=SeqID_21843
  Homolog annotation: Hit_ID=Q1SG68; Match level="QueryCoverage=57%, HitCoverage=17%, E-value=4e-25, Identity=81%"; Hit description=Lipid- binding START
MSISCDSSERLPDCTVELDELGLPIEWVFYKASNSSPSYAKSFLPGSNACEITMFHQEDAGLNTEMAKLAFRKGIWNYVCKMDNALRRYSVIGYHLSSSVTTSIDLMQKGSVSD

SEQ ID NO: 138622 - protein, 238 aa, Glycine max
  Coding DNA Sequence Number=SeqID_21844
MKNKPQSKEEAVTAKVSDRDNDKGKGIANQRTTTTGGRNYGTKKWTPKPAHANSIPSCSSVQLTIQLDKKPWLTNTWVGRLKNLVMFDRLKEEFMWDRGIESNLSMFHTLERWSPSLRAGFRLAWVMCWGIPLHAWDAKNITKIENGIGEVMDVDEDEGQADGKSPISNTVSDAKGDARAVNCGMPRWADTAEQQEGDMEDSRQQNLAAESNHIGEADAVLSRRGGNQFKSVKKTKQA

SEQ ID NO: 138623 - protein, 185 aa, Glycine max
  Coding DNA Sequence Number=SeqID_21845
MAKNIGVNFSKQDGTIIGKLINMEERDKGINQGKGSNETKKEAIDKTLCQALWGDAESDATFKMEKKVMGNGFIYLEGTWVGDGGKNGGSIKEFNDWIVDLDVEDVPSVGRKFTLYRPNGTAKSKIDRVLVSADWFCKWQDSIQIILDRNFSDHCPILLRSSFVDWGPKPFRFLDCWLQDKSLRK

SEQ ID NO: 138624 - protein, 102 aa, Glycine max
  Coding DNA Sequence Number=SeqID_21846
  Homolog annotation: Hit_ID=Q1SN43; Match level="QueryCoverage=69%, HitCoverage=12%, E-value=5e-09, Identity=46%"; Hit description =Nucleic acid-binding, OB-fold, subgroup
MVRVVRLWMVSNVLTNKQTSTIEIPLSMEMVLVDPVEDKVHGSVKRTLIYKFDKTLQERKVYSIQFFVVENGGILTGVGTERENERNGRRTKMNVIQIEDDR

SEQ ID NO: 138625 - protein, 115 aa, Glycine max
  Coding DNA Sequence Number=SeqID_21847
  Gene Ontology: Cellular component=chloroplast thylakoid membrane
  Homolog annotation: Hit_ID=Q2HTB6; Match level="QueryCoverage=81%, HitCoverage=56%, E-value=2e-14, Identity=40%"; Hit description =Thylakoid membrane phosphoprotein 14 kDa, chloroplast
MSKVVLIVLWVSRKSSLLQTRASSEESSSVDANEWDALENKSTVLLYGGGAIVAIWLSSILVSAINSVPLLPKIMELVGLGYTGWFVYRYLLFKSSRKELATDIESLKKKITGTE

SEQ ID NO: 138626 - protein, 247 aa, Glycine max
  Coding DNA Sequence Number=SeqID_21848
  Homolog annotation: Hit_ID=Q84YF3; Match level="QueryCoverage=93%, HitCoverage=76%, E-value=9e-18, Identity=27%"; Hit description =Hypothetical protein 4B
  Pfam annotation: Domain name=DUF1191; Domain location=1-243; Score =148.7; E_value=1.6e-41; Accession=PF06697.3; Description=Protein of unknown function (DUF1191)
MVASYIVNIVFVFVMFGMEVSVVRLHRFSLWSRGMNYSFFSLPPRILPQPNEKRITILFENLGNWSSHYFNVPNYTIVAPVFGVMAYNSSEKVLVDEKINFTTHGDPIRIRFPHVGQHGKNDTPICAEFSAGELVKFKNMTEPYVCEVYSQGHYTLVVPSFPSPKEPNSRSHSKRFTKWWVLGFVIGFVGLVILVLILLALVKEAKKRRIRKMERNSEGGELFDTFWIGETKLPSASMLRTQPTLEN

SEQ ID NO: 138627 - protein, 108 aa, Glycine max
  Coding DNA Sequence Number=SeqID_21849
MGTTPSQNIQQIKKRNPDSRQIQIKKANASLCPFLFVLRISDAPEIDEVAIKRADLRDLNGFLCSNECHQPMKAGSAVVYPEWRLETWRRQRGMVAYGGEVMVRSDGK

SEQ ID NO: 138628 - protein, 127 aa, Glycine max
  Coding DNA Sequence Number=SeqID_21850
MSNNSPRRRHNNLLHLRRLRQRHEQAGVLVEKGLSFELKAHTFVAFFEVAQKDDMAWLVEDFFDNASTLLITLVLDAFSSDDRIKMNVHPDVHFEELARSTDDFNRADASGMAESLKEHKFPSIVDP

SEQ ID NO: 138629 - protein, 195 aa, Glycine max
  Coding DNA Sequence Number=SeqID_21851
  Gene Ontology: Mol. function=protein serine/threonine kinase activity; Cellular component=membrane; Biological process=protein amino acid phosphorylation
  Homolog annotation: Hit_ID=Q2R4L1; Match level="QueryCoverage=99%, HitCoverage=37%, E-value=3e-37, Identity=42%"; Hit description =Protein kinase domain containing protein, expressed
  Pfam annotation: Domain name=Pkinase_Tyr; Domain location=1-151; Score=-173.1; E_value=0.075; Accession=PF07714.7; Description =Protein tyrosine kinase
MANSSLDKFLFGDKKGSLIWKQRDIKTANILLDDDLQPKIADFGLARLLPGDRSHVSTLGYTAPEYALNVLEIISGQKRTNVTGDEDDREYLLQRSWKLYERGSHLQLLEEDINPNEYDAEEVKKIIEIALLCTQASAAMRPTMSEVVLLLKSKSLMEHLQPTMPVVIGTNTMPREGNSTTSSNDIASISIPSAR

SEQ ID NO: 138630 - protein, 71 aa, Glycine max
  Coding DNA Sequence Number=SeqID_21852
  Subcellular localization annotation: CTP_CleavageSite=33; ConfidenceScore=5.81e-01
MAAAAAVTVLLPPRIPTTTNVTRCSALPSLPPRVSNTKTTLFSPSLNNFSEMSNFSFRPAKIAFGRNASGK

SEQ ID NO: 138631 - protein, 120 aa, Glycine max
  Coding DNA Sequence Number=SeqID_21853
  Gene Ontology: Mol. function=protein kinase activity; Cellular component=integral to membrane; Biological process=protein amino acid phosphorylation
  Homolog annotation: Hit_ID=Q6R2K1; Match level="QueryCoverage=72%, HitCoverage=15%, E-value=2e-27, Identity=55%"; Hit description =Strubbelig receptor family 5
  Pfam annotation: Domain name=LRRNT_2; Domain location=29-70; Score =39.5; E_value=1.1e-08; Accession=PF08263.3; Description=Leucine rich repeat N-terminal domain
MHHNHNLNLARLWIALLAVSTTVVHCKTASQDVSALNVMYTSLNSPSKLSGWKSSGGDPCGDSWEGIKCSGSSVTEIDLSNNNFKGDIPYQLPPNARYMTVKIQECNLLRIFLLLGNLHL

SEQ ID NO: 138632 - protein, 305 aa, Glycine max
  Coding DNA Sequence Number=SeqID_21854
MLLFYHHDLKFSNLSWASPLRFFFLDRPISHYHSTLPFSCPTSETHTPKPPPSPESTIRHQPITGTMLRLLKPQPFPSGHHLIQRCAVSGTAKGKAKIKAGQALKRSRITTKKPGSATAGPPMSRERQERERLYEQCLQAPTPLRHLTQKEREREAEREKLGLISKDRQREIDMMKRKDDKFKVSEKPTIIGTPGLDYVSLGLVDVDKLPKYDLTVEDGRRLAKEYSRVLMRKHRARQAAESNLLRMKKEAIEALPEGLREAALVPDLAPFPVNRFMATLTPPIEGYIEQVREAANRISGKEKIR

SEQ ID NO: 138633 - protein, 49 aa, Glycine max
  Coding DNA Sequence Number=SeqID_21855
MAFLTMFSLLEITNARDLYGYVTDDAPCPSPTTGTGDAVTSNHAHVHWK

SEQ ID NO: 138634 - protein, 347 aa, Glycine max
  Coding DNA Sequence Number=SeqID_21856
  Gene Ontology: Mol. function=protein kinase activity; Cellular component=integral to membrane; Biological process=protein amino acid phosphorylation
  Homolog annotation: Hit_ID=Q1SG69; Match level="QueryCoverage=99%, HitCoverage=50%, E-value=1e-159, Identity=82%"; Hit description =Protein kinase
  Pfam annotation: Domain name=Pkinase; Domain location=64-331; Score =93.0; E_value=9.1e-25; Accession=PF00069.15; Description=Protein kinase domain
  Pfam annotation: Domain name=Pkinase_Tyr; Domain location=64-331; Score=91.0; E_value=3.6e-24; Accession=PF07714.7; Description =Protein tyrosine kinase
  Pfam module annotation: Pfam domain module=Pkinase::Pkinase_Tyr; Domain location=64-331::64-331
  Subcellular localization annotation: CTP_CleavageSite=48; ConfidenceScore=5.56e-01
MDSTSIDVKALQKSPSVSVRSSVSDCVQSFNDNEFANRLNSKRSTSIRVTTFSHAELQSATANFASGRLLGEGSIGCVYRAKYADGKVLAVKKINPSLLHGGPSEEFSQIVSRISKLHHPNIVELVGYCSEPEHMLIYDYFRNGSLHDFLHLSDDFSKPLTWNTRVRIALGAARAVEYLHEICSPPLLHKNIKSSNILLDTDLNPRLSDYGLESFYQRTGQNLGAGYNAPECTKPSAYTQKSDVYSFGVVMLELLTGRMPLDSSKTKAEQSLVRWATPQLHDINAVEKMVDPALRGLYPPKSLFRFADIVALCVQSEPEFRPPVSELVQALVRLVQRSSMTMREDFE

SEQ ID NO: 138635 - protein, 139 aa, Glycine max
  Coding DNA Sequence Number=SeqID_21857
  Gene Ontology: Mol. function=hydrolase activity, hydrolyzing O -glycosyl compounds; Biological process=carbohydrate metabolic process
  Homolog annotation: Hit_ID=Q8RU06; Match level="QueryCoverage=58%, HitCoverage=16%, E-value=2e-17, Identity=59%"; Hit description =Putative Glucan 1,3-beta-glucosidase
  Subcellular localization annotation: CTP_CleavageSite=37; ConfidenceScore=5.02e-01
MAKWLPTQLKMSWSRFTNKITDEPRGATPLATAIEARARAKASVGTLGSIFVLSLGGGTILVANCTVASGWETFRLWRINEDSFRLRVFNKQFVGLDGINVVAVSNICTYSETFHIVKEGDNSSRIRIKASNGYFLQRQ

SEQ ID NO: 138636 - protein, 261 aa, Glycine max
  Coding DNA Sequence Number=SeqID_21858
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=98%, HitCoverage=21%, E-value=5e-66, Identity=43%"; Hit description=Chromo
  Pfam annotation: Domain name=Chromo; Domain location=211-261; Score =14.5; E_value=0.019; Accession=PF00385.14; Description='chromo' (CHRromatin Organisation MOdifier
MDFMTRLPNSSGFTVIMVVIDRLKKYSLFVAMKFDYTNNIVAKAFMCHIVKLHGVPKTLVQYLFHSSLGITPFQALYGREPPALLRYNGSSQDPPAVLKGNLINAQTAMKIQADKKRLDRNFQVGDEVLVKLQPYRQHSAALRKNQKLSIRYFDPFTVLEKIGKVAYKLQLPDTTKIHPVFHASQLKQFQRASTEPYVSLPLSTFELGPLLGPMDILETWIIVKGSTLIPQVLIQWQGCSTIEATWEDVTKIQASYPIIQP

SEQ ID NO: 138637 - protein, 220 aa, Glycine max
  Coding DNA Sequence Number=SeqID_21859
  Homolog annotation: Hit_ID=Q2HV98; Match level="QueryCoverage=42%, HitCoverage=17%, E-value=5e-27, Identity=53%"; Hit description =Dynamin central region; Dynamin; Dynamin GTPase effector
MELQAKTQELVTADVLEVSEWEDDDPTIFVMTIAARLQGEFQVTNATVQFATRIVPPPRLSTKILPNVPTDAFAYTHKLVRNPSSSFDGGGERRRSSRLVGDLVGEPAPGHLQLCREPLCHRPPVGSSGLRIIKKLDIMDRGTDAWNLLLGKVIPLRLGYVGVVNRSQEAVLPGLRARISASLVTLAKEHASYGEITESKACAGQGALLLNILSKYCDGT

SEQ ID NO: 138638 - protein, 216 aa, Glycine max
  Coding DNA Sequence Number=SeqID_21860
  Gene Ontology: Mol. function=protein dimerization activity; Cellular component=nucleus; Biological process=regulation of transcription, DNA-dependent
  Homolog annotation: Hit_ID=Q9FGV1; Match level="QueryCoverage=85%, HitCoverage=22%, E-value=2e-99, Identity=91%"; Hit description=Auxin response factor 8
  Pfam annotation: Domain name=B3; Domain location=151-212; Score=16.0; E_value=0.0011; Accession=PF02362.12; Description=B3 DNA binding domain
MAISGNVPPLLVQGEKQKKVKLDDMKLSTSGLGQQGHEGGEKKCLNSELWHACAGPLVSLPTAGTRVVYFPQGHSEQVAATTNREIDGHIPNYPSLPPQLICQLHNITMHADVETDEVYAQMTLQPLTPQEQKDTFLPMELGIPSKQPSNYFCKTLTASDTSTHGGFSVPRRAAEKVFPPLDFSQQPPAQELIARDLHDVEWKFRHIFRGSILVPY

SEQ ID NO: 138639 - protein, 172 aa, Glycine max
  Coding DNA Sequence Number=SeqID_21861
  Subcellular localization annotation: CTP_CleavageSite=56; ConfidenceScore=5.55e-01
MRSDCLVQFCIVNLFRSPMNCVFVHVSSTQAFAAMRSDCLVQFFTVNLFRSPMNCVFVHVSSTFEFGAMRSDCLVQFSIVNLFRSPMNCVFVHVSSTHGFGAMRSDCLVQFFIVNIFRNQMNCVFVHVSSTFELGAMGSDSLVQFSIPNLFSERHALRFGSCVLHRRVWSHA

SEQ ID NO: 138640 - protein, 214 aa, Glycine max
  Coding DNA Sequence Number=SeqID_21862
MEAMMSMRKMMEVNMATVVAASTAIEVDPTHPYGLNQGGEVLGSTGGPHFVQIQNKHSLPPYGFPPNYTPPNVAHTPDENVDNSTPMPLESQQPQSDHAHAYQPLGETHEAPQDPILVDFEPHLGYVTKGQAFCGIPLPNTLGGPQYRPQPQPLHFAMGKVPLAMWKELCLVPNVVIPLKFKVPDFDKYKGTTLPQESPSTQIWNPPESIPGRT

SEQ ID NO: 138641 - protein, 71 aa, Glycine max
  Coding DNA Sequence Number=SeqID_21863
MANQQATKSKAKVLHKISKSSLLYVCHGNKCGTSPLSLNRWPNQHPDIHHVRSFCKPFDPRPQTTINLDSG

SEQ ID NO: 138642 - protein, 214 aa, Glycine max
  Coding DNA Sequence Number=SeqID_21864
MALPRKNESSSIPSFNNIEDTSQAFPEDWFIPGKWINFQSLKEEGFDVKGLFDRVGWTSFLENFNTWHYGPYALFWETARQDGVNIKGTFVRTQVVISLTTIIVVSTCALDGLTMSKDWEKEITLETMDKLLYGKPHPDRNGNKALNTFLRIANLTYLCRMIHNVLFNTVMPRLHSRHYVSDRDHFCICKIMAFKDRFNLKVEKNLIPYGMLFT

SEQ ID NO: 138643 - protein, 185 aa, Glycine max
  Coding DNA Sequence Number=SeqID_21865
  Gene Ontology: Mol. function=protein binding; Biological process =defense response
  Homolog annotation: Hit_ID=Q1SW22; Match level="QueryCoverage=99%, HitCoverage=22%, E-value=1e-24, Identity=39%"; Hit description =Disease resistance protein; AAA ATPase
MRLREAAFRMEDVIDEYNISCEDKQPDDPRCAALLCEAVAFIKTQILLLQSAYKIQDVKSLVRAERDGFQTHFPLEQRQTSSRGNQDITWQKLRRDPLFIEEDEVVGLDGPRGVGKTTLAKQVYDQVRNNFDCNALITVSQSFSSEGLLRHMLNELCKENKEDPPKDVSTIESLTEEVRNRLRNK

SEQ ID NO: 138644 - protein, 52 aa, Glycine max
  Coding DNA Sequence Number=SeqID_21866
MEGKFPVLFSLKYQTQLSLRYGLDHRLSVSLVLSKSSLTRAKHENGAKRNVE

SEQ ID NO: 138645 - protein, 116 aa, Glycine max
  Coding DNA Sequence Number=SeqID_21867
MCESAAQKDFHPNGTTSEDLAKCFSSREGSRSRLDDNTTSYLGGNSKVGKVQRILNVEEEVGQISHIKHKAHLKIELNHGDKNNKWAYNNITQIATMKWWVNTNVLLIWSCSHKLG

SEQ ID NO: 138646 - protein, 99 aa, Glycine max
  Coding DNA Sequence Number=SeqID_21868
MRGTMHKSQVNLRADQKFLPGLKVLALSFTGLKVLAVSFIGLKQNGEGEGLLETSLQGEDESRRSSPPKEAMDKILKVGEDGWRERERRGTKFCASNEV

SEQ ID NO: 138647 - protein, 125 aa, Glycine max
  Coding DNA Sequence Number=SeqID_21869
MQKNAHANACTSVITVDSLEDINCESPQASDSNSFSDDENCESNTNEAAIDTEGYSDLGDQAMECRHCNAKMWKYNKVQNSPYVVEMGKLSFCYYKFHRNILNDFCLMVKQVIVKIISVTNGHTT

SEQ ID NO: 138648 - protein, 264 aa, Glycine max
  Coding DNA Sequence Number=SeqID_21870
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-40, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDPWVLVPNAFRGLHILDFRGLHVLAFRGLQVLAFRGLHVLALRKLHVLTLRGLHVLALRGIHVLTFRGLGLHILAFRGLHVCDFRGQHVLIFGGLQVLAFRELHVLALRRLRILALRGLHVLTLRGLHVLAFRGLHVLDFRGLHVLAFRGLQVLAFRGLHILALRELHVLALRGLHVLALRGLHVLTFRGLGLHVRDFRGLHVLAFRGLHILTFRGLHVLAFRGLYVLAFRGLHVLAFRGLQVLAFRGLQVLAFRGLHVLAFT

SEQ ID NO: 138649 - protein, 203 aa, Glycine max
  Coding DNA Sequence Number=SeqID_21871
  Gene Ontology: Mol. function=ribonuclease H activity; Cellular component=intracellular; Biological process=DNA integration
  Pfam annotation: Domain name=rve; Domain location=1-139; Score=50.3; E_value=6.3e-12; Accession=PF00665.16; Description=Integrase core domain
MPGTCGHHFILVAIDYFIKWVEVASYASVTRSIVVRFIKKEIICRYGFPRKIITDNATNLNNKMMKEMCEDFKIQHHNSSPYKPKMNEAVEAANKNIKKIVQKMTVSYKDWHKMLPFALHGYRTSVRTSTGATPFSLVYGIEVVLPFEVEVPSLRILAKSRLEELEWARTRFDQLNLIEGKRLAAISHEQLYQSRVKNAFDKK

SEQ ID NO: 138650 - protein, 179 aa, Glycine max
  Coding DNA Sequence Number=SeqID_21872
  Homolog annotation: Hit_ID=Q8LKJ3; Match level="QueryCoverage=35%, HitCoverage=16%, E-value=1e-08, Identity=51%"; Hit description =Geranyl diphosphate synthase
MMLIHDDLPYMDNEDLPYMDNDDLYHTKLTNHKVYDEDVVVLAFAFKHVAVPTKGVLSSHGPLRNPLPDPLLFLCNQPFQNPKDAPFPTASPPLPVTSSTTSSLTSAASPPPAPPPSSSPRSKDPTRNSSPSSSRALGFLARHDFRHNNSLLLPLTLHEIYPDLQIENAPSRDQYERAL

SEQ ID NO: 138651 - protein, 106 aa, Glycine max
  Coding DNA Sequence Number=SeqID_21873
MNVSGRRSELLWRKSWRARKPSALDEDGDEFRVGSLERGEELGGGAGGGEAAEVRDEVVDDVTGRGGEAVGNGASFGFWKGWLHKKRSGSGSGLRRGLVVEKEDSD

SEQ ID NO: 138652 - protein, 185 aa, Glycine max
  Coding DNA Sequence Number=SeqID_21874
  Gene Ontology: Mol. function=transmembrane receptor activity; Cellular component=membrane; Biological process=regulation of transcription, DNA-dependent
  Homolog annotation: Hit_ID=Q6URA3; Match level="QueryCoverage=86%, HitCoverage=22%, E-value=3e-43, Identity=49%"; Hit description =Putative TIR-NBS type R protein 4
  Pfam annotation: Domain name=TIR; Domain location=16-144; Score =154.2; E_value=3.5e-43; Accession=PF01582.10; Description=TIR domain
MAKHVMSSSCPKKYDIFISFRGEDIRTTFIGHLRSALSGPNIKAYADDHDLQKGQEIWPSLCQAIQDSHFAIVVFSENYAESKWCLKELVQILHCRKTQGLVVIPVFYQVDPSHIRKCTGTYGEAIAKHKDNQSVQDWKAALTEAANISGWDTRSRDNKFYFLLQNHQSLSRVSLRQRVASIPLT

SEQ ID NO: 138653 - protein, 911 aa, Glycine max
  Coding DNA Sequence Number=SeqID_21875
  Gene Ontology: Mol. function=protein binding; Cellular component =membrane; Biological process=defense response
  Homolog annotation: Hit_ID=Q2HVE0; Match level="QueryCoverage=86%, HitCoverage=80%, E-value=1e-122, Identity=36%"; Hit description =Disease resistance protein; AAA ATPase
  Pfam annotation: Domain name=LRR_1; Domain location=375-396; Score =9.7; E_value=4.4; Accession=PF00560.23; Description=Leucine Rich Repeat
  Pfam annotation: Domain name=LRR_1; Domain location=398-420; Score =11.5; E_value=2; Accession=PF00560.23; Description=Leucine Rich Repeat
  Pfam annotation: Domain name=LRR_1; Domain location=422-443; Score =3.8; E_value=56; Accession=PF00560.23; Description=Leucine Rich Repeat
  Pfam annotation: Domain name=LRR_1; Domain location=445-464; Score =1.6; E_value=1.4e+02; Accession=PF00560.23; Description=Leucine Rich Repeat
  Pfam annotation: Domain name=LRR_1; Domain location=466-487; Score =10.6; E_value=3; Accession=PF00560.23; Description=Leucine Rich Repeat
  Pfam annotation: Domain name=LRR_1; Domain location=489-510; Score =4.9; E_value=35; Accession=PF00560.23; Description=Leucine Rich Repeat
  Pfam annotation: Domain name=LRR_1; Domain location=512-537; Score =0.8; E_value=2e+02; Accession=PF00560.23; Description=Leucine Rich Repeat
  Pfam annotation: Domain name=LRR_1; Domain location=539-561; Score =9.6; E_value=4.6; Accession=PF00560.23; Description=Leucine Rich Repeat
  Pfam annotation: Domain name=LRR_1; Domain location=563-584; Score =9.6; E_value=4.5; Accession=PF00560.23; Description=Leucine Rich Repeat
  Pfam annotation: Domain name=LRR_1; Domain location=586-607; Score =13.5; E_value=0.75; Accession=PF00560.23; Description=Leucine Rich Repeat
  Pfam annotation: Domain name=LRR_3; Domain location=352-371; Score =29.7; E_value=1e-05; Accession=PF07725.3; Description=Leucine Rich Repeat
  Pfam annotation: Domain name=NB-ARC; Domain location=1-213; Score= -30.2; E_value=2.3e-08; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_3::NB-ARC; Domain location=375-396::398-420::422-443::445-464::466-487::489-510::512 -537::539-561::...
  Pfam module annotation: Domain location=563-584::586-607::352-371::1 -213
MGLTSLCDKLLSKLLKEGHHEYNLAGSEDLTRRLGNKKVLIVLDDVDSFSQLDTLYQPCKYVGPGSKLIITTRDRHLLRRRVDVTHVYEVKTWSIAESLELFSVHAFNERRPKKGYEDLSNRAVNCARGVPLALEVLGSNLYSRTTEFWDDELNKLENYRNDNIQDVLQVSYDGLDDLEKEIFLDIAFFFKGEHKKDVVRILDACDFYPTRGLKVLEDKALITISHSGMIEMHDLIEEMGLNIVRGESKDPRNRSRLSDIKEVSDVLANKKGSDLIEGIKLDLSSIEDLHLNADTLNMMTNLRILRLYVPSGKISRNVHHSGVPSKLSGKLRYLEWNGFHLKSLPVTFCAKMLVEIRMPHSHVTELWQGVQDVANLVRIDLSECKHLKNLPDLSKASKLKWVNLSGCESLCDIHPSLFSFDTLETLMLDGCKKLKGLKSEKHLTSLRKISVDGCTSLKEFSLSSDSITSLDLSSTRIGMLDSTFERLTSLESLSVHGLRYGNIPDEIFSLKDLRELKICNSRVAIDKEKLHVLFDGSRYLRLLHLKDCCNLCELPDNIGGLSKLNELRLDGSCVKTLPASIEHLRKLKTLSLENCRELGSLPKLPPFITEFNAANCWSLTTVSSLNSSALGLKGKGKFISFKNCGWLDEPSLHCIMEGALELTELASCQNEIVKIVDEANTKNCNNKSVKVCFPGSKVPSQFKHRTTDSSITIGLPCYRNGRVGLTLCVVLSRSRVAAKIWCQCYLADGTKLEPATTWYHEAVTELNSDHVFIWCDSSLFNSIFESGTPLVFFEFFVTNDKGKRVTIDTPECGVCVMFDSKALMEAEDDNIEIVTITRQCRACLIFEAENFVRISSRSVDAAASGFGLESKATETYDMMGTIAMTNNNHEPDLSEHCSCSWDYLFGMEFTT

SEQ ID NO: 138654 - protein, 119 aa, Glycine max
  Coding DNA Sequence Number=SeqID_21876
  Subcellular localization annotation: CTP_CleavageSite=24; ConfidenceScore=5.45e-01
MYKMQNASAAPAGYASRRSSLSFSASVEGSSRKLLEVGGGAPRLPSSPACPSHMTIPALPLHFFLLSNLKKSEPPSIDRWFVGWVQIDVAEVKVFVVVDACPWRWRNFWVLSLCECMSD

SEQ ID NO: 138655 - protein, 50 aa, Glycine max
  Coding DNA Sequence Number=SeqID_21877
MAHKKLQWQLRESNSNTQRQPIGQDWKVALNISGWDSRNPHIKVRLVVGI

SEQ ID NO: 138656 - protein, 848 aa, Glycine max
  Coding DNA Sequence Number=SeqID_21878
  Gene Ontology: Mol. function=transmembrane receptor activity; Cellular component=membrane; Biological process=defense response
  Homolog annotation: Hit_ID=Q2HUN2; Match level="QueryCoverage=97%, HitCoverage=74%, E-value=1e-167, Identity=41%"; Hit description=TIR; Disease resistance protein
  Pfam annotation: Domain name=LRR_1; Domain location=584-606; Score =6.1; E_value=20; Accession=PF00560.23; Description=Leucine Rich Repeat
  Pfam annotation: Domain name=LRR_1; Domain location=629-650; Score =8.8; E_value=6.3; Accession=PF00560.23; Description=Leucine Rich Repeat
  Pfam annotation: Domain name=LRR_1; Domain location=652-674; Score =10.6; E_value=3; Accession=PF00560.23; Description=Leucine Rich Repeat
  Pfam annotation: Domain name=LRR_1; Domain location=720-741; Score =7.0; E_value=14; Accession=PF00560.23; Description=Leucine Rich Repeat
  Pfam annotation: Domain name=LRR_1; Domain location=766-791; Score =3.5; E_value=63; Accession=PF00560.23; Description=Leucine Rich Repeat
  Pfam annotation: Domain name=LRR_1; Domain location=793-815; Score =13.8; E_value=0.65; Accession=PF00560.23; Description=Leucine Rich Repeat
  Pfam annotation: Domain name=LRR_1; Domain location=817-838; Score =9.6; E_value=4.6; Accession=PF00560.23; Description=Leucine Rich Repeat
  Pfam annotation: Domain name=LRR_3; Domain location=606-625; Score =28.0; E_value=3.3e-05; Accession=PF07725.3; Description=Leucine Rich Repeat
  Pfam annotation: Domain name=LRR_3; Domain location=817-836; Score =2.0; E_value=16; Accession=PF07725.3; Description=Leucine Rich Repeat
  Pfam annotation: Domain name=NACHT; Domain location=222-364; Score =8.5; E_value=1.2e-05; Accession=PF05729.3; Description=NACHT domain
  Pfam annotation: Domain name=NB-ARC; Domain location=180-467; Score =101.0; E_value=3.6e-27; Accession=PF00931.13; Description=NB-ARC domain
  Pfam annotation: Domain name=TIR; Domain location=17-151; Score =177.5; E_value=3.3e-50; Accession=PF01582.10; Description=TIR domain
  Pfam module annotation: Pfam domain module=LRR_1::LRR_1::LRR_1::LRR _1::LRR_1::LRR_1::LRR_1::LRR_3::LRR_3::NACHT::NB-ARC::TIR; Domain location=584-606::629-650::652-674::720-741::766-791::793-815::817 -838::606-625::...
  Pfam module annotation: Domain location=817-836::222-364::180-467::17- 151
MAKQGMLSSLCPRKYQVFISFRGEDVRTSFISHLRSALSRDNIKAYMDDHNLQKGDELWPSLCQAIQDSELAIVVFSEHYAASKWCLNELVEILHCRKSQGLAVIPVFYEVDPSHIRKYDGTCGEAISKYETYFGDKDNESIQKWKAALAEAAHISGWDSHSREYKNDSQLIEKIVVDVSEKLSQGTPFKLKVEDFVQIEKHCGEVKLLLSKNQDQLQKNVHVIGIWGMGGIGKTTIAKALFSQLFPQYDAVCFLPNVREESRRIGLTSLRHKLLSDLLKEGHHERRLSNKKVLIVLDDVDSFDQLDELCEPCNYVGPDSKVIITTRNRHLLRGRVDDRHVYEVKTWSFAESLELFSLHAFNERRPKKGYEDLSNRAVNCARGVPLALKVLGSNLYSRSIKFWDGELSKLENYRNDSIQDVLQVSYDGLHDLEKKIFLDIAFFFKGEHKDDVIRILDACDFYATSGIEVLEDKALVTLSNSGMIQMHDLIQEMGLNIVRGGSEDPRNRSRLRDIEEVSDVLENKNGSDLIEGIKLDLSSIEDLHLNADTFDRMTNLRILRLYVPSGKRSGNVHHSGVLSKLSSKLRYLEWNGCRLKSLPKSFCGKMLVEICMPHSHVTELWQGVQDLANLVRIDLSECKHLKNVPDLSKASKLKWVNLSGCESLCDIHPSVFSLDTLETSTLDGCKNVKSLKSEKHLRSLKEISVIGCTSLKEFWVSSDSIKGLDLSSTGIEMLDSSIGRLTKLRSLNVEGLRHGNLPNELFSLKCLRELRICNCRLAIDKEKLHVLFDGSRSLRVLHLKDCCNLSELPENIWGLSKLHELRLDGSRVKTLPTTIKHLKRLNTLSLKN

SEQ ID NO: 138657 - protein, 112 aa, Glycine max
  Coding DNA Sequence Number=SeqID_21879
MEDAHLATKSIVLKNMFLKELFRGTNTRIDNYDYVKRQFKYQTTPYSLVIVDLPSSKSDFVGFVRNDMLLSPSQEMKNLCVGGVKIWCQCYMVDDARLGPPQPHGITKLSLG

SEQ ID NO: 138658 - protein, 153 aa, Glycine max
  Coding DNA Sequence Number=SeqID_21880
  Gene Ontology: Mol. function=nucleic acid binding; Cellular component= intracellular; Biological process=regulation of transcription
  Homolog annotation: Hit_ID=Q93XJ4; Match level="QueryCoverage=95%, HitCoverage=74%, E-value=1e-15, Identity=34%"; Hit description =Lateral shoot inducing factor
  Pfam annotation: Domain name=zf-C2H2; Domain location=9-31; Score =22.8; E_value=0.0012; Accession=PF00096.16; Description=Zinc finger, C2H2 type
DTGGTKRSYECTFCKRGFTNAQALGGHMNIHRRDRAKAKQFTLDASPSVNKFNSNNNDSMALPFVSEIMNQPTRPNYSPLESQMNFHPPHAFYYEFCNSRSQPLSLNNQELRDANLSLQIGSSHVDDNIHQVRRGNQKESEVDLELRLGHDPY

SEQ ID NO: 138659 - protein, 40 aa, Glycine max
  Coding DNA Sequence Number=SeqID_21881
MVVHIAGLSRFSDWRCNNSKVARIITTRRVENKVQTAGDP

SEQ ID NO: 138660 - protein, 120 aa, Glycine max
  Coding DNA Sequence Number=SeqID_21882
  Gene Ontology: Mol. function=ATP binding; Cellular component=nucleus; Biological process=response to DNA damage stimulus
  Homolog annotation: Hit_ID=Q1S277; Match level="QueryCoverage=96%, HitCoverage=46%, E-value=1e-26, Identity=58%"; Hit description=XRCC4, N-terminal
MDKVVRENELFEKMKVEAEKCLTQSERIANERLEFESEIYAKFLGVLNSKKSKLRELRDKLAKPENTEKSPEEEDTDKTESFDEESDFDRSDEDPQKDISSSSKDVMANKPSCPKRTRRK

SEQ ID NO: 138661 - protein, 134 aa, Glycine max
  Coding DNA Sequence Number=SeqID_21883
  Gene Ontology: Mol. function=RNA-directed DNA polymerase activity; Biological process=RNA-dependent DNA replication
  Homolog annotation: Hit_ID=Q1S7B8; Match level="QueryCoverage=80%, HitCoverage=14%, E-value=1e-10, Identity=35%"; Hit description=RNA -directed DNA polymerase
MYIGIESVTSGTLNGEDCAFSVALAYRVLHNIQRGDLESDLLANVWTFPVLSKAKLLIWRLCLNGLPTLDNLRIRNCIDVTNNGLFPLCGAVTETVVHLFLTCSLVEGVWKQWIEWLDIWTVFPDEVVHMHIKM

SEQ ID NO: 138662 - protein, 179 aa, Glycine max
  Coding DNA Sequence Number=SeqID_21884
  Gene Ontology: Mol. function=transition metal ion binding; Cellular component=viral capsid
  Homolog annotation: Hit_ID=Q4J0M2; Match level="QueryCoverage=99%, HitCoverage=61%, E-value=8e-76, Identity=79%"; Hit description =Manganese containing catalase
  Pfam annotation: Domain name=Mn_catalase; Domain location=1-179; Score=231.9; E_value=1.4e-66; Accession=PF05067.3; Description =Manganese containing catalase
MFRHVKKLQYTVRVSAPNPGLANLLLEQFGGPQGELAAAMRYFTQGLGDEDLGRRDLLMDIATEELSHLEIIGSLVGMLNKGAKGKLAEGTEEEGELYRSITGAGNDSHLTSILYGGGPPLTNSGGVPWTAAYVDTIGEVTADLRSNIAAEARAKIIYERLINVTDDVGVKDALGFLMT

SEQ ID NO: 138663 - protein, 211 aa, Glycine max
  Coding DNA Sequence Number=SeqID_21885
  Homolog annotation: Hit_ID=Q8H6Q8; Match level="QueryCoverage=97%, HitCoverage=7%, E-value=7e-17, Identity=27%"; Hit description=CTV.20
MQPQHYGSNLNQPKKISAPFDPAGYNYWDYIDAWTNVFWHQNSKFKHSWLIYFKNNTVYNFPNWFLQWWNYFRPIPQIFPEEVQQGFQQFNKLYNGKESHTEKLKQQAISTAAPDQVKNWFQSNPEFLKPADPETSLFLNQKSQLAAFLASSKSKESLAQNLKEVLQLLQQEVEEEPSKKEAESSETNDDQEDDPFYQNEDDCFGISLDDD

SEQ ID NO: 138664 - protein, 271 aa, Glycine max
  Coding DNA Sequence Number=SeqID_21886
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=81%, HitCoverage=43%, E-value=3e-99, Identity=87%"; Hit description=ATP synthase subunit alpha
  Pfam annotation: Domain name=ATP-synt_ab; Domain location=1-92; Score= 24.1; E_value=2e-09; Accession=PF00006.15; Description=ATP synthase alphabeta family, nucleotide-binding domain
  Pfam annotation: Domain name=ATP-synt_ab_C; Domain location=104-204; Score=127.9; E_value=2.8e-35; Accession=PF00306.17; Description=ATP synthase alphabeta chain, C terminal domain
  Pfam module annotation: Pfam domain module=ATP-synt_ab::ATP-synt_ab _C; Domain location=1-92::104-204
MSLLLRRPPGREAYPGDVFYLHSRLLERAAKLSSQLGEGSMTALPIVETQSGDVSAYIPTNVISITDGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQIHSIRKKIDSNRINREYKRVAGIEPASLAWKARGYSRR

SEQ ID NO: 138665 - protein, 118 aa, Glycine max
  Coding DNA Sequence Number=SeqID_21887
GKFWVKKTFSSPSFNPSRVGVARPGELTCTYFFREDISMALYGILGCLAAVLPVCPGLGKGQQSIGRDPSLYMRPSLTSSRHLTTAYDDSAPVITKYACICVCTSVFKYNNLFSESRS

SEQ ID NO: 138666 - protein, 122 aa, Glycine max
  Coding DNA Sequence Number=SeqID_21888
  Gene Ontology: Mol. function=nucleic acid binding; Biological process= DNA integration
MEESVEVPYPVVPSKKEKDRHLARLLDIFRKLEITMPLGEALQQMPLYSKFLKDMLTRKHRYIHQENIIIDENCSVVIQKILPPKHKDPGSVTIPCSIGEVNVRKTLIDLGASINLMPLSMC

SEQ ID NO: 138667 - protein, 72 aa, Glycine max
  Coding DNA Sequence Number=SeqID_21889
MFNSGGPIVIDDIPRPVGSRSIIVLGDGQILGQIQRQRQIEGRMRVEARPMIDGSSSHAQLRTSGKRSWEAA

SEQ ID NO: 138668 - protein, 115 aa, Glycine max
  Coding DNA Sequence Number=SeqID_21890
MEREKGIAHRQYIWRLQSLLRLSDVWELYRSSRRKNWRNLREPPEMPLSLSEDTGFSPQEGKALMDSSECRPWGSPGLSAPLSLYQSHMVGAFSQNTVTLTGLPMILPSESDLTC

SEQ ID NO: 138669 - protein, 138 aa, Glycine max
  Coding DNA Sequence Number=SeqID_21891
MATTAKTWTSKRAIPRLKKHPVLKEKCSPPLITLLRYTWADREVGTYFSQYNHELDLVNLLSWLSISIITDPELCSISLCIIRTNATSSTEFVFMNREGMNRDFFYMYDCLFHYLHVRVPFDDFTISVLRILNVALHT

SEQ ID NO: 138670 - protein, 136 aa, Glycine max
  Coding DNA Sequence Number=SeqID_21892
  Subcellular localization annotation: CTP_CleavageSite=53; ConfidenceScore=5.39e-01
MYPSLFSLNNLVDVPSTRTDPQEMYPLLFSVTTTQVDVPSTCTTKDVPSNVLRQSSQAVSPSKLCEGETKEFSGGRRETQKEFRRLVLGEFFLAKGEENKRYSTLLFSRFGKPENFRKLLQRKKKKKKKFKEIQKL

SEQ ID NO: 138671 - protein, 255 aa, Glycine max
  Coding DNA Sequence Number=SeqID_21893
  Gene Ontology: Mol. function=DNA binding; Biological process=DNA integration
  Homolog annotation: Hit_ID=Q1S3I6; Match level="QueryCoverage=78%, HitCoverage=17%, E-value=9e-61, Identity=49%"; Hit description =Integrase, catalytic region
MVISYSDFATNPSNPYYMHPNENPSLILIQPMLDNKNYQIWCRSMKVALISKNKVKFVDGTLSPPPISDPLYEPWLRCNNLVLSWLQRSISEEIAKSLLWCDRTSLVWKSLENRFSQGDIFRVADIQEEEEIENFRPIRDCTCAIPCSCGAAIDLRKFKEQDKIMLMSPLPTLDNAFNLILQQERQFHLPSTTDSSIENQSLVNHFSQTPSRPSNNFGRGRGRGYSSGGRGNRLCTHCNHTNHTVELYREGFSSL

SEQ ID NO: 138672 - protein, 279 aa, Glycine max
  Coding DNA Sequence Number=SeqID_21894
  Homolog annotation: Hit_ID=Q1STP6; Match level="QueryCoverage=41%, HitCoverage=59%, E-value=7e-31, Identity=56%"; Hit description =Harpin-induced 1
  Pfam annotation: Domain name=Hin1; Domain location=19-156; Score =31.2; E_value=3.6e-06; Accession=PF07320.4; Description=Harpin -induced protein 1 (Hin1)
MVALCVAIALVLLRVILALTVFKPRHPITNVDSIRLQNMSLGMDMFSMSVNVNFTLEVDVLVNNPNKLGFNYYNSSAQLNYRTQLIGEAPIPNGDILVEEIKGLNLTLTVMADRLVSNSKVTKDVALGSLPLNTLARPCHSAATGLGKNSAMRGEPNPAMLFNTKRCREDRVTKNKVAEKYMGTVARYHDGDKIVERDRVTKTKLRRRRRECKENRARGGVAAFAEEVRALGERDDSENGHKKRGNSCADFLAKLGAALDDALCILEVVPGGLIIFFGG

SEQ ID NO: 138673 - protein, 247 aa, Glycine max
  Coding DNA Sequence Number=SeqID_21895
  Gene Ontology: Cellular component=integral to membrane; Biological process=defense response to bacterium
  Homolog annotation: Hit_ID=Q60EC2; Match level="QueryCoverage=78%, HitCoverage=78%, E-value=8e-33, Identity=40%"; Hit description =Unknow protein
  Pfam annotation: Domain name=MtN3_slv; Domain location=119-205; Score= 98.5; E_value=1.9e-26; Accession=PF03083.6; Description=MtN3saliva family
  Pfam annotation: Domain name=MtN3_slv; Domain location=7-90; Score =39.6; E_value=1.1e-08; Accession=PF03083.6; Description=MtN3saliva family
  Pfam module annotation: Pfam domain module=MtN3_slv::MtN3_slv; Domain location=119-205::7-90
MAISLRMVVAVLGNVASMSLYAAPSVTFKRVIRKKSTEEFSSIPYIIALLNSLLYTWYGLPIISNKWENFPLVTVNGAGIPFELSYVKVAITTVTILAVFCFIAFVSAFAIPGHRYRKLLVGSIGLAVSIALYASPLVAMKKVIQTKSVEFMPLPLSLSSLLASLLWMTYGLLIGDIFVAGPNVVGTPLGILQIVLYCKYWKKIVTEEPNKVELQKGNTEKVDLEIGQGKKECVTVPSNCNSRPMTT

SEQ ID NO: 138674 - protein, 136 aa, Glycine max
  Coding DNA Sequence Number=SeqID_21896
MYQFAGITPPRHPVDPERSNKALGFPTLIIGLCQFYGVPVNPSKLIGPPISRAFIEKYYMPRQAQIELQMHPYMQHVTSQQTANHKGSGPQLPGPEMRPILRHRQDLQGPLGMMKELRRMTIWSTCWISSLEEAES

SEQ ID NO: 138675 - protein, 152 aa, Glycine max
  Coding DNA Sequence Number=SeqID_21897
MVTGENVAKQQRHPNRCEGGHAGGHDPHPSPRYALGNVLPQNVQQLADSLLIKAQGLTPPLAKLTVLALFQDQWMPQKLINGILIEEDPLASHPGAFVFNSLLCRPCIVIKLDTILPRKGPVTRAMSKSLQEDWARAAEEGPRVLMNLRVDF

SEQ ID NO: 138676 - protein, 56 aa, Glycine max
  Coding DNA Sequence Number=SeqID_21898
MLLSCNVIHICVIVVMLVRMIHTHFFAAARVKSCPGGPPPRSGGGPRTDKRKLLAL

SEQ ID NO: 138677 - protein, 151 aa, Glycine max
  Coding DNA Sequence Number=SeqID_21899
  Gene Ontology: Mol. function=chitin binding; Cellular component =extracellular region; Biological process=chitin metabolic process
  Homolog annotation: Hit_ID=UPI00006A2D9E; Match level="QueryCoverage =90%, HitCoverage=83%, E-value=2e-12, Identity=16%"; Hit description =UPI00006A2D9E related cluster
WVLVPIAFRGLYVLTFRGLHVLTFRGLHTLAFRGLHVLSVRGLYVLTFRGLHVLTFRGLHTLAFRGLHVLSVRGLYVLTFRGLHVLTFRGLHALVFRGLNVLAVRGLYVLTFRGLHVLAFRGLHALAFRGLHVLAFRGLHTLAFSVLHIRT

SEQ ID NO: 138678 - protein, 222 aa, Glycine max
  Coding DNA Sequence Number=SeqID_21900
MASKKRKSIGARPTAQYDTRRFHSLDAWNRYIDNVLGRSILPERKLEIYQTEFDDFKTELERHNLHKRLTNLADGTIGVALQARVRGHLVKIDADNLNTFLETPVVLEEGETLPTYSRYCRLPSDHREIEVALCIAGIRFILNAEGHPGRILRKDVTTLAQVWTVLYYSNLAPTSHTSDLTVDRARLIFGLVSHMDMNIGALISGQMTSIAQSNSCRLGFLL

SEQ ID NO: 138679 - protein, 88 aa, Glycine max
  Coding DNA Sequence Number=SeqID_21901
MDSINIPSCIHHISSMIGCLSIAQQISVEAIASLTQYYDQPLRCFTVGDFHDAILPRKGPVTRAMSKRLQEDWARAAEEGPRVLMNLR

SEQ ID NO: 138680 - protein, 75 aa, Glycine max
  Coding DNA Sequence Number=SeqID_21902
MAVGTTSDNVSSKIKTLDEVSQPSSKSETQHDHRSTSTSYISTDPGIGPNTSPYVQRAWPLLLRILKCDEELRPT

SEQ ID NO: 138681 - protein, 79 aa, Glycine max
  Coding DNA Sequence Number=SeqID_21903
MVFHLRLVMSFKSKKGEHRLKGAIKGINSRKHQQESSQGYCASNQWGKTHQKIMMMDGSNSHKAPLITFKLSFQNYHDM

SEQ ID NO: 138682 - protein, 172 aa, Glycine max
  Coding DNA Sequence Number=SeqID_21904
  Gene Ontology: Mol. function=calcium ion binding; Cellular component =extracellular region; Biological process=pathogenesis
  Homolog annotation: Hit_ID=Q6J0T3; Match level="QueryCoverage=88%, HitCoverage=76%, E-value=2e-21, Identity=37%"; Hit description=Cable pili-associated 22 kDa adhesin protein
MNQILNATYRYTDDPRRGYSGTSPQARNGFAEIAIDGQPPYTVKVDAEGRWSWTPPADWTPGEHIVSVRMIDAAGNIGDPAQFIQVVDYTAPDAPRLLNMYDDQGDITGSFDAGRMTDDRRPTLTGVAEKGTVVYLKEGDTVIGSAQADAKTGIWTLEPDADLSDGTHQLTL

SEQ ID NO: 138683 - protein, 36 aa, Glycine max
  Coding DNA Sequence Number=SeqID_21905
MSEDAHMSEPRDPSVLTSFAEHVAHAIWTGQVTFCC

SEQ ID NO: 138684 - protein, 129 aa, Glycine max
  Coding DNA Sequence Number=SeqID_21906
  Gene Ontology: Mol. function=calcium ion binding; Cellular component =extracellular region; Biological process=pathogenesis
  Homolog annotation: Hit_ID=Q83SZ3; Match level="QueryCoverage=88%, HitCoverage=55%, E-value=3e-14, Identity=37%"; Hit description=Large repetitive protein
MELFNYEEVKYLERDTNTPTFFGYANSEIGKGGTMLITVGKETFSVDIDPANGYWSWTPATPLEDGYYNMSFQSVDKAGNVSTPSLRTLIVDTTPPAAPTLLNMYDDQGDITGSFDSGKMTDDRRPTLT

SEQ ID NO: 138685 - protein, 218 aa, Glycine max
  Coding DNA Sequence Number=SeqID_21907
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=1e-30, Identity=37%"; Hit description= UPI00006A17C9 related cluster
LHVLALRGLLALALGLHSLTFRGPHVPTFRGLRTLAIRGLHVLTFVGLHALTFRGLHVLANRGRHAFTFRGLHVLANRGLHALTLRGLHVLTIRGLHALTSRGLHVLAFRGLHALTLGLHVLTFRGLHALTSRGLHVLALRGLHALTLGLQALTFRGLHVLALRGLHALTLATSYPHRQRATRPHLERTTRPRQQRAARPHLQRTTPPRLERAARPHL

SEQ ID NO: 138686 - protein, 62 aa, Glycine max
  Coding DNA Sequence Number=SeqID_21908
MVIDYSFVKTSLKTISVTGNRLLPNGNRLPESKNSDNPKFFSPFGINKKAKVRCNIKSYTNG

SEQ ID NO: 138687 - protein, 69 aa, Glycine max
  Coding DNA Sequence Number=SeqID_21909
  Homolog annotation: Hit_ID=Q1S510; Match level="QueryCoverage=40%, HitCoverage=4%, E-value=7e-07, Identity=89%"; Hit description =Protein kinase
MYQVYNSLKSISKDQSFFEHDDEFPLIFVESSHNGVNVYGLSMSMGDPNQVRFFEILSVSLFVVCKCNL

SEQ ID NO: 138688 - protein, 100 aa, Glycine max
  Coding DNA Sequence Number=SeqID_21910
MLMCSMLSPEMLNPDVSCMFSLVLLKYHPQIPLVELNLSSTALRHTYQQLAPVMLSQPGGSSGVLSKLILAERIIDNSSASRIFYALSHELLRSADGSLS

SEQ ID NO: 138689 - protein, 101 aa, Glycine max
  Coding DNA Sequence Number=SeqID_21911
MASRKRKVPASASQACYDRSRFTSQEAWDRYSDIVIGRKILPERNVMIYHTEFDEFKAELERRNWHKELTNFVDESIDVAIVKEFYTNLYDPEDKSPKQMR

SEQ ID NO: 138690 - protein, 118 aa, Glycine max
  Coding DNA Sequence Number=SeqID_21912
MALFIQRVHQPTKKSLLELSSQDVVLAQNKLLSKQLEILTETIGCTICGGAHESDHCIPFEEQTQEVSYMGNQQRQGYNQGGFSGFQQGPYNQQGQWRSHPGNQFNKDQGGPPNRPPQ

SEQ ID NO: 138691 - protein, 50 aa, Glycine max
  Coding DNA Sequence Number=SeqID_21913
MEARETIGFMNPAWGEDESIAGQSAAGKTAAVAALQVGLLQQALVLVGHQ

SEQ ID NO: 138692 - protein, 129 aa, Glycine max
  Coding DNA Sequence Number=SeqID_21914
  Gene Ontology: Mol. function=structural constituent of ribosome; Cellular component=ribonucleoprotein complex; Biological process =translation
  Homolog annotation: Hit_ID=P0A0X3; Match level="QueryCoverage=89%, HitCoverage=89%, E-value=4e-61, Identity=99%"; Hit description=30S ribosomal protein S11
  Pfam annotation: Domain name=Ribosomal_S11; Domain location=19-128; Score=233.6; E_value=4.4e-67; Accession=PF00411.9; Description =Ribosomal protein S11
  Subcellular localization annotation: CTP_CleavageSite=65; ConfidenceScore=5.14e-01
MAKPAAKTKKKIKRVVTDGVAHVHASFNNTIVTITDRQGNALSWATSGGAGFRGSRKSTPFAAQVAAEKAGRAALDYGVKSLEVRIKGPGPGRESAVRSLNNVGYKITNIIDVTPIPHNGCRPPKKRRV

SEQ ID NO: 138693 - protein, 394 aa, Glycine max
  Coding DNA Sequence Number=SeqID_21915
  Gene Ontology: Mol. function=DNA-directed RNA polymerase activity; Cellular component=cytoplasm; Biological process=transcription, DNA -dependent
  Homolog annotation: Hit_ID=Q3BWV9; Match level="QueryCoverage=84%, HitCoverage=100%, E-value=1e-177, Identity=95%"; Hit description=DNA- directed RNA polymerase alpha chain
MRLCGSLSPSWRCCADCGWSWPPVLDDLPREPAVRRGILQALPISAQHAVAGDTGRRPVLQLHAERQAALSQHFLDLGERLLAQVRGLQQLHFGLLDQIADVVDAFSLQAVGRTHGQLQIVDRAQQHRIHAVVGRLRRTAVAVGEVTEHRQLVAEDVGGGAHGFLGVDGAVGLDIDDQLVQVGTLFDAGRFNGIGDAADRRERGIQDQAADSTGFFVRTTTRGSRLVAETTFDLQTHVDRRILGQVADHVFAVQDLHIVVDLDIGSGDNARALLGQGQGGAVAGVHTDGHVLQVQQDFEHVLLQTFDRGVLMQHAVDFDFRDGEARDGRQQHATQGITQRMPVTPLQRFDNDLCTGVGKAFDLRTARTQNLVGGNRHVAGSPSEPPAVAGGSPM

SEQ ID NO: 138694 - protein, 135 aa, Glycine max
  Coding DNA Sequence Number=SeqID_21916
MGCTVGESPTLSFSPGIGRRTMFGFGYNPSSDKYKVVAIALTMLSLDVSQKTEMKFIARVTIVGETLKGKETIHSKIVIIFVDLEKETCRSLFLPDDFCFVDTNIGVFRDSLWVWQDSNTHLGLWQMRKFGDDKS

SEQ ID NO: 138695 - protein, 48 aa, Glycine max
  Coding DNA Sequence Number=SeqID_21917
  Gene Ontology: Mol. function=choline kinase activity
  Homolog annotation: Hit_ID=Q1S5N6; Match level="QueryCoverage=73%, HitCoverage=9%, E-value=2e-11, Identity=80%"; Hit description =Choline kinase, N-terminal; Protein kinase-like
MAANYHTDTPHVLDFTKYPDLEERRRFAHAYLSSSGNISIMLKDCTTL

SEQ ID NO: 138696 - protein, 78 aa, Glycine max
  Coding DNA Sequence Number=SeqID_21918
MKAPVIASGFRGPDPSTEEMKKKKIIGLDNLPFGLSFSLHPSILFSPLTQIILSVFLPKLCVLCTRIRSNPRKKLENG

SEQ ID NO: 138697 - protein, 1476 aa, Glycine max
  Coding DNA Sequence Number=SeqID_21919
  Gene Ontology: Mol. function=RNA-directed DNA polymerase activity; Cellular component=chromatin; Biological process=chromatin assembly or disassembly
  Pfam annotation: Domain name=Chromo; Domain location=1381-1429; Score= 10.3; E_value=0.058; Accession=PF00385.14; Description='chromo' (CHRromatin Organisation MOdifier
  Pfam annotation: Domain name=RVP; Domain location=342-446; Score= -1.2; E_value=0.0052; Accession=PF00077.10; Description=Retroviral aspartyl protease
  Pfam annotation: Domain name=RVP_2; Domain location=329-460; Score= -33.5; E_value=0.00041; Accession=PF08284.2; Description=Retroviral aspartyl protease
  Pfam annotation: Domain name=rve; Domain location=1075-1231; Score =95.7; E_value=1.4e-25; Accession=PF00665.16; Description=Integrase core domain
  Pfam annotation: Domain name=zf-H2C2; Domain location=1016-1057; Score=19.5; E_value=0.00093; Accession=PF09337.1; Description=His(2)- Cys(2) zinc finger
  Pfam module annotation: Pfam domain module=Chromo::RVP::RVP_2::RVT _1::Retrotrans_gag::rve::zf-H2C2; Domain location=1381-1429::342 -446::329-460::583-752::83-173::1075-1231::1016-1057
MADSGTDRVEAALDRLTSRIEDLLQHVTPSASPPFPPRSPIPAHTHRMKLDVPRFDGTDPMGWIFKITQFFEYHGTPDTDRITIAAFYMEGRALAWFQWMSSNGQFTSWPVFLQALQTRFTLSNYEDPSGSLFKLIQKTTVAEYLSEFEELANRVVGLPAPFLLSCFVFGLAPEIRREVMINQPLTVAQAAGLARLHEEKLRDLRFDFRQPNRPRPLQLPPVAPPQTSPLPTYTPPRASTLPPLLPLPPRPNPQPPPMFRRLTSEELASRRERCLCFSYDEKFHKGHRCAPRVHLLIADDEDPLDPAGSNINPPDSPDPLPGPLDRPDSPAHLSINSLAGHLAPETLRLLGTISGVPVLVLIDGGSTHNFIQEPLVHQLGLPCQSTSPLKVMVGNGQHLQCHTICSSTTLVLQHHSFTMDLYVLPIAGANIILGVQWLQSLGPVLTDYTKLTMQFFHDDRFVELRDDPEAHRDLLSSPQFRRVCRHQPQSLYFHITVLPVDSAQPLTKPDDPQVQHLLHQFAILFQDPTTLPPARDTDHQIHLLPHATPVNVRPYKYPYYQKRKIEAQVETMLQRGIIQPSKSPFSSPVLLVKKSDNTWRFCVDYRALNALTIKDRFPIPTIDELLDELGGASCFSKLDLLQGYHQIRMQPEDIPKTAFRTHHGHFEFKVMPFGLCNAPFSFQATMNTLFRPYLRRFIIVFFDDILIYSGSLSDHLRHLQATFQILYENHFVLKISKCLFAQSEVEYLGHLVSHRGVQPVTSKLDAIAQWPIPRSVRALRSFLGLAGFYRRFIRGYATIAALLVKATTVEPLQWNSSTQAAFDALKQALTSAPVLSLPDFQLPFTIETDASVIGMGAVLSQRGHPIAYFSKPFSPKLLRASTYVRELFAITAAVKKWRQVVQTPEQHTYLARLMGYDYQIQYRSGSHNQAADTLSRLPENPSQALLILSVPCLTFLEELHTQLAANSSFQHLFQEVRDTPDKHPDFSIANKLLLYKGRIWLPSDIPIIKTLLTEYHATPTGGHAGVAKTVARLTTNFYWTSLRDDVMRFIATCVDCQVTKYETKKTAGLLCPLPVPTQPWSDLSLDFICGLPPYRGNTTILVVVDRFSKGIHLGMLPQSHTALAVARLFLDLVVKIHGLPRSLVSDRDPLFISQLWQELFKSSGTQLRMSSAYHPQSDGQTEVLNRVVEQYLRAFVHRKPTSWGKLLPWVEWSHNTSWMASTGTIPYEITFGRKPFNFPDYLAGSSKIEAVEEILTDRDTTFQLVRKKLLKAQSKMKLYADQHRRDVQFAVGDWVLVRLRPYRQSSAKDKHHTNEKLARRYYGPFQVVAKLGPVAYRLALPEGVRLHPVFHCSKLKPFRGDPDSSSPLPLPATFHENQPLVSPLSILDFHRETSDPQSPWQVLVQWQALPPEETSWEDWHQLCQDYHLEDKVILQGPRDDTSTEDTELGKEDAEDDLSKRGEEDRGVQREGKPKRK

SEQ ID NO: 138698 - protein, 81 aa, Glycine max
  Coding DNA Sequence Number=SeqID_21920
  Gene Ontology: Biological process=multicellular organismal development
  Homolog annotation: Hit_ID=A0CDD4; Match level="QueryCoverage=78%, HitCoverage=33%, E-value=2e-28, Identity=85%"; Hit description =Chromosome undetermined scaffold_17, whole genome shotgun sequence
  Pfam annotation: Domain name=DUF667; Domain location=1-66; Score =15.0; E_value=7.3e-10; Accession=PF05018.4; Description=Protein of unknown function (DUF667)
MDEGWNQIQFNLADFTKRAYGTNYVETLRVQVHANCCLRRIYFSDRLYSEEELPPEFKLYLPMQINIARSSNIKLCSDACL

SEQ ID NO: 138699 - protein, 1183 aa, Glycine max
  Coding DNA Sequence Number=SeqID_21921
  Gene Ontology: Mol. function=protein binding; Cellular component =membrane; Biological process=defense response
  Homolog annotation: Hit_ID=Q6R270; Match level="QueryCoverage=99%, HitCoverage=100%, E-value=0.0, Identity=78%"; Hit description =Disease resistance protein
  Pfam annotation: Domain name=LRR_1; Domain location=1027-1048; Score =11.1; E_value=2.4; Accession=PF00560.23; Description=Leucine Rich Repeat
  Pfam annotation: Domain name=LRR_1; Domain location=1050-1073; Score =3.3; E_value=70; Accession=PF00560.23; Description=Leucine Rich Repeat
  Pfam annotation: Domain name=LRR_1; Domain location=1105-1125; Score =7.3; E_value=13; Accession=PF00560.23; Description=Leucine Rich Repeat
  Pfam annotation: Domain name=LRR_1; Domain location=1127-1150; Score =10.4; E_value=3.2; Accession=PF00560.23; Description=Leucine Rich Repeat
  Pfam annotation: Domain name=LRR_1; Domain location=589-611; Score =7.5; E_value=11; Accession=PF00560.23; Description=Leucine Rich Repeat
  Pfam annotation: Domain name=LRR_1; Domain location=613-634; Score =9.8; E_value=4.1; Accession=PF00560.23; Description=Leucine Rich Repeat
  Pfam annotation: Domain name=LRR_1; Domain location=636-658; Score =13.7; E_value=0.68; Accession=PF00560.23; Description=Leucine Rich Repeat
  Pfam annotation: Domain name=LRR_1; Domain location=660-681; Score =4.8; E_value=35; Accession=PF00560.23; Description=Leucine Rich Repeat
  Pfam annotation: Domain name=LRR_1; Domain location=793-814; Score =5.6; E_value=26; Accession=PF00560.23; Description=Leucine Rich Repeat
  Pfam annotation: Domain name=LRR_1; Domain location=816-839; Score =1.8; E_value=1.3e+02; Accession=PF00560.23; Description=Leucine Rich Repeat
  Pfam annotation: Domain name=LRR_1; Domain location=871-892; Score =8.6; E_value=7; Accession=PF00560.23; Description=Leucine Rich Repeat
  Pfam annotation: Domain name=LRR_1; Domain location=949-970; Score =10.9; E_value=2.6; Accession=PF00560.23; Description=Leucine Rich Repeat
  Pfam annotation: Domain name=LRR_1; Domain location=972-995; Score =1.9; E_value=1.3e+02; Accession=PF00560.23; Description=Leucine Rich Repeat
  Pfam annotation: Domain name=NB-ARC; Domain location=162-466; Score =348.8; E_value=8.9e-102; Accession=PF00931.13; Description=NB-ARC domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR_1::NB- ARC; Domain location=1027-1048::1050-1073::1105-1125::1127-1150::589 -611::613-634::...
  Pfam module annotation: Domain location=636-658::660-681::793 -814::816-839::871-892::949-970::972-995::162-466
MALELVGGALLSAFLQVAFEKLASPQVRDFFRGRKLDEKLLNNLEIKLNSIQALAVDAELKQFRDTRVRDWLLKVKDALFDAEDLLDEIQHEISTCQVEAESQTCSGCTCKVPNFFKSSPVSSKEIKSRMKQVLGDLENLASQSGYLDLKNASGVGSGFGGAVSLHSESTSLLVESVIYGRDDDKEMIFNWLTSDIDNCNKLSILSIVGMGGLGKTTLAQHVFNDPRIENKFDIKAWVCVSDEFDVFNVTRTILEAVTKSTDDSRNREMVQGRLREKLTGKRFFLVLDDVWNRNQKEWKDLQTPLNDGASGSKIVITTRDKKVASVVGSNKTHCLELLQDDHCWRLFTKHAFRDDSHQPNPDFKEIGTKIVEKCKGLPLALTTIGSLLHQKSSISEWEGILKSEIWEFSEEDSSIVPALALSYHHLPSRIKRCFAYCALFPKDYRFDKEGLIQLWMAENFLQCPQQSRSPEEVGEQYFNDLLSRSFFQQSSTIERTPFVMHDLLNDLAIYVCRDICFRLEDDQAKNIPKTTRHFSVASDHVKCFDGFRTLYNAERLRTFMSLSEEMSFRNYNRWHCKMSTRELFSKFKFLRVLSLSGYSNLTELPDSVGNLKYLHSLDLSNTDIEKLPESTCSLYNVQILKLNGCRHLKELPSNLHKLTDLHRLELIDTGVRKVPAHLGKLKYLQVLMSSFNVGKSREFSIQQLGELNLHGSLSIQNLQNVENPSDALAVDLKNKTHLVELELKWDSDWNQNRERDEIVIENLQPSKHLEKLTMRNYGGKQFPSWLSDNSSCNVVSLTLENCQSCQRLPPLGLLPFLKELSIRWLDGIVSINADFFGSSSCSFTSLESLEFSDMKEWEEWECKGVTGAFPRLQRLFIVRCPKLKGLPPLGLLPFLKELLIERLDGIVSINADFFGSSSCSFTSLESLKFFDMKEWEEWECKGVTGAFPRLQHLSIVRCPKLKGLPPLGLLPFLKELSIDSLDGIVSINADFFGSSSCLFTSLESLKFSRMKEWEEWECKGVTGAFPRLQRLSIYYCPKLKGLPPLGLLPFLKELSIDNLDGIVSINADFFGSSSCSFTSLESLKFSDMKGWEEWECKGVTGAFPRLQRLSIYRCPKLKGHLPEQLCHLNDLTISGCDSLTTIPLDIFPILRELDIRKCPNLQRISQGQTHNHLQRLSIKECPQ

SEQ ID NO: 138700 - protein, 42 aa, Glycine max
  Coding DNA Sequence Number=SeqID_21922
MSEIGRFGGLGMEERRKEEGAAQGFLENVIFIEQDAWPSVLL

SEQ ID NO: 138701 - protein, 81 aa, Glycine max
  Coding DNA Sequence Number=SeqID_21923
MDYLIRMCYTDSKEDKATIKEGKKKPYLDDGNLLKASNGSSHRQQHNTKQRRGCKKTKEEVAYGRRIGGKFEVVEGANKVQ

SEQ ID NO: 138702 - protein, 99 aa, Glycine max
  Coding DNA Sequence Number=SeqID_21924
MVVREGGDTLISGGYSDNHAIMCQDKFSDKVDRRMQKVQQMEGVEGTHHDGKGHEEVGTNFVIPTIVKSKGKTDMQNMGSCGKVEDIGPGLVLMISERG

SEQ ID NO: 138703 - protein, 108 aa, Glycine max
  Coding DNA Sequence Number=SeqID_21925
MEAMKEQMTTMMEAMMSMRKMIEVNMTTVVFASTATEVDPIHPSGLNQVQNKHSFLLYGLPPNYTPPNVAHTPDENVYHFAPIPIESQQPESNHAHVSQPIGETHEAP

SEQ ID NO: 138704 - protein, 219 aa, Glycine max
  Coding DNA Sequence Number=SeqID_21926
  Gene Ontology: Mol. function=RNA-directed DNA polymerase activity; Biological process=RNA-dependent DNA replication
MVERERFGHIEERLRAIEGGRDYAFADMAELYLMPNVVIPLKFKVSNYDKYKGTTCPKNHLKMYNKKMGAYSKNENLLMHFFQESLTGATVTWQYHYNSDMATDKMRLQNVCKKEHESFKEYIQRWRDLAAQVVPPMMEREMITMIVDTLLVFYYEKMVGYMPSSFSDFVFTGKKIEVGLRRGKFDYPTLMNRKPGANGENKKEGETHADVILPPKGIG

SEQ ID NO: 138705 - protein, 52 aa, Glycine max
  Coding DNA Sequence Number=SeqID_21927
MDEEMTDLLDFLGDSGARDREIFGVMALSYFVTVFVTYHFRALFVHLVVRRK

SEQ ID NO: 138706 - protein, 96 aa, Glycine max
  Coding DNA Sequence Number=SeqID_21928
MHMRQMQLMNTGVRGNCLIFKKVTRTLRWFPKERGSRQNPCVMHMRRAQHGSVQYNNIHKIYKRKGYMLLMHGSVKKWNAACPLCAPIRGTYMGGS

SEQ ID NO: 138707 - protein, 89 aa, Glycine max
  Coding DNA Sequence Number=SeqID_21929
  Gene Ontology: Mol. function=nucleic acid binding
MRTLCFPQGIVEDLLIKVRKFIFPVDFMILDIEENEVTPIILGKLFLNTIGTLIDVKEGKLTWWLGDEEEVFKATNKIKVIFSSNTHKP

SEQ ID NO: 138708 - protein, 125 aa, Glycine max
  Coding DNA Sequence Number=SeqID_21930
  Gene Ontology: Mol. function=chitin binding; Cellular component =extracellular region; Biological process=chitin metabolic process
  Homolog annotation: Hit_ID=Q86AI8; Match level="QueryCoverage=95%, HitCoverage=26%, E-value=6e-11, Identity=39%"; Hit description =Similar to Homo sapiens (Human). Mucin 2
DGPLGTSTLVSRGLYVLTLRGLHVLTIRGLHAFTSRGLYVLALRGLHALTLGLHVLALRGLHVLTIRGLHALTSRGLYVLALRGLHAFTLGTSYPHRQRTTRPRLERTTRPHHQRAARPYLQRTT

SEQ ID NO: 138709 - protein, 109 aa, Glycine max
  Coding DNA Sequence Number=SeqID_21931
MSRNLMDYAIIPSLASKMLWNFTDCALTRPFNSRHVAELHGLPNNGCQARMTIRYLRTSSGSPPLDDERCRMTIICLCVPSDMIAFEWRKGVRNDHNLSPHVIGLAASG

SEQ ID NO: 138710 - protein, 541 aa, Glycine max
  Coding DNA Sequence Number=SeqID_21932
  Gene Ontology: Mol. function=transcription regulator activity; Cellular component=nucleus; Biological process=regulation of transcription
  Homolog annotation: Hit_ID=Q5Z610; Match level="QueryCoverage=97%, HitCoverage=96%, E-value=7e-40, Identity=27%"; Hit description=Basic helix-loop-helix protein-like
  Pfam annotation: Domain name=HLH; Domain location=351-400; Score =32.2; E_value=1.9e-06; Accession=PF00010.16; Description=Helix-loop -helix DNA-binding domain
MESVFSLSVAARADFIQFLVQSFGCSYICLWAYDSISPNRLSFLDGIYNLRNNQASSSLGSVQAQQLFSQFRTLTFDINDDRVPGLAFRNQRSYLELQQLELLRLASTEIQTQFFQEARIKTAVFMGCNKGEIELGFLNMSQVDIQTTLRSLFPEDFSTRVLSQQIDQNPPASSSSSLRSISTGSPEYSSLLFSIPGTSQPHFSPETLGASSSSRLVPPMQPVPNSPHQQAINNIQALAQVPSLTQFPTPETEHDAIMRAILYVISPTTSHHHHNQQHQQNLPYSSNNSLPVVHPDASAFQRYRQDLGSNNMVSNILRRQSLMKRSFVFFRNLNFMRMRDRIQATSRPTNTQLHHMISERRRREKLNENFQSLRALLPPGTKKDKASILIAAKETLSSLMAEVDKLSKRNQGLTSFLSAKESTTEETKVASLSPNKRLSVIISHVPESSSSEERMVELQVNVRGQVSQTDLLIRLLEFLKLAHHVSLVSMDANTHVAEGNNALHQLSFRFRIIQGSEWDESSFEEAVRRVVADLLQYQMDQ

SEQ ID NO: 138711 - protein, 168 aa, Glycine max
  Coding DNA Sequence Number=SeqID_21933
MRCGDVNEVKTERRERIGEEKENRGVRGSDDVETERRRGTTRGCSANSERVSMPQVRKRCGGGSNGGGENNGGDGGCGISGGGGGCSNVGGVGYDGGGFHNGGSGGGGIVSSSDNEGGGGDSNINGGGDVGDGDGDTNGGNNVVGNGDVGDNNNSDSNAYDCSSDSQL

SEQ ID NO: 138712 - protein, 85 aa, Glycine max
  Coding DNA Sequence Number=SeqID_21934
MIIEESIHVAFDETNAILPRKDILDDISESLEEMNIHGEDHKGKGEGNDEDFHIDEIKTNADLLREWRTSRYHPLDNIIGDISKG

SEQ ID NO: 138713 - protein, 57 aa, Glycine max
  Coding DNA Sequence Number=SeqID_21935
MKKGDPTQPVITQLGCKTLVALRKKWGDQRGNHHGGWRATRGTTGARSSGARPPWGR

SEQ ID NO: 138714 - protein, 96 aa, Glycine max
  Coding DNA Sequence Number=SeqID_21936
  Gene Ontology: Mol. function=protein binding
  Homolog annotation: Hit_ID=Q1S5Q4; Match level="QueryCoverage=85%, HitCoverage=9%, E-value=2e-16, Identity=50%"; Hit description =Leucine-rich repeat
MDRCFQVGNSPSVTLKVKGAWSLIEANQFPCEDEHHQGQDIAIMRKDVKSNGDFRQEDHNYMINQDNGGWWSFHTDGEGYLLTSHEISDYPLNYNG

SEQ ID NO: 138715 - protein, 96 aa, Glycine max
  Coding DNA Sequence Number=SeqID_21937
MEFFVDGKRLVLRGATPTNLATARKQNLHKTISSSVHFSMISLQSNEPSGLPPCRIGHDHKIPLLQGANPVKKRPYRYAKQQKDINDGLIQNYLKS

SEQ ID NO: 138716 - protein, 153 aa, Glycine max
  Coding DNA Sequence Number=SeqID_21938
MVRTRGLGHALARVIGRGRQDEHDAVDAPQRRRPTASARRRRVYITVDEGIPQVTEDVPHMAEDVPQVTEDVPHMADDVAQRSEDVPQMTADVDATVAEDLSRDGAEGSYTDEGFPGGPRDPSVLTSFAKHVTHAIWTGQERPELKLVSHGRK

SEQ ID NO: 138717 - protein, 105 aa, Glycine max
  Coding DNA Sequence Number=SeqID_21939
MTNCLRILLILPFPLNKRFQRINRLRYLLFSLTKIQRTNRLRILCLNTLEDTSFVAPVEVQVEGTSTWLFKENKGGYIPCGSLACKGFYKVERNLKNRWLLGDWM

SEQ ID NO: 138718 - protein, 505 aa, Glycine max
  Coding DNA Sequence Number=SeqID_21940
  Gene Ontology: Mol. function=binding; Cellular component=membrane; Biological process=cell adhesion
  Homolog annotation: Hit_ID=UPI00005F98F2; Match level="QueryCoverage =90%, HitCoverage=44%, E-value=3e-36, Identity=28%"; Hit description =COG3468: Type V secretory pathway, adhesin AidA
  Subcellular localization annotation: CTP_CleavageSite=71; ConfidenceScore=5.39e-01
RGQPVLKCTKAPAVPPPDAHRSAVACQIRWSPALAGSCRCPRTRSSLPAAVQPVLPRSGTEIAIPERKAVLAGVAAHLRQRNAFVALNAAVAVAIGERRAACRIEPDVEQRGAAGVTADVDVVGELVAQRAAVIQARHQIRLTAQRRQRAVDVQRIARRTAAIGEIQRAAVIHLQRIRCAARQRGMHVVTGIQRRTPINVDGAVRQLQIVSQRPAAIREVNDAPAAAEVNAFAQVIRAEAAAARRNLVKGQAVTGAVAAGEMVSGAEIDAADLGNIVVVCAHGQAAVERAAGPAERVAAAARIDVAQHVTLRQQNHIVSVTARHRHALRRGRHDSTEVLEYRFAAAQIDHRCRQAAGAQRAAVDDGAGGAGDQRRTACRISDIDAGGGEDISRGVGANPGAAGAGDIENVTRTQRQIAAGGRSIGVGDSQAVTAAGYIGGHGGGGIERDGSADAVAIADVKRQVAQANVVQLRAVFDAVAAAQYVDGGVARAERRRAGVEQYAMR

SEQ ID NO: 138719 - protein, 76 aa, Glycine max
  Coding DNA Sequence Number=SeqID_21941
  Subcellular localization annotation: CTP_CleavageSite=41; ConfidenceScore=5.03e-01
MKEILGLQAPMELTSPSVHHALCRPALLQRVLRSPPLRQPRCRPQRNLQLPILLPRNRHFEAPVVTTRLVAMISSS

SEQ ID NO: 138720 - protein, 87 aa, Glycine max
  Coding DNA Sequence Number=SeqID_21942
MEEEHMMLSLLLCKSLQIRARHVALSSTVRQWSFQGINVDLVTDPSLNLYESLALRVEYLAVLRKRSRISKIWKKDSSPTNHLYSEA

SEQ ID NO: 138721 - protein, 144 aa, Glycine max
  Coding DNA Sequence Number=SeqID_21943
  Homolog annotation: Hit_ID=Q9M5G4; Match level="QueryCoverage=41%, HitCoverage=12%, E-value=2e-13, Identity=62%"; Hit description=CDK -activating kinase
MEREREREKDLLRNSKKGGNDVRDLKFIGNEWIHCRREASGIETEENLNHPMLELASTKGLVNLSSVDDDGGQVGSEELKDKDGVLVFSPEVLVQNDNVWEALFSKKPLKEASQGSFSKKPLKEASQRSLSRKASQGSFLKLSQ

SEQ ID NO: 138722 - protein, 261 aa, Glycine max
  Coding DNA Sequence Number=SeqID_21944
  Gene Ontology: Mol. function=nucleic acid binding; Biological process= DNA integration
  Homolog annotation: Hit_ID=Q1RVR8; Match level="QueryCoverage=77%, HitCoverage=15%, E-value=8e-11, Identity=27%"; Hit description =Glycoside hydrolase, family 1; Integrase, catalytic region; Zinc finger, CCHC-type
  Pfam annotation: Domain name=zf-CCHC; Domain location=162-179; Score =22.9; E_value=0.00017; Accession=PF00098.13; Description=Zinc knuckle
MTLKEKEFELCLDIETSAKEKDTFLKNFQELENKLKDLQNDLNELNELHDYQKGEGHDLWRECAKAHKDYEDLKMSKHNIWVEYDEHKRFVNDKILKNQEVIGQCQNVLKLHEETRTLKTTLAKFVNGTYNLNKLLGYSRSSLENSRNGYNGKVYVHDKDTIVCYFCGKTGHMTSRCKDQPKKDTINIFMANTKGPKKIWVPKKKIIPTANDLDIRKHTPIMVPGQWLLMTHDRRNVYVPMLDSLSWWNNHFQRESKWKNN

SEQ ID NO: 138723 - protein, 173 aa, Glycine max
  Coding DNA Sequence Number=SeqID_21945
  Homolog annotation: Hit_ID=Q1SDG1; Match level="QueryCoverage=34%, HitCoverage=5%, E-value=2e-13, Identity=56%"; Hit description =Integrase, catalytic region; Zinc finger, CCHC-type
MMSLSSSLNMGLLYSLPREKKNNLVRGLPSISYKDDLLCKACLKGKQIKNSFSNKNIVSTSRPLELIHLHLFGPTRITPKWKETQVSLGRLASLQRVREFTKFSKRHRFEAKLLPYTRVATPWPCCAEAATHRCSLASSLLALSRSPPSSIIVGHRCLAGPHSRSKLCFTSRR

SEQ ID NO: 138724 - protein, 75 aa, Glycine max
  Coding DNA Sequence Number=SeqID_21946
MSMSVRVMLFSENAPIMWNRHRLKGALKTGCTPKAYTPKSPSEPLPPDLGSTPKIFLHADTASELYNTHDLTLVS

SEQ ID NO: 138725 - protein, 113 aa, Glycine max
  Coding DNA Sequence Number=SeqID_21947
  Gene Ontology: Mol. function=RNA-directed DNA polymerase activity; Biological process=RNA-dependent DNA replication
MENDCCVHVRKFHKCQTFADNVNAPPVSLNVLAAPWPFSMLPRKIITDNATNLNNKMMKEMCEDFKIQHHNLTPYRPKMNGVIEAANKNIKKIVQKMIVSYKDWHEMLPFTLH

SEQ ID NO: 138726 - protein, 161 aa, Glycine max
  Coding DNA Sequence Number=SeqID_21948
  Homolog annotation: Hit_ID=Q58J68; Match level="QueryCoverage=29%, HitCoverage=12%, E-value=8e-12, Identity=62%"; Hit description =Mitochondrial SBP40
RIQGTNCLRILCPNTLEGTSFVVQVEGTSTWVVILRTREGTSLVDQFKWRVDPLGCSKRTREGTSHVDLWLVKDFTRLKEISRTVGCLGTGCHLIQHDLVQNYANWWDNRLNKRNAKAPDFKHKETSKGLWLDSSSKWVLEKLPPPMKPKQSVDTERTLVS

SEQ ID NO: 138727 - protein, 108 aa, Glycine max
  Coding DNA Sequence Number=SeqID_21949
MTKKRRNESNEREERKEKGRATGEKKRARKRDNEGNERYLETPLLSLMVVPSVTLPLVNSLSSGSMLLYMQLVQRSSSFTLSSPLDLMGSPSESNRIQTELGSDTLLK

SEQ ID NO: 138728 - protein, 575 aa, Glycine max
  Coding DNA Sequence Number=SeqID_21950
  Gene Ontology: Mol. function=transporter activity; Cellular component= membrane; Biological process=oligopeptide transport
  Homolog annotation: Hit_ID=Q9M817; Match level="QueryCoverage=97%, HitCoverage=94%, E-value=1e-143, Identity=47%"; Hit description =Peptide transporter, putative
  Pfam annotation: Domain name=MFS_1; Domain location=24-503; Score =15.4; E_value=6.3e-05; Accession=PF07690.6; Description=Major Facilitator Superfamily
  Pfam annotation: Domain name=PTR2; Domain location=86-487; Score =244.5; E_value=2.3e-70; Accession=PF00854.12; Description=POT family
  Pfam module annotation: Pfam domain module=MFS_1::PTR2; Domain location=24-503::86-487
MMDSSGATNEKLLENGTPSSSQMRKVNESLEKVASYGIMPNMILYLRDEYRMSIAKGTSVIYTWTAASDILSIFGAFLSDSYLGRFLVIAIGSFSSLLGLTMLWLTAMIPDLKPTRESDMLGCNSATAVQLALLFFSMGLISIGAGCVRPCSIAFGADQLTIKERSNDERLLDSYFNWYYTSIAISSMIALSVIVYIQENLGWKIGFGLPALLMFISAASFILGSPFYVKVKPGHSLLTTFVQVAVVAVKNRKLSLPDCNFDQFYQDRDSEPMIPTDSLRCLNKACIKNTGTVSNPDVSVSDPWSQCTVGQVESLKSLVRLLPMWSSGVLMMVSQGSFSTLQATTLDRRLFGNFKMPAGSFNLIMILTLSIVIPLYDRIMVPLLAKYRGLPNGFGSKTRIGIGLLFVCAAKGTSAVVETIRRNAAIEQGFEDQPNAIIDMSVFWLFPEFILLGIGEAFNTVAQVEFFYNYIPKTMSSFAMALFTLELAAASVVGSVLVNIVDKVTSVGGEESWLATNINRAHLNYYYALLTCIGLINYLYFLAISCAYGPPPGQTLGASAGKEEEKFDYRELHTS

SEQ ID NO: 138729 - protein, 68 aa, Glycine max
  Coding DNA Sequence Number=SeqID_21951
MLQPYGINIGLKEHSNRVTPKAYTPKSLSGPLSPDSDIAHELYNMHDLTLVFSNTFNTLRYNLALAPK

SEQ ID NO: 138730 - protein, 140 aa, Glycine max
  Coding DNA Sequence Number=SeqID_21952
MTTLIQIWMTLLLSNILPNDHNSDLPLPKCQLVYAILTQMTVHVAQIIADAIYLFAGTAPTRHPLDPKKSNRALGFPALITGLCQFYIVPVTPSKVIRPPITRAFIEKYCTPRQAQGGAQQVTNTSPPQQPDLVRPLSVE

SEQ ID NO: 138731 - protein, 77 aa, Glycine max
  Coding DNA Sequence Number=SeqID_21953
  Homolog annotation: Hit_ID=Q6Q2Z9; Match level="QueryCoverage=67%, HitCoverage=5%, E-value=3e-16, Identity=75%"; Hit description =Phosphoenolpyruvate carboxylase
MTDITDDIAEEISFQGFEDDCKLLGNLLNDILQREAGSTFVDKLEKIRVLSQSLVLFCCGENGRRLKHDMRNAFRLS

SEQ ID NO: 138732 - protein, 94 aa, Glycine max
  Coding DNA Sequence Number=SeqID_21954
  Subcellular localization annotation: CTP_CleavageSite=29; ConfidenceScore=5.32e-01
MTPLPVKEDKSGLSSFSTQGLCPSPLGPSSFSTWTFSLYLASFRILITITLDDMASLLHFPIIGAFHSFEQLHVNDAIKILVELLEVSFVDARA

SEQ ID NO: 138733 - protein, 152 aa, Glycine max
  Coding DNA Sequence Number=SeqID_21955
  Gene Ontology: Mol. function=nucleic acid binding; Cellular component= endoplasmic reticulum membrane; Biological process=DNA integration
CDIANTNSQNLKNQVVSLHSKLESDPTEKHQKSIFNYRKTSTRPDIAFAVGVLERYQSDPSVGHWKVAKKVMRYLQGTKDYMLMYRQTDDLKVIGYSNLDYVGCIDTKKSTSIYIFMLAGGVVSWRSAKQPLIATSNMEAEFVSFFMAILHD

SEQ ID NO: 138734 - protein, 100 aa, Glycine max
  Coding DNA Sequence Number=SeqID_21956
  Gene Ontology: Mol. function=ribonuclease H activity; Biological process=RNA-dependent DNA replication
  Homolog annotation: Hit_ID=Q1T5S5; Match level="QueryCoverage=98%, HitCoverage=33%, E-value=7e-17, Identity=42%"; Hit description =Ribonuclease H
MPRIIPVSWYPPLCGWIKCNSDGSGSFDPAASGELLTAMTTVELDFEKGWWRLYLECGSTLVVHAFHNPDIVPWKLQNHWKNRLGLARFMRFEVSHILRE

SEQ ID NO: 138735 - protein, 339 aa, Glycine max
  Coding DNA Sequence Number=SeqID_21957
  Gene Ontology: Mol. function=oxidoreductase activity; Biological process=metabolic process
  Homolog annotation: Hit_ID=Q8ZKH5; Match level="QueryCoverage=55%, HitCoverage=45%, E-value=1e-69, Identity=64%"; Hit description =Putative outer membrane or exported protein
EGVTILVVNTDAGFHRDRNADHIAHRFDTVRDQRRLTHQARAKTAVLYPIGRTTDVQVDLIVSARFCQLCTGCQRSRIATAQLQRQRMLRLAIGQIVAFAVDDGPGGHHFGVQQRVAAQLTVKIATVTVGPVQHWGDGETLRRECIEVKPELHHGPPGIVFADRTGQVQMHRVVERRHAETGRKHIGVIRLHIRAIAGTQRQPVQHAIFTTHASVLTALLRFKTFGFGQIDIAGQSKGSAIPRQSGGYQWANLIRIAIAVNLFGVDIARDQVLPGHAEGPVLREVGSDTGIDVETGIGAAIAAVVNIILVVVINAGGVVIQPGFLQLRRDANGDRVTGD

SEQ ID NO: 138736 - protein, 79 aa, Glycine max
  Coding DNA Sequence Number=SeqID_21958
MWLILLSLWFFLFLLWFFLLLLWFFLLFCTLNDNIHRLLFILCRLILLEAEQQGGGEAKAKENETQDVAEDQGGGQKVV

SEQ ID NO: 138737 - protein, 81 aa, Glycine max
  Coding DNA Sequence Number=SeqID_21959
  Homolog annotation: Hit_ID=Q1SJY5; Match level="QueryCoverage=56%, HitCoverage=4%, E-value=2e-09, Identity=63%"; Hit description =Integrase, catalytic region
MDNSTSDEEDEEETNLCLMDDIEIEESKSEQEEEKNDARQLVELPKDKKAIGAKWVFRKKLDEDGKVVRNRARLFSKGYSQ

SEQ ID NO: 138738 - protein, 194 aa, Glycine max
  Coding DNA Sequence Number=SeqID_21960
MMGRRVTLNTESIAKGCGCERLLDNHYLNNWSNWYDKSSYVEKVLYGGVYNNSMKGKRWSTKIFARRKIFGRKYVTSVFCTRSGSRTISQTYTNEGVPLSPPHDTVNAYESSTFAYTPPTITRTTIEMRPPSSLLYLTKFVRPTPTWLSTWPAWTNPPKKITEDEKIREKFSVVIFTRNEHNYCKKKEIIGRPH

SEQ ID NO: 138739 - protein, 249 aa, Glycine max
  Coding DNA Sequence Number=SeqID_21961
  Gene Ontology: Mol. function=nucleic acid binding; Cellular component= beta-galactosidase complex; Biological process=DNA integration
MDDGKEMKIPMHPTTYLRLDKESKKVDNTLYKGIVGSLLYLTMSRPNIMFSVCLCARFQKDPREVHLTEVKRIVRYLIDTPNLGLCFKKEKDFKFISFCNVDYVGDKIERKRTRGSCYFIGGNLVIWVCKKGTITLSTLEAEYISISSCYAQLLWIKNQLEEYNIFESNVPIFCNNKAAISLFKNSSLHYRAKHVEIKHHFIRDLVQKGTLDLQFVPIEDQLVDIFTKPLTEDKLILLRNKLGMEFIRE

SEQ ID NO: 138740 - protein, 78 aa, Glycine max
  Coding DNA Sequence Number=SeqID_21962
MPLEYADELWVDRMRVIEVTSDATFEQVLMQVESSTFQILNVEEVLNVDGSFIIILTCDGDGVNKACQQEMTQQKSTN

SEQ ID NO: 138741 - protein, 427 aa, Glycine max
  Coding DNA Sequence Number=SeqID_21963
  Gene Ontology: Mol. function=protein binding; Cellular component =integral to membrane; Biological process=defense response to fungus
  Homolog annotation: Hit_ID=Q949G9; Match level="QueryCoverage=98%, HitCoverage=83%, E-value=4e-66, Identity=29%"; Hit description =HcrVf1 protein
  Pfam annotation: Domain name=LRR_1; Domain location=104-129; Score =6.6; E_value=17; Accession=PF00560.23; Description=Leucine Rich Repeat
  Pfam annotation: Domain name=LRR_1; Domain location=131-153; Score =12.5; E_value=1.3; Accession=PF00560.23; Description=Leucine Rich Repeat
  Pfam annotation: Domain name=LRR_1; Domain location=155-177; Score =17.2; E_value=0.062; Accession=PF00560.23; Description=Leucine Rich Repeat
  Pfam annotation: Domain name=LRR_1; Domain location=179-201; Score =20.9; E_value=0.0047; Accession=PF00560.23; Description=Leucine Rich Repeat
  Pfam annotation: Domain name=LRR_1; Domain location=203-225; Score =15.5; E_value=0.19; Accession=PF00560.23; Description=Leucine Rich Repeat
  Pfam annotation: Domain name=LRR_1; Domain location=227-249; Score =2.2; E_value=1.1e+02; Accession=PF00560.23; Description=Leucine Rich Repeat
  Pfam annotation: Domain name=LRR_1; Domain location=256-278; Score =1.5; E_value=1.5e+02; Accession=PF00560.23; Description=Leucine Rich Repeat
  Pfam annotation: Domain name=LRR_1; Domain location=280-302; Score =10.8; E_value=2.7; Accession=PF00560.23; Description=Leucine Rich Repeat
  Pfam annotation: Domain name=LRR_1; Domain location=3-25; Score=14.4; E_value=0.41; Accession=PF00560.23; Description=Leucine Rich Repeat
  Pfam annotation: Domain name=LRR_1; Domain location=304-326; Score =9.4; E_value=4.9; Accession=PF00560.23; Description=Leucine Rich Repeat
  Pfam annotation: Domain name=LRR_1; Domain location=328-351; Score =6.1; E_value=20; Accession=PF00560.23; Description=Leucine Rich Repeat
  Pfam annotation: Domain name=LRR_1; Domain location=353-376; Score =3.6; E_value=60; Accession=PF00560.23; Description=Leucine Rich Repeat
  Pfam annotation: Domain name=LRR_1; Domain location=402-425; Score =6.8; E_value=15; Accession=PF00560.23; Description=Leucine Rich Repeat
  Pfam annotation: Domain name=LRR_1; Domain location=54-75; Score=9.8; E_value=4.2; Accession=PF00560.23; Description=Leucine Rich Repeat
  Pfam annotation: Domain name=LRR_1; Domain location=80-102; Score =7.9; E_value=9.7; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1; Domain location=104-129::131-153::155-177::179 -201::203-225::227-249::...
  Pfam module annotation: Domain location=256-278::280-302::3-25::304 -326::328-351::353-376::402-425::54-75::80-102
MSSLTHLDLSDTGFMGKIPSQIGNLSNLLYLDLGNYFSEPLFAENVEWVSSMWKLEYLHLRNANLSKAFHWLHTLQSLPSLTHLYLSNCTLPHYNEPSLLNFSSLQTLDLSDTSYSPAISFVPKWIFKLKKLVSLQLWGNEIQGPIPCGIRNLTHLQNLDLSSNSFSSSIPDALGNLTSLVELDLSGNQLEGNIPTSLGNLTSLVEIDLSYSQLEGNIPTSLGNLCNLRVIDLSYLKLNQQVNELLEILAPCISHGLTRLAVQSSRLSGNLTDHIGAFKNIELLDFFNNSIGGALPRSFGKLSSLRYLDLSMNKFSGNPFESLRSLSKLLSLHIDGNLFHGVVKEDDLANLTSLTEFAASGNNFTLKVGPNWIPNFQLTYLDVTSWQLGGPSFPLWIQSQNQLQYVGLSNTGIFDSIPTQMWEALSQ

SEQ ID NO: 138742 - protein, 106 aa, Glycine max
  Coding DNA Sequence Number=SeqID_21964
  Gene Ontology: Mol. function=RNA-directed DNA polymerase activity; Biological process=RNA-dependent DNA replication
MEDESSSYGPTLILGRPFLMTPLPTHLKYAYGVANNQLLVIISSTLQVEQEEKLLQVFRDHRRFIGWTLVDLFGISLAIYMHRMLLEDKFRPVYSHKGESIPPSRM

SEQ ID NO: 138743 - protein, 95 aa, Glycine max
  Coding DNA Sequence Number=SeqID_21965
MMGYAPSSFVDLVFSGERIKVGLEKGKSDHPALMNVKTEANEEGENEGETHAATAIPIRPSFPPTQQHHYSANINLSQRVPGRSRNSGGKIRGLG

SEQ ID NO: 138744 - protein, 87 aa, Glycine max
  Coding DNA Sequence Number=SeqID_21966
KKKSTTQAWKAVRVAAVWVIWRNRNNIIFKKGQLDSEKVLEEIKLQSSACLKAKMKGFKAILLMNGHVFQHWVYQWQDKSNTFLIHG

SEQ ID NO: 138745 - protein, 85 aa, Glycine max
  Coding DNA Sequence Number=SeqID_21967
MKADMKVMKEQMTMMMEAIIWYTNLEPSWVHSWKDLMDSFIKQYQYNFEMTPDRMQLQNMCKRDNESFKEYTPRWRDLTTQVVPP

SEQ ID NO: 138746 - protein, 89 aa, Glycine max
  Coding DNA Sequence Number=SeqID_21968
  Subcellular localization annotation: CTP_CleavageSite=50; ConfidenceScore=5.68e-01
MNLLPSAVHASSTNKSGAPRSYCVALFADCAFSNLIRRPMNSLPSAVHVSSVIKRGALKRRRSRDESCHHGKGRTGKISVLSLLSSYLR

SEQ ID NO: 138747 - protein, 173 aa, Glycine max
  Coding DNA Sequence Number=SeqID_21969
  Gene Ontology: Mol. function=zinc ion binding
  Homolog annotation: Hit_ID=Q1S5F3; Match level="QueryCoverage=74%, HitCoverage=63%, E-value=2e-37, Identity=61%"; Hit description=Zinc finger, C3HC4 type (RING finger), putative
  Pfam annotation: Domain name=zf-C3HC4; Domain location=84-139; Score =13.1; E_value=0.007; Accession=PF00097.15; Description=Zinc finger, C3HC4 type (RING finger)
MLVTEDKSHVVVAIDNDGCCHRSSAGGEGFADAGERSDEEQRSSHDSGTEIVGVCEKERGSECSVEVDLVPEVKVHLANVERDCRICHLSMDMTNHESGTSIELGCSCKDDLAAAHKQCAEVWFKIKGNNVSILECESGIIMWIKWSCLMKCPNSGDVNLILLLLTLGYRELN

SEQ ID NO: 138748 - protein, 323 aa, Glycine max
  Coding DNA Sequence Number=SeqID_21970
  Gene Ontology: Mol. function=DNA binding; Cellular component=nucleus; Biological process=regulation of transcription
  Homolog annotation: Hit_ID=A0FK20; Match level="QueryCoverage=89%, HitCoverage=75%, E-value=3e-67, Identity=47%"; Hit description=Myb transcription factor
  Pfam annotation: Domain name=Myb_DNA-binding; Domain location=19-65; Score=39.0; E_value=1.6e-08; Accession=PF00249.21; Description=Myb -like DNA-binding domain
MPYSSHYEYNDCQLSISNENSISAEEEDSIIVSAHAIHGNKWAAIARLLPGRTDNAIKNHWNSTLKRRCMEMGRYVPAHADVMEDGTGSFDKTKASSEETMSIGDINSKNPAEVRNVMMDNENKPPTKDDAKVEEHPTLHRPVARVSAFSVYNTPGRSTMGSCSKMFPRQSPLIQSPKPDVGSCKLFDDIDCEPMVPSQCGHGCCTGDSRESHSHGSLLGPEFVDYLESPSSSHAFISIATDLNNIAWIKSGLENCSTGVTENTANLTASRGVASALQTNFLGQDLKNGYGQFEEGHGMFLGAMQEVLSTKMARQHYAMPAEV

SEQ ID NO: 138749 - protein, 68 aa, Glycine max
  Coding DNA Sequence Number=SeqID_21971
MVNFGGLPLITASETIRCLIPSSWPRNCILHMKESGMIHISSICRRNEWKEKSNLSPKSQAHILPLTS

SEQ ID NO: 138750 - protein, 117 aa, Glycine max
  Coding DNA Sequence Number=SeqID_21972
MVIFIHGVAAKNKGEEVASLRSTCYIPPIAKLTPCQKYMKEESFLEMLPWEATHEPKIYPKAHENPRAFSCIFGLIFLESSIQCPCGVGLHHPFPLEKDLTSNPEVLETLGFFPRHL

SEQ ID NO: 138751 - protein, 37 aa, Glycine max
  Coding DNA Sequence Number=SeqID_21973
  Subcellular localization annotation: CTP_CleavageSite=17; ConfidenceScore=5.03e-01
MGTNSNSNSNNNNSAFRMAAKPCSITTLTQNSPTSGI

SEQ ID NO: 138752 - protein, 511 aa, Glycine max
  Coding DNA Sequence Number=SeqID_21974
  Pfam annotation: Domain name=HPC2; Domain location=88-507; Score= -191.0; E_value=0.087; Accession=PF08729.1; Description=Histone promoter control 2 (HPC2)
  Pfam annotation: Domain name=SPT2; Domain location=391-503; Score =69.0; E_value=1.5e-17; Accession=PF08243.2; Description=SPT2 chromatin protein
  Pfam module annotation: Pfam domain module=HPC2::SPT2; Domain location=88-507::391-503
MSLCRIGLERSFKEILVAIGDSAVVIETTMRGYDDEGDGYDDYYENEGQENEYEEGGEEEYEEEEEVPRKPSKEEMEYLELRQKLKESIRKQMKKDSSANGTLRRDSTDRNKNKLPYDNYGSFFGPSQPVIAQRVIQESKSLLENQHLASRFSNPQHIKKNQNKVPSGGSKSSSHNLAPKVSEIQVKAQKIKNTRDYSFLLSDDAELPAPSKAPPPQNMPIRNSGNLYRIFADVEEGRPAQVPARSKLPLSNGGKHVRASHEERNVGSAAGRLPPKSGSSYKTSKPSMASADSRKQLGNNSDNGPGWPVGPKGLPSKISVGTTGNKSSAPGIKNSVNGMRKSLPSKNHPSIPKQSVDQRISKQSVEQRIPKQSVEQRRDIRELNRPKMTPKQPVASSKPQINKPLKQNSVHTASQDRRPKHKVAKRPFDDDEDEVDFRNVIRNIFNYNPNKFVDDDDDDNMEAGFDEILREEKRSEMIAKREDEEQLRLIEEEEERERRRKMAKLKKRKLG

SEQ ID NO: 138753 - protein, 57 aa, Glycine max
  Coding DNA Sequence Number=SeqID_21975
MLYRNARWQQRSGGGGHVNHEGIMQERREGEYGHERGLEQVILVPTIEGTSSVFLKH

SEQ ID NO: 138754 - protein, 211 aa, Glycine max
  Coding DNA Sequence Number=SeqID_21976
  Homolog annotation: Hit_ID=Q1S8S5; Match level="QueryCoverage=39%, HitCoverage=48%, E-value=2e-31, Identity=74%"; Hit description=C2
  Pfam annotation: Domain name=DUF1723; Domain location=84-133; Score =19.4; E_value=0.0025; Accession=PF08330.1; Description=Protein of unknown function (DUF1723)
MGEAEIDLKPYVQCKQMGLGKLPNGCSLKRIQPDRTNYLAEESSCIWQNGKIVQEMFLRLRNVESGEILVEIEWVDVVGCRGLSQPWDVLIKILRFWSTTINGFVLPKATIGLTLLDVLTILNLSIHGEDLLSLYGICCVPSTTLGIKFSKDDSRYSKFMLLATKKSDIVSPAKHEDICYGQAFIHLPASKVSAFLIANWHLMADFCLAPF

SEQ ID NO: 138755 - protein, 439 aa, Glycine max
  Coding DNA Sequence Number=SeqID_21977
  Gene Ontology: Cellular component=integral to membrane; Biological process=peroxisome organization and biogenesis
  Homolog annotation: Hit_ID=Q8LAE3; Match level="QueryCoverage=99%, HitCoverage=97%, E-value=1e-167, Identity=67%"; Hit description =Proline transporter 1
  Pfam annotation: Domain name=Aa_trans; Domain location=25-424; Score =282.9; E_value=6.2e-82; Accession=PF01490.8; Description =Transmembrane amino acid transporter protein
MTLISNSDVESHADVQIPDTAHQISTDSWFQVGFVLTTGINSAYVLGYSGTIMVPLGWAGGVVGLILATAISLYANALIARLHEYGGTRHIRYRDLAGFIYGRKAYSLTWALQYVNLFMINAGYIILAGSALKATYVLFREDDGMKLPYFIGIAGFILPPHTQYSCPSWKHLQHGGVSSLSRDFLFLSRIQTHDLHEGETSIKSPPRDYSIPGTSTSKISTTIGASANLVFAYNTGMLPEIQATIRQPVVKNMMKALYFQFTVGVLPLYLVTFAGYWAYGSSTATYLMSDVNGPVWAKAMANIAAFLQSVIALHIFASPMYEYLDTKYGIKGSALAFKNLSFRVLVRGGYLTLNTFVSALLPFLGDFMSLTGAISTFPLTFILANHMYLVANANKLTSIQKLWHWINICFFAFMSVAATIAALRLIDLDSKTYHVFADI

SEQ ID NO: 138756 - protein, 93 aa, Glycine max
  Coding DNA Sequence Number=SeqID_21978
MQSDIDRVGKDKPKKEMARVAYAGHRMRVKNKVLGDGYYMRVFRLDVAMGMYSCVIDALVLTGFNSWHCMAKNTRGSDNKLGDNKDLFYSLLI

SEQ ID NO: 138757 - protein, 134 aa, Glycine max
  Coding DNA Sequence Number=SeqID_21979
MSLFQTKKKKSGKDREMAKDLSKEPPPTFDTRWTKTIDRIGLNKCKDDLAALTGSVNSIPILKKPSLLDEVAFEYFHSSMTSPSSRLGRLNNLGFSIKRLEYESRLFLYYAILPIEQGKCPTTEEKLPWKKKEE

SEQ ID NO: 138758 - protein, 76 aa, Glycine max
  Coding DNA Sequence Number=SeqID_21980
MIQYDFFLCWMPLREAAMGLIREASLKDNFTPKLFQLRADDSLAIRSALEGEVFLLIVRNSPIAQQLHWEKGLPRA

SEQ ID NO: 138759 - protein, 191 aa, Glycine max
  Coding DNA Sequence Number=SeqID_21981
  Gene Ontology: Mol. function=nucleotide binding
  Homolog annotation: Hit_ID=Q1S5H0; Match level="QueryCoverage=74%, HitCoverage=27%, E-value=4e-57, Identity=72%"; Hit description=Plant protein family, putative
  Pfam annotation: Domain name=DUF246; Domain location=2-96; Score= -204.8; E_value=0.01; Accession=PF03138.5; Description=Plant protein family
MKSLRSKYRYLLTHSTLATKEELLPFKDHQNQLAALDYIIAVESDVFIYSYDGHMAKAARGHRAFEGFRKTISPDKQKFVRLIDQLDNGLISWDEFSSRVKSIHANKNGGPHHRKVNRHPKLEESFYANPYPGCICERRETMMMIAFWQLELQKPNNYFELYIKKKFIELNLNLRPQDRFKLNVDGALMRI

SEQ ID NO: 138760 - protein, 43 aa, Glycine max
  Coding DNA Sequence Number=SeqID_21982
MEFLKKEVALSPMNKSVADVNVTHADTVQMLGTATSAAPREQR

SEQ ID NO: 138761 - protein, 173 aa, Glycine max
  Coding DNA Sequence Number=SeqID_21983
  Gene Ontology: Mol. function=structural constituent of ribosome; Cellular component=ribonucleoprotein complex; Biological process =translation
  Homolog annotation: Hit_ID=Q9LMK0; Match level="QueryCoverage=62%, HitCoverage=100%, E-value=1e-42, Identity=85%"; Hit description=60S ribosomal protein L35a-1
  Pfam annotation: Domain name=Ribosomal_L35Ae; Domain location=74-168; Score=137.6; E_value=3.5e-38; Accession=PF01247.8; Description =Ribosomal protein L35Ae
MPLMLEDINPYRSSVPSNRPLLTLNMFAPFDYVYKNPETDAIVATASAELRRIEEEQEASPLPQWLKVAKENVLYVRGSILGYKRSKSNQYPSTSLIQIENVNSKEEVAWYCGKRMAYIYKAKVKKNGSHYRCIWGKVTRPHGNSGIVRAKFKSNLPPRVQGLEYSCIQAIYE

SEQ ID NO: 138762 - protein, 92 aa, Glycine max
  Coding DNA Sequence Number=SeqID_21984
  Subcellular localization annotation: CTP_CleavageSite=46; ConfidenceScore=5.55e-01
MAKPTLAAMNASTKTFVSVIAKRTTLSLYLSLLKQRHLSLQQMTFREMPVSEGFIAVEKPKFTVANKMNVTVASSFMYMGQFTGDHYFVSRG

SEQ ID NO: 138763 - protein, 145 aa, Glycine max
  Coding DNA Sequence Number=SeqID_21985
MAAEWRRKRERRHHFKEKMSLEEAHHHRRPWIRAWRKKEMNEGRGREEHEILCSKRALKYELWFSPLIQDQVQDSPLSVLRCHEASRGPEIYPKAHENPRVFSCIFGPIFLESSIQCPCGLGLHHVVMVVFVAPPAMAVIGVIRG

SEQ ID NO: 138764 - protein, 97 aa, Glycine max
  Coding DNA Sequence Number=SeqID_21986
  Gene Ontology: Mol. function=catalytic activity; Cellular component =cellular_component; Biological process=metabolic process
  Homolog annotation: Hit_ID=Q8H2B0; Match level="QueryCoverage=94%, HitCoverage=12%, E-value=1e-44, Identity=88%"; Hit description=Beta -amyrin synthase
MWRLKIAEGGNEAYIFSTNNFVGRQTWEFDPEAGTPEERAQVEAARKDFYHHRFKVKPCADLLWRFQILRENNFRQTIPSVKIEDGEEITYQKAQAL

SEQ ID NO: 138765 - protein, 63 aa, Glycine max
  Coding DNA Sequence Number=SeqID_21987
MNILSLLFIEIPLERKFGCGNFTHPLIDHFDQPWDWYFLRVGNFANLGRMRVGFFPRLYLATP

SEQ ID NO: 138766 - protein, 73 aa, Glycine max
  Coding DNA Sequence Number=SeqID_21988
MKLAIALGVKEGESKNCPALLENGASASVTQHIQRRFLTIVVAVVVECQPTLLQKGFLHRLKMSFYISYDASS

SEQ ID NO: 138767 - protein, 170 aa, Glycine max
  Coding DNA Sequence Number=SeqID_21989
  Gene Ontology: Cellular component=membrane
  Homolog annotation: Hit_ID=Q8GZZ6; Match level="QueryCoverage=55%, HitCoverage=42%, E-value=1e-09, Identity=54%"; Hit description =Putative phosphate/phosphoenolpyruvate translocator protein
MIIVESFTYGRVHRPVLECGTSYDESSIATVVVDDTIRKPNNPNVKGFVAPKASAVSIMPEREAVMSSIRFLWILMVKLLHFRSQQNPLNHRLQSEKEVHCCSPRRYRTPPATARVEGDEEVAEGGVAADDGEVEDCAESEDLEELLLGVDVLEQNEFKEVDGGVGISGA

SEQ ID NO: 138768 - protein, 213 aa, Glycine max
  Coding DNA Sequence Number=SeqID_21990
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
DDGEIEGDVNHRIQAGWMKWRKASGVLCDAKVPIKLKGKFYRTAVRPAILYGTECWAVKSQHENKVGVAEMRMLRWMCSKTRQDKIRNEAIRERVGVAPIVEKMVENRLRWFGHVERRPVDSVVRRVDQMERRQTIRGRGRPKKTIREVIKKDLELNDLDRSMSRKPQKPFFNKTGEVVAAQLTQANSARPGELGCFHLKQGNAQNSLEGPKF

SEQ ID NO: 138769 - protein, 165 aa, Glycine max
  Coding DNA Sequence Number=SeqID_21991
MKCVFVHVSPPFEFGAMRSDCLVQFSIHVSSTFEFGAMRSDCPMNCVFVHVSTFEFGAMRSDCIVQFSILTLFRSPMNCLFVHVSSTFEFGAMRSDCPMNSVFAHVSTFKFRAMRSDCLVQFSILTLFRSPMNCLFVHVSSTFEFGAMRSDCLVQFSTLNLFGAP

SEQ ID NO: 138770 - protein, 140 aa, Glycine max
  Coding DNA Sequence Number=SeqID_21992
MRNFIARLRLMRFLVSTVVMKAERRLGRSIFVFCGYIVKVSTDGGASVGDELREKGVSVRADSRSRMMSSLAVISRVLVVISKVWVVMVDRFRVRWIFVEGEQVVHRVGSLSKPSITCWSQMVILNWSTFIYREANYFAG

SEQ ID NO: 138771 - protein, 65 aa, Glycine max
  Coding DNA Sequence Number=SeqID_21993
MEAPFQNTQSQGEHGQFEQENCQEITLQAETSKRVGLRPQKETTPEKLVFHRFKQKTQMKHEAET

SEQ ID NO: 138772 - protein, 143 aa, Glycine max
  Coding DNA Sequence Number=SeqID_21994
  Subcellular localization annotation: CTP_CleavageSite=23; ConfidenceScore=5.53e-01
MPTQPPMPPPSTIPTPPPLPALRQQHPTSVPAPRTIAVIPLLANNKPHAPSDRCWATLFQICKEYPSRRILPSDLCLFSLVTIAAKVGDKELNHSFLLTFYATIGAAKWLYFRNTNLHSLIPLPILIWDPGSNFQAMVVAPAP

SEQ ID NO: 138773 - protein, 158 aa, Glycine max
  Coding DNA Sequence Number=SeqID_21995
  Homolog annotation: Hit_ID=Q01AK1; Match level="QueryCoverage=18%, HitCoverage=3%, E-value=1e-08, Identity=100%"; Hit description =Homology to unknown gene
MTAIVTLTCASICRQSSEQFHNLHYASPFVNTASYLLLHPIIILHKLRLIAHANALLLATMPSHLLLLINCHCSVKLLNVIACLHYPYLSGRPIQRHSWAFNPCPYKDACNDYTSNGSSLPVSEGCVDISIAAASEKAYSRHFDFANFGSIGIGCMNL

SEQ ID NO: 138774 - protein, 384 aa, Glycine max
  Coding DNA Sequence Number=SeqID_21996
  Gene Ontology: Mol. function=binding
  Homolog annotation: Hit_ID=UPI000045BCA3; Match level="QueryCoverage =56%, HitCoverage=66%, E-value=2e-17, Identity=28%"; Hit description =COG0457: FOG: TPR repeat
  Pfam annotation: Domain name=TPR_1; Domain location=220-253; Score =10.9; E_value=0.27; Accession=PF00515.18; Description=Tetratricopepti de repeat
  Pfam annotation: Domain name=TPR_1; Domain location=307-340; Score =8.7; E_value=0.5; Accession=PF00515.18; Description=Tetratricopeptide repeat
  Pfam annotation: Domain name=TPR_1; Domain location=341-374; Score =4.2; E_value=1.7; Accession=PF00515.18; Description=Tetratricopeptide repeat
  Pfam annotation: Domain name=TPR_2; Domain location=186-219; Score =11.5; E_value=1.5; Accession=PF07719.7; Description=Tetratricopeptide repeat
  Pfam annotation: Domain name=TPR_2; Domain location=220-253; Score =14.1; E_value=0.51; Accession=PF07719.7; Description=Tetratricopeptid e repeat
  Pfam annotation: Domain name=TPR_2; Domain location=255-288; Score =4.3; E_value=11; Accession=PF07719.7; Description=Tetratricopeptide repeat
  Pfam annotation: Domain name=TPR_2; Domain location=307-340; Score =6.5; E_value=5.8; Accession=PF07719.7; Description=Tetratricopeptide repeat
  Pfam annotation: Domain name=TPR_2; Domain location=341-374; Score =6.8; E_value=5.4; Accession=PF07719.7; Description=Tetratricopeptide repeat
  Pfam module annotation: Pfam domain module=TPR_1::TPR_1::TPR_1::TPR _2::TPR_2::TPR_2::TPR_2::TPR_2; Domain location=220-253::307-340::341- 374::186-219::220-253::255-288::307-340::341-374
  Subcellular localization annotation: CTP_CleavageSite=86; ConfidenceScore=5.72e-01
MSIRSSAFFCFQINCSDSKQGRGFGENTNSNSNSNRIKTNKSDKGSTTKQSRPLSSQAPRLSSQLDGKSRNDFLDVDFEERLKAVRRSALEQKKAEEEKEFGAIDYGAPIPSDNKTIGLGTKIGVGVAVAVFGLVFAFGDFLPSGSVSPTEDSAVVNSKLSEEDKATLQSRLKEFEATLSNSPRDQIALEGAAVTLAELGEYARASSLLDDLTKEKPNDADVFRLLGEVKYELKDYEGSVAAYKSSARVSKDIQFEVLRGLSNSLLAAKKQEEAVQLLLAYREHLSSENLSKNSDSNPTDSQKLDPVQVELLLGKAYSDWGHVSDAVTVYDQLISTHPNDFRGYLAKGIILKENKNIGDAERMFIQARFFAPDRAKALVDRYSR

SEQ ID NO: 138775 - protein, 87 aa, Glycine max
  Coding DNA Sequence Number=SeqID_21997
MNTHSNLAYFYHRAITTSLIPNLAYFYHCAHRGFCGFEQAVSSSIENNMGQCGCRGNTFRKILGGRRKIRESAGFSSVWVKTDVNIN

SEQ ID NO: 138776 - protein, 69 aa, Glycine max
  Coding DNA Sequence Number=SeqID_21998
MKNNEEWWKTFTKSPKETSRKRYASASAWIFFMGKEGGGCRPAGFLFAHPCLLNTPPLPFFVDSFSVTL

SEQ ID NO: 138777 - protein, 155 aa, Glycine max
  Coding DNA Sequence Number=SeqID_21999
  Homolog annotation: Hit_ID=O49581; Match level="QueryCoverage=98%, HitCoverage=92%, E-value=2e-29, Identity=43%"; Hit description=Auxin induced like-protein
  Pfam annotation: Domain name=Auxin_inducible; Domain location=12-127; Score=122.0; E_value=1.7e-33; Accession=PF02519.5; Description=Auxin responsive protein
  Subcellular localization annotation: CTP_CleavageSite=72; ConfidenceScore=5.19e-01
MDSKKCNKIREVVRLQQILKKWKKVATASNNNNNSSSSKGIKFLKRTLSFTDVSSTNTNQDIVPKGFLAVCVGKELKRFIIPTDYLRHQAFEMLLQEAEEEFGFQQEGVLKIPCQVSVFEKILNAVEDNKQPLDEFGFNASDCEVTSPHHAQPCT

SEQ ID NO: 138778 - protein, 861 aa, Glycine max
  Coding DNA Sequence Number=SeqID_22000
  Gene Ontology: Mol. function=helicase activity; Biological process =protein amino acid phosphorylation
  Homolog annotation: Hit_ID=Q9FHU7; Match level="QueryCoverage=98%, HitCoverage=98%, E-value=1e-154, Identity=39%"; Hit description =Similarity to nonsense-mediated mRNA decay trans-acting factors
MALLQPRKMQMVRTNDKKEEVPGRGLLDQVFSWSFSDILNQNLYQNQVKKIPETFSSTSIYLRSFILPLVEETHADLLSCVRTVSKAPIRQITSVRKTKNHQFPSDLFYQITVLEKQGGRAYVPAVGDLIAVTNLRPKYTDDLNSPCVFAFVHRASNNSITVLSSKLIAAQGVHDQNKDILFAVYLTNLTTNIRIWRSLSSELEARNLNMIDEVLQLRSSECGTCAEWLDNGLNSEIRGKICNSDLNDSQRDAVLSCISLREEWRHQNSVKLIWGPPGTGKTKTVGLMLFCLLKLKCRTLTCAPTNVAVLEVAKRVLVQVRKNESHEYGGYGLGDIVLFGNGKRMNIDDHIELHDVFLDYRVNALRKFLGVWKHSLASIISLLENPQRLFLEYVNKTEEDVIVNDHSQSKKNEQDTAEPWTFEEFINKRLDSLRELLTFSFMNLCKHLPTSFISLTDATNTFRARDLLHSISTLVGKQHEGIKQELYGSKHNESERLTIKECLDILKLLPKKFRIRGSLRDFCLSNACLVFCTVSSSAKLHEKGMTPIELLVIDEAAQLKECEATIPLQLYGIRHSILIGDERQLPAMVQSKISEKAEFGRSLFERLVQLGHKKHLLNVQHRMHPSISLFPNTEFYRSQILDALNVKQIGYGTSFIPQMMYGSYSFINVPFGKEELDGNHSQRNMTEASVVSEIVKILHEEYVRTNKKVSVDIISPYKAQVYAIEEKVKRHSSRVSDSGGFEVRVGSVDGFQGGEADVIIISTVRCNNKGSIGFLSDQRRVNVALTRARHCLWILGNATTLLNSESVLKKLVIDAKNRGCFYNALEDKCLAKTLLYSLIELNAVNDLDNVLSSLFNDARWK

SEQ ID NO: 138779 - protein, 138 aa, Glycine max
  Coding DNA Sequence Number=SeqID_22001
  Homolog annotation: Hit_ID=Q9LJX7; Match level="QueryCoverage=48%, HitCoverage=60%, E-value=9e-14, Identity=52%"; Hit description =Genomic DNA, chromosome 3, P1 clone:MAL21
  Pfam annotation: Domain name=Auxin_inducible; Domain location=12-116; Score=82.9; E_value=1e-21; Accession=PF02519.5; Description=Auxin responsive protein
  Subcellular localization annotation: CTP_CleavageSite=87; ConfidenceScore=5.82e-01
MKLATPKIIRKIPSPLKLVSRSSSSAAKKPLLVSGSGQPSSSSDGSSKQQVVPKGSLAVYVGPDLRRFVIPVSFLAMPDFKVLMESVAEEYGCDHDGAIQIPCDEDYFQQILMSCSQRQRIISPKKLIPNIPLICTTH

SEQ ID NO: 138780 - protein, 531 aa, Glycine max
  Coding DNA Sequence Number=SeqID_22002
  Homolog annotation: Hit_ID=O22159; Match level="QueryCoverage=79%, HitCoverage=75%, E-value=3e-13, Identity=24%"; Hit description =Expressed protein
  Pfam annotation: Domain name=DUF247; Domain location=42-522; Score =140.6; E_value=4.2e-39; Accession=PF03140.6; Description=Plant protein of unknown function
MPGQGDGMHRNVVVVEEDEEANLKKWLDFMQTMLGCLGSEGFEVEACSISLVPRQLRQSKEEAYTPQVVSIGPLHRGITSSTDLLYMEEIKWRCLLRLIERSKQDKEQVLRNCGKAMLEIDEIARASYNVQVKLNRYELAKIMVLDGCFLLELLIGGSTQLNEQLKCISSDSDSSLVTQAIESEKVLLDLIMLENQIPLVVLSTLSTNLFPNTFTGAASTRLIHEHALSIFGYSSSPDSNIINSPKFKGFHFLQLVHSFIDTENDAIWQQPTTELQIQIPDESPQKVKLERCATLLEAAGVTIKPAKAQYKAKTRFDLKVTFRDGKLRIPQLHITKTTEAKWRNLIAWELNSATLEKQRELKTDRISCQFISYAWFFQSLTCSVHDVKLLRDRKVITVEKERTDKGKKKKIMSNKDLMNLFLSITEEFPEVEIQVDSRFRHVIEKLNSYPTQEDRSMATCWKIIAYGVRGPSKIMWHFFRRFLTWIWCKWIEAYGILKRVYIPSGWRLIAVLAAAAGLALTAIQTYYSIRN

SEQ ID NO: 138781 - protein, 129 aa, Glycine max
  Coding DNA Sequence Number=SeqID_22003
  Homolog annotation: Hit_ID=Q1T344; Match level="QueryCoverage=74%, HitCoverage=32%, E-value=6e-10, Identity=35%"; Hit description=RNA polymerase, RBP11-like
MATKLWDRSFAYEIGFVAVIMRLNTNTGMRGRTSFVLIGYERSGRYRYRKKDIVKIDIGSRKCGFPFKLHGKPVVGEQGWMVKLMCGSHNHELTKLLVGHPYAGRLTKDEKVHGETKKHYANVEGAQCQ

SEQ ID NO: 138782 - protein, 111 aa, Glycine max
  Coding DNA Sequence Number=SeqID_22004
  Gene Ontology: Mol. function=ionotropic glutamate receptor activity; Cellular component=integral to membrane; Biological process=ion transport
  Homolog annotation: Hit_ID=Q8GXJ4; Match level="QueryCoverage=99%, HitCoverage=11%, E-value=1e-42, Identity=72%"; Hit description =Glutamate receptor 3.4 precursor
MLNIGGSGMRRIGYWSNYSGLSVVTPEILYKKPPNTSTSSQQLYDVIWPGETVAKPRGWVFPNNGKPLRIAVPNRVSYKDFVSKDKNPPRVRGYCIVLEAAINLLPYPVPR

SEQ ID NO: 138783 - protein, 95 aa, Glycine max
  Coding DNA Sequence Number=SeqID_22005
  Homolog annotation: Hit_ID=Q1SCD5; Match level="QueryCoverage=46%, HitCoverage=4%, E-value=7e-09, Identity=60%"; Hit description =Elongation factor Tu, domain 2; Translation elongation factor G
MDSLLADTSTTSGETLEDYDDHEDVFHPQKEDVIFACALDGWRSGYSDEEDDVLERLEEPTIEDGNGTIKKKGKKKKKEKRRRRRRGSGKRKKLK

SEQ ID NO: 138784 - protein, 187 aa, Glycine max
  Coding DNA Sequence Number=SeqID_22006
  Homolog annotation: Hit_ID=Q1SJY6; Match level="QueryCoverage=71%, HitCoverage=16%, E-value=5e-07, Identity=25%"; Hit description =Glucoamylase s1/s2
MVINEFVFFSLTHLPSQGAPFEGTIVDDWKFDYSSLDARRMVNNDQAHMTGRLLAGSLTFDCRIMHFIIVHILLPRSSNLAQASEEDLILMWAFLTGRPIEWAHLIRYHMHKALRPNAPLPYPQLVTLFLHHFQIPLDNEPFVKVKCSFAIGAGAVTSLGYHKDMDGQWLKKDAQPSQDEHTPSPPP

SEQ ID NO: 138785 - protein, 81 aa, Glycine max
  Coding DNA Sequence Number=SeqID_22007
  Gene Ontology: Mol. function=adenylosuccinate lyase activity; Cellular component=cytoplasm; Biological process=purine ribonucleotide biosynthetic process
  Homolog annotation: Hit_ID=Q8VZX0; Match level="QueryCoverage=92%, HitCoverage=14%, E-value=1e-31, Identity=92%"; Hit description =Adenylosuccinate-AMP lyase
  Pfam annotation: Domain name=ASL_C; Domain location=1-59; Score=39.0; E_value=4.4e-11; Accession=PF08328.2; Description=Adenylosuccinate lyase C-terminal
MRGHRVMRRYGVPEPYEKLKELTRGRAVTKESIRDFIEGLDIPEEAKNNLLKLTPDTYVGAAVELARTVENVVNTVIGIKI

SEQ ID NO: 138786 - protein, 539 aa, Glycine max
  Coding DNA Sequence Number=SeqID_22008
  Gene Ontology: Mol. function=RNA-directed DNA polymerase activity; Cellular component=intracellular; Biological process=RNA-dependent DNA replication
  Pfam annotation: Domain name=RnaseH; Domain location=326-446; Score =35.7; E_value=2.8e-08; Accession=PF00075.14; Description=RNase H
MPFGLINAGATYQRGMTTLFHDMMHKEIEVYVDDMIVKSGTEEEHVEYLLKMFQRLRKYQLRLNPNKCTFGVRSGKLLGFIVSQKGIEVDPDKVKAIREMPVPQTEKQVRGFLGRLNYISRFISHMTATCGPIFKLLRKDQGVVWTEDCQKAFDSIKNYLLEPPILIPPVEGRPLIMYLTVLEDSMGCVLGQQDETRKKEHVIYYLSKKFTDCESRYSLLEKTCCALAWAAKRLRHYMINHTTWLISKMDPIKCCYPSMISNTAPGKQLKGSVLADHLAHQPIEDYQPIKFDFPDEEIMHLKMKDCDEPLLGEGPDPESRWGLIFDGAVNVFGNGIGAVIITPEGNHLPFAARLQFDCTNNVAEYEACILGIEKAIDLKIKNLDIYGDSALVINQIKGEWETRHPGLIPYKDYAKHLLTFFNKVELHHIPRDENQMADALATLSSMYEVSHRNNLPTIRIQRLERPAHVFAVEEVVDDKPWFHDIKCFLQSQEYPPEVSNKDRRTLRRLSAEFLMHEIHEGSFGTHSNGHAMARKLLRA

SEQ ID NO: 138787 - protein, 421 aa, Glycine max
  Coding DNA Sequence Number=SeqID_22009
  Gene Ontology: Mol. function=adenylosuccinate lyase activity; Cellular component=cytoplasm; Biological process=purine ribonucleotide biosynthetic process
  Homolog annotation: Hit_ID=Q8VZX0; Match level="QueryCoverage=100%, HitCoverage=74%, E-value=0.0, Identity=83%"; Hit description =Adenylosuccinate-AMP lyase
  Pfam annotation: Domain name=ASL_C; Domain location=365-421; Score =59.5; E_value=1.1e-14; Accession=PF08328.2; Description =Adenylosuccinate lyase C-terminal
  Pfam annotation: Domain name=Lyase_1; Domain location=22-321; Score =146.7; E_value=6e-41; Accession=PF00206.10; Description=Lyase
  Pfam module annotation: Pfam domain module=ASL_C::Lyase_1; Domain location=365-421::22-321
MFGPHSTDFELSALTALSPLDGRYWSKVKELAPFLSEYGLIYFRVLVELSVIPEIVEVPSFSDGAKSFLQGLIDDFSVEDASEVKNIERVTNHDVKAVEYFLKQKCQSNAEVAKVLEFFHFACTSEDINNLAHALMLKETMNSVMFPVMDKIMIALCDVAKDNADVPMLSRTHGQPASPTTLGKEMAIFAARLSRERKDLSQVEILGKFAGAVGNYNAHVVAYPNVNWPHIAEQFVHSLGLSFNPYVAQIETHDYMAKLFHSLIQFNNILIDFDRDVWGYISLGYFKQTTKAGEIGSSTMPHKVNPIDFENSEGNLGVANGGLSHLSMKLPISRWQARPLDFDFFFWFYSAHFGIAIILHYDAKRDLTDSTVLRNMGIGIGHSLLAYKSTLQGIGKLQVNEARLSEDLNQCWEVLAEPIQT

SEQ ID NO: 138788 - protein, 577 aa, Glycine max
  Coding DNA Sequence Number=SeqID_22010
  Gene Ontology: Mol. function=oxidoreductase activity; Cellular component=intracellular; Biological process=lignin catabolic process
  Homolog annotation: Hit_ID=Q9FSC9; Match level="QueryCoverage=98%, HitCoverage=98%, E-value=0.0, Identity=63%"; Hit description=Laccase precursor
  Pfam annotation: Domain name=Cu-oxidase; Domain location=200-328; Score=140.9; E_value=3.4e-39; Accession=PF00394.12; Description =Multicopper oxidase
  Pfam annotation: Domain name=Cu-oxidase_2; Domain location=427-561; Score=187.6; E_value=3e-53; Accession=PF07731.4; Description =Multicopper oxidase
  Pfam annotation: Domain name=Cu-oxidase_3; Domain location=29-145; Score=226.0; E_value=8.3e-65; Accession=PF07732.5; Description =Multicopper oxidase
  Pfam module annotation: Pfam domain module=Cu-oxidase::Cu-oxidase _2::Cu-oxidase_3; Domain location=200-328::427-561::29-145
  Subcellular localization annotation: CTP_CleavageSite=38; ConfidenceScore=5.36e-01
MEPRLLTIFFVVLSFSPFVQSLVRHYKFSVVLKNTTKLCSTKSFVTVNGQCPGPTLYAREDDTVIVKVTNHVKYNITIHWHGIKQLRTGWSDGPAYVTQCPIQPGQSYVYNFTINGQRGTLLWHAHITWLRATVYGGIVILPKRGISYPFPKPDKEKIIILGKIYVSGGNQMLKQFSIRLKILVCHRTYQMLIPSMVIQDQFPVALLRFYQPVFRHVLKYRALSTCTGYTLHVESGKTYLLRIINAALNDELFFKIAGHKLTVVEADASYVKPFETDTIFMSPGQTTNVLLTANQVVGKYLIAVTPFMDAPIGFDNVTSIATLRYKGTPPYPKTTLTTIPALNATPLTSDFIDSLRSLNSKEYPAIAPLTVDHSLFFSITVGLNPCHTCLTGARLVSAINNITFLMPTTTSLLEAHYYNIKGVFTDDFPSFPPIAFNYTGTQPANIQTNNGTRLYRLDFNSTVQIILQGTAMIAPENHPFHLHGYNFFVVGQGLGNFDPEKDPLSFNLVDPVERNTIGVPNGGWAAIRFRANNPGVWFLHCHLEVHTTWGLKMAFIVDNGNGPHESSLPTPKDLPMC

SEQ ID NO: 138789 - protein, 229 aa, Glycine max
  Coding DNA Sequence Number=SeqID_22011
  Gene Ontology: Mol. function=protein binding; Cellular component =nucleus; Biological process=jasmonic acid mediated signaling pathway
  Homolog annotation: Hit_ID=Q45FY8; Match level="QueryCoverage=99%, HitCoverage=53%, E-value=6e-71, Identity=53%"; Hit description =Coronatine-insensitive 1
MEDRDAKRMATRLSDVVLDCVMPYIHDSKDRDAVSQAAVPAPGVVKPEGKAAGGDVQPDTGGLGRDSDLQVLARSRGHILQALKLDKCSGFSTDGLYYIGRYCRNLRVLFLEESSLVENDGDWLHELALNNTVLETLNFYLTDIANVRIQDLELIARNCPNLNSVKITDCEVLDLVNFFRYASALEEFCGGSYNEESENLTEKIGSSLCNAGYRGPLYVNPKVPQLGGP

SEQ ID NO: 138790 - protein, 61 aa, Glycine max
  Coding DNA Sequence Number=SeqID_22012
MVQGKFVPNLGEVLSSCWAKLSSWAKRLFTAKRSFRALSAKENLAEHQHQRCALSVAGAFI

SEQ ID NO: 138791 - protein, 746 aa, Glycine max
  Coding DNA Sequence Number=SeqID_22013
MANWRERDLFHIDEIDPVDASNGEDFDDSSSVDSATSDGSRTQVGLTERLTDILVDERDGDLLIQQTNREDRLLWWLQALDMQVMGACRADERLKPLLKMNASCGVAEDPLLAQLTQHFEPSEVGILARCFCVPLVSFRVGKINKEGTRFCPTSNSPASGGSVGAALHHYCINAKQRCDVLCIWKNKEFTATWNPSVTAAQGRLMGLGQGGNLTLVLLPSSDLRLSFIGDDGRTERLFTLTNKSQCSAVVVDEIPTDSSGRSFLVRTPDSRAFYFWCSEKSKLLGIELLGKMKDLLKRKPSIVELSGISKSRLDCFATQLRAFLVGTTGGSSHDSSVCASTSANSMSCSNVASESSHPSSSKFPRSRNIGGQTAKGDTTLYQSILSPRSSSFKEVPPRNLSSHRIAAREKIKRRGDNHQPTVDTLTNDSTHILDLSSTSDHDKASEVTKTLAFSPSFLGSLGKLGGVPSSLGLSGEVPPIVSPIFSPYYCWCPPGISTCPSIAAVTQSPNSSIETLPFPSGASLLANPLSVNLLDPVQPLGTSMDFPPFLPDPLVRMSLPTSQQIPTFTPLMCDPIVHVPVIDVCSSGQGYLVSAGPAMSPSIPPLHPNLVKPLIPESDAVVKGARETLRLLLSGSSQGNQQMMRDTLPAILTNPDENQNNILVAGSRGLYTGTRDINAIANSIAAMGLVSLSGVSKVDSGVYSELCENYGNLEAVKNSNDSGGGAFLDDEGGSSLDSKQYTFEWF

SEQ ID NO: 138792 - protein, 71 aa, Glycine max
  Coding DNA Sequence Number=SeqID_22014
MDGRGGSRRRKGDNRVGNWEYSLLSMVPLDPLEWQISQESANAIVAWLANTIGATTRGCFSRSFSYRCLCR

SEQ ID NO: 138793 - protein, 729 aa, Glycine max
  Coding DNA Sequence Number=SeqID_22015
  Gene Ontology: Mol. function=RNA-directed DNA polymerase activity; Cellular component=chromatin; Biological process=RNA-dependent DNA replication
  Pfam annotation: Domain name=rve; Domain location=458-611; Score=5.5; E_value=0.0021; Accession=PF00665.16; Description=Integrase core domain
  Pfam module annotation: Pfam domain module=RVT_1::rve; Domain location=294-547::458-611
MEEQRKCDIENRDRFEKLQKSMDMLLQHRSLSIGGSNSSSSSSGGLPVTPISSSAPVKDISLGFPYFDGHTPVLEWIFKVEKFFNYHHTPDSDRVEIAAIHFEKDDDEGEAEMSFDVVSEDNNSTAETVIDNLHHLSLNALKGGLGVGTIRFVAHINTLPVKVLVDGGSLDNFIQPRVAKFLKLPIEPAPLFKVMVGNVFSMQLIEPSNFQFPLSELLADVEPELALLLHTYESVFETPTSLPPPRSHDHAIPLLEGSKPIKVKPYRYLHSQNDEIEKLVQGMLEEGIIQPSKSLFSSPIIFLKKRDGSWRVCTDYRALNAITIKDTFPIPIVDELSDELFGAEFFSKLDLWSGARVTMETTKLEAITNWPQPTTIKQLRGIQGITAFVQLKKAMTSALVLAIPNFREPFVLETDASGSGIGAVLSQSQHPIAYFSKKLSPRMQKQSTYTREFYAITEAMAKFRHYLLDHKFIIRTDQKSLKKENIPADALSRSLFIAWLEPTNHWLAKVATVTKEDKLLSELISRYAHGGTIDPKYDLFKAQGTTLAISSSYHPQSDGQTEILNKTLEMYLRCFVFDNPKLWYPMLAWAQYWYNSSYHHNLGMSPFKAVFGREPPVVVPYQVHLKDPGNLARAQNYMKMQADKKRRDFQLESFDASEALWEDLTAIKQSYPRFNLKDKVDFKGKGIITSNSVGDNCVENSVRNDGHMEDDSQNLTMRRSTRACGENVH

SEQ ID NO: 138794 - protein, 444 aa, Glycine max
  Coding DNA Sequence Number=SeqID_22016
  Gene Ontology: Mol. function=nucleoside-triphosphatase activity; Cellular component=cytoplasm; Biological process=protein catabolic process
  Homolog annotation: Hit_ID=Q9C5U3; Match level="QueryCoverage=99%, HitCoverage=100%, E-value=0.0, Identity=83%"; Hit description=AtSUG1 protein
  Pfam annotation: Domain name=AAA; Domain location=196-385; Score =280.3; E_value=3.8e-81; Accession=PF00004.19; Description=ATPase family associated with various cellular activities (AAA)
  Pfam annotation: Domain name=AAA_2; Domain location=193-325; Score= -26.0; E_value=0.00085; Accession=PF07724.4; Description=ATPase family associated with various
  Pfam annotation: Domain name=AAA_3; Domain location=196-328; Score= -12.7; E_value=0.008; Accession=PF07726.2; Description=ATPase family associated with various
  Pfam annotation: Domain name=AAA_5; Domain location=196-332; Score= -0.4; E_value=0.0019; Accession=PF07728.4; Description=ATPase family associated with various
  Pfam module annotation: Pfam domain module=AAA::AAA_2::AAA_3::AAA_5; Domain location=196-385::193-325::196-328::196-332
MALVGVEVKHAAEGAPEENCSAKPTKQGEGLRHYYSHNIHEHQLLLRQKTHNLNRLEAQRNELNSRVRMLREELQLLQEPGSYVGEVVKVMGKNKVLVKVHPEGKYVVDIDKSIDITKITPSTRVALRNDSYVLHLVLPSKVDPLVNLMKVEKVPDSTYDMIGGLDQQIKEIKEVIELPIKHPELFESLGIAQPKGVLLYGPPGTGKTLLARAVAHHTDCTFIRVSGSELVQKYIGEGSRMVRELFVMAREHAPSIIFMDEIDSIGSARMESGSGNGDSEVQRTMLELLNQLDGFEASNKIKVLMATNRIDILDQALLRPGRIDRKIEFPNPNEESRLDILKIHSRRMNLMRGIDLKKIAEKMNGASGAELKILYLGMRQIKCFVTKNVKELAPKLGDAVCTEAGMFALRERRVHVTQEDFEMAVAKVMKKETEKNMSLRKLWK

SEQ ID NO: 138795 - protein, 182 aa, Glycine max
  Coding DNA Sequence Number=SeqID_22017
  Gene Ontology: Mol. function=structural molecule activity
  Homolog annotation: Hit_ID=Q06Z73; Match level="QueryCoverage=83%, HitCoverage=54%, E-value=3e-56, Identity=73%"; Hit description =Fibrillin 8
  Pfam annotation: Domain name=PAP_fibrillin; Domain location=17-159; Score=-2.2; E_value=6.9e-06; Accession=PF04755.3; Description=PAP _fibrillin
MELAFHSALYPASLSCRARRLSLVPCALKTRSCIEEALVSVEACNMASHPINFSKLDGTWRLQYTSSSDVLVLLQAAATLPFFQVGQIFQKFECGDQSHGGVIRNVVRWSIPNLLEEQEGATLLVSAKFNVVSVRNIYLQFQEITVQDIYISEELRALIAPAILPRSFISLQILQFLHTFKA

SEQ ID NO: 138796 - protein, 179 aa, Glycine max
  Coding DNA Sequence Number=SeqID_22018
MANRNENVPVVVNYDAYVVDCDDGIEFKAEKNVLVSMKRIMTFNVLKTKIQRKMGLNRGQTITAIIYRYPISARSRMFNYQAITTIDDDDIDGIVDVSGNQVTDNPDYRHFLDQQQQSDLQDGELFVGQRFLQLEDLKHAINMRHIKNHVTFKHMRYVKDTWVLCCLAEECQRKLRASK

SEQ ID NO: 138797 - protein, 99 aa, Glycine max
  Coding DNA Sequence Number=SeqID_22019
  Gene Ontology: Mol. function=7-dehydrocholesterol reductase activity; Cellular component=membrane; Biological process=cholesterol biosynthetic process
  Homolog annotation: Hit_ID=Q6K4V9; Match level="QueryCoverage=65%, HitCoverage=14%, E-value=2e-33, Identity=92%"; Hit description =Putative sterol delta-7 reductase
WGLSRHFHYVPEILAAFFWTVPALFEHFLPYFYVIFLTILLFDRAKRDDDRCRSKYGKYWKLYCDKAGSLKFSPIQSLLKTEVGAQHHNENEFKNSNIK

SEQ ID NO: 138798 - protein, 163 aa, Glycine max
  Coding DNA Sequence Number=SeqID_22020
MDGLKIYSESNGGDEDVETHGWVKILKLMMKHFVQNFASDIPNMDDVGDDIDVDYIAHEMCNDFQFKIDMEFSSLTQFKEAIMEYSMLNGHKCPRVFGNKKNAKSKWVAMQMLDKLKLNSSMTVKEVDDIRSRFATSITSATTYRAQIALAFVEGDAVKKIQC

SEQ ID NO: 138799 - protein, 149 aa, Glycine max
  Coding DNA Sequence Number=SeqID_22021
  Gene Ontology: Mol. function=RNA-directed DNA polymerase activity; Biological process=RNA-dependent DNA replication
  Homolog annotation: Hit_ID=Q1SAS4; Match level="QueryCoverage=90%, HitCoverage=8%, E-value=3e-25, Identity=39%"; Hit description=RNase H, putative
MMEAMMTMNNIMKELSEDFKIQHHDLTPHHPKMNGAVEATNKNIKKIIQKMTRTFVGTSTGAILFSLEYGMEADFSFKVEIPSLRVLLEAELEEVSHVQKDLRGKLAPNYEGPFMVKKAFLDGTLTLTNMDGEELPLPVNSDDVEQYYA

SEQ ID NO: 138800 - protein, 109 aa, Glycine max
  Coding DNA Sequence Number=SeqID_22022
MQNYLAVKPCELSKQTGNSAPQTDLAVTTTFTNQTLAPEILKNNCSEHQFPKITCYSIQHGKDNKESRNVPSMEKNKARTRTFDGEQQSAKNNLRWRTTVVIRLQRQTF

SEQ ID NO: 138801 - protein, 119 aa, Glycine max
  Coding DNA Sequence Number=SeqID_22023
MGLSNGDDQEKKKPCLWEWKRLSSAYSAYRALFPSSIGLDMLKNLVTHTYARFFPPNIEREEEGQVKENGAGEKVREAFAKSLGNSKATLEDAAKSAAETVRTFSESDENRETQHQNEL

SEQ ID NO: 138802 - protein, 63 aa, Glycine max
  Coding DNA Sequence Number=SeqID_22024
MEKEYCRIQRDTTDRIEHVSEEWVGASGVSGSRGKRNRGVMDLPENANKQHVGRSSNVMRIRY

SEQ ID NO: 138803 - protein, 366 aa, Glycine max
  Coding DNA Sequence Number=SeqID_22025
  Gene Ontology: Mol. function=protein kinase activity; Biological process=protein amino acid phosphorylation
  Homolog annotation: Hit_ID=Q10NJ0; Match level="QueryCoverage=98%, HitCoverage=49%, E-value=7e-57, Identity=42%"; Hit description =Protein kinase domain containing protein, expressed
MAPEIMQLQKYDAKADLWSVGAILFQLVTGRTPFTGNNQIQLLQNIMKSTELQFPSDSPSLSFECKDLCQKMLRRNPGLGGVEEMYLKGGVERLTFEEFFNHPFLAQKQTERDESLRNRSSSRMDGGFCSTVSDLRRTEENYQEDCLPFMLDDDSSGPEGSSSFSRKKSSMKSTYGFDLNAKLDKAESSSPISGFGSMTQRSENTTKRLDNHTISRNLTDPLESPEQLFASPYPKVMDSLENIDQEYVLVSGPTIDVSSLSVGASRPIHTPSRSGSLPQESSSTITRLSAPMPIVGVPTNSVCQIGSSGSQDSAPGTSLGSMDTGDEQPSAHCMTRVKSLQQCASSITELVNEKVNAAKSLLSTMS

SEQ ID NO: 138804 - protein, 182 aa, Glycine max
  Coding DNA Sequence Number=SeqID_22026
  Gene Ontology: Mol. function=protein kinase activity; Cellular component=cytosol; Biological process=protein amino acid phosphorylation
  Homolog annotation: Hit_ID=Q10NJ0; Match level="QueryCoverage=95%, HitCoverage=21%, E-value=3e-50, Identity=56%"; Hit description =Protein kinase domain containing protein, expressed
  Pfam annotation: Domain name=Pkinase; Domain location=14-182; Score =16.3; E_value=1.6e-09; Accession=PF00069.15; Description=Protein kinase domain
  Pfam annotation: Domain name=Pkinase_Tyr; Domain location=14-181; Score=-65.6; E_value=1.9e-08; Accession=PF07714.7; Description =Protein tyrosine kinase
  Pfam module annotation: Pfam domain module=Pkinase::Pkinase_Tyr; Domain location=14-182::14-181
MAQAAGRSRVVGDYVVGKQIGAGSFSVVWHGRHKVHGTEVAIKEIATLRLNKKLQESLMSEIFILKRINHPNIISLHDIINQLCGFCTVGFEEEKDLTIMGVPGKIHLVLEYCKGGDLSLYIQRHGRVPEATAKHFMQQLAAGLQVLRDNNLIHRDLKPQNLLLSRNDEKSVLKIADFGFAR

SEQ ID NO: 138805 - protein, 237 aa, Glycine max
  Coding DNA Sequence Number=SeqID_22027
  Gene Ontology: Mol. function=single-stranded DNA binding; Cellular component=nucleus; Biological process=response to DNA damage stimulus
  Homolog annotation: Hit_ID=Q84L33-2; Match level="QueryCoverage=94%, HitCoverage=61%, E-value=3e-67, Identity=58%"; Hit description =Isoform 2 of Q84L33
  Pfam annotation: Domain name=UBA; Domain location=124-166; Score =46.1; E_value=1.2e-10; Accession=PF00627.21; Description=UBATS-N domain
  Pfam annotation: Domain name=ubiquitin; Domain location=1-55; Score =4.5; E_value=0.091; Accession=PF00240.13; Description=Ubiquitin family
  Pfam module annotation: Pfam domain module=UBA::ubiquitin; Domain location=124-166::1-55
MAVKKNIEDVQGKDNYPCGQQLLIHNGKVLKDETTLVENKVSEDGFLVVMLSKSKTSGSAAASSVQPASNPPTTVSTSNSTPPSDPPVQTQAANNSTSSTDAPTTNVSADTYGLAASNLVAGSNLEQTIQQIMDMGGGNWDRDTVSRALRAAYNNPERAIDYLYSGIPEAAEVAVPVPQTAGISSGAVPVGPNSSPLNMFPQETISSTGAGLGSLDFLRNNPQSNQNLFFHYVGSAT

SEQ ID NO: 138806 - protein, 204 aa, Glycine max
  Coding DNA Sequence Number=SeqID_22028
MAMSFNNNNCKNDTKNNGEKIGFQKLKIKYINEQTNRYLSSWIMLEVTNRYHRETITHYADEDNLGQARKDAFSCKPSYLRYFLSSFVANYYMPPLEQESSNIDENESFSKHRFRSILFDDDCKNDDLNLNLEFRITDLHRGQWNVTAIVVKAIFGSRCSLPLYLGIYVVCHVVVVTNDDAGKRKEEEERQRHDNNEAQTVTKA

SEQ ID NO: 138807 - protein, 74 aa, Glycine max
  Coding DNA Sequence Number=SeqID_22029
  Subcellular localization annotation: CTP_CleavageSite=39; ConfidenceScore=5.37e-01
AVHVSSTFEIGVVFHDCLSADPQGNRPFSPFFRSSMNCVFVHVSSTFKFGAVFHDCLSADPQGNPPFSPFFGAP

SEQ ID NO: 138808 - protein, 85 aa, Glycine max
  Coding DNA Sequence Number=SeqID_22030
MVFRANSTDVAFRLTLDSGLPSRSPMVFRANSTDVAFWPIFDCANGIGKKNIADLGRKKKSSTNLDKKQFKPTSTKKDSRSLYPK

SEQ ID NO: 138809 - protein, 109 aa, Glycine max
  Coding DNA Sequence Number=SeqID_22031
  Subcellular localization annotation: CTP_CleavageSite=71; ConfidenceScore=5.27e-01
MSVEKQHLSRLDFRNCSVGSSAVMLFGMPRPSPLNLCFIISFFHFMPRTTLLRPTKLATTQPLNLDNFLMRIMKLAKYRLKAQVEKDEGPSGEGQSPRVEKDEGPSGEG

SEQ ID NO: 138810 - protein, 138 aa, Glycine max
  Coding DNA Sequence Number=SeqID_22032
MASHKRYAPASASQAHYDRSRFLSQEDWDRYSDIVIGIKILSKRNFMIYHTKFDEFKDELERRNWHKEMTNFMDGSIDVAIVKEFCANLYDPEDKSPKQVRVRGHLIKFDEDALNTILKTPAIIEERKSYRHTLGLLY

SEQ ID NO: 138811 - protein, 83 aa, Glycine max
  Coding DNA Sequence Number=SeqID_22033
MACLGSNLKHEDNERKMNGDNENDVLTKKLEIVSELKTGLADYCKSMPIKVKHRRPFIIFHSMNPQGSLYEQLPHCVRYLQIP

SEQ ID NO: 138812 - protein, 126 aa, Glycine max
  Coding DNA Sequence Number=SeqID_22034
MASKKRKAPSTPSQVRFNRSRFTSQEAWERYTDIGVPRKLLPDRNVIVYYTEFDEFKEELERRHWDEELTDFTDSSIDVAIVKEFDANLYDLEDKSPKQKNLEEDDLYRCTERVSNSLSAPLAPPG

SEQ ID NO: 138813 - protein, 560 aa, Glycine max
  Coding DNA Sequence Number=SeqID_22035
  Gene Ontology: Mol. function=protein kinase activity; Cellular component=cytoplasm; Biological process=protein amino acid phosphorylation
  Homolog annotation: Hit_ID=Q1SGQ5; Match level="QueryCoverage=90%, HitCoverage=78%, E-value=0.0, Identity=78%"; Hit description=Protein kinase
  Pfam annotation: Domain name=Pkinase; Domain location=13-266; Score =209.3; E_value=9e-60; Accession=PF00069.15; Description=Protein kinase domain
  Pfam annotation: Domain name=Pkinase_Tyr; Domain location=13-266; Score=67.9; E_value=3.3e-17; Accession=PF07714.7; Description =Protein tyrosine kinase
  Pfam module annotation: Pfam domain module=Pkinase::Pkinase_Tyr; Domain location=13-266::13-266
MEKKKYPIGEEHYLLYEEIGQGVSASVHRALCLPFNEVVAIKILDFERDNCDLTMILVDHPNVLKSHCSFVSDHNLWVVMPFMSGGSCLHILKAAHPDGFEEVVIATVLKEVLKGLEYLHHHGHIHRDVKAGNILIDSRGAVKLGDFGVSACLFDSGDRQRTRNTFVGTPCWMAPEVMEQLHGYNFKADIWSFGITALELAHGHAPFSKFPPMKVLLMTLQNAPPGLDYERDRKFSKSFKQMIASCLVKDPSKRPSASKLLKHSFFKQARSSDTIVKKLLEGLPALGDRMEALKRKEEDMLAQKKMPDGKMEELSQNEYKRGISGWNFNLDDMKAQASLIHDFDDAMSDINHAGSSSSLSTLDSLDKQLPSAIHKPSRSADMEENDEMRRQLASALLVDSAVNDAKTRFEKSDDDSSIASSSHEPQTSSSCPDDHVNNHLGEKSDMENGGRSVEGMATHYYHRRGCSSSILPEATLLPIRAERPCAFKNCSGMSCAKFSVKKDQSVTPVPQTGEDVLTELPSRVSKSSANSDDTDEKSKVPVVQQRGRFKVTSENVDPEK

SEQ ID NO: 138814 - protein, 69 aa, Glycine max
  Coding DNA Sequence Number=SeqID_22036
  Homolog annotation: Hit_ID=Q1SGQ5; Match level="QueryCoverage=54%, HitCoverage=5%, E-value=9e-14, Identity=94%"; Hit description =Protein kinase
MFDKVQGPLLVLDAGKFWYVRRSQRSIGFKLEAAHEREKELLHEITDLQWRLICTQEELQKLKTENAQK

SEQ ID NO: 138815 - protein, 40 aa, Glycine max
  Coding DNA Sequence Number=SeqID_22037
MDLGDVLLNENPIDGRLDELGGGDRHSVELEEAYDQSRKA

SEQ ID NO: 138816 - protein, 74 aa, Glycine max
  Coding DNA Sequence Number=SeqID_22038
  Gene Ontology: Mol. function=isomerase activity; Biological process =carbohydrate metabolic process
  Homolog annotation: Hit_ID=Q1SGQ4; Match level="QueryCoverage=74%, HitCoverage=16%, E-value=2e-19, Identity=83%"; Hit description =Galactose mutarotase-like
MSREMKYVQQCMGVNGLEKIILREVRGFSAEVYLYGAQVTSWKNDLGEELLFLSSKVQVSLAYIYMNLFELVTF

SEQ ID NO: 138817 - protein, 362 aa, Glycine max
  Coding DNA Sequence Number=SeqID_22039
  Gene Ontology: Mol. function=protein serine/threonine kinase activity; Cellular component=cytoplasm; Biological process=protein amino acid phosphorylation
  Homolog annotation: Hit_ID=Q93WR8; Match level="QueryCoverage=82%, HitCoverage=83%, E-value=1e-134, Identity=79%"; Hit description=MEK map kinase kinsae
  Pfam annotation: Domain name=APH; Domain location=92-281; Score= -16.4; E_value=0.085; Accession=PF01636.13; Description =Phosphotransferase enzyme family
  Pfam annotation: Domain name=Pkinase; Domain location=90-347; Score =238.8; E_value=1.1e-68; Accession=PF00069.15; Description=Protein kinase domain
  Pfam annotation: Domain name=Pkinase_Tyr; Domain location=90-342; Score=42.9; E_value=4.2e-15; Accession=PF07714.7; Description =Protein tyrosine kinase
  Pfam module annotation: Pfam domain module=APH::Pkinase::Pkinase_Tyr; Domain location=92-281::90-347::90-342
  Subcellular localization annotation: CTP_CleavageSite=68; ConfidenceScore=5.11e-01
LILPSRHEMRPMQLPPPSASGANPAPATTNNNNKEQRPQRRRKDLTLPLPQRDTNLAVPLPLPPSTAPAAAASGGASQQAAQQVIPFSELERLNRIGSGSGGTVYKVVHRTSGRVYALKVIYGHHEESVRRQIHREIQILRDVDDANVVKCHEMYDQNSEIQVLLEFMDGGSLEGKHITQEQQLADLSRQILRGLAYLHRRHIVHRDIKPSNLLINSRKQVKIADFGVGRILNQTMDPCNSSVGTIAYMSPERINTDINDGQYDAYAGDIWSFGVSILEFYMGRFPFAVGRQGDWASLMCAICMSQPPEAPPSASPHFKDFILRCLQRDPSRRWSASSYSLLRQGLFPPSMMDPSTCLLPIA

SEQ ID NO: 138818 - protein, 37 aa, Glycine max
  Coding DNA Sequence Number=SeqID_22040
MNDSQMLLIFPPQAGNGYLTFPACYKEAERQWKVELW

SEQ ID NO: 138819 - protein, 621 aa, Glycine max
  Coding DNA Sequence Number=SeqID_22041
  Gene Ontology: Mol. function=oxidoreductase activity, acting on the CH-OH group of donors, NAD or NADP as acceptor; Cellular component =chloroplast; Biological process=L-serine biosynthetic process
  Homolog annotation: Hit_ID=Q1SGN7; Match level="QueryCoverage=99%, HitCoverage=99%, E-value=0.0, Identity=80%"; Hit description=D -isomer specific 2-hydroxyacid dehydrogenase, catalytic region
  Pfam annotation: Domain name=2-Hacid_dh; Domain location=82-391; Score=128.8; E_value=1.5e-35; Accession=PF00389.20; Description=D -isomer specific 2-hydroxyacid dehydr
  Pfam annotation: Domain name=2-Hacid_dh_C; Domain location=184-359; Score=292.6; E_value=7.7e-85; Accession=PF02826.9; Description=D -isomer specific 2-hydroxyacid dehyd
  Pfam annotation: Domain name=ACT; Domain location=548-612; Score =33.9; E_value=5.7e-07; Accession=PF01842.15; Description=ACT domain
  Pfam annotation: Domain name=AdoHcyase_NAD; Domain location=193-363; Score=-34.8; E_value=0.045; Accession=PF00670.12; Description=S -adenosyl-L-homocysteine hydrolase, NAD binding domain
  Pfam annotation: Domain name=IlvN; Domain location=215-384; Score= -85.6; E_value=0.03; Accession=PF07991.2; Description=Acetohydroxy acid isomeroreductase, ca
  Pfam module annotation: Pfam domain module=2-Hacid_dh::2-Hacid_dh _C::ACT::AdoHcyase_NAD::IlvN; Domain location=82-391::184-359::548 -612::193-363::215-384
  Subcellular localization annotation: CTP_CleavageSite=66; ConfidenceScore=5.42e-01
MASSRACTKPIIFLSAFTKSKFSHQYHVSFINTTSHIPIYPKLSQQRSLVVNNVLKTVEPTESSLRSSNSEEFGSLGEKPTILVSERLGEAGLQVLRGVGHVECAYELSQEELCTKISCCDALIVRSGTKVTREVFEAAKGRLKVVGRAGVGIDNVDLQAATEFGCLVVNAPTANTIAAAEHGIALLAAMARNVAQADASTKAGKWQRSKYVGVSMVGKTLAVMGFGKVGSEVARRAKGLGMHVIAHDPYAPADRARAIGVDLVSFDQAITTADFISLHMPLTPTTNKIFNDNTFAKMKKGVRIVNVARGGVIDEDALVRALDSGIVAQAALDVFTEEPPSKDSKLVQHENVTVTPHLGASTKEAQEGVAIEIAEAVLGALKGELSATAVNAPMVAPEVLSELAPYVVLAEKLGRLAVQLVCGGSGIKSVKVVYRSARGPDDLDTRLLRAMVTKGLIEPISNTIVNLVNADFIAKQKGLRISEERVVVDSSPELPVDSIQVQISSVDSKFASAVSESGQISIDGRVKFGEPHLTCVGSFDVDVSLEGNLILCRQVDQPGMIGRVGNILGEQNVNVSFMSVGRTSRRNKAIMAIGVDEEPNKEALDNIGAVSAIEEFVFLKL

SEQ ID NO: 138820 - protein, 267 aa, Glycine max
  Coding DNA Sequence Number=SeqID_22042
  Gene Ontology: Mol. function=nucleic acid binding
  Homolog annotation: Hit_ID=Q1SGN5; Match level="QueryCoverage=88%, HitCoverage=72%, E-value=5e-66, Identity=58%"; Hit description=RNA -binding region RNP-1
  Pfam annotation: Domain name=RRM_1; Domain location=42-109; Score =3.6; E_value=0.066; Accession=PF00076.12; Description=RNA recognition motif. (a.k.a. RRM, R
MAGTGIHPYHQQWAPAAAAPPPPPPAAAGGPPPHPGEEVRTIFITGLPEDVKERELQNLLRWLPGFEASQLNFKAEKPMGFALFSAPHQALTAKDILQDMLFDPDTKSVLHTEMAKKNLFVKRGIGADAGAFDQSKRLRTAGDYTHTGYTSPSPFHPPPPPVWGPHGYMAPPPPPPYDPYAGYPVAPVPMPTPAPIAAPSTYVPVQNTKDNPPCNTLFIGNLGENINEEEVRGLFSVYSKNPFGKRKDNLPVAVPSANGAPPTMTYQ

SEQ ID NO: 138821 - protein, 1094 aa, Glycine max
  Coding DNA Sequence Number=SeqID_22043
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=76%, E-value=0.0, Identity=45%"; Hit description =Integrase, catalytic region
  Pfam annotation: Domain name=rve; Domain location=396-556; Score =149.4; E_value=9.5e-42; Accession=PF00665.16; Description=Integrase core domain
  Pfam annotation: Domain name=zf-CCHC; Domain location=100-117; Score =10.9; E_value=0.016; Accession=PF00098.13; Description=Zinc knuckle
  Pfam annotation: Domain name=zf-CCHC; Domain location=64-81; Score =10.1; E_value=0.021; Accession=PF00098.13; Description=Zinc knuckle
  Pfam module annotation: Pfam domain module=RVT_2::rve::zf-CCHC::zf -CCHC; Domain location=758-1013::396-556::100-117::64-81
MQFLRGLNEQYTNIRSHVLLMDPIPAISKIFSYVAQQERQLLGNSSSPNFNFESKEISINATKSICDYCGRVGHTESVCYKKHGMPLNHETRNKGNGGRKTCTHCGRIGHTVDVCYRKHGYPLGYKPFNGRSTVNNMVTMDNKSPDNQTQHHESQDLIQFSPEQYKALLALIQRPSIGNTASEQTKQVASISSCTTDKLPNPGMSQPIMSSWILDSRATDHVKCSLNNLHSYESINPVTVKLPNGHHVHATHSGTVHLSKTITLFNVLYIPTFTFNLISISKLVSSTNCALIFSSTSCMLQDTNLRMKIGIVEERHGLYHLIPDQNDKAICSTIVHPKCNVIPIDLWHFRMGHLSTERLQCMKSYYPILRNDKDFVCNTCHYAKHKKLPFSLSISHASHIFYLLHMDIWGPCSKTSMHGHKYLLTIVDDHSRFTWIHLMNTKAETRNIIISFIASIETQYNKKVKTIRSDNGSEFLMPSFYASKGIMHQTTCVETPEQNGIAERKHQHLLNVTRALLFQANLPSSFWCYALLHAAYLVNCIPTPFLQNASPYEKLHGHIPDISHLRIFGCLCYASTLKENRKKLDPRAHPCIFIGFKPNTKGYLIYDLHSHSITTSRNVVFYENYFPQIINSQHSDIKPSTLLPEPFSITQHDPTIETSPTLPPIHEPVTITHTVEPISSQPRCSTRPKQAPTYLQDYHRELSSHDTNASTKVRYPLSSVLSYSRLSPTHKHFVMSITSIVEPSSYAEASKHDCWLRAMKAELQALQLNETWKLTPLPPHKTAIGCRWVYKVKHKADGSIERYKARLVAKGYTQMEGLDYLDTFSPVAKLTTVRLLLAVAAMNHWHLRQLDVNNAFLHGELEEEVYMQVPPGLTVPNPNLVCRFQRSLYGLKQASRQWFVKLSGFLTMHGFQQSHSDHSLFLRFNGSVTTILLVYVDDIILTGNSNTEIQEMLTLLDQAFRIKDLGNLKYFLGLEIARSSKGIHLSQRKYTLDILSDSGMLGCRPNTTPMDSSTKLQAATGTPLSAEASSSYRRLIGQLIYLTNTRPDIAYAVQQLSQYLSSPTNAHLQAAYRILRYLKGTPGSDIFLSATGTP

SEQ ID NO: 138822 - protein, 389 aa, Glycine max
  Coding DNA Sequence Number=SeqID_22044
  Gene Ontology: Mol. function=oxidoreductase activity, acting on the CH-CH group of donors; Cellular component=mitochondrion; Biological process=electron transport
  Homolog annotation: Hit_ID=Q8UHZ9; Match level="QueryCoverage=98%, HitCoverage=61%, E-value=0.0, Identity=95%"; Hit description=Acyl -CoA dehydrogenase
  Pfam annotation: Domain name=Acyl-CoA_dh_1; Domain location=241-389; Score=3.6; E_value=0.0004; Accession=PF00441.14; Description=Acyl -CoA dehydrogenase, C-terminal doma
  Pfam annotation: Domain name=Acyl-CoA_dh_M; Domain location=121-178; Score=68.7; E_value=1.9e-17; Accession=PF02770.9; Description=Acyl -CoA dehydrogenase, middle domain
  Pfam annotation: Domain name=Acyl-CoA_dh_N; Domain location=2-117; Score=-10.2; E_value=0.0029; Accession=PF02771.7; Description=Acyl -CoA dehydrogenase, N-terminal domain
  Pfam module annotation: Pfam domain module=Acyl-CoA_dh_1::Acyl-CoA_dh_ M::Acyl-CoA_dh_N; Domain location=241-389::121-178::2-117
PAKRAKLAEERLFPLNLSGDQQGCERADDGSVSVPDGFKEAYDAYCEGGWIGLAVPQEFGGQGLPYTLHAAIGEYMSSANLSLMMYPGLTQGAIAAVLVHGTPEQKQTYLPKMVQGIWSGTMNLTEPHCGTDLGLLRTKAVPQGDGTYKISGQKIFISAGEHSMTDNIVHLVLARIEGAPEGTKGISLFIVPKFLVRQDGTPGERNGVTCGAIEHKMGIHGNATCVMNYDDATGYLLGAENKGLSAMFVMMNEARLCVGLQGLSVGEIAYQNAVEYARERIQGRSLSGAKFPDKKADPIIVHPDIRRTLMTIKAYNEAGRAFLLWTALQSDIAHRSTDEKERQAADDLLGLVTPILKGVLTDKGFDHAVTAQQVFGGHGYIEEHGMSQY

SEQ ID NO: 138823 - protein, 697 aa, Glycine max
  Coding DNA Sequence Number=SeqID_22045
  Gene Ontology: Mol. function=transferase activity; Cellular component= membrane; Biological process=protein metabolic process
  Homolog annotation: Hit_ID=Q9SJA2; Match level="QueryCoverage=99%, HitCoverage=99%, E-value=0.0, Identity=68%"; Hit description =Putative glucosyltransferase
  Pfam annotation: Domain name=Glycos_transf_2; Domain location=238 -413; Score=10.1; E_value=0.0002; Accession=PF00535.16; Description =Glycosyl transferase
MGPSPSIDFSKWWVKESSSSSSRKGNPVVVTMENPNYSVLEIDAPDSAFQPVDKDRGKNAKQFTWLLLLRAHRFVGFLSWLGNSLCSLLHAVKKRLFLGHVETEMSSKAKFLFRVILTFLVMALAFLSFELVAHFKGWRYFHNHNNLHLIPQTSEITGWFHTAYVRWLEFRVDYIAPLIQSLSTFCILLFLIQSVDRMVLCLGCFWIKFNKIKPVVIDGDSLNSHDLEGSNDGYPMVLVQIPMCNEKEVYDQSISAVSQLDWPKDRLLIQVLDDSDDEGIQWLIKGEVSKWSQKGVNIIYRHRKFRTGYKAGNLKSAMSCDCVKDYEFVAIFDADFQPNPDFLKQTVPHFKGNPELALVQARWAFVNKDENLLTRLQNINLCFHFEVEQQVNGVFLNFFGFNGTAGVWRIKALEESGGWLERTTVEDMDIAVRAHLNGWKFIFLNDVKVLCELPESYEAYRKQQHRWHSGPMQLFRLCLPAIITSKIAFWKKTNLIFLFFLLRKLILPFYSFTLFCIILPLTMFVPEAELPIWVICYIPVFMSFLNILPAPKSFPFIVPYLLFENTMSVTKFNAMVSGLFQLGSSYEWIVTKKAGRASEPDLLAAEERDSKAMSLQLHRGTSDSGLSELNKIKECQETVPVKKMNKIYKKELALAFLLLTAAVRSLLSAQGMHFYYLLFQGVSFLLVGLDLIGEQMN

SEQ ID NO: 138824 - protein, 169 aa, Glycine max
  Coding DNA Sequence Number=SeqID_22046
MAWQIADTRYEDPKTNVNFLDQFLQKAALWFMLSRLNSIVLTININYIFYEFHYLPGGSVLAAFADSFAPLYFAVRELKEVMSIEQPCDLAYEFGDGLHDIEELPLGFPRPVEHPYPFNDQIVVYVRYLGPGVSVGQAWQEGTKLEQVPHKLYGEILMVKDCTSLREDQ

SEQ ID NO: 138825 - protein, 115 aa, Glycine max
  Coding DNA Sequence Number=SeqID_22047
MARKPCSQPASVPDPTSSIKQLFCYAIHYSKLCLGFYVFLLGCYLSYPNFVWGLLFDDIQPLIGRFETLGVLYCTMNKVPRRVRNQKGSRLAQSVKFRNVAEIEKRCFCAIHKFL

SEQ ID NO: 138826 - protein, 950 aa, Glycine max
  Coding DNA Sequence Number=SeqID_22048
  Gene Ontology: Mol. function=binding; Cellular component=endoplasmic reticulum; Biological process=ER to Golgi vesicle-mediated transport
  Homolog annotation: Hit_ID=Q9SV20; Match level="QueryCoverage=99%, HitCoverage=100%, E-value=0.0, Identity=77%"; Hit description=Beta -COP-like protein
  Pfam annotation: Domain name=Adaptin_N; Domain location=12-530; Score= 218.3; E_value=1.7e-62; Accession=PF01602.10; Description=Adaptin N terminal region
  Pfam annotation: Domain name=Coatamer_beta_C; Domain location=668 -945; Score=520.8; E_value=1.5e-153; Accession=PF07718.3; Description= Coatamer beta C-terminal region
  Pfam annotation: Domain name=HEAT; Domain location=126-162; Score =20.3; E_value=0.0069; Accession=PF02985.12; Description=HEAT repeat
  Pfam module annotation: Pfam domain module=Adaptin_N::Coatamer_beta _C::HEAT; Domain location=12-530::668-945::126-162
MEKSCTLVVHFDKGTPALANEIKEALEGNDVAAKIDALKKAIMILLNGETIPQLFITIIRYVLPSEDHTIQKLLLLYLEIIDKTDSRGKVLPEMILICQNLRNNLQHPNEYIRGVTLRFLCRLNESEIIEPLIPSILSNLEHRHPFVRRNAVLAVMSVYKLPQGEQLLDSGPEIVDKFLSTEQDPSSKRNAFLMLFSCSQDRAISYLFANIDRIIDWGEQLQMVVLELIRKVCRNNKGEKGKYIKIIISLLNAPSTAVIYECASTLVSLSSAPTAIRAAASTYCQLLLSQSDNNVKLIVLDRLNELKTSNREIMVEMVMDVLRALSTPNHDIRRKTLDIALELITPRNIDEVVMMLKKEVVKTQSGEHEKNGEYRQMLVQAIHTCAIKFPEVASTVVHLLMDFLGDTNVASAMDVVVFVREIIETNPKLRISIITRLLDTFYQIRAARVCSCALWIIGEYCLSLSEVESGIATIKQCLGDLPFYTITEEGDGQEASKPIQQVNSTTVSSRRPAILADGTYATQSAALETAMSPPTLVQGSLSSIGNLRSLILSGDFFLGAVVACTLTKLVLRLEEVQTSKAEVNKATTQALLIIVSMLQLGQSSILPHPIDNDSFDRIVLCIRLLCNTGDEIRKIWLQSCRQSFVKMLADKQCRETEEIKAKAQISNAQPDDLIDFYHLKSRKGMSQLELEDEVQDDLKRATGEFTKDADDANKLNRILQLTGFSDPVYAEAYVTVHHYDIVLDVTVINRTKETLQNLCLELATMGDLKLVERPQNYTLAPESSKQIKANIKVSSTETGVIFGNIVYETSSNVLERTVIVLNDIHIDIMDYISPASCADVAFRTMWAEFEWENKVAVNTVLQDERDFLNHIVKSTNMKCLTPPSALEGDCGFLAANLYAKSVFGEDALVNVSIEKQADGKLSGYIRIRSKTQGIALSLGDKITLKQKGAA

SEQ ID NO: 138827 - protein, 343 aa, Glycine max
  Coding DNA Sequence Number=SeqID_22049
  Homolog annotation: Hit_ID=Q47522; Match level="QueryCoverage=14%, HitCoverage=60%, E-value=3e-21, Identity=95%"; Hit description=LacZ protein
MVKVGTSYVPINVSFSPKVGPGLPGINRDTRIYLFCEVIFRHSGFCFYQLSLLFQLLTGWCVTAKAPPDISAGKCSGRVPFAIQAAQLLGRAIGAGLFAITPAGERGMCCKAIKLGNARVFPVTTLANWISTAVAAALELVDPPGCRNSIVDCILDIGLRARMIWIAGTIASNMHDFPVSLVRSLVFEQLTISDQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138828 - protein, 88 aa, Glycine max
  Coding DNA Sequence Number=SeqID_22050
MEVEVFDCWVIDFMGPFPSSASNKYIVVAVDYCESLIQDVFKIKSCLTMKGFKSSKAYVIDYQYMLSYPNFVRGPLLDDMRPFFGPCE

SEQ ID NO: 138829 - protein, 98 aa, Glycine max
  Coding DNA Sequence Number=SeqID_22051
MENNMTCKSAIGSTIGLGPSITAPNQSIPVLDSQTIYLTNIAKKITNKAPKYPKEKVKLDGDVTYLCEMKGMQKNETKGAQRKLEAAANGGSRSQMIR

SEQ ID NO: 138830 - protein, 288 aa, Glycine max
  Coding DNA Sequence Number=SeqID_22052
MHGETFDHSIKDKKANKKSKTIDHRQRSKDLSCESGSNSDSERQTNIISKGEHSRNDHSDTHINGTKSIPSLARRTSSSSSSESSSDNFFRIKEAFKYTKSGKDYVSSSESSDKSKVDNNLLVPTSTYQVYDLSRNQKGMSPTASPPIQVMDRSGRYDASIVPSSIFETNTNPSEWSISSNDSLFSIQIGQPSFTRENALMYAELGFSRELTKSGEEISTVIKSVDVKNLQTIETSYGPLMLEGERLSEVDNEIKTSHQTKSYEPSKSNVSILSHSSDIGMSSIAFPK

SEQ ID NO: 138831 - protein, 477 aa, Glycine max
  Coding DNA Sequence Number=SeqID_22053
  Gene Ontology: Mol. function=binding; Cellular component=membrane
  Homolog annotation: Hit_ID=O82388; Match level="QueryCoverage=88%, HitCoverage=81%, E-value=6e-40, Identity=33%"; Hit description =Expressed protein
  Subcellular localization annotation: CTP_CleavageSite=57; ConfidenceScore=5.12e-01
MASRVSPNLKCWQFRTPYYCDSWKTPRAVPSSILRHVTERNNVMPPCGLVHRSRNLRVQRGKRVYSSLFDDFHQEERMNLVQDGCWDENGHEIACAVSDNTPNKELKNDFSGGGCSSEEFGTMKPEVLEPSLLGIQPEPPSWPERDEILRRTFERKVNSVGISLSIRMIKKKLQLEEGSKEAGELTELTNCSVKKTFSSMMLIMHELQSHALQTRESLCGENLQGVMTKLEREMDASFVWLFQQVFWKTPALMVYVMVLLANFLVFSMNDNTVKVITPSSMITKALTLTSNESKVQHSHVDVDQGEYVNRELTEEEHMLWNSFLEEASMLQKELSGEVLDHETRQRLVAPVSVELEGDQYEEYVKTELYYKKHLFRTPHCSLLLSNYAQFLFLVLHDIDGAEEYYKKSVLAESSEAEAFSRYADFLLMVRKDVWAAELRYLQTLEADPGNAYYLSKYASFLWNTGGQDTNSFPMMVI

SEQ ID NO: 138832 - protein, 57 aa, Glycine max
  Coding DNA Sequence Number=SeqID_22054
MAYRGVQQWWHPNTSEKGKGMQGDEERRMKGGLNEFPALSIGLTLLDIIHDAFTFQQ

SEQ ID NO: 138833 - protein, 446 aa, Glycine max
  Coding DNA Sequence Number=SeqID_22055
  Gene Ontology: Mol. function=receptor activity; Cellular component =membrane; Biological process=positive regulation of fibroblast growth factor receptor signaling pathway
  Homolog annotation: Hit_ID=Q5Z8V4; Match level="QueryCoverage=68%, HitCoverage=76%, E-value=6e-92, Identity=54%"; Hit description =Putative Reg receptor
  Pfam annotation: Domain name=EXTL2; Domain location=144-444; Score =399.7; E_value=4.2e-117; Accession=PF09258.1; Description=EXTL2, alpha-1,4-N-acetylhexosaminylt
  Pfam annotation: Domain name=Glycos_transf_2; Domain location=145 -309; Score=-16.2; E_value=0.038; Accession=PF00535.16; Description =Glycosyl transferase
  Pfam module annotation: Pfam domain module=EXTL2::Glycos_transf_2; Domain location=144-444::145-309
MVGCRNEMCEGKHEAPLSGNIRVAKGQSDKSSGAESVHRFSFGSGWLAAEPDRFGLERSCWARKHAFAAVMRGSCCCWNRRTEQRFRLLAISTVKSLKIKLLLFCCVAFTLLAFSTSASSFVLWINNQTPPPPPPRFPDSGKGYSIVMNTWKRYDLLKQSIKHYSSCPRLESVHIVWSEPDPPSDILLKFLHHVVKSKSKDGRYVKLRFDINKEDSLNNRFKEIKDLETDAVFSIDDDVIFPCSTVEFAFDVWQSAPDTMVGFVPRVHWVDSLEGNDSKFIYGGWWSVWWTGTYSMVLSKAAFFHKKYFNIYTNEMPSSIREYVTKNRNCEDIAMSFLVANATGAPPIWVKGAAEKLCLGDGFESINSLFAYVSQMVDSGLTEYVMHIAVEYNSKILEIGSTGISSLGGHSERRTECVNRFVAAYGRMPLVSTSVKAVDSRNIWFW

SEQ ID NO: 138834 - protein, 238 aa, Glycine max
  Coding DNA Sequence Number=SeqID_22056
MAGEKEAHQPMSTLNDYLVNTRPKYFNTIAKPKVQACNMEINSEFIHLVQKIQFWGYDHEDPYANLATFVDICCNMPLRKCPPHGLDEGAQINTFLVGLRAQTKLLLNVSVGSKIMLKTPDEAKEIIQNMASNDYETNMIGLWCKEEEENKVSMNPVIKDLPYPHAPTRKDKEKPHAWILEILKQLQFNISFLKVAKPRPSYDDKSVDYQLNVLDELFVEPKLQLHIPFPLELAPIDA

SEQ ID NO: 138835 - protein, 201 aa, Glycine max
  Coding DNA Sequence Number=SeqID_22057
  Gene Ontology: Mol. function=protein transporter activity; Cellular component=integral to membrane; Biological process=intracellular protein transport
  Homolog annotation: Hit_ID=Q9FFK1; Match level="QueryCoverage=79%, HitCoverage=48%, E-value=2e-46, Identity=59%"; Hit description =Syntaxin-31
  Pfam annotation: Domain name=SNARE; Domain location=114-177; Score =61.3; E_value=3.1e-15; Accession=PF05739.9; Description=SNARE domain
MPCYIYHSHAINVVRVCMLQNIKAHENRKQIFSKNASRENPLQHQPKPTTEPPPWSNSSNASESLHQELALPSNGAPVGNQLRRRLAVDSTPSQQMEMSMVQQVVPRHDNYAQSRATALHNVESTITELSGIFSHLATMVAHQGELAIRIDDNMDESSANVEGAHSSLLRHLNRISSNRWLLIKIFVILILFLMIFIFFVA

SEQ ID NO: 138836 - protein, 66 aa, Glycine max
  Coding DNA Sequence Number=SeqID_22058
MKNERRTVKNLHEITHGNVSEEKRGRWLPPSSPRRAGLLPPKGIAFFWNPQEGPSGPGCYLHPPFH

SEQ ID NO: 138837 - protein, 122 aa, Glycine max
  Coding DNA Sequence Number=SeqID_22059
MWAKRADPLGNPLRKRIEICLSECNVNYTHICPNLLNLTCIFSHTQLLAFLLFLHLHSSSTTDKDSKELPKSAYLAKRVHLLRMNTHPLAEMPVAKRGSIAKPMVFPSLLRILNCDEKIRPT

SEQ ID NO: 138838 - protein, 140 aa, Glycine max
  Coding DNA Sequence Number=SeqID_22060
  Subcellular localization annotation: CTP_CleavageSite=24; ConfidenceScore=5.18e-01
MERNNEGKKALIQAHSVSRHGLTTASLRSCCRLCRDFASCQDQSGTPLSSSPTTPPSTPPGGSADQCGGPLPPLREAQLLRRHLQQHRPPRPPPPRAHHAHTSSIAKAGTEEAIRKSKISESQFEKGLTLCDGDLGSMKI

SEQ ID NO: 138839 - protein, 998 aa, Glycine max
  Coding DNA Sequence Number=SeqID_22061
  Gene Ontology: Mol. function=protein kinase activity; Cellular component=integral to membrane; Biological process=protein amino acid phosphorylation
  Homolog annotation: Hit_ID=Q1SEN0; Match level="QueryCoverage=99%, HitCoverage=97%, E-value=0.0, Identity=63%"; Hit description=Protein kinase
  Pfam annotation: Domain name=LRRNT_2; Domain location=12-52; Score =39.6; E_value=1.1e-08; Accession=PF08263.3; Description=Leucine rich repeat N-terminal domain
  Pfam annotation: Domain name=LRR_1; Domain location=105-127; Score =16.6; E_value=0.088; Accession=PF00560.23; Description=Leucine Rich Repeat
  Pfam annotation: Domain name=LRR_1; Domain location=129-151; Score =7.6; E_value=11; Accession=PF00560.23; Description=Leucine Rich Repeat
  Pfam annotation: Domain name=LRR_1; Domain location=155-177; Score =10.3; E_value=3.4; Accession=PF00560.23; Description=Leucine Rich Repeat
  Pfam annotation: Domain name=LRR_1; Domain location=179-201; Score =13.6; E_value=0.75; Accession=PF00560.23; Description=Leucine Rich Repeat
  Pfam annotation: Domain name=LRR_1; Domain location=203-225; Score =15.8; E_value=0.16; Accession=PF00560.23; Description=Leucine Rich Repeat
  Pfam annotation: Domain name=LRR_1; Domain location=227-246; Score =6.0; E_value=22; Accession=PF00560.23; Description=Leucine Rich Repeat
  Pfam annotation: Domain name=LRR_1; Domain location=252-274; Score =8.9; E_value=6.2; Accession=PF00560.23; Description=Leucine Rich Repeat
  Pfam annotation: Domain name=LRR_1; Domain location=276-298; Score =11.0; E_value=2.5; Accession=PF00560.23; Description=Leucine Rich Repeat
  Pfam annotation: Domain name=LRR_1; Domain location=300-325; Score =2.9; E_value=83; Accession=PF00560.23; Description=Leucine Rich Repeat
  Pfam annotation: Domain name=LRR_1; Domain location=330-352; Score =7.9; E_value=9.4; Accession=PF00560.23; Description=Leucine Rich Repeat
  Pfam annotation: Domain name=LRR_1; Domain location=355-377; Score =14.2; E_value=0.49; Accession=PF00560.23; Description=Leucine Rich Repeat
  Pfam annotation: Domain name=LRR_1; Domain location=379-401; Score =10.2; E_value=3.5; Accession=PF00560.23; Description=Leucine Rich Repeat
  Pfam annotation: Domain name=LRR_1; Domain location=403-425; Score =12.0; E_value=1.6; Accession=PF00560.23; Description=Leucine Rich Repeat
  Pfam annotation: Domain name=LRR_1; Domain location=427-449; Score =10.6; E_value=3; Accession=PF00560.23; Description=Leucine Rich Repeat
  Pfam annotation: Domain name=LRR_1; Domain location=451-474; Score =9.5; E_value=4.7; Accession=PF00560.23; Description=Leucine Rich Repeat
  Pfam annotation: Domain name=LRR_1; Domain location=476-498; Score =18.5; E_value=0.025; Accession=PF00560.23; Description=Leucine Rich Repeat
  Pfam annotation: Domain name=LRR_1; Domain location=500-522; Score =14.7; E_value=0.34; Accession=PF00560.23; Description=Leucine Rich Repeat
  Pfam annotation: Domain name=LRR_1; Domain location=524-546; Score =8.9; E_value=6.3; Accession=PF00560.23; Description=Leucine Rich Repeat
  Pfam annotation: Domain name=LRR_1; Domain location=548-570; Score =18.5; E_value=0.024; Accession=PF00560.23; Description=Leucine Rich Repeat
  Pfam annotation: Domain name=LRR_1; Domain location=572-593; Score =5.8; E_value=24; Accession=PF00560.23; Description=Leucine Rich Repeat
  Pfam annotation: Domain name=LRR_1; Domain location=595-619; Score =3.1; E_value=76; Accession=PF00560.23; Description=Leucine Rich Repeat
  Pfam annotation: Domain name=Pkinase; Domain location=691-964; Score =96.5; E_value=7.7e-26; Accession=PF00069.15; Description=Protein kinase domain
  Pfam annotation: Domain name=Pkinase_Tyr; Domain location=691-989; Score=62.6; E_value=2.6e-16; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=12-52::105-127::129-151::155-177::179-201::203-225::227 -246::252-274::276-298::300-325::330-352::355-377::379-401::403 -425::427-449::451-474::...
  Pfam module annotation: Domain location=476-498::500-522::524 -546::548-570::572-593::595-619::691-964::691-989
MMPGTVGHALSAESDKVALLALKQKLTNGVFDALPSWNESLHLCEWQGVTCGHRHMRVTVLRLENQNWGGTLGPSLANLTFLRKLILSNIDLHAQIPTQIGRLKMLQVLDLSHNNLHGHIPIHLTNCSKLEVINLLYNKLTGKLPSWFGTGSITKLRKLLLGANDLVGTITPSLGNLSSLQNITLARNHLEGTIPHALGRLSNLKELNLGLNHLSGVVPDSLYNLSNIQIFVLGENQLCGTLPSNMQLAFPNLRYFLVGGNNFNGSFPSSISNITGLLKFDISSNGFSGSIPPTLGSLNKLKRFHIAYNSFGSGRAQDLDFLSSLTNCTRLNILILEGNQFGGVLPDLIGNFSANLTLLDMGKNQISGMIPEGIGKLIGLTEFIMGDNYLEGTIPGSIGNLKNLVRFVLQGNNLSGNIPTAIGNLTMLSELYLHTNNLEGSIPLSLKYCTRMQSFGVADNNLSGDIPNQTFGNLEGLINLDLSYNSFTGSIPLEFGNLKHLSILYLNENKLSGEIPPELGTCSMLTELVLERNYFHGSIPSFLGSLRSLEILDLSNNDLSSTIPGELQNLTFLNTLNLSFNHLYGEVPIGGVFNNLTAVSLIGNKDLCGGIPQLKLPTCSRLPSKKHKWSIRKKLILIIVIGVGGGLVSFIACISIYLFRKKPKTLSSLLSLENGRVKVSYGELHEATNGFSSSNLVGTGCCGSVYRGSLLHFKGPIAVKVLNLETGGASKSFAAECKALGKIMHRNLLNVLTCCSSIDYNGNDFKAIVFEFMANGSLENLLRSNEELESRNFNINLQLMLNIALDVANALDYLHHGSEQAVVHCDIKPSNILLDDDFVAHLGDFGLARLLNVVTGHSSRDQVSSSAIKGTIGYVPPEYGAGVGVSPKGDIYSYGILLLEMLTGMRPTDNKFGESLSLHKFCQMAIPEGITEIVDSRLLVPTTTEEGTRVRVMERNIRECLVSFARIGLTCSAELPVQRISIKDVIVELHLIKKKLAR

SEQ ID NO: 138840 - protein, 74 aa, Glycine max
  Coding DNA Sequence Number=SeqID_22062
  Subcellular localization annotation: CTP_CleavageSite=48; ConfidenceScore=5.24e-01
MPRPDKPNWPTMHLRSAPHLALSAFRSRAGRAMHAGPVLLLDRALGACASVGSGAGRLAGLARVTVSATLSASS

SEQ ID NO: 138841 - protein, 68 aa, Glycine max
  Coding DNA Sequence Number=SeqID_22063
  Gene Ontology: Mol. function=hydrolase activity, hydrolyzing O -glycosyl compounds; Biological process=carbohydrate metabolic process
  Homolog annotation: Hit_ID=Q1SKR1; Match level="QueryCoverage=84%, HitCoverage=12%, E-value=3e-19, Identity=72%"; Hit description =Proteinase inhibitor I4, serpin
MIVITTTLGEFGWILMEILFKLMEGAFYMMKDKEHTIGTVNIKMGPRTMLTREHLLGLIIKQVYVYKK

SEQ ID NO: 138842 - protein, 570 aa, Glycine max
  Coding DNA Sequence Number=SeqID_22064
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=Q9LU41; Match level="QueryCoverage=99%, HitCoverage=53%, E-value=0.0, Identity=66%"; Hit description =Putative calcium-transporting ATPase 9, plasma membrane-type (EC 3.6.3.8) (Ca(2+)-ATPase isoform 9)
  Pfam annotation: Domain name=E1-E2_ATPase; Domain location=1-146; Score=-135.5; E_value=0.1; Accession=PF00122.10; Description=E1-E2 ATPase
  Pfam annotation: Domain name=Hydrolase; Domain location=208-460; Score=32.4; E_value=1.6e-06; Accession=PF00702.16; Description =haloacid dehalogenase-like hydrolase
  Pfam module annotation: Pfam domain module=E1-E2_ATPase::Hydrolase; Domain location=1-146::208-460
VTGVGINTEWGLLMASISEDNGEETPLQVRLNGVATFIGVVGLSVAVLVLAVLLGRYFSGHTKDLDGNVEFVAGKTSLSNAVDGVIKIFTIAVTIVVVAVPEGLPLAVTLTKVVSFPFPFTNKRLLYGLEKDALFVKDNKMTVVEAYVGSTKVNPPDDSSKLHPKALSLINEGIAQNTTGNVFVPKDGGETEVSGSPTEKAILSWAVKLGMNFDVIRSNSTVLHVFPFNSEKKRGGVALKLGDSGIHIHWKGAAEIVLGTCTQYLDSDGQLQSIEEDKKAFFKDAIDDMAARSLRCVAIAYRSYELDKVPSSEQDLDQWSLPEYELVLLAIVGIKDPCRPGVKDAVKVCTDAGVKVRMVTGDNLQTAKAIALECGILASIEDAVEPNIIEGKKFRELSEKEREDIAKKITVMGRSSPNDKLLLVQALRKGGEVVAVTGDGTNDAPALHEADIGLSMGISGTEVAKESSDIIILDDNFASVVKVVRWGRSVYANIQKFIQFQLTVNVAALVINVVAAITSGDVPLNAVQLLWVNLIMDTLGALALATEPPTDRLMHRSPVGRRFGLIGFLT

SEQ ID NO: 138843 - protein, 53 aa, Glycine max
  Coding DNA Sequence Number=SeqID_22065
MGKARLELRSSYKLQVEVKQKKLEQHMEVWDTKTKNPRHMCFTSNSTNLATVG

SEQ ID NO: 138844 - protein, 686 aa, Glycine max
  Coding DNA Sequence Number=SeqID_22066
  Gene Ontology: Mol. function=cation transporter activity; Cellular component=integral to membrane; Biological process=cation transport
  Homolog annotation: Hit_ID=Q8H1G3; Match level="QueryCoverage=54%, HitCoverage=81%, E-value=1e-171, Identity=81%"; Hit description =Metal tolerance protein C4
  Pfam annotation: Domain name=Cation_efflux; Domain location=328-615; Score=117.7; E_value=3.3e-32; Accession=PF01545.11; Description =Cation efflux family
  Pfam annotation: Domain name=Glyco_hydro_47; Domain location=1-201; Score=-192.5; E_value=2.2e-05; Accession=PF01532.11; Description =Glycosyl hydrolase family 47
  Pfam module annotation: Pfam domain module=Cation_efflux::Glyco_hydro_ 47; Domain location=328-615::1-201
MDELACFAPGMIALGSFGYSAADDSQKFLSLAEEVITEDMHLTLQLAWTCYNFYQSTPTKLAGENYFFHSGQDMSVGTSWNILRPETVESLFYLWRLTGNKTYQEWGWNIFQAFEKNSRIESGYVGLKDETNDFYYSWAIYLVMLTVVDEYLAVNSGVKDNMMQSFFLAETLKYFYLLFSPSSVISLDEWVFNTEAHPLRIVTRHEEGLVKNLNEKQKPFSRIGGRKEGRSACKMSGFPHWGGLKALVSMRTSYNLVLLRSRFRRSHNFHAYRSLSVVILKPDHHPPAIIPSNSRFLLPGFNAHRHRSAAKPATTNIEFNDHHSQRAVKTALWCNFLVFSLKFGVWLASSSHVMLAEVVHSVADFANQALLAYGLSSSRRAPDAIHPSVYGYSKERFVWSLISAVGIFCLGSGATVVNGVQNLWIAQPPENMKYAALVICGSFVIEGASLIVAIQAVKKGAAAEGMKLRDYIWRGHDPTSVAVMTEDGAAVTGLVIAGASLVAVNVTGNAIYDPIGSIVVGNLLGMVAIFLIQRNRHALIGRAMDDHDMEKVLQFLKKDPVVDSLYDCKSEVIGPGFFRFKAEIDFNGEMVVQNYLKRTGREEWARQFREAAKQKDDTAMMKIMSNYGEEVVTALGSEVDRLEKEIQNLVPGIRHVDIEAHNPPTETTLSISRVLKKSGVELHASG

SEQ ID NO: 138845 - protein, 104 aa, Glycine max
  Coding DNA Sequence Number=SeqID_22067
  Gene Ontology: Mol. function=nucleic acid binding; Biological process= DNA integration
  Homolog annotation: Hit_ID=Q1SEI7; Match level="QueryCoverage=64%, HitCoverage=12%, E-value=1e-16, Identity=57%"; Hit description =Peptidase S8 and S53, subtilisin, kexin, sedolisin; Zinc finger, CCHC- type; Peptidase aspartic, catalytic
MKSEFDMTDLGILHYFLSFEFMHTHKGIFLHQRKYTDSYATANPTLVMEWDCLADLWGMIKTDYALKPTLIQTSVVIRLKEKAPLDTCLSIWMHQYPGVQRSKV

SEQ ID NO: 138846 - protein, 1029 aa, Glycine max
  Coding DNA Sequence Number=SeqID_22068
  Gene Ontology: Mol. function=RNA-directed DNA polymerase activity; Cellular component=chromatin; Biological process=chromatin assembly or disassembly
  Pfam annotation: Domain name=rve; Domain location=786-930; Score= -12.9; E_value=0.072; Accession=PF00665.16; Description=Integrase core domain
  Pfam module annotation: Pfam domain module=RVT_1::rve; Domain location=413-642::786-930
MAELATRDLQDNVGLPLGDNITNSIIVIFPSTKLQFSTGPSKPTASYFPINFGVVIVMADAFRAKGSSNKLEDAILKLTNHQLSLGEIMQSMSLKFDELLLRMSPLLSTPTSVPPPMTTLPLVSATNHRMKLDVPRQSPHLVLVDDQQWSIHFMARVSPSPPNSFGQPISWSSFLIPSKLLYFWPHSGNSSGGAGVTALDSCPGSRARVTPRGETLGHAPRLAQSTTTRRLTAALVSYGDSISPSLATMPTAINPQMLISGGDNEEDAPLAHIEGLDPPPDPLDTHDPFAAQISFNSLAGQMAPKTLRLLGMLVGHQVVILVDGGSTHNFIQEELATTFTIDLYMLPISGANIVLGFQWLKSLVPVLTDYNTLCMKFFHDDRLVELKGDNESTLNLLTLPQFRRLLKKQGASFYYHIAVISNEKQDGSWRFCVDYRALNAIIVRDRFPIPTIDKLLDELGGASWFSKLDLLQGYHQIKMHSGDIAKTEFHTHHGHYEFKAMINMIFHPYLWRFIIVFFNDILIYSGSFDDHVEYLGHLVSKRGVEPVASKVGAIRQWPVPQSTKALRSFLGLVSFYHRLIKGYAIIATLLVKATTIEPFQWTTLAQIAFEQLKQAFSEAPVLTLTNFQLLFTIETNALGVGMSAILSQQGHHFTIITNHQSLKELLMQVIQTSEQHMYLARLMGYDYQIQYRSGANNQAAYALSRLLKHNTSPLLTLSVPYLTFMEELYRGRIWLPRGLPLISMLLIEYHSTPTEGHLGIAKTIARLSENFCWPGLRDDVMQFVAVPHRPWEDLSLDFIIDLPLYHGNTVILVVVDRFPKGIHLRMLPPSHTAHTVACLFMDIVGKTHGIPWSLSDNQTEVLNCVIEQYLWAFVHRHPSSWERLLLWVEWSHNTSWNVGTGSTLYEITFGRKPFHFPGYITGTSKVDVVDDMLVNRKETFQVILKKLLKAQTLMKQHVDAKRREVNYQPSDWVMRASTPPISLRQTASSHVWQTALSRRSWFNGWDCHRMRPRGRTGHNCARIITLRTR

SEQ ID NO: 138847 - protein, 678 aa, Glycine max
  Coding DNA Sequence Number=SeqID_22069
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=61%, E-value=1e-147, Identity=36%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=377-540; Score =151.8; E_value=1.8e-42; Accession=PF00665.16; Description=Integrase core domain
MDVILGFQELDEIVRDGFQEPSKNASTEQKEMHRENKRLDYKAQAATSKKAWDSLQQVYGNTGRTKKVMTNSMRACDEAMVDSKIMEKVLKTLTPNFDHIVVAIEESKDLENMTVEELQNSLEAHEQREEEDIEEAKVVIEMQKHIVQLPKSRFLEAIQMSSVIIPVLEEETFSKVKVIGNNNAHSKYKKNDWAHLAQEEDGFDSDQVLLMVTTSSKEDYSSWYLDIRCSNHMTGNRDWLVDFNPNVTTSMRFADNSTILAEGIRKKGFTMAMQGNHIEIFDDKQKLVLKAPLSRNRTFKVNLSIAAIQCLSTVNTEEDNWLWHYRYGHLNFKSLHQLSSKQMVLGMPSIHSPQKTCEGCLIDKQPRKAFKTKAPQRAKQPLGIVHLDVCRPFDTPSLSGNRYFLTFVDEFTKKIWIYMLKEKGAVFSLFVKFFKSVNRQSELKLKILRIDGGGEYNSKEFKEFCEAKGIEHEVIAPYTPQHNGLAKRRNRTLLDMARCMLKGKGLLNCYWGEAVTTAAYVLNRCPTKRLQSITLEEAWIGDKPMVNHLRIFGSLSYRHIPNERRKKLDDKNVMVDEIVAWKWENESKIPNSYILKDNPRAKAVNPASSIQSPIKRSQRTRFPSIRLTGYELYSNGSISNDGEMVHFAFIVDTKPVQWKQALDIREWKATMKEELDAI

SEQ ID NO: 138848 - protein, 424 aa, Glycine max
  Coding DNA Sequence Number=SeqID_22070
  Homolog annotation: Hit_ID=Q1S0F5; Match level="QueryCoverage=60%, HitCoverage=58%, E-value=3e-17, Identity=27%"; Hit description=IMP dehydrogenase/GMP reductase
MVEEFEEILGCPLGGRKPYLFSRFYPSLARISKIVQISVQELDHKKQVENGVVGIPRKCLEAKARILAGRGKWAPFIDILALLIFGGVLFPNVDGLVDLAAIDAFLAYHDRKESPVVSILVDLYDTFDRRCEKSSTRIVCCTPALYQAKKERLSTGSLDGRRKNQDSYFVRRISKSLMGTRGCISYNLLLAIRQLGYPMRGAPLEEELAPIIARGFNKTNVEALQKVRKAWEMVQKKDKELIGSNNGPISGYRKWLKAHMQGLGWLPSLRTTKGEEVEAPEEDEEVHALRAELEQAQTVKERFKSAALKIRKENAELRDVNIATTKALERETKRARREEHDQNKFRGALWGSNSELKLRREERDQSRVDSLILKDELKVCLRSKRSLSQRLCKTKTNMLSIINKYQEELNLATVHEHKVADKYA

SEQ ID NO: 138849 - protein, 67 aa, Glycine max
  Coding DNA Sequence Number=SeqID_22071
ELCGEVDEDTTKGKDHEALEGPMTKGILKKAQHSDEDTTKGKDHEALERPMTRDKLKQAQHVIETRL

SEQ ID NO: 138850 - protein, 76 aa, Glycine max
  Coding DNA Sequence Number=SeqID_22072
MNKINATCRRHNSERIRKFLQDLEVAATPEVEPQSSEASSSFPIVWHSHIEPVEDPIMAEEPRRVTLEDYSSSTVP

SEQ ID NO: 138851 - protein, 63 aa, Glycine max
  Coding DNA Sequence Number=SeqID_22073
MTLGLAHHFWAKRAYHAKHDRESGTTPISRPRAKREISALSTMVVISQAQRMTSAKLKSTYSR

SEQ ID NO: 138852 - protein, 387 aa, Glycine max
  Coding DNA Sequence Number=SeqID_22074
  Gene Ontology: Mol. function=chitin binding; Cellular component =extracellular region; Biological process=chitin metabolic process
  Homolog annotation: Hit_ID=UPI000044A8F0; Match level="QueryCoverage =57%, HitCoverage=99%, E-value=1e-32, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
TLTFRGIYVLVIRGLHALTFRGLHVLAFRGLHALTFRGLHVLAIRGLQVLAIRGLHVLAFRGLHVLAIRGLHALTFRGLHVLAFRGLHALIFRGLHVLAFRGLHVLAIRGLHALTFRGLHVLTFRGSWLHALTFKGLHALIFRGLHVLAFGGLHSLVFRGLYVLPLRGLHFLAFRGLHVLAFRGLQVPLFRRLHALAFRGRHVLAFGGKAIAQLLCIPGQGFTRATAKRRVWIMRTNMTTLTQICITLLLSNISPSDRNVDLPLRKYQLGSRPQDTQWTQRSPTGPWGFQLWLRASISPIGCPYPPARSCHHDIGIAPARHPMDPKKSNRVLGFPTLITGLCQFYGVPVTPNKAGARRNTTIAWGWPATGNKCTVATSRAPQLIQKK

SEQ ID NO: 138853 - protein, 244 aa, Glycine max
  Coding DNA Sequence Number=SeqID_22075
  Gene Ontology: Mol. function=RNA-directed DNA polymerase activity; Biological process=RNA-dependent DNA replication
MPSMVERGMITMIIDTLSVFYYEKMVGYMPSSFGDLVFPGERIEVGLRRGKFDYAASTGSNNKRLGMSGGKKKEGETHDLTVVPTWPNFPLAPYNPMYQYPPQLYHYSTNISSTYYPPPYQPKPSLNRPQNLPAAQPRPNTTANTNQNTNQGKNFPERKPVEFTPILISYVDLLPYFLNNAMVAMSPTKISQPPFPRGYNLNVTCAYHGGAPGHSIDYCMTLKHKVQSLIDAGWLKFQEDNPNV

SEQ ID NO: 138854 - protein, 52 aa, Glycine max
  Coding DNA Sequence Number=SeqID_22076
MEHRNLGIPRSCGSACHRTLGTRISFLNDHLEEALGPTKIGENHSKCINLTQ

SEQ ID NO: 138855 - protein, 255 aa, Glycine max
  Coding DNA Sequence Number=SeqID_22077
  Gene Ontology: Mol. function=N-isopropylammelide isopropylaminohydrola se activity
  Homolog annotation: Hit_ID=Q3P909; Match level="QueryCoverage=83%, HitCoverage=49%, E-value=9e-80, Identity=67%"; Hit description=N -isopropylammelide isopropylaminohydrolase precursor
LEHLQLALANHPAFRCEIVAFPQHGMLHSQVDGLMREAMQLGVQYVGGLDPTNVDGAMQASLDAMFRIALDYDRGVDIHLHETSAAGVAAIQYMIATIARNPQLKGKVTLSHGFALATLEADERGVTIPIGKLTMPLPQLQAAGVTVMTGTDSVIDHWSPFGTGSMLEKANLYAQLYRGSDEFGLSRALHIATGGILPLANSGERQWPQLQDEATRHAGIQRLKAHRSQHQHARPGQKKASRRRLWKVTPARQAR

SEQ ID NO: 138856 - protein, 51 aa, Glycine max
  Coding DNA Sequence Number=SeqID_22078
MERGLDFDGMGIYLRRYGRGLGSRVITPIKEASMSLPVGTVFDHHSILTCH

SEQ ID NO: 138857 - protein, 100 aa, Glycine max
  Coding DNA Sequence Number=SeqID_22079
MKDRKRFLSRLVHTTTSIFLFRIQIRVRERVVDVVVIVREVAVQGFNPSKVGDSIWVKGGWESYDMDEVEEGTTWRRPWSAMLARSRKEHRGEKSCNIAK

SEQ ID NO: 138858 - protein, 55 aa, Glycine max
  Coding DNA Sequence Number=SeqID_22080
MALWQHLKRKKLQILQHLRGVIFILHYPFSLFVIVDCREGFPAPLWFSRVVDYRL

SEQ ID NO: 138859 - protein, 120 aa, Glycine max
  Coding DNA Sequence Number=SeqID_22081
MQQPILGCPSQPLNIHGITLKGKQDENCEQLFTPMIGQWNKQVDFRVDETLQYMVSPQGRNTWTVDDLVPYVEKITILLKEQERITEPVSHGPASEHQFPAQEFHILQSSVETQGIGRRR

SEQ ID NO: 138860 - protein, 161 aa, Glycine max
  Coding DNA Sequence Number=SeqID_22082
MGKQSTQFSALNYIHLALDLDAIFFISHKCLESPLQLCVCCTMKGNEFIPAGFPVGPWDDSAIMSDNMTGLKRFRDEDVKPFSGLNAPESQVEYHWTKACAFSPLQIVFSVAMGVIFLGHTLHVGSGGGLAEFAVAKKNILINAALGGVGHYALQRAKLGR

SEQ ID NO: 138861 - protein, 121 aa, Glycine max
  Coding DNA Sequence Number=SeqID_22083
MGVKYLEVVKRRFHATKQWSPDEIRDHQVFELVMVLSVRLQLSQSTRSTRLSKLVEMKGAFHPQLVKVFYSYALVDLEGNLSSTINGVEIVIDAIVWKEVAGLDMGGVHKFYETTDGYNKM

SEQ ID NO: 138862 - protein, 65 aa, Glycine max
  Coding DNA Sequence Number=SeqID_22084
MKERLNHVCFSRKGECAYENGDLAAEDWDKLKGLEEAISKFIKREYNDLPLAHERILSPAIAQAF

SEQ ID NO: 138863 - protein, 165 aa, Glycine max
  Coding DNA Sequence Number=SeqID_22085
  Gene Ontology: Mol. function=manganese ion binding; Cellular component=mitochondrion
  Homolog annotation: Hit_ID=Q9ZU95; Match level="QueryCoverage=98%, HitCoverage=89%, E-value=1e-62, Identity=68%"; Hit description=Nudix hydrolase 17, mitochondrial precursor
  Pfam annotation: Domain name=NUDIX; Domain location=20-156; Score =66.2; E_value=1.1e-16; Accession=PF00293.18; Description=NUDIX domain
MPCMVSRTGREMQRYNSSGGRQVVGCIPYRYKEDSDGNVSNELEVLMVSSQKSQALMFPKGGWELDESVEEAACRESLEEAGVTGFVQHELGQWSFISKRHGTYYEGHMFPLLVEEQLDSWPEKDLRRRIWMSVNEAREVCQHWWMKEALDILVERLTLQQNRNI

SEQ ID NO: 138864 - protein, 111 aa, Glycine max
  Coding DNA Sequence Number=SeqID_22086
  Subcellular localization annotation: CTP_CleavageSite=53; ConfidenceScore=5.27e-01
MEHATRDTARCTRQQQGSAPASGSALPLGAAGSAQRVGATGVWVVPASGALPVAPTRWALPVAPSGRALPDVPASGSLPCRCLVRRTVPRVACSMEAPSWGALCNKKTDPQ

SEQ ID NO: 138865 - protein, 498 aa, Glycine max
  Coding DNA Sequence Number=SeqID_22087
  Gene Ontology: Mol. function=zinc ion binding; Cellular component =intracellular
  Homolog annotation: Hit_ID=Q10E42; Match level="QueryCoverage=60%, HitCoverage=66%, E-value=2e-55, Identity=36%"; Hit description=Zn -finger in Ran binding protein and others containing protein, expressed
  Pfam annotation: Domain name=zf-RanBP; Domain location=244-273; Score= 36.6; E_value=8.8e-08; Accession=PF00641.9; Description=Zn-finger in Ran binding protein and others
  Pfam annotation: Domain name=zf-RanBP; Domain location=288-316; Score= 30.5; E_value=5.8e-06; Accession=PF00641.9; Description=Zn-finger in Ran binding protein and others
  Pfam annotation: Domain name=zf-RanBP; Domain location=321-350; Score= 29.0; E_value=1.7e-05; Accession=PF00641.9; Description=Zn-finger in Ran binding protein and others
  Pfam module annotation: Pfam domain module=zf-RanBP::zf-RanBP::zf -RanBP; Domain location=244-273::288-316::321-350
ATFTLARRYFVSNEVEKDPGWRWRLEEEPSGFVDKEEEEQESALQISHPWPEWLQLMKCLHDKGHFSHEERNINAAMGAKDCNVVRTACLNFGRDHFHILRKHDLHRSYFENDFVLRFLSRKDIGVTVALGCPSLDRKVINSGKRLRAYIGIDEGNAREDEGGRTVDIMRIVLTYGLDPINGSVENKPCLTKRVEESVRRLLKEIVEHSNKEENSNFPDSTEVVTGHVHPNEQDKGKIDVSKMKQGDWLCPKCNFMNFARNIRCLRCDSFFEERIKQLKEDNNHMPLKKGDWICNKCNFLNFAKNTRCLQCKERPSNRQINPGEWECDSCNYVNFRRNMVCLKCDHRRPIVSKASSFSFEPQPEDLDHYKNSKFSFVARQGDRIDETPMVFERKNRNRDSPKWRFVEDRNENNKCLNKSNDSSEFIDFPIVGGKTHLTKVQRREAYKTELPNQCRRPSWQSETENEFCSSDNLSTDDEFCSVNNQSTDDEEMDEWFGK

SEQ ID NO: 138866 - protein, 221 aa, Glycine max
  Coding DNA Sequence Number=SeqID_22088
  Gene Ontology: Mol. function=hydrolase activity; Biological process =metabolic process
  Homolog annotation: Hit_ID=Q1H125; Match level="QueryCoverage=37%, HitCoverage=18%, E-value=1e-32, Identity=83%"; Hit description =Luciferase-like protein
STLEDPTGKGRFLQQLELARRENLTIRQLVLKFRVARGHLQAIGSVNTVADLIEEWFVEKGADGFNVVPPLLPQGFEDFTRLVVPELQRRDSEHIVNRVFAAMLNKAGVPITLDHLFEKFMGYSLEQCLAMIHQQYGIALGADFVTEYKVQRDLALAKHIKAVEGVEQLICRLCRPFCVASNSDAQKVHTMLTLTGLIDHFAGRYSVRPIWPNQSLRLMCI

SEQ ID NO: 138867 - protein, 87 aa, Glycine max
  Coding DNA Sequence Number=SeqID_22089
SPTGNIVPLDLEIEATLRRNRAERRRKLLQDRKIASILEEEAQSSDSTSSDSLSSRESAIYLPEASVMADEHHKRVILEDYSSSSVS

SEQ ID NO: 138868 - protein, 64 aa, Glycine max
  Coding DNA Sequence Number=SeqID_22090
MEWLHQHKKTSRSSCVRLIIKGVLFLCEVKDDLVPSNPTVKVYMAVFSLMAEMVAPKVIDFIGG

SEQ ID NO: 138869 - protein, 230 aa, Glycine max
  Coding DNA Sequence Number=SeqID_22091
MVIDQSLFHNLTQLSSDGVPFEGTLNDDWKFDFSAYDARQLVFTNHADMIGRLLAGSLAFESHILHYLIVHILLPRSSNLAQVSEEDLVIMWAFHIGRQLDWAHLVRYRMHKALRLNAPLPYPHLVTLFLRHFQIPLHSEPYVPIKRSFLIGAAVIASFGYHKEHDGSWVKKGAQPADDEGNLPVEDNSSLLRRLLDKFDGLRTFVGGKFDAMELQVDMRFDAMDSRITK

SEQ ID NO: 138870 - protein, 305 aa, Glycine max
  Coding DNA Sequence Number=SeqID_22092
  Gene Ontology: Mol. function=transporter activity; Cellular component= integral to membrane; Biological process=transport
  Homolog annotation: Hit_ID=Q2L1N2; Match level="QueryCoverage=60%, HitCoverage=45%, E-value=2e-72, Identity=71%"; Hit description =Probable transporter
  Pfam annotation: Domain name=MFS_1; Domain location=20-305; Score= -30.8; E_value=0.0081; Accession=PF07690.6; Description=Major Facilitator Superfamily
QASPLRELSALTRKQVLLTLAIGAIGSGGMFSVFSYVKPTMMELAHLPENLVPAILALFGLGMIIGNLVGGRLADRGLEKTIRIVLVWSLLVLSAFVFAAHYALAGALNVMLVGTMVALGSVLQIRLMDVAGDAQTLAAALNHSAFNIANALGAWLGGITISAGLGWQSTGWVGAILSVLGLLIHAVATSAVVTAGRHYSRITAGAVSCCRRLADAAAPQCAKSGAVAAAKQRCASGIPAQSCQGRVRYRVFQPGTVPVIGRFAIAGGNPHAPDYGVPVRSLALEFQLAHGEQWRTGMNALPFFP

SEQ ID NO: 138871 - protein, 379 aa, Glycine max
  Coding DNA Sequence Number=SeqID_22093
  Pfam annotation: Domain name=WRC; Domain location=185-235; Score=5.0; E_value=0.057; Accession=PF08879.1; Description=WRC
  Subcellular localization annotation: CTP_CleavageSite=57; ConfidenceScore=5.36e-01
ILSEFSTSHATQLKSLRMTLLPFTLLGSKWDPIKIRKNAKLSPLLFSSSLSSSSSSSCVQGGSVPLESHVCQLNQSPWDVIPFDSDSIQVPSLSQSLHSIRYFIILVIPRPRLDLYALTHLGFSLFRLRFKLDDNFTAGNNNGSAVNSFAAVQSVASMMDAGNKTTCHSTVMVDLVAPTNIDATVNMTNPCQFHDDKGWPCKNEAGQGQSFCEQHLSYSLLTPLHHTSSKKSQPSATGTRRGKTRGAAGKKAAAVAAAGASSNPYEFYYYSGFGPSWSKRRGDRNGGGEGSKNNSVGVENSTMVESENVVGGGADDVVDDINGNVASVEVVPSVSEMEHDGIIDYVDDDEEEEEEEVLDDSGKKRMRKPVKARSLKSLM

SEQ ID NO: 138872 - protein, 133 aa, Glycine max
  Coding DNA Sequence Number=SeqID_22094
MAHQRIMRTSMTPLTQIWMTLLLSNILPSDHNSDLPLPKCQLVYAILTQAGAGLGTTAAREGPVAGSCKCTAVISRVHLCSPTEFEAAVAWPGDWPNSQTGARLAGTSRDGDGAEQDDGMADVMDFFLGGGGL

SEQ ID NO: 138873 - protein, 229 aa, Glycine max
  Coding DNA Sequence Number=SeqID_22095
  Gene Ontology: Mol. function=shikimate 5-dehydrogenase activity; Cellular component=cytoplasm; Biological process=aromatic amino acid family biosynthetic process, shikimate pathway
  Homolog annotation: Hit_ID=Q8ZEX9; Match level="QueryCoverage=100%, HitCoverage=54%, E-value=1e-110, Identity=88%"; Hit description =Glutamyl-tRNA reductase
  Pfam annotation: Domain name=GlutR_N; Domain location=6-157; Score =291.4; E_value=1.8e-84; Accession=PF05201.5; Description=Glutamyl -tRNAGlu reductase, N-terminal domain
  Pfam annotation: Domain name=Shikimate_DH; Domain location=161-229; Score=10.6; E_value=4.1e-05; Accession=PF01488.10; Description =Shikimate  quinate 5-dehydrogenase
  Pfam module annotation: Pfam domain module=GlutR_N::Shikimate_DH; Domain location=6-157::161-229
MTLLALGINHKTAPVSLRERVTFSPESIDEALTSLLQQPLVQGGVVLSTCNRTELYLSVEQQEHMHEQLVAWLCAYHNLRPEEVKKSLYWHQGNDAVSHLMRVASGLDSLVLGEPQILGQVKKAFAESQRGQSLSGELERLFQKSFSVAKRVRTETDIGASAVSVAFAACTLARQIFESLADLNVLLVGAGETIELVARHLREHKVRHMIIANRTRERAQLLADEVGAE

SEQ ID NO: 138874 - protein, 110 aa, Glycine max
  Coding DNA Sequence Number=SeqID_22096
MLVATPGVSLPWKTHREPHVALPPKEPNHNTMEEIHGEEDEEQGIKVNCPNKKIEEATKHHLEENALIPHDVAPCRVCRPWIFFINGVLCFLKINGSKMEMPLQGEDEKR

SEQ ID NO: 138875 - protein, 76 aa, Glycine max
  Coding DNA Sequence Number=SeqID_22097
  Gene Ontology: Mol. function=metal ion binding
  Homolog annotation: Hit_ID=Q9XF92; Match level="QueryCoverage=78%, HitCoverage=43%, E-value=3e-16, Identity=67%"; Hit description=BRH1 RING finger protein
RRLRRWRPTKRLVRSVPVRVLRGGGGSVPAQLQAHFPPHMRGPTPFVPDDMLDDYNQRLWAASGVNEFYADYTSSF

SEQ ID NO: 138876 - protein, 62 aa, Glycine max
  Coding DNA Sequence Number=SeqID_22098
MACIMFNYGHKQLEQVLVHAGHWSARGMLCHRLIDTFQCAIIKNHINNTRELFLEGQDKQVS

SEQ ID NO: 138877 - protein, 230 aa, Glycine max
  Coding DNA Sequence Number=SeqID_22099
  Gene Ontology: Mol. function=protein binding; Cellular component =integral to membrane; Biological process=xylan catabolic process
  Homolog annotation: Hit_ID=Q6ZIU0; Match level="QueryCoverage=96%, HitCoverage=66%, E-value=5e-30, Identity=30%"; Hit description =Putative HcrVf3 protein
  Pfam annotation: Domain name=LRR_1; Domain location=114-136; Score =13.8; E_value=0.64; Accession=PF00560.23; Description=Leucine Rich Repeat
  Pfam annotation: Domain name=LRR_1; Domain location=138-161; Score =8.2; E_value=8.3; Accession=PF00560.23; Description=Leucine Rich Repeat
  Pfam annotation: Domain name=LRR_1; Domain location=163-185; Score =9.8; E_value=4.1; Accession=PF00560.23; Description=Leucine Rich Repeat
  Pfam annotation: Domain name=LRR_1; Domain location=187-209; Score =10.0; E_value=3.8; Accession=PF00560.23; Description=Leucine Rich Repeat
  Pfam annotation: Domain name=LRR_1; Domain location=3-25; Score=13.5; E_value=0.76; Accession=PF00560.23; Description=Leucine Rich Repeat
  Pfam annotation: Domain name=LRR_1; Domain location=43-65; Score=0.4; E_value=2.4e+02; Accession=PF00560.23; Description=Leucine Rich Repeat
  Pfam annotation: Domain name=LRR_1; Domain location=67-89; Score=2.3; E_value=1e+02; Accession=PF00560.23; Description=Leucine Rich Repeat
  Pfam annotation: Domain name=LRR_1; Domain location=90-111; Score =0.7; E_value=2.1e+02; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=114-136::138-161::163- 185::187-209::3-25::43-65::67-89::90-111
MTSLEDLYLFDNKLQGKIPASLGNICVSINRQLSVSTWIPPFQLFTLGIASCKLGPSFPSWLQTQSCLSFLDISDAGIDDFVPDWLWNKSIGEMNMSFNSLKGRIPQFMGTLVNLEALVLRNNNLIGELPLTLKNCTRLVILDVSENLLSGPITSWTGESLQQLEILSLRVNHFFGSVPVLLCNLRQIHLLELSRNHLSGEIRSCLRNFTAMMESGGEIASERRMLRKRI

SEQ ID NO: 138878 - protein, 77 aa, Glycine max
  Coding DNA Sequence Number=SeqID_22100
  Gene Ontology: Mol. function=protein binding
  Homolog annotation: Hit_ID=Q6JN47; Match level="QueryCoverage=67%, HitCoverage=5%, E-value=1e-10, Identity=52%"; Hit description=EIX receptor 1
MKHVYKTSFIVALNAFPFATISVIVTVPPRRQHARVIYEALFEVEECFSLTIYALLLETQWNPRMDPAACNKSSTNA

SEQ ID NO: 138879 - protein, 358 aa, Glycine max
  Coding DNA Sequence Number=SeqID_22101
  Gene Ontology: Mol. function=oxidoreductase activity; Cellular component=proton-transporting two-sector ATPase complex; Biological process=ATP synthesis coupled proton transport
  Homolog annotation: Hit_ID=Q2HTD9; Match level="QueryCoverage=96%, HitCoverage=95%, E-value=2e-84, Identity=43%"; Hit description=2OG -Fe(II) oxygenase
  Pfam annotation: Domain name=2OG-FeII_Oxy; Domain location=208-308; Score=134.1; E_value=3.8e-37; Accession=PF03171.10; Description=2OG -Fe(II) oxygenase superfamily
MWCWEVIKINALTKVDETKVGVKGLIDSGIRTIPPFFVHPPETLADLKRGAEPGSVQEIPTVDLAGVEDFRAGVVEKVRLAASTVGFFQVVNHGIPEELLRRTLAAVKAFHEQPAEERARVYRRDIGKGVSYISNVDLFQSKAASWRDTIQIRMGPTVVDSSEIPEVCRKEVMEWDKEVVRVARVLYALLSEGLGLGAERLTEMGLVEGRVMVGHYYPFCPQPDLTVGLNSHADPGALTVLLQDHIGGLQVETKQGWIHVRPQPNALVINIGDFLQIISNETYKSAHHRVLANYSNEPRVSVAVFLNPSDRVRLFGPLPELTSTEKPALYRNFTFDEFMKRFFTKELDGKSLTNFFRQ

SEQ ID NO: 138880 - protein, 1135 aa, Glycine max
  Coding DNA Sequence Number=SeqID_22102
  Gene Ontology: Mol. function=zinc ion binding; Cellular component =membrane; Biological process=defense response
  Homolog annotation: Hit_ID=Q9FHX1; Match level="QueryCoverage=99%, HitCoverage=98%, E-value=0.0, Identity=63%"; Hit description=TMV resistance protein-like
  Pfam annotation: Domain name=DZC; Domain location=1074-1109; Score =89.0; E_value=1.4e-23; Accession=PF08381.1; Description=Disease resistancezinc fingerchromo
  Pfam annotation: Domain name=FYVE; Domain location=612-680; Score =50.3; E_value=6.7e-12; Accession=PF01363.12; Description=FYVE zinc finger
  Pfam annotation: Domain name=RCC1; Domain location=286-335; Score =10.2; E_value=0.056; Accession=PF00415.9; Description=Regulator of chromosome condensation (RCC1)
  Pfam annotation: Domain name=RCC1; Domain location=338-390; Score =20.9; E_value=0.0039; Accession=PF00415.9; Description=Regulator of chromosome condensation (RCC1)
  Pfam annotation: Domain name=RCC1; Domain location=393-442; Score =20.6; E_value=0.0042; Accession=PF00415.9; Description=Regulator of chromosome condensation (RCC1)
  Pfam annotation: Domain name=RCC1; Domain location=456-505; Score =26.6; E_value=8.9e-05; Accession=PF00415.9; Description=Regulator of chromosome condensation (RCC1)
  Pfam annotation: Domain name=RCC1; Domain location=508-557; Score =18.8; E_value=0.0066; Accession=PF00415.9; Description=Regulator of chromosome condensation (RCC1)
  Pfam annotation: Domain name=RCC1; Domain location=562-609; Score =19.1; E_value=0.0061; Accession=PF00415.9; Description=Regulator of chromosome condensation (RCC1)
  Pfam module annotation: Pfam domain module=DZC::FYVE::RCC1::RCC1::RCC1 ::RCC1::RCC1::RCC1; Domain location=1074-1109::612-680::286-335::338 -390::393-442::456-505::508-557::562-609
MTHHHMKALIALKKGAQLLKYGRKGKPKFCPFRLSNDESSLIWITSSGERNLKLSSVSRIIPGQRTAVFQRYLRPEKDYLSFSLIYSNGKRSLDLICKDKAEAEVWIAGLKALISSGQGGRSKIDGWSDGGLILNDSRDLTSNSPSESSASTSRGISSPDISSTLPNTSPKSYRPDNTISERSHASPDPTNMQVKGSASDVFRVSVSSAPSTSSHGSAPDDYDALWDVYIWGEVTCENVKVGADKNVNYFSPRADVLLPRPLESNVVLDVHHIACGVRHASLVTRQGEVFTWGEESGGRLGHGVGKNVVQPRLVEALISTTIDFVACGEFHSCAVTMAGELYTWGDGMHNAGLLGHGSNVSHWIPKRIAGPLEGLQIAFVACGPWHTALITSTGQLFTFGDGTFGVLGHGDRQNVSYPREVESLLGLRTIAVACGVWHTAAVVEVIATHSGTSISSGKLFTWGDGDKNRLGHGDKEARLKPTCVSALIDYNFHKIACGHSLTVGLTTSGRVFTMGSTVYGQLGSSLSDGKVPCLVGDKIAGESIEEIACGAYHVAVLTSKNEVYTWGKGANGRLGHGDIEDRKTPALVEALKDRHVKYIACGSNYSAAICLHKWVSGAEQSQCSTCRQAFGFTRKRHNCYNCGLVHCHSCSSRKALRAAHAPNPGKPYRVCDSCYAKLNKVAEACNSNRRNALPRLSGENKDRLDKSDLRLSKAVIPSNMDLIKQLDSKAAKQGKKGDTFSLIRPSQPPSLLQLKDVVLSTALDLRRTVPRPVVAPSGVSSRSVSPFSRRSSPPRSATPIPTTSGLSFSKSISDSLKKTNELLNQEVQKLHAQVESLRQRCELQELELQRSAKKTQEATALAAEESGKSKAAKEVIKSLTAQNKLPHISLILLCFHTYTYCSLTFSQLKDLAEKLPPGVYDAENIRPAYLPNGLEPNGIHNPDSNGEQHSRAESIIGSSLDSMGLESALLNKTAGNSPGTYGTNLHQKIRSPVSSNGTNNYPGVKLPNGGGVIQASSGTVSDTADGRDSGNFHDDESGLKSRNAAPTADGNQVEAEWIEQYEPGVYITLVALHDGTRDLKRVRFSRRRFGEHQAETWWSENRDRVYERYNVRSTDKSANQAARSSKGAGSPVSQT

SEQ ID NO: 138881 - protein, 140 aa, Glycine max
  Coding DNA Sequence Number=SeqID_22103
LLNPELFWHNPGTLVRYGIVDPGKNKHQIDARTKFEDTTTYLQQRSGFIDKGGVASLVEQRVRCRKGVANGCYNGRSGTMQGKHKTTGSWKDKGGSNNLNMSLKSPKNNITKTIGLCFATGLKQGLFNRNTNNEALRKDK

SEQ ID NO: 138882 - protein, 246 aa, Glycine max
  Coding DNA Sequence Number=SeqID_22104
  Gene Ontology: Mol. function=nucleic acid binding
  Homolog annotation: Hit_ID=Q8H0P8; Match level="QueryCoverage=99%, HitCoverage=82%, E-value=3e-74, Identity=63%"; Hit description=RNA -binding protein
MTDGYWNRQQTLLSQSGMLKRPHSDYVRILVARRPKLNYMGIPMICLLPVCLSGNEMHNNFARDDDRTGHRMLKDTKTIGSAYDRYLQSGQLSSFTSGEASTVGGLGLARGGGGLSDHSLADPSVMGRHGGGGPDLAPNGRGVNYGGQLPVDAVSRPGPETVPLPPDASSTLYVEGLPSDSTRREVALIHIIFINITLDIFRPFVGYREVRLVSKESKHRGGDPHYLCFVDFANPACAATAMSALQ

SEQ ID NO: 138883 - protein, 423 aa, Glycine max
  Coding DNA Sequence Number=SeqID_22105
  Gene Ontology: Mol. function=ubiquitin-protein ligase activity; Cellular component=ubiquitin ligase complex; Biological process =protein ubiquitination
  Homolog annotation: Hit_ID=Q9AR60; Match level="QueryCoverage=90%, HitCoverage=93%, E-value=3e-62, Identity=39%"; Hit description =Photoperiod responsive protein
  Pfam annotation: Domain name=U-box; Domain location=12-86; Score =66.2; E_value=1.1e-16; Accession=PF04564.6; Description=U-box domain
MAKVRDQKLYVTVPSLFRCPISMDVMRSPVSLCTGVTYDRASIQRWLDSGHDTCPATLQVLPSKDFIPNLTLHRLIRLWLLSSSAAEPFSPSSADHLRPLLRKIHTSDDDLAGTLSIIAEFSLKSGEKRRSLATFPGFDSALVRALAGSNSLIDAAENSIYLLDSVFRENGEKIRKLILDAREECFSSMVFVLRNGSMKSKIETVRILEFLSCDFQSSKLVAETRGLLPLVASFLKDGVEELNDAVLSLLGVVSVTHSAKMELVSSGIVEVVTKLLRACSAATAERCLRMLAILATCAEGRAAMAVEPSLAAAVVERITKAPKAAAADAVAVLWSLCCLCGNVKVRDDVAKRNGVVVVLLVMQRGWEEHVRSMCVDLIKVLKGPACKNGKGEIMGKVRGRKVENGGKEGGTIDEKGREGGSIV

SEQ ID NO: 138884 - protein, 86 aa, Glycine max
  Coding DNA Sequence Number=SeqID_22106
VPEGAGAGVGAGGASGAEVGGAEEEGAEVSDGSRALALRVHGNVIVGSSGFQQFFLMYAKLMAGLRDSKSRRSKNLEQLPGRCIRQ

SEQ ID NO: 138885 - protein, 168 aa, Glycine max
  Coding DNA Sequence Number=SeqID_22107
MVRLMKQANVFPLKKTIKKFTIWEINRDKDILKEDSQASSKVLITNKDSGDHTLTIKFNKDQGGPSNRPIPQGPNIFQRMTKLEETLTQFMQIADKSSNSFRANTEKNPKEECKAVMTRSKWFVEAEDEDSVVSKKKAVEKKGNDEKKDDVRGESNQEKEKQIMVKKK

SEQ ID NO: 138886 - protein, 451 aa, Glycine max
  Coding DNA Sequence Number=SeqID_22108
  Gene Ontology: Mol. function=transporter activity; Cellular component= membrane; Biological process=transport
  Homolog annotation: Hit_ID=Q6D0N4; Match level="QueryCoverage=80%, HitCoverage=77%, E-value=1e-146, Identity=69%"; Hit description =Probable sodium:solute symporter
  Pfam annotation: Domain name=SSF; Domain location=126-451; Score= -81.3; E_value=5.7e-06; Accession=PF00474.8; Description =Sodium:solute symporter family
MVRCGARSGDWRCRHSGGRGAVDGAVPSSAQTAETGKRQSRLTFAAAWHGGRGRARTQRRNNNNHGRLINGACEARHAPRPYVINEANMKQFSAEGMVIIVGIVIAYILFTTWLTWRLRSKNSGDFMAGSNVMPAFVVGVMLMSEYIGAKSTIGTAQAAFEDGFAASWSVIGAAIGFPLFGILLVKRIYNTGKITISGAIAERYGNSTKNIISIIMIYALLLVNVGNYVSGAAAISTVLNLDLTTAAVITALVSTFYFMFGGMKGIAWVTLLHSGLKYIGILVILGVALHMTGGVSPMIKEMPHFYWTWDGNVGASTIFAWMIGTIGSIFCTQFVIQAIASTKSAASAKRATWVAFFFCMPIAIAIALIGVAAKYLHPEINSLYALPVFLQDMSPWLAGIVTTSLVASIFVSVSTVALAIASLVVKDFYVPYRNPTPEREFRMTRWLSLLI

SEQ ID NO: 138887 - protein, 317 aa, Glycine max
  Coding DNA Sequence Number=SeqID_22109
  Gene Ontology: Mol. function=hydrolase activity
  Homolog annotation: Hit_ID=Q8FJX1; Match level="QueryCoverage=89%, HitCoverage=73%, E-value=1e-121, Identity=73%"; Hit description =Hypthetical protein
  Pfam annotation: Domain name=BNR; Domain location=137-148; Score=6.9; E_value=15; Accession=PF02012.10; Description=BNRAsp-box repeat
  Pfam annotation: Domain name=BNR; Domain location=197-208; Score=9.6; E_value=6.7; Accession=PF02012.10; Description=BNRAsp-box repeat
  Pfam annotation: Domain name=BNR; Domain location=245-256; Score =14.5; E_value=0.38; Accession=PF02012.10; Description=BNRAsp-box repeat
  Pfam module annotation: Pfam domain module=BNR::BNR::BNR; Domain location=137-148::197-208::245-256
MHLIHQCKTVEPDMTDSTITVERNGKLHPHAQDAQQLTAMLPSVCPQNHAANLLPLPNGDLLCVWFGGTQEGIADISVWCSRLAQGSAQWSDPRQLSDDPARSEQNPVLFLDPEGVLWLLWTAQKSGNQDTAIVRYRQSHDLGHSWSAIDTLLDQPGTFIRQPLVILPNGNWLLPVFYCRTQPGVKWVGNDDISAVKISSDKGQSWRDVVVPDSLGCVHMNITLLQDGSLLALYRSRWADYIYQSRSDDGGESWSAPQATDLPNNNSSIQVTTLHNGHLALVFNAMSARDASERRLSLYDEIEDEDDAAVDVAAQPV

SEQ ID NO: 138888 - protein, 154 aa, Glycine max
  Coding DNA Sequence Number=SeqID_22110
MGDYPVAGVQSTERQRGNQIRDGTGGIGQQSDAEPPDNWKNRIFCAVRLQPPVTTPARYSAAQNRAGATAWPATIFFDEKATYTFFLPAAHWLAGQTPWWTAVNPDKYRDNGEPQTVDSIPARAYPHRHNESGRFPPARRAYNHDRHGPAWSGY

SEQ ID NO: 138889 - protein, 68 aa, Glycine max
  Coding DNA Sequence Number=SeqID_22111
MTSSLRPRATALALALLAAMSLSACQAPAKKSVAPAAAAKPAAAEKVQQRELGDGLYEMAYVPGDPAA

SEQ ID NO: 138890 - protein, 325 aa, Glycine max
  Coding DNA Sequence Number=SeqID_22112
  Gene Ontology: Mol. function=transferase activity
  Homolog annotation: Hit_ID=Q7N2Q8; Match level="QueryCoverage=79%, HitCoverage=81%, E-value=3e-35, Identity=32%"; Hit description =Similar to putative galactosyl transferase or beta- glucosyltransfera se
  Pfam annotation: Domain name=Glycos_transf_2; Domain location=9-184; Score=95.4; E_value=1.7e-25; Accession=PF00535.16; Description =Glycosyl transferase
MMVPDYLISVLLTAHNSEKFLPDTLASLEKACHGVEQYIEFILINDASVDNTAALLDDFSRRHPQAKVFNIDYRNIGRVRNFGVQQCSGEYITMLDGDDQLLADALADIVRYLKSHRPDALFTALNEVYESRPQHITWQGLQAETLSRHQAIEKFLIHRDLQAHFIGQFIKRTMLLAHPFPDYTCYEDAWLFPEILVSSDAIAYSRQSPYLYFKRGNSLSSQLDKHKISLLVSATQHMDEVLQARYRNLLSCHWINIAHKHRQALDNPDDRKQGKCASDPLQRKRFKEIIVQVIHDVFIRFGIVALMLRDVFPCFCRALIRTLPQ

SEQ ID NO: 138891 - protein, 91 aa, Glycine max
  Coding DNA Sequence Number=SeqID_22113
MEEKVKLKISGGLRSTYLKLLCSDTTCWKLAYEASMEARSLSFNKILQWRSFTTKRVTWIRSLKRKLQWRKRIPEREGEEGGGRGVGIEGD

SEQ ID NO: 138892 - protein, 72 aa, Glycine max
  Coding DNA Sequence Number=SeqID_22114
  Homolog annotation: Hit_ID=Q3KBE1; Match level="QueryCoverage=98%, HitCoverage=9%, E-value=2e-18, Identity=59%"; Hit description=Type II and III secretion system protein precursor
  Subcellular localization annotation: CTP_CleavageSite=34; ConfidenceScore=5.07e-01
MPSSVSAARRPGRCACSRSGRGSGAGRRRGHAPRAGAGTPSGWSWSACAYHCGTAPPAPGSYPGPAPHHGHG

SEQ ID NO: 138893 - protein, 90 aa, Glycine max
  Coding DNA Sequence Number=SeqID_22115
MDILTPGQGHADEGAHYLLTPNHKVNEKRTKWCGDLGHVAPFPPKKPSKFVISSSLRASSASPGDPAGASPVWASGQSSGQTTSALNCSG

SEQ ID NO: 138894 - protein, 82 aa, Glycine max
  Coding DNA Sequence Number=SeqID_22116
MVAPPDSIPSVEQFNEWVAWPGTQSSLHREDEEPLVRRKKADQTQEAAATSEKSLEATFEPSEPVADIASLQQAADPSTPED

SEQ ID NO: 138895 - protein, 296 aa, Glycine max
  Coding DNA Sequence Number=SeqID_22117
  Gene Ontology: Mol. function=transferase activity; Biological process= biosynthetic process
  Homolog annotation: Hit_ID=Q11EC2; Match level="QueryCoverage=61%, HitCoverage=42%, E-value=7e-71, Identity=66%"; Hit description =Glycosyl transferase, group 1
MTRRLFADRYATCRGGGNRINRGMIDLAFLQAVEIRQPDDGAARQTRWIDDLSANPGWLVFYTHDISDTPTEFGCRPETFERLVSHAVKSGATILSVREAVARLEAHPERRETIGWQAAPFAMQHPDNFPSDWSSYFVSEIEYGRESSPFTKVVQAGKIIYSWEARDRIKALIEHFRPNVAHAHNIYHHLSPSIFPVLKDAGIPTVMTAHDLKLACPAYKMLSHNQICERCKGGRIYNVALHKCIKDSTALSGLVFVETAIHRMLGLYRNTLDRIVVPSRFYIAKLAEWGWPEEKL

SEQ ID NO: 138896 - protein, 127 aa, Glycine max
  Coding DNA Sequence Number=SeqID_22118
MEVTSLQKLGQKMDQMHFDSDKMKERVLRCPYRTCAKAKVMSEIEELQEWMKADMEAMKEQMITMMEAMMSMRKLVEANMATVVVTSTATEVDPTHPSGLKQVNRLASDMVGQGGEALGSAGDPHFV

SEQ ID NO: 138897 - protein, 124 aa, Glycine max
  Coding DNA Sequence Number=SeqID_22119
MGRLPPAMVEREKFDHIEERLRAIEGGEDYVFADMAELCLVPNVVIPLKFKVPDFDMYKGTTCPKNHLRMYYRKMGAYSKDEKLLMYFFQETLTGAAITYSSSAPIDGKGDDNNDSGHATGVLL

SEQ ID NO: 138898 - protein, 158 aa, Glycine max
  Coding DNA Sequence Number=SeqID_22120
MGKLNHLEERLRAIEGGEDYAFANLEELSLEPNIITPPKLKELDFDKYKGTTCPKNHLKMYYRKMEACAKDEELLIHSFQENLTRVAVTWYTNLEPSRVHSWKDIMIAFIRQYQYSFDMVSDRMQLQNMCKKKAQIFQRIRPKVEKPGSSSGTSMKKK

SEQ ID NO: 138899 - protein, 111 aa, Glycine max
  Coding DNA Sequence Number=SeqID_22121
  Subcellular localization annotation: CTP_CleavageSite=34; ConfidenceScore=5.44e-01
MSNLSSSLNTNNHPNPLYPLWTARRALGSFFAISSSVVTILKLELLSLSMRMIGRQGAAVVILGSKGGIIKESIYLTILRVVLRVKVAVVCTVNDGYNGYSGSWCLGREND

SEQ ID NO: 138900 - protein, 68 aa, Glycine max
  Coding DNA Sequence Number=SeqID_22122
MIGESEPLPSALSCLFIGKEGTWLINSSPRRAGYFTPKFCGRARGQKRLPNDPFTLPFGYFPHSLLKR

SEQ ID NO: 138901 - protein, 303 aa, Glycine max
  Coding DNA Sequence Number=SeqID_22123
  Gene Ontology: Mol. function=protein serine/threonine kinase activity; Cellular component=membrane; Biological process=protein amino acid phosphorylation
  Homolog annotation: Hit_ID=Q9M0X5; Match level="QueryCoverage=94%, HitCoverage=42%, E-value=5e-44, Identity=37%"; Hit description =Receptor protein kinase-like protein
  Pfam annotation: Domain name=DUF26; Domain location=199-253; Score =91.9; E_value=1.9e-24; Accession=PF01657.8; Description=Domain of unknown function DUF26
  Pfam annotation: Domain name=DUF26; Domain location=81-139; Score =72.6; E_value=1.2e-18; Accession=PF01657.8; Description=Domain of unknown function DUF26
  Pfam module annotation: Pfam domain module=DUF26::DUF26; Domain location=199-253::81-139
MALNSFKHYPLFTFLMFTLTEASSDVPIFLRENCTTIETFISNTTFQFNLITLLSSLSSNATGNTQFYNTTLSGKSSSDTVYGLFLCRGDVPPQLCQQCVLNAIQRLSNQSSDTCKFAKSAIIWYDECLVRYSNRYFFSTVDTRPRMRLRNTANVSDTKSFLRLLYTTLNETADEAANSSNGAKLYATKQAKISGFQTLYCMTQCTPDLSPQDCRRCLSGVIGDLSWCCPGSQGGRVLYPSCNFRYELYPFYRMDSPAPEGIISPTHSTMDKGEAGKKGISSEIATATFVSITVAGLSWVFGS

SEQ ID NO: 138902 - protein, 623 aa, Glycine max
  Coding DNA Sequence Number=SeqID_22124
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=93%, HitCoverage=94%, E-value=1e-147, Identity=46%"; Hit description =Protein kinase
  Pfam annotation: Domain name=DUF26; Domain location=199-254; Score =49.5; E_value=1.1e-11; Accession=PF01657.8; Description=Domain of unknown function DUF26
  Pfam annotation: Domain name=DUF26; Domain location=87-141; Score =73.5; E_value=6.6e-19; Accession=PF01657.8; Description=Domain of unknown function DUF26
  Pfam annotation: Domain name=Pkinase; Domain location=303-572; Score =168.9; E_value=1.3e-47; Accession=PF00069.15; Description=Protein kinase domain
  Pfam annotation: Domain name=Pkinase_Tyr; Domain location=303-574; Score=134.6; E_value=2.7e-37; Accession=PF07714.7; Description =Protein tyrosine kinase
  Pfam annotation: Domain name=RIO1; Domain location=316-465; Score= -98.1; E_value=0.098; Accession=PF01163.12; Description=RIO1 family
  Pfam module annotation: Pfam domain module=DUF26::DUF26::Pkinase::Pkin ase_Tyr::RIO1; Domain location=199-254::87-141::303-572::303-574::316- 465
MGSFHLFLLLPTFFSLFLHTSPSPIIQAAIDQGTKAYYNCTRNSTFASYSAYRSNVKILLDFLSSNGTNNAKFYNTTVYSEDTADPVHGSFLCTRDTIPKQCQECVTQAAKLISSLCNNATEAIVWYQVCYVRYSDRRFFSTVEESPKLSFMNDQDYVGNVGRFNNIVWDMMNDLRSEAASASNKSADKSVNITDNQKAYGYVWCLPYLSGENCSWCLSDAIAEIPTGCCRGKSGGTIIYPSCGVRYELYQFHKAHIRGGSVSPPPLPNSSSSPFSSSVGNDSTTLETLRFELAKIEAATNRFAKENMIGKGGFGEVYRGILSDGKEIAVKRLTGSSRQGAVEFRNEVQVIAKLQHRNLVRLQGFCLEDDEKILIYEYVPNKSLDYFLLDTKKRRLLSWSDRQKIIIGIARGILYLHEDSCLKIIHRDLKPSNVLLDSNMNPKISDFGMARIVVADQIEESTGRIVGTYGYMSPEYAMHGQFSVKSDVFSFGVMVLEIINGKRKGCSSVSDGIDDIRRHAWTKWTEQTPLELLDSNIGGPYSPEEVIKCTHIGLLCVQEDPNDRPTMATVVFYLNSPSINLPPPHEPGYFKRDRIEGNKTTNKELDNISDSINGITLTNLFPR

SEQ ID NO: 138903 - protein, 660 aa, Glycine max
  Coding DNA Sequence Number=SeqID_22125
  Gene Ontology: Mol. function=protein serine/threonine kinase activity; Cellular component=mitochondrion; Biological process =protein amino acid phosphorylation
  Homolog annotation: Hit_ID=Q1T3J0; Match level="QueryCoverage=88%, HitCoverage=88%, E-value=1e-157, Identity=50%"; Hit description =Protein kinase
  Pfam annotation: Domain name=DUF26; Domain location=197-252; Score =79.9; E_value=8.1e-21; Accession=PF01657.8; Description=Domain of unknown function DUF26
  Pfam annotation: Domain name=DUF26; Domain location=79-133; Score =69.1; E_value=1.4e-17; Accession=PF01657.8; Description=Domain of unknown function DUF26
  Pfam annotation: Domain name=Pkinase; Domain location=334-605; Score =178.6; E_value=1.5e-50; Accession=PF00069.15; Description=Protein kinase domain
  Pfam annotation: Domain name=Pkinase_Tyr; Domain location=334-605; Score=139.1; E_value=1.2e-38; Accession=PF07714.7; Description =Protein tyrosine kinase
  Pfam module annotation: Pfam domain module=DUF26::DUF26::Pkinase::Pkin ase_Tyr; Domain location=197-252::79-133::334-605::334-605
  Subcellular localization annotation: CTP_CleavageSite=69; ConfidenceScore=5.76e-01
MIIRSKLSLTLFLLCTLSLTVTETSASVFNNVSCSSNKTFTPNSTFNTNLNTLLSYLSSNVTNNVRFFNATAGKDSNAVYGLYMCRGDVPFALCRECVGFATLTIASSCPTSKEAVIWYNECLLRYSYRLIFSKMEERPRHKINIPLGDPLVLHSNGFYTALGSIFDELPHKAALALAESNNGYAVKQENTSASVTLYGLAQCTPDLAAGDCIRCVTDAAAEFVKSCCGGSIGASVLFPSCIVRYETYPFYQHSGTSAPTMIKRGGNIGTEVIVIVVVLVVVLVMLFGFGYCFIRIKARKKRKAGDREKFGPEHTVLESLEFDLVTIEAATNNFSEDRRIGKGGYGEVYKGILPNREEVAVKRLSTNSKQGAEEFKNEVLLIAKLQHKNLVRLVGFCQEDREKILIYEYVPNKSLDHFLFDSQKHRQLTWSERFKIIKGIARGILHLHEDSRLKIIHRDIKPSNVLLDNGINPKISDFGMARMVATDQIQGCTNRVVGTYGYMSPEYAMHGQFSEKSDVFSFGVMVLEIISGKKNSCYFESCRVDDLLSYAWNNWRDESSFQLLDPTLLESYVPNEVEKCMQIGLLCVQENPDDRPTMGTIVSYLSNPSLEMPFPLEPAFFMHGRMRRHSAEHESSSGYSTNRSSLSSVNKMSTTAFFPR

SEQ ID NO: 138904 - protein, 143 aa, Glycine max
  Coding DNA Sequence Number=SeqID_22126
  Subcellular localization annotation: CTP_CleavageSite=51; ConfidenceScore=5.02e-01
MGSVFGGNSPMELASWTHGSSRWGTRSTGCDWGSGFEGRGGGRGLRGRVFKAARRASWDPTRPVALATTALTNAPARGARPKAPPRRAPTEAPALPTHPILKRSRQQCVQTCPTASHVMPHVTITGNALIEEALCSKKNRPVK

SEQ ID NO: 138905 - protein, 195 aa, Glycine max
  Coding DNA Sequence Number=SeqID_22127
  Gene Ontology: Mol. function=protein serine/threonine kinase activity; Cellular component=anchored to membrane; Biological process=protein amino acid phosphorylation
  Homolog annotation: Hit_ID=Q9M0X5; Match level="QueryCoverage=88%, HitCoverage=25%, E-value=2e-40, Identity=45%"; Hit description =Receptor protein kinase-like protein
RRGKAGNGGNVVKWKQFISDTTARKQDPCTSFAVTAIRKGTDGACEARVALRSGQIGRALRQCVELHGAREIRFFCSKLLTRIHGFPCRIVQRGRKNIVEPCVVRVRDARFVTEAKTWNYVVENGAVGVTQHTVVVPDYGLCLVGAEVCDIFGRGGDAVVTGGGGGVAAAEEESLDIVDGGAVESVVEGGAGDEG

SEQ ID NO: 138906 - protein, 399 aa, Glycine max
  Coding DNA Sequence Number=SeqID_22128
  Gene Ontology: Mol. function=protein serine/threonine kinase activity; Cellular component=mitochondrion; Biological process =protein amino acid phosphorylation
  Homolog annotation: Hit_ID=O65470; Match level="QueryCoverage=98%, HitCoverage=54%, E-value=1e-118, Identity=55%"; Hit description =Serine/threonine kinase-like protein
  Pfam annotation: Domain name=Pkinase; Domain location=27-340; Score =152.9; E_value=8.4e-43; Accession=PF00069.15; Description=Protein kinase domain
  Pfam annotation: Domain name=Pkinase_Tyr; Domain location=27-340; Score=132.4; E_value=1.2e-36; Accession=PF07714.7; Description =Protein tyrosine kinase
  Pfam module annotation: Pfam domain module=Pkinase::Pkinase_Tyr; Domain location=27-340::27-340
ADDLTDVGDVESLQFDLPTVEAATNRFSEENKIGQGGFGVVYKGVLPSGQEIAVKRLSVTSLQGAVEFRNEAALVAKLQHRNLVRLLGFCLEGQEKILIYEYIPNKSLDYFLFDPAKQKELDWSRRYKIIVGIARGIQYLHEDSQLRIIHRDVKASNVLLDENMNPKISDFGMAKIFQADQTQVNTGRIVGTYGYMSPEYAMRGQFSVKSDVFSFGVLVLEIVSGKKNTDFYQSNHADDLLSHVSINKSNFLSLLIPSLATMPSYISVGEERDIPGLNANIIQLQAWKNWTLQTPLELLDPTLRGSYSRNEVNRCIHIGLLCVQENPSDRPSMATIALMLNSYSVTMSMPQQPASFLRGRGPNRLNQGMDSDQSTTDQSTTCSIPWSVNEVSITDVYPR

SEQ ID NO: 138907 - protein, 645 aa, Glycine max
  Coding DNA Sequence Number=SeqID_22129
  Gene Ontology: Mol. function=protein serine/threonine kinase activity; Biological process=protein amino acid phosphorylation
  Homolog annotation: Hit_ID=Q9XED4; Match level="QueryCoverage=93%, HitCoverage=94%, E-value=0.0, Identity=53%"; Hit description =Receptor-like protein kinase homolog RK20-1
  Pfam annotation: Domain name=DUF26; Domain location=193-247; Score =77.5; E_value=4.3e-20; Accession=PF01657.8; Description=Domain of unknown function DUF26
  Pfam annotation: Domain name=DUF26; Domain location=80-134; Score =85.3; E_value=1.9e-22; Accession=PF01657.8; Description=Domain of unknown function DUF26
  Pfam annotation: Domain name=Pkinase; Domain location=345-594; Score =132.0; E_value=1.6e-36; Accession=PF00069.15; Description=Protein kinase domain
  Pfam annotation: Domain name=Pkinase_Tyr; Domain location=345-594; Score=122.0; E_value=1.7e-33; Accession=PF07714.7; Description =Protein tyrosine kinase
  Pfam module annotation: Pfam domain module=DUF26::DUF26::Pkinase::Pkin ase_Tyr; Domain location=193-247::80-134::345-594::345-594
  Subcellular localization annotation: CTP_CleavageSite=53; ConfidenceScore=5.12e-01
MGMAPSRLISLLFLLLTLISYTTAQPSFLYHFCTNDKGNYTANSSYQTNLNTLLSTLSSSNTQIDSGFYNFSEGQNSDKVNAIGMCRGDVKPDACRSCLNDSRVLLTQRCPNQKEAIGWYDDCMLRYSNRSIFETMEPNPTYFLWTQSNATDMDQFNEALRGLVDGLRSKAASGDSLKKYAAGSAAGPSFQTIFALLQCTPDLSEQQCNNCLVRAITDISSCCAGRTSGRIGKPSCNLRFDTSPFYDSAADASPPWSPPQAPSPPPPSDTNTAPSEGKSNTTQIVVAVVVPTVVILVLVISVCIFLRARKQRKNVDNDNEIDDEIEPTETLQFNFDIIRMATNNFSETNMLGRGGFGPVYKGKLSRGQEVAVKRLSMNSGQGDVEFKNEVQLVAKLQHRNLVRLLGFSLERKERLLVYEFVPNKSLDYFIFDPIKRAHLDWERRYKIIGGIAKGLLYLHEDSRLRIIHRDLKASNILLDAEMNPKISDFGMARLFLVDQTQGNTSKIVGTYGYMAPEYISQGQFSVKSDVFSFGVLVLEIAWKNWREGTASNLIDPTLNTGSRNEMMRCIHIGLLCVQGNLADRPTMASVALMLNSYSHTMPVPSEPAFFMHSRGLSDIQSREYNSGATESKSKSVKAYSSEEST

SEQ ID NO: 138908 - protein, 112 aa, Glycine max
  Coding DNA Sequence Number=SeqID_22130
  Gene Ontology: Mol. function=protein serine/threonine kinase activity; Biological process=protein amino acid phosphorylation
  Homolog annotation: Hit_ID=Q9XED4; Match level="QueryCoverage=94%, HitCoverage=20%, E-value=3e-19, Identity=40%"; Hit description =Receptor-like protein kinase homolog RK20-1
  Pfam annotation: Domain name=DUF26; Domain location=6-51; Score=32.1; E_value=5.6e-07; Accession=PF01657.8; Description=Domain of unknown function DUF26
MAMEIDVKPDECSKCLNDSKVLLTHRCPSQKEAIVGYDDCMLRYSNGSIFNTKETVPEYPLSNFNNATDVEEFNRVLRNLLDSLIGQMIQYQADLSEQDCSACLVDAIKGIP

SEQ ID NO: 138909 - protein, 49 aa, Glycine max
  Coding DNA Sequence Number=SeqID_22131
MYTKIRKIRLHLAKVAQKGGKKEEILKQAQSNRGAQRALGAKRATNWRR

SEQ ID NO: 138910 - protein, 228 aa, Glycine max
  Coding DNA Sequence Number=SeqID_22132
  Gene Ontology: Mol. function=protein serine/threonine kinase activity; Cellular component=anchored to membrane; Biological process=protein amino acid phosphorylation
  Homolog annotation: Hit_ID=Q9XED4; Match level="QueryCoverage=94%, HitCoverage=31%, E-value=1e-46, Identity=46%"; Hit description =Receptor-like protein kinase homolog RK20-1
  Pfam annotation: Domain name=DUF26; Domain location=196-228; Score =3.3; E_value=0.0024; Accession=PF01657.8; Description=Domain of unknown function DUF26
  Pfam annotation: Domain name=DUF26; Domain location=77-133; Score =54.8; E_value=2.8e-13; Accession=PF01657.8; Description=Domain of unknown function DUF26
  Pfam module annotation: Pfam domain module=DUF26::DUF26; Domain location=196-228::77-133
MVTQRASFYLCLLVILITQATAEPDDQYPVCLSRGGDYAPNSTYHTNLNTVLSRLTSNTQIDYGFYNSSYGQDSDRVYATGLCRGDVSRHTCLTCLNNSSFFLLKNCPHQKEAVGFGGYDKCILHYADQSMFSYQDSSFRFYFWEETNVTNWDQYSYVLNQLLSRLRVKAATSNSNLNRKFAAGNATVPTPSSQTIYAVVQCYPDLTAAECNDCLIGAFSEIPKNCNN

SEQ ID NO: 138911 - protein, 223 aa, Glycine max
  Coding DNA Sequence Number=SeqID_22133
MTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASASEAPLPTQSPSQPSQRPRHPPASTSASMDTHGQMLRWTPRSPLQRPIVSESPGQETSPPLTGGKSTSRVAEDPAVDEDLIADLATADWGPWADLGGGS

SEQ ID NO: 138912 - protein, 515 aa, Glycine max
  Coding DNA Sequence Number=SeqID_22134
  Gene Ontology: Mol. function=protein serine/threonine kinase activity; Cellular component=mitochondrion; Biological process =protein amino acid phosphorylation
  Homolog annotation: Hit_ID=Q9SVG2; Match level="QueryCoverage=99%, HitCoverage=84%, E-value=4e-98, Identity=35%"; Hit description =Protein kinase-like protein
  Pfam annotation: Domain name=DUF26; Domain location=334-388; Score =90.3; E_value=6e-24; Accession=PF01657.8; Description=Domain of unknown function DUF26
  Pfam annotation: Domain name=DUF26; Domain location=447-501; Score =87.0; E_value=5.8e-23; Accession=PF01657.8; Description=Domain of unknown function DUF26
  Pfam annotation: Domain name=Pkinase; Domain location=13-233; Score =28.4; E_value=3e-10; Accession=PF00069.15; Description=Protein kinase domain
  Pfam annotation: Domain name=Pkinase_Tyr; Domain location=13-233; Score=-40.3; E_value=5.4e-10; Accession=PF07714.7; Description =Protein tyrosine kinase
  Pfam module annotation: Pfam domain module=DUF26::DUF26::Pkinase::Pkin ase_Tyr; Domain location=334-388::447-501::13-233::13-233
FDFDTIRVATNNFSDANKLGQGGFGPVYSEERLLVYEFLPNKSLDKIIFDPIERAHLDWKKRHKIIEGIALGLLYLHEDSQQRIIHRDLKLSNILLDADMNPKISDFGFARLFNADQTLLNASKIAGTYGYMAPEYARHGKLSTKLDVFSFGVVILEIVSGKKNSGFRIGESVEHLLSFAWKNWTKGTADKIIDPALNNALRDEILRCIHIGLLCVQEKVADRPTMASVILMLDSHSFALPVPLQPAYFMKNSCLSVIQFSGCSSVETGSNEQKSDSADVSANEASISSLYPRRFTANNTYHTNLNTLLSNLTSNTGIDYGFYNLSYGENMDKVNAIGLCRGDVKPDECSSCLNNSTVLLTQLCPNQKEAIGWYDKCMLRYSNRSIYGVMETSPLFYLSEITNATDVDQFNQVLGNLMSNLTGIAASGNSLRKYAAANATAPNSQTIYGAAQCTPDLSEQDCNSCLVEAFSRITSCCIGNISGRVAAPSCNIRYENFRFYDEHEHATEDAPAPSL

SEQ ID NO: 138913 - protein, 383 aa, Glycine max
  Coding DNA Sequence Number=SeqID_22135
  Gene Ontology: Mol. function=protein serine/threonine kinase activity; Biological process=protein amino acid phosphorylation
  Homolog annotation: Hit_ID=O65470; Match level="QueryCoverage=99%, HitCoverage=61%, E-value=2e-99, Identity=50%"; Hit description =Serine/threonine kinase-like protein
  Pfam annotation: Domain name=DUF26; Domain location=1-46; Score=53.5; E_value=7e-13; Accession=PF01657.8; Description=Domain of unknown function DUF26
  Pfam annotation: Domain name=DUF26; Domain location=105-159; Score =93.9; E_value=4.9e-25; Accession=PF01657.8; Description=Domain of unknown function DUF26
  Pfam annotation: Domain name=Pkinase; Domain location=218-381; Score =11.3; E_value=3.1e-09; Accession=PF00069.15; Description=Protein kinase domain
  Pfam annotation: Domain name=Pkinase_Tyr; Domain location=218-381; Score=-15.8; E_value=1.7e-11; Accession=PF07714.7; Description =Protein tyrosine kinase
  Pfam module annotation: Pfam domain module=DUF26::DUF26::Pkinase::Pkin ase_Tyr; Domain location=1-46::105-159::218-381::218-381
DVEPDECRSCLNDARGNLTQRCPSQKKAIIYYDNCMLRYSNTTIFGVMETSPALFLGNTVNATDVEQFNQVLQTLMSNLTDRAASGDSRRKYATDDTTAASFQRIYGLVQCTPDLSGLDCSSCLVGAIENIQDCCSGKRGGRVIRPSCNVRFELGPFYGQTTTIDPVPEVSPPPPPPTNNTSQQVKGEEDAIEDDDEIKIAESLQFNLDTIRVATEDFSESNKLGQGGFGAVYWGKLSNGQMIAVKRLSRDSGQGDTEFKNEVLLVAKLQHRNLVRLLGFCLEGRERLLVYEYVHNKSLDYFIFDSTMKAQLDWERRYKIIRGIARGLLYLHEDSRLRIIHRDLKASNILLDEEMNPKIADFGMARLVLVDQTQANTSRIVGT

SEQ ID NO: 138914 - protein, 105 aa, Glycine max
  Coding DNA Sequence Number=SeqID_22136
  Gene Ontology: Mol. function=protein serine/threonine kinase activity; Cellular component=mitochondrion; Biological process =protein amino acid phosphorylation
  Homolog annotation: Hit_ID=Q9XED4; Match level="QueryCoverage=71%, HitCoverage=11%, E-value=5e-26, Identity=79%"; Hit description =Receptor-like protein kinase homolog RK20-1
MTFVIPVNSDKEDLGWGCLQGGLSNGQEVAVKRLSTDSRQGDIEFKNEVLLVAKLQHRNLVRLLGFCLERRERLLDYEFVPNKSLDYFIFARHGKAGEKEELQIS

SEQ ID NO: 138915 - protein, 157 aa, Glycine max
  Coding DNA Sequence Number=SeqID_22137
  Homolog annotation: Hit_ID=Q9LVZ6; Match level="QueryCoverage=22%, HitCoverage=11%, E-value=2e-07, Identity=68%"; Hit description =Arabidopsis thaliana genomic DNA, chromosome 3, P1 clone: MSJ11
MKPRSKGGDDDGTMRNVFSTTMKKRSPNANKHDIQCAVGGSCGAEGAPATGVEKVGPKDRVLVRGWKIKGRGEVVGGGSEEDEAVSDGDGLDGEAVGEEGGVEEREGEPHGKDGVKSVELDDREGVGVGENGMAMAKIGLWWWWWKKKKNFCECKIF

SEQ ID NO: 138916 - protein, 299 aa, Glycine max
  Coding DNA Sequence Number=SeqID_22138
  Gene Ontology: Cellular component=intracellular; Biological process =transport
  Homolog annotation: Hit_ID=Q5Q975; Match level="QueryCoverage=63%, HitCoverage=55%, E-value=5e-09, Identity=28%"; Hit description =Putative secreted salivary gland peptide
AGPEYLLIPARGPKAVNPIPSLPIIQVNNLLDSQKRNQECEDHDHPLHADVANPNESVGRKRQEQAHDGVQEAHSKALCTKLHPGALVEKHKLGRVVAVDEKHRHLPDYVMHCTRNAEEDDLVAGEERGAVDGAHGEFGLGFNELGHGIGEAGEVALVHGLGVLEARRGPNETDVREGVDAELGEGELGLLELDVAEEELGVGRVVGEEGGGDDGEFVAELGEAELRLVVELCGVKEKEDGVRARGFHGGEEAGEGLVVQPDYARFGSGLQGEQFAHSLVGGGHRGGDEHHQYQQRELR

SEQ ID NO: 138917 - protein, 344 aa, Glycine max
  Coding DNA Sequence Number=SeqID_22139
  Gene Ontology: Mol. function=protein binding; Cellular component =intracellular; Biological process=protein modification process
  Homolog annotation: Hit_ID=Q9M0W3; Match level="QueryCoverage=88%, HitCoverage=97%, E-value=1e-167, Identity=98%"; Hit description =Polyubiquitin
  Pfam annotation: Domain name=Tash_PEST; Domain location=121-139; Score=6.2; E_value=8.9; Accession=PF07708.2; Description=Tash protein PEST motif
  Pfam annotation: Domain name=Tash_PEST; Domain location=197-215; Score=6.2; E_value=8.9; Accession=PF07708.2; Description=Tash protein PEST motif
  Pfam annotation: Domain name=Tash_PEST; Domain location=273-291; Score=6.2; E_value=8.9; Accession=PF07708.2; Description=Tash protein PEST motif
  Pfam annotation: Domain name=Tash_PEST; Domain location=45-63; Score =6.2; E_value=8.9; Accession=PF07708.2; Description=Tash protein PEST motif
  Pfam annotation: Domain name=ubiquitin; Domain location=121-189; Score=138.0; E_value=2.5e-38; Accession=PF00240.13; Description =Ubiquitin family
  Pfam annotation: Domain name=ubiquitin; Domain location=197-265; Score=138.0; E_value=2.5e-38; Accession=PF00240.13; Description =Ubiquitin family
  Pfam annotation: Domain name=ubiquitin; Domain location=273-341; Score=138.0; E_value=2.5e-38; Accession=PF00240.13; Description =Ubiquitin family
  Pfam annotation: Domain name=ubiquitin; Domain location=45-113; Score= 138.0; E_value=2.5e-38; Accession=PF00240.13; Description=Ubiquitin family
  Pfam module annotation: Pfam domain module=Tash_PEST::Tash_PEST::Tash_ PEST::Tash_PEST::ubiquitin::ubiquitin::ubiquitin::ubiquitin; Domain location=121-139::197-215::273-291::45-63::121-189::197-265::273 -341::45-113
MKEKADRSGNGHCGPNLQRVRAQFNNAVVTDKAKREAVKMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 138918 - protein, 74 aa, Glycine max
  Coding DNA Sequence Number=SeqID_22140
  Gene Ontology: Mol. function=protein binding; Cellular component =nucleus; Biological process=transcription
  Homolog annotation: Hit_ID=Q6YZ89; Match level="QueryCoverage=69%, HitCoverage=54%, E-value=5e-25, Identity=94%"; Hit description =Putative postsynaptic protein CRIPT
MSVSQILTNFPHSHIWICDNIRRWTPYGNTKCTICKQQVHQNAKYCHTCAYSKGVCAMCGKQVLDTKFYKQSNV

SEQ ID NO: 138919 - protein, 56 aa, Glycine max
  Coding DNA Sequence Number=SeqID_22141
MTSNRRCIERRQAKECATLMWEWDLSQAARMEIALGLHPFSLATSIMETIYSSLYV

SEQ ID NO: 138920 - protein, 110 aa, Glycine max
  Coding DNA Sequence Number=SeqID_22142
MYPVPVERVVLQTHKTQVELLDEQLLKDCPVFDFPYNEVDVYLKPPPQLVVLKLTVLPVNSKEKIEIILSSVLAGYTKGLHQHEEPNKCMWVTPTAPRRNTHACIIITDP

SEQ ID NO: 138921 - protein, 235 aa, Glycine max
  Coding DNA Sequence Number=SeqID_22143
  Subcellular localization annotation: CTP_CleavageSite=73; ConfidenceScore=5.36e-01
FPPSLNLKTLPQDHQDPSGFGKLQFPSPTQVTPMQQMPPPQLPSLGPPRVTVNVKLPKSKDRIPIEMAENDVVGKLKKKIVALKDMQGVAVDRIVLYPGLTRGGMWNPNIDVFLKWSVPVTRGSSSASRKQMVVLMPLHSNLANVVVEVNPMDNVSSVLKNQMKKLEEKLMFRLAQYGTYFFLYKEEVMNQQETFEWHGVRDGDSIRVFVGYVTDSIPLLHVAENRKYRYFVLHS

SEQ ID NO: 138922 - protein, 212 aa, Glycine max
  Coding DNA Sequence Number=SeqID_22144
  Gene Ontology: Biological process=protein modification process
  Pfam annotation: Domain name=ubiquitin; Domain location=6-74; Score =47.7; E_value=3.8e-11; Accession=PF00240.13; Description=Ubiquitin family
MDVILDVLGGNSFSIEVGPFDTVLHVKEKVQKIHHIPVSYQTFVFHGEILPDDLQLSRSQLRRGYRINLLVTAPDFQNLAPPPPPLPLGTPEFPPSSHLNPLADYCDQLFGSSTQVMPMPSNRNVFQELMPPPMRMTLKVKVPTILDRIPIEMECEDTVRKLKEKILALDNLRGIPVERIALQSHSARVELLNHQVLQDCCSVPENNEIDVV

SEQ ID NO: 138923 - protein, 153 aa, Glycine max
  Coding DNA Sequence Number=SeqID_22145
MGGYITHPLGLEYNNYNHLGQSLVLPMPFRTPMLSMPSNHKSLEEPPAPSDKQTSQVIPKPYDPSRIVTVSLKAHKYWKDRFPMEADLDDTVLKLKKFILASMKVLAGFEMEHVTVDRMVLHSHSTRVELLDHQLLRDCNVSENHEIDLSIKE

SEQ ID NO: 138924 - protein, 373 aa, Glycine max
  Coding DNA Sequence Number=SeqID_22146
  Homolog annotation: Hit_ID=Q2L3S3; Match level="QueryCoverage=21%, HitCoverage=41%, E-value=2e-07, Identity=37%"; Hit description =Polyubiquitin-like protein
  Pfam annotation: Domain name=ubiquitin; Domain location=195-269; Score=8.5; E_value=0.036; Accession=PF00240.13; Description =Ubiquitin family
  Pfam annotation: Domain name=ubiquitin; Domain location=6-78; Score =58.8; E_value=1.8e-14; Accession=PF00240.13; Description=Ubiquitin family
  Pfam module annotation: Pfam domain module=ubiquitin::ubiquitin; Domain location=195-269::6-78
MEIKFHVQQQGGKNFSLEVDPSETIRHVKEKVLNSQRIPIYRQIIIYHGQLLRDEWTVSQCDLHHGARILLQLSAERPPSPLSHSDLPKHPQPTPDLQLPTLPTKEHVPSAIPPWDPSLQLIPPQDFYDPLAMPECPSLSDVIPMPQPPSELKEIQELPASTILSRRLQLFRPTPSQLVPNPLPPPPPTVTLNVKVPRSQDRIPIEMEKVETVLNLKWKISERGEMRGVPVARIVLQSPSMGMELRDDQILQNIIVSGSPEIDVFLKPSLPVPGRRMKVKVIPRNSRHTVKIEVNSTDKVSVLRQELERLQQLGGFSLPANGGYFFIHKRNAMDENNSFLWHRVRESDTIETFDGLISSTAASASASSSSRPA

SEQ ID NO: 138925 - protein, 260 aa, Glycine max
  Coding DNA Sequence Number=SeqID_22147
MDIEEISESNLGGSSSSHEALESEEKNMGTQRILVSDHINAYQYSAEEADSFVIDMDSFSSGINKDSNNANSRITRSLSRKGSQRGGDRKVNGNVTLHDRDTAPTTCSPKGVFVSIFDHYGTWVHRYAYVDCGHGYCHYKKLRQYFDEFYGTAAALAGSCTAEKSAVVAVGSTHHSTNTQVHHQITITASNMCTTTTPTTESKCITRRNSFKRSSSWLLDPKRVLLFFATLSSMGTMLLIYFTLTLSKQNADEYGGDWQQ

SEQ ID NO: 138926 - protein, 529 aa, Glycine max
  Coding DNA Sequence Number=SeqID_22148
  Gene Ontology: Mol. function=nucleotide binding
  Homolog annotation: Hit_ID=Q195N6; Match level="QueryCoverage=65%, HitCoverage=86%, E-value=1e-110, Identity=57%"; Hit description =Pyruvate Pi dikinase regulatory protein
  Pfam annotation: Domain name=2OG-FeII_Oxy; Domain location=46-142; Score=117.2; E_value=4.8e-32; Accession=PF03171.10; Description=2OG -Fe(II) oxygenase superfamily
  Pfam annotation: Domain name=DUF299; Domain location=251-515; Score =427.7; E_value=1.6e-125; Accession=PF03618.5; Description=Domain of unknown function (DUF299)
  Pfam module annotation: Pfam domain module=2OG-FeII_Oxy::DUF299; Domain location=46-142::251-515
MLGSAGTNTFSWTIQQFATQVSILAQTLAEILAQVSTFFEENCLPRSCYIRLNRYPPCPLASGLMPHTDSAFLTILHQDQVRGLQMLKDGKWFAVKPNPDALIIIIGDLFQAWSNGVYKSVEHRVVTNPKLERIFGNVVIFPIFAWLREKKTGSAHSAAMPIWQLCPNIHSVPQIVACTRNDKTGSKSVSGRPKVSPQLNRWSRARAVRSGQKLDQSSLRTQPPEPNPPVRPLPLPVDPDGAVNLDGADVMTVKSIYIVSDGTGWTAEHCVNAALGQFDYCLVDRGCPVSTHLFSGIDDAEKLLEITKQAAKEGAFFVYTLADPSLASAAKQACKLWGVPSTDVLGPITEAIASHLGVSPSGLPRGASGLPLSDDYFRRIEAVEFTIKQDDGACPQNLAEADIVLTGVSRTGKTPLSIYLAQKGYKVANVPIVLGVGVPRTLFEVDSKKNIRRTRAKTMGLSSDGRSNYSEMNYVREELEFAGRLFAQNPLWPVIDVTGKAIEETAAVVLRLYHDRKHICTMPRISKRY

SEQ ID NO: 138927 - protein, 96 aa, Glycine max
  Coding DNA Sequence Number=SeqID_22149
MHIQDRDELEEMMQRNSDAPPPPPPPPPDKNEYQELPQSIVDMPPPKEELLSSIPDAPPVAPQTPMTVTENALPPRNPEFTQSPPPPPPPPQLPLT

SEQ ID NO: 138928 - protein, 225 aa, Glycine max
  Coding DNA Sequence Number=SeqID_22150
  Gene Ontology: Cellular component=cellulose and pectin-containing cell wall
  Homolog annotation: Hit_ID=Q1JUZ3; Match level="QueryCoverage=71%, HitCoverage=87%, E-value=3e-11, Identity=33%"; Hit description =Hairpin-induced family protein
  Pfam annotation: Domain name=Hin1; Domain location=65-201; Score =81.6; E_value=2.5e-21; Accession=PF07320.4; Description=Harpin -induced protein 1 (Hin1)
MELQFKEQPNDFVAIIALPVAYFLVYTLGFQPEARETEPAPHDAVLRPPGPRKPHNPRLQDDLRYLLRPSFYCGPHHLHPLAQPPAPQAQVPHPGVQLAGPDPKLRNIGVYYESMDGAVYYRDQKIGSKPLLYPFYQQPKNTTEVDGDLSGATLTVSSQRWSEFQSDRADGSVVFRLELTSVIRFKISTWDSKRHTMHANCNVGVGPDGSLLTLYKDKRCPVYFS

SEQ ID NO: 138929 - protein, 102 aa, Glycine max
  Coding DNA Sequence Number=SeqID_22151
MKANKTRNELKFLDSKTYRLKTEERTKNGGKSWWNCSWKRLGSVTEAPRLEFSSWKHVFSPKTTEMHSIGGYRNFTEALRKPRKPFFNKTGEEVAAQLAQAS

SEQ ID NO: 138930 - protein, 183 aa, Glycine max
  Coding DNA Sequence Number=SeqID_22152
  Gene Ontology: Mol. function=kinase activity; Biological process =carbohydrate metabolic process
  Homolog annotation: Hit_ID=Q8D1N4; Match level="QueryCoverage=97%, HitCoverage=32%, E-value=6e-83, Identity=84%"; Hit description =Putative sugar kinase
  Pfam annotation: Domain name=FGGY_C; Domain location=1-157; Score= -62.7; E_value=0.0053; Accession=PF02782.6; Description=FGGY family of carbohydrate kinases, C-terminal domain
MAGEPENIAFLTKDIHMLPYFHGNRSPRANPTLTGTLTGLKLSRTPEDMALHYLATIQALALGTRHIIETMNQSGYCIDTIMASGGGTKNPIFVQEHSNATGCAMLLPEESEAMLLGSAMMGTVAAGAYDSLPEAMAAMSRIGKTITPQTNKIKEYYDRKYRVFHEMYHDSMKYRQLMQGKTE

SEQ ID NO: 138931 - protein, 104 aa, Glycine max
  Coding DNA Sequence Number=SeqID_22153
RSFSIGAGVVTFFWYRKDIDGQWIRKQDLPLRIPDERTPSPLPHRDASSTLMHEVLSELRGLRPFIDDHLDAMDAYFEGMDTQITQLEDDMGFIRRCFDPPAAP

SEQ ID NO: 138932 - protein, 75 aa, Glycine max
  Coding DNA Sequence Number=SeqID_22154
VVCAEDDVNLCMSTGLLAAIDKGCRGRLCAEDDVNLCVSTGLLATTDKGCRRRHSKRTFAGYRRVSSHATGLLGH

SEQ ID NO: 138933 - protein, 89 aa, Glycine max
  Coding DNA Sequence Number=SeqID_22155
  Subcellular localization annotation: CTP_CleavageSite=61; ConfidenceScore=5.47e-01
MQVVGMSPPPLGPLNHSQTQLMLSGRIPFPALRIDRSGALSGMTLLVANMHRSSFFQILPRAQPRSVALSGWLAKLADWLSKKVKISTS

SEQ ID NO: 138934 - protein, 152 aa, Glycine max
  Coding DNA Sequence Number=SeqID_22156
MGEVEEVQEQMKADMEAMKEQMATMMEAMMSTKKIMEANAVAVAATSAVAKVNLTPPSGLNQMNHPTSDMVSKDLGSTGGPHDVKIQNELPSCHMTCLPTIHHPMWRTLPMRMSITPLPYSLRADNLIMHDNLIMHMSLNPWEIHMKYPTII

SEQ ID NO: 138935 - protein, 80 aa, Glycine max
  Coding DNA Sequence Number=SeqID_22157
RGGARADEGQHGGHERENGYNGGGMMSMKKIMEANTVAIATTSAVAKVNPMPPSDLNQMNHPTSDMVGKDFGSTDGPMMC

SEQ ID NO: 138936 - protein, 111 aa, Glycine max
  Coding DNA Sequence Number=SeqID_22158
MSVAGKEVCNYCLSDNSSGSVNIRIINAPEVGPERLSVEAENGFYLVTLLEYDESGSDVRSIWDQTSSSGENVMILGNYWPKRQLTKDFDLVVRIFKEFFDTGNVSMDLLN

SEQ ID NO: 138937 - protein, 73 aa, Glycine max
  Coding DNA Sequence Number=SeqID_22159
ITTVTDKTTWRELCQASQQRQDLGADQARENGEQVIAGDWLSQPGITEAEHLEVSAAPGVIRLRRREVGGFRD

SEQ ID NO: 138938 - protein, 83 aa, Glycine max
  Coding DNA Sequence Number=SeqID_22160
MWLSDGRLEAYRLRPDLYEVSEDFACVEGARQALPGGARMLFDVPRNVSAPRQRAITVADAAALGRVRPNWRSQSKAQEIRHF

SEQ ID NO: 138939 - protein, 216 aa, Glycine max
  Coding DNA Sequence Number=SeqID_22161
MAALADFERFVVPLIEGAPTPAVEDAIVDAAIEFCTRTRVLRAFLDPVTLVPGTTEYELDPPEADTQIVDVVAAWLPEGPVTSATRTELEEKFPDGWAWRQVGSTADVQHFYCRLPGFVQLVPAVTVKAPRALRLEVAYAPTRNARELHDVLLNRYAEKLANGALARLHQHKADYADPGRAGGYQTEFDRDCNTLADDGARGFAKRRMRTGGDEFK

SEQ ID NO: 138940 - protein, 62 aa, Glycine max
  Coding DNA Sequence Number=SeqID_22162
MEVLLSPIALKVVGPLLLDPNSSRDGTNPPFQFPIWQLTNKKTKRQAIIKDQNEMKAKPMEF

SEQ ID NO: 138941 - protein, 86 aa, Glycine max
  Coding DNA Sequence Number=SeqID_22163
MATEVVAVFIVDMVAINDISDSDTKVNHVVVKCVKVLELQEEANCVVRTERGSIPILSGFDIQLSCVEAFYILSKQCQSCSPLDSS

SEQ ID NO: 138942 - protein, 104 aa, Glycine max
  Coding DNA Sequence Number=SeqID_22164
  Pfam annotation: Domain name=Tryp_alpha_amyl; Domain location=19-103; Score=1.9; E_value=0.054; Accession=PF00234.12; Description=Protease inhibitorseed storageLTP f
MAYGLAATTLSASQIPPTCNGDEALLTFCGSYLGNILPKPTSDCCKSATSAFDKAMFDSTGQGIRDLCDCLMVAGPVLNFQQTKLESLPDACGIKLSFSIFLCV

SEQ ID NO: 138943 - protein, 642 aa, Glycine max
  Coding DNA Sequence Number=SeqID_22165
  Gene Ontology: Mol. function=binding; Cellular component =intracellular; Biological process=protein amino acid phosphorylation
  Homolog annotation: Hit_ID=Q1SZI6; Match level="QueryCoverage=96%, HitCoverage=61%, E-value=1e-119, Identity=31%"; Hit description =Tetratricopeptide-like helical
  Pfam annotation: Domain name=PPR; Domain location=110-144; Score =44.8; E_value=3e-10; Accession=PF01535.11; Description=PPR repeat
  Pfam annotation: Domain name=PPR; Domain location=145-179; Score =17.9; E_value=0.036; Accession=PF01535.11; Description=PPR repeat
  Pfam annotation: Domain name=PPR; Domain location=211-245; Score =41.1; E_value=3.7e-09; Accession=PF01535.11; Description=PPR repeat
  Pfam annotation: Domain name=PPR; Domain location=246-280; Score=8.8; E_value=0.69; Accession=PF01535.11; Description=PPR repeat
  Pfam annotation: Domain name=PPR; Domain location=312-346; Score =42.5; E_value=1.4e-09; Accession=PF01535.11; Description=PPR repeat
  Pfam annotation: Domain name=PPR; Domain location=347-381; Score=6.2; E_value=1.4; Accession=PF01535.11; Description=PPR repeat
  Pfam annotation: Domain name=PPR; Domain location=413-447; Score =44.8; E_value=2.9e-10; Accession=PF01535.11; Description=PPR repeat
  Pfam annotation: Domain name=PPR; Domain location=448-482; Score =11.5; E_value=0.33; Accession=PF01535.11; Description=PPR repeat
  Pfam annotation: Domain name=PPR; Domain location=484-518; Score=6.7; E_value=1.2; Accession=PF01535.11; Description=PPR repeat
  Pfam annotation: Domain name=PPR; Domain location=551-585; Score =16.2; E_value=0.09; Accession=PF01535.11; Description=PPR repeat
  Pfam annotation: Domain name=PPR; Domain location=8-42; Score=13.9; E_ value=0.17; Accession=PF01535.11; Description=PPR repeat
  Pfam module annotation: Pfam domain module=PPR::PPR::PPR::PPR::PPR::PP R::PPR::PPR::PPR::PPR::PPR; Domain location=110-144::145-179::211 -245::246-280::312-346::347-381::413-447::448-482::484-518::551 -585::8-42
MENPCEISLWNGLMAGYTKNYMYVEALELFEKLLHYPYLKPDSYTYPSVFKACGGLHRYVLGKMIHTCLIKTGLMMDIVVGSSLVGMYGKCNAFEKAIWLFNEMPEKDVACWNTVISCYYQSGNFKDALEYFGLMRRFGFEPNSVTITTAISSCARLLDLNRGMEIHEELINSGFLLDSFISSALVDMYGKCGHLEMAIEIFEQMPKKTVVAWNSMISGYGLKGDIISCIQLFKRMYNEGVKPTLTTLSSLIMVCSRSARLLEGKFVHGYTIRNRIQPDVFVNSSLMDLYFKCGKVELAEKIFKLIPKSKVVSWNVMISGYVAEGKLFEALGLFSEMRKSYVESDAITFTSVLTACSQLAALEKGKEIHNLIIEKKLDNNEVVMGALLDMYAKCGAVDEAFSVFKCLPKRDLVSWTSMITAYGSHGHAYGALELFAEMLQSNVKPDRVAFLAILSACGHAGLVDEGCYYFNQMINVYGIIPRVEHYSCLIDLLGRAGRLHEAYEILQQNPEIRDDVELLSTLFSACRLHRNIDLGAEIARTLIDKDPDDSSTYILLSNMYASAHKWDEVRVVRSKMKELGLKKNPGCSWIEINQKILPFFVEDNSHLHLELVFKCLSYLSDHMEDESKSFTYHLDVETLRLY

SEQ ID NO: 138944 - protein, 172 aa, Glycine max
  Coding DNA Sequence Number=SeqID_22166
  Homolog annotation: Hit_ID=Q43468; Match level="QueryCoverage=27%, HitCoverage=8%, E-value=5e-16, Identity=85%"; Hit description=Heat shock protein STI
MANTDEPNLINFSSVGEPSKVLMDKVGIKRRVSIDKTKKEVDNTTLIENLPLVSCSAASDQVDVPKQSQKKEEPEPPQHQNFIVNEPKRVQISRIVLDCFNLYAGNGNLIKSGRGMTVHLNKFDDCIKDCERAVERGKILRSDYKMIARALTRKGTALAKMAKCITQILTCH

SEQ ID NO: 138945 - protein, 242 aa, Glycine max
  Coding DNA Sequence Number=SeqID_22167
MVIVYLASESSKFWENSLRTESNQGKEQAQKQFLTLGKQPKSRPFATVKGLRANTTVVPHQSVNPRLEKILEKVLVKQEVLVCHANTNVKEMLEDIVLLAFADDVILFAKATLDQISTHKEQGGLGLRKMRYDESQLEILLISFEVTITLIKFWNDAWIPSCGRLVDVAASNTPHYELQKSVAEYIDVNGCWQIHTIKDYLSPNVVKMVTDMEVNGVATHKNHALFMEMRKWKDPEYAKGFL

SEQ ID NO: 138946 - protein, 326 aa, Glycine max
  Coding DNA Sequence Number=SeqID_22168
  Gene Ontology: Mol. function=protein binding; Cellular component =membrane; Biological process=defense response
  Homolog annotation: Hit_ID=Q1SW20; Match level="QueryCoverage=94%, HitCoverage=32%, E-value=5e-64, Identity=45%"; Hit description =Disease resistance protein; AAA ATPase
  Pfam annotation: Domain name=NB-ARC; Domain location=113-325; Score =18.2; E_value=1.9e-11; Accession=PF00931.13; Description=NB-ARC domain
MASEEGDNTTKGVKAWVKELREASFRIEDVIDEYMIFVEQQPHDDAFGCVNFLFECNITHFIESLKRRHQIASEIQQIKSFVQGIKQKGIDYDYLIKPSLEKGSSSYRGSQSVQWHDPRKHSRYLEEAEVVGLEGQRDKLIGWLVEGPSERTVISVVGMGGLGKTTLAGRVFNNQKVTAHFECCAWITVSKTYTEEGVLGKLLKKLYEEDKQEKAPQGIDEMDRDSLIHKVRKYLQPKRYFVIFDDVWSIELWGQIQNAMLDNKKGSRVFITTRMDGVVDSCMISPFDMVHKLKPLTKEESMELFCKKAFPCHNTEIVQKIQENFF

SEQ ID NO: 138947 - protein, 148 aa, Glycine max
  Coding DNA Sequence Number=SeqID_22169
MKGRKHKYGFNKNKREKPEKIRVVDDETGDKHQLDEVLRIPSTYIMGSQPASPPPPPPSPPPPPPAPSDASALPFATKRTHKASRLRSLSTRPPGVERPVVHVDPATGKTDGPHRKKLRIYLGIVARDKVDVTYENWKKVPTSQKDLI

SEQ ID NO: 138948 - protein, 80 aa, Glycine max
  Coding DNA Sequence Number=SeqID_22170
  Homolog annotation: Hit_ID=Q9SD67; Match level="QueryCoverage=59%, HitCoverage=5%, E-value=2e-12, Identity=75%"; Hit description=FtsH metalloprotease-like protein
MHVCVHYGKILPTPYVGGNVLKIMTRPCLKGIEEKTAKLKGSEKALVARHEASHAVVGTAVANLLAGQPHVEALVIRLLV

SEQ ID NO: 138949 - protein, 89 aa, Glycine max
  Coding DNA Sequence Number=SeqID_22171
MGFVGVGGEYGVLGEGDGAAFGVHGGELLLGYVFLSRLPSLTDIFSNLDFLLLCEWCVWDWDWDKEVLEEGGWIFEIIQGKERRGQKKR

SEQ ID NO: 138950 - protein, 782 aa, Glycine max
  Coding DNA Sequence Number=SeqID_22172
  Gene Ontology: Mol. function=binding
  Homolog annotation: Hit_ID=Q6K272; Match level="QueryCoverage=96%, HitCoverage=88%, E-value=1e-180, Identity=47%"; Hit description =Putative Cnot10 protein
  Pfam annotation: Domain name=TPR_2; Domain location=335-368; Score =14.2; E_value=0.46; Accession=PF07719.7; Description=Tetratricopeptid e repeat
  Pfam annotation: Domain name=TPR_2; Domain location=385-418; Score =3.0; E_value=15; Accession=PF07719.7; Description=Tetratricopeptide repeat
  Pfam annotation: Domain name=TPR_2; Domain location=722-755; Score =10.9; E_value=1.8; Accession=PF07719.7; Description=Tetratricopeptide repeat
  Pfam module annotation: Pfam domain module=TPR_2::TPR_2::TPR_2; Domain location=335-368::385-418::722-755
MEACYEHVLHNIAIAEFFRDGCSDPKKLLEVINGIKRKNDELALVLEEQGESVNNVGNKVLGSKGSNASAHQFSGANSTSTSTMYTDEFDSSVAMLNIAIIWFHLHDYAKTLSVLEPLFQNIEPIDETTALHICLLLLDASLACHDASKSADVLTYLEKAFGVSSVSQGDSGNTAQQQAANLITKSVPVASNVSAADASSSDLGPSANVSENHLSRDLSEDTLDYEAMILDMGGQNLARPMGPSSNDLSRALVDRFSTVDLKLKLQLYKVRFLLLTRNLKLAKREVKLAMNIARGRDSSMALLLKSQLEYARGNHRKAVKLLMASNNRTDTAFSSIFNNNLGCIYYQLGKYQTSSLFFSKALTNCSSLRKDQSLKLATFSQDNSLLIIYNCGVQYLACGKPILAARCFQKASLVFYKQPLLWLRLSECCLMALEKGLIKSSRVPSEKLGVGVCVVGIGKWRQLVVEDQISGNGLVDSSEGDDCPSEDGRLKLSMSLARQCLLNALHLLDSNSANCLKSGLPSNSSVEDNNGSEVSPSKNSNIKNSHGIDSKAFSVAVGLGQVNANGDTKEQKGVNSQELVQNSLSCYENVRNRENQLVKQAVLANLAYVELELDNPVKALSVAKSLLELPECSRIYIFLGHVYAAEALCLMNRPKEAAEHLSFYLSGGNNVDLPFSLEDCEKWQPERTADFEEVNGGSTAAKNSSLEGTQSIVFLKPEEARATIYANFAVMSAMQGEFEKSNILVAQALSLLPNSPEATLTAVYVDLLLGGGCVLVSAGAHL

SEQ ID NO: 138951 - protein, 302 aa, Glycine max
  Coding DNA Sequence Number=SeqID_22173
MKSSPHHLPCNKQGIGKRVLRCKLGFLTMSIDYFKQDIDELIGEFTQDESTTLAEIKRVWLSRKFSYIYEARPSANLAFFMQSLYAHCIGYMVGTATLSHRLGGLYCLYCLYETQPFNPSFKVYLSLGELKKLRILVADAKANDIKVALALVKRMLERNTFLFGSVDLMEGCVTETVNELQQLQNARIQVAYEKLFDSTSIDNYIQMDLGLEVDLDLLKKKSSGYATAKNVAIQEASNILDVENIKHLQKDKELIGDVVEKVANDWHVQKQTFYKQTGLGDDAYEKELEQLLLEQHPHDGNS

SEQ ID NO: 138952 - protein, 393 aa, Glycine max
  Coding DNA Sequence Number=SeqID_22174
MANKFEGRNPRICLLRSETGFWREEFVLAASFPGDADEVVRVSEGFPFFVQKASARKTMSEQHSCANPSSLQSLAHSSQSIISSIVSDFSHDHDEEIVAQALKCLGFMLYHPSVVSVFGVDDANLVLGALPKLITTTQLKASASFLVIHFPSLLRAIVHALDNPMDSLSTTFEATQAIVKDMKIKLLNGMKGLLDNGMKTQAIRAWGWFARMLGSHALRNIHMLKIPERTFTDLDPQVQIATQLVISINETSMIKTVFEPLPKAIFQNGPDSKNICLWNLGLDLLSDSISHKRGDVLYQSTGPVSHRVSDNGPSLSGKCSWKQHLIRWMPRNINQLDFYLSMIFHLIHQASRPTVTYDRRNHVYDTALKLFIYILKGVKLDVESPSTNYDGIM

SEQ ID NO: 138953 - protein, 277 aa, Glycine max
  Coding DNA Sequence Number=SeqID_22175
MAHSEVPRMTLSNDSASLDKYPVSPERKVKFELVIQTWKSLYGSLSALGFGCSSATNFSGDLCMLLSNCLDENGGMVESGTDFESTCNDVDHGVLHLSGNFLICILEQIQTLELVTELRRSKSDRDFKIFCCIKNCLKFVAKYMNFLRIKMVRDPLSGFVGTSSCLHWKQDILHLLELSRNGRLKLQKRSLPCLQKCHSHEEANDALEGCRDSPKHNWTSKRVELVLDTLKEAPPPLSFKKRRLELTEHLKGVRRAQQGRERDTGGRGPGIRIYTRA

SEQ ID NO: 138954 - protein, 133 aa, Glycine max
  Coding DNA Sequence Number=SeqID_22176
MVSFLKFVQISAEFGVWKVVRRRASGVQCSLSYGSSGMKVAAVREIKFMASITHLYIFSRGGIKALGLQIEWGVIKNNEQGFIVAFSAKIGNCSIAQAELWGIYHRLFLACEKGFSHILLESDYLPPFRLFHS

SEQ ID NO: 138955 - protein, 79 aa, Glycine max
  Coding DNA Sequence Number=SeqID_22177
MIFNEVSTPNAPLAGPWNVPGDIPDMDDLLGVDLRHDFFGEADQVDERVNPRRRNPDRAARNWDRPCGTSSRHHRHSDD

SEQ ID NO: 138956 - protein, 32 aa, Glycine max
  Coding DNA Sequence Number=SeqID_22178
MNRAMAIFGVVGFSELPLALPINLLRVVISKT

SEQ ID NO: 138957 - protein, 1152 aa, Glycine max
  Coding DNA Sequence Number=SeqID_22179
  Gene Ontology: Mol. function=protein kinase activity; Cellular component=integral to membrane; Biological process=protein amino acid phosphorylation
  Homolog annotation: Hit_ID=Q1SEN0; Match level="QueryCoverage=83%, HitCoverage=97%, E-value=0.0, Identity=63%"; Hit description=Protein kinase
  Pfam annotation: Domain name=LRRNT_2; Domain location=15-55; Score =39.6; E_value=1.1e-08; Accession=PF08263.3; Description=Leucine rich repeat N-terminal domain
  Pfam annotation: Domain name=LRR_1; Domain location=108-130; Score =18.3; E_value=0.028; Accession=PF00560.23; Description=Leucine Rich Repeat
  Pfam annotation: Domain name=LRR_1; Domain location=132-154; Score =7.6; E_value=11; Accession=PF00560.23; Description=Leucine Rich Repeat
  Pfam annotation: Domain name=LRR_1; Domain location=158-180; Score =10.3; E_value=3.4; Accession=PF00560.23; Description=Leucine Rich Repeat
  Pfam annotation: Domain name=LRR_1; Domain location=182-204; Score =13.6; E_value=0.75; Accession=PF00560.23; Description=Leucine Rich Repeat
  Pfam annotation: Domain name=LRR_1; Domain location=206-228; Score =15.8; E_value=0.16; Accession=PF00560.23; Description=Leucine Rich Repeat
  Pfam annotation: Domain name=LRR_1; Domain location=230-249; Score =5.2; E_value=30; Accession=PF00560.23; Description=Leucine Rich Repeat
  Pfam annotation: Domain name=LRR_1; Domain location=255-277; Score =6.7; E_value=16; Accession=PF00560.23; Description=Leucine Rich Repeat
  Pfam annotation: Domain name=LRR_1; Domain location=279-301; Score =10.6; E_value=3; Accession=PF00560.23; Description=Leucine Rich Repeat
  Pfam annotation: Domain name=LRR_1; Domain location=303-328; Score =2.8; E_value=84; Accession=PF00560.23; Description=Leucine Rich Repeat
  Pfam annotation: Domain name=LRR_1; Domain location=333-355; Score =9.0; E_value=6; Accession=PF00560.23; Description=Leucine Rich Repeat
  Pfam annotation: Domain name=LRR_1; Domain location=358-380; Score =15.1; E_value=0.26; Accession=PF00560.23; Description=Leucine Rich Repeat
  Pfam annotation: Domain name=LRR_1; Domain location=382-404; Score =8.4; E_value=7.6; Accession=PF00560.23; Description=Leucine Rich Repeat
  Pfam annotation: Domain name=LRR_1; Domain location=406-428; Score =10.6; E_value=3; Accession=PF00560.23; Description=Leucine Rich Repeat
  Pfam annotation: Domain name=LRR_1; Domain location=430-452; Score =11.1; E_value=2.4; Accession=PF00560.23; Description=Leucine Rich Repeat
  Pfam annotation: Domain name=LRR_1; Domain location=454-477; Score =10.1; E_value=3.6; Accession=PF00560.23; Description=Leucine Rich Repeat
  Pfam annotation: Domain name=LRR_1; Domain location=479-501; Score =19.1; E_value=0.016; Accession=PF00560.23; Description=Leucine Rich Repeat
  Pfam annotation: Domain name=LRR_1; Domain location=503-525; Score =14.7; E_value=0.33; Accession=PF00560.23; Description=Leucine Rich Repeat
  Pfam annotation: Domain name=LRR_1; Domain location=527-549; Score =8.0; E_value=9; Accession=PF00560.23; Description=Leucine Rich Repeat
  Pfam annotation: Domain name=LRR_1; Domain location=551-573; Score =18.5; E_value=0.024; Accession=PF00560.23; Description=Leucine Rich Repeat
  Pfam annotation: Domain name=LRR_1; Domain location=575-596; Score =5.8; E_value=24; Accession=PF00560.23; Description=Leucine Rich Repeat
  Pfam annotation: Domain name=LRR_1; Domain location=598-622; Score =3.1; E_value=76; Accession=PF00560.23; Description=Leucine Rich Repeat
  Pfam annotation: Domain name=Pkinase; Domain location=663-933; Score =123.9; E_value=4.5e-34; Accession=PF00069.15; Description=Protein kinase domain
  Pfam annotation: Domain name=Pkinase_Tyr; Domain location=663-958; Score=74.0; E_value=4.8e-19; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=15-55::108-130::132-154::158-180::182-204::206-228::230 -249::255-277::279-301::303-328::333-355::358-380::382-404::406 -428::430-452::454-477::...
  Pfam module annotation: Domain location=479-501::503-525::527 -549::551-573::575-596::598-622::663-933::663-958
MVSMMPGTVGHALSAESDKVALLALKQKLTNGVFDALPSWNESLHLCEWQGVTCGHRHMRVTVLHLENQNWGGTLGPSLANLTFLRKLILSNIDLHAQIPTQIGRLKRLQVLDLSHNNLHGQIPIHLTNCSKLEVINLLYNKLTGKLPSWFGTGSITKLRKLLLGANDLVGTITPSLGNLSSLQNITLARNHLEGTIPHALGRLSNLKELNLGLNHLSGVVPDSLYNLSNIQIFVLAKNQLCGTLPSNMQLAFPNLRDFLVGGNNFNGSFPSSISNITGLHVFDISLNGFSGSIPPTLGSLNKLTRFHIAYNSFGSGRAQDLDFLSSLTNCTQLHKLILEGNQFGGVLPDLIGNFSANLTLLDIGKNQISGMIPEGIGKLIGLTEFTMVDNYLEGTIPGSIGKLKNLVRFTLEGNYLSGNIPTAIGNLTMLSELYLRTNNLEGSIPLSLKYCTRMQSVGVADNNLSGDIPNQTFGNLEGLINLDLSNNSFTGSIPLEFGNLKHLSILYLNENKLSGEIPPELSTCSMLTELVLERNYFHGSIPSFLGSFRSLEILDLSNNDLSSTIPGELQNLTFLNTLNLSFNHLYGEVPIGGVFNNLTAVSLIGNKDLCGGIPQLKLPTCSRLPSKKHKWSIRKKLIVIIVIGVGGGLVSYGELHEATNGFSSSNLVGTGSFGSVYKGSLLHFESLVAVKVLNLETFGASKSFAAECKALGKIMHNNVLKILTFCSSVDYNGDDFKAIVFEFMPNGSLDSLLHGNEELESGNFNLNLQLLLNIALDVANALEYLHHVSEQAVVHCDIKPSNILLDDDFVAHLGDFGLARLFHVLTEHSSRDQISSSAIKGTIGYVPPEYGAGVRVSPKGDIYSYGILLLEMLTGMRPTDNMFGEGLSLHKFCQMTIPEEITEIVDSRLLVPINKEGTRVIETNIRECLVAFARIGVSCSAELPVRRMDIKDVIMELEAIKQKLPHAWLSALGGVVIVIDDLGIGDGSGVLDDGAADRVDPILLLLLGVGDEVHGVGARGELEGVGLVEDVFGAFDGEARGDGDHAAWTRRTRDGGVLEPEELALLEDEPAAAPGLDVLALLGEPAGPLGVRPELDAVVIGGVVRHAGCRAPQARHRSSKMRGQRKRINTAQENQRKNQLTHDIALLALPL

SEQ ID NO: 138958 - protein, 371 aa, Glycine max
  Coding DNA Sequence Number=SeqID_22180
  Gene Ontology: Mol. function=protein binding
  Homolog annotation: Hit_ID=Q2QV86; Match level="QueryCoverage=54%, HitCoverage=15%, E-value=4e-11, Identity=33%"; Hit description =Expressed protein
MHTICLIAISKDFFESDLPKPELSGDEDDLPERLWKEFLSSSLGGASFRIFITLSTILVPITTGLTLSFALEYARLTAGIELPVGREMPLEERPLEGEHDCRLGLPLEAGSTDEDRRLGAPGLPLVVDSDLSGSVVLKLGGASSEKPGISDGFHCLDFTVGEVPRDGTGCLDITGADLETEEVLTEGEDTVGTLGGVDGRRAGVDALDVGLDAGVEGLADFETAVGVEGLGDFETVVNVERPAGVVDRDPIFPDDECLLVTPPEEVNPGEEADCLDTKLLLPLCSDRFSDDEGLLIPPPEEVNPGEEARCLITELLLPVSSDRFPADEGLLIPPPEEVNPGEEAGCLDTKLLLPVSSNGEFANYNHKETNT

SEQ ID NO: 138959 - protein, 42 aa, Glycine max
  Coding DNA Sequence Number=SeqID_22181
METSKTVMSQLGAPTVRPTPLKARMLSLASGFNSLMKLYISL

SEQ ID NO: 138960 - protein, 146 aa, Glycine max
  Coding DNA Sequence Number=SeqID_22182
MNRSFRAVELQMQDAFNQRRHQLAALRSSSPRVMDRDDELALFLEMRNREKERNDLLLRAAEDFDAAAPLGSDPGNSPLFNVPPAASAPARKTGADDFLNSENDKNDYDWYYVALFVIGLYQQYIHGTWESYVIWTQALSYSELGF

SEQ ID NO: 138961 - protein, 115 aa, Glycine max
  Coding DNA Sequence Number=SeqID_22183
MELNKSWMQITDRTTPLYDKGVQEFLDFAFNSFEKGKDYVIWEHHGEVISEPGEFDDDDQNNCNDGVRDMLHDLGSAMNIENITGDEEINYITGTDTNNVNEEEDKFSKLFFIVE

SEQ ID NO: 138962 - protein, 125 aa, Glycine max
  Coding DNA Sequence Number=SeqID_22184
  Homolog annotation: Hit_ID=Q1SKA6; Match level="QueryCoverage=50%, HitCoverage=7%, E-value=2e-09, Identity=49%"; Hit description =Rad21/Rec8 like protein, C-terminal; Rad21/Rec8 like protein, N- terminal
MHIWRNLVEREIPLMSANRIFYKKVEYVLEDCNEVLVKINKFVVNKEGLVCVETLCMPVTKPERFELDAFVLDEPEDAGRYIVRKSIKSAKDIVHFPFQQDATILYLLHTVYRGREYLPLLTVHY

SEQ ID NO: 138963 - protein, 94 aa, Glycine max
  Coding DNA Sequence Number=SeqID_22185
MVKSKDILLILKEQYANNCTTMKQVYNYYCLLWKNDMHILRRYVKNLPLDSRCHREMYKKGLVLTMTSTRKCGCPFKLRMKPVPRDEGWMINLR

SEQ ID NO: 138964 - protein, 128 aa, Glycine max
  Coding DNA Sequence Number=SeqID_22186
  Homolog annotation: Hit_ID=Q1RX12; Match level="QueryCoverage=68%, HitCoverage=7%, E-value=6e-14, Identity=47%"; Hit description=Zinc finger, RING-type; Transcription factor jumonji, jmjC; Cupin region; Zinc finger, FYVE/PHD-type
MEQEGGLCDGKEVDQFHQPSGSNEVAIANEDGISYGSELIEVDKVKINQGDLLFGGDASDGALWDIFWRQDVPKLQEYLKKNFREFRHVHCCRLKQVREYNWEIECIRLDRVSQFLLVQCWVDYMAPG

SEQ ID NO: 138965 - protein, 112 aa, Glycine max
  Coding DNA Sequence Number=SeqID_22187
MEKSGGKQNNFGSMKEKEWKIFRQDKFSARLPFSTGDIPPHMNKEEKTETPSFLSENTTLEKILLVRDRMSLPSVVHVSSTFESGATRSYCVALFANSPFSTFLRSPMNVIA

SEQ ID NO: 138966 - protein, 273 aa, Glycine max
  Coding DNA Sequence Number=SeqID_22188
  Homolog annotation: Hit_ID=Q64EX4; Match level="QueryCoverage=99%, HitCoverage=67%, E-value=2e-97, Identity=60%"; Hit description=MtN19- like protein
  Pfam annotation: Domain name=SURNod19; Domain location=1-273; Score =314.0; E_value=2.6e-91; Accession=PF07712.3; Description=Stress up -regulated Nod 19
GHIAVKSFNAEVVDEAGNPVPLHETYTTGGTCQRDILAQYYGLGSETRRTATDIPDPFEIIVGNPAKIPEGYEEKWLVNIHAIDTRGVVDKMGCTECKCELYNVTNDEYGELLLRPDYKGGLLCCYDQTQCRLREGFVGQKRNLYLRCTVKWVNWDKFIVPVKIYILDVTDTSKISHDSKGMIAEHDCQIEYEVESCSTGNEDGNDCLHVKRTNLSMKNCGYVIYGVAHQHSGGTGSMLYGQLMFNVTVILKYLEFGSKGYMFFNTKLWKGKG

SEQ ID NO: 138967 - protein, 63 aa, Glycine max
  Coding DNA Sequence Number=SeqID_22189
MVPDEIRYSTPVAAQRKRSLSVLIKNTKGCQGRGQKGLFLDFSRPQIAQASIWLTWTMELPPG

SEQ ID NO: 138968 - protein, 134 aa, Glycine max
  Coding DNA Sequence Number=SeqID_22190
  Gene Ontology: Mol. function=RNA-directed DNA polymerase activity; Cellular component=mitochondrion; Biological process=RNA-dependent DNA replication
  Pfam annotation: Domain name=rve; Domain location=27-134; Score=15.1; E_value=0.00032; Accession=PF00665.16; Description=Integrase core domain
MKGSTVSTPEDTPLPPKWCELATTNQHSRQMPLTLPRDILGPLPKASGVVKYLLVAIDSFTKWIEARPLREIMTSEAEKFTWKNLICRYSLPYAIVTDNDTQFKAQTHEDFLTWLGIKHLVTSTEHPQTNGQVE

SEQ ID NO: 138969 - protein, 409 aa, Glycine max
  Coding DNA Sequence Number=SeqID_22191
CLFKVLGLVLPLIVFQCALLENLNVAHFELHPNSWAMVRAFEILCSFFNIQPNVLVFLFFFQVKLTGKNGWVSLNSMSKKLFEFDSNSDPTKLKSFDEDLLTFVKRVDKTILEQLDPLVALDGIMSDYVWRPLVKQVGLVGDVVLPSVVVPILEKGVNLLATRLTLGSGRPSSVLDVSPAPPAVKAPAADDAALVSPEVSAPAALVGSAMAPSSVITAPLLSVSVVTSSAPMVPLPSSSAPMVPPSTALALTSTFSLPCVSLDHIYTSNDVDYLSEWNHQLSSKVGGVLAKFLCTRLDSDELSKHYKDLQEENKNLAGLVEEVPTEKEKLAKKVADLEAQLKESEFMLEESELQAARDREANKELEEELLIFKKKAREQNEKGFNKDMKGGVLLDEDDIVAEEEVDKEQ

SEQ ID NO: 138970 - protein, 133 aa, Glycine max
  Coding DNA Sequence Number=SeqID_22192
MVQVQQNELPPDYLARPSIRCSSCLPLITIRGETLQVKRPTTRLVGMTFNQGQVKRTPHKHQGRSYAKQKEAPPDGGKTFNQVEIKPEMISCHLLFTGPPRSYAYIDKVLLSAPSKIPHLSSRQPIHTTTSNG

SEQ ID NO: 138971 - protein, 117 aa, Glycine max
  Coding DNA Sequence Number=SeqID_22193
  Gene Ontology: Mol. function=DNA binding; Biological process=DNA integration
  Homolog annotation: Hit_ID=Q1T192; Match level="QueryCoverage=99%, HitCoverage=22%, E-value=7e-15, Identity=37%"; Hit description =Polynucleotidyl transferase, Ribonuclease H fold
MVVWSVELSKFNIQYEPCGPMKTQFMDDLLAEFAGNDTTTPDWWNLYIVSVSNVKGSMARIILEGPNNVTLEQALQLQSLKQLGRIQGFHCRESNTRANLLFKLASTKKVEHLKTII

SEQ ID NO: 138972 - protein, 806 aa, Glycine max
  Coding DNA Sequence Number=SeqID_22194
  Gene Ontology: Mol. function=double-stranded RNA binding; Cellular component=intracellular; Biological process=metabolic process
  Homolog annotation: Hit_ID=Q9C5Q8; Match level="QueryCoverage=93%, HitCoverage=79%, E-value=1e-157, Identity=43%"; Hit description =CORYMBOSA2
  Pfam annotation: Domain name=Gemini_AL1_M; Domain location=298-392; Score=-24.1; E_value=0.038; Accession=PF08283.2; Description =Geminivirus rep protein central domain
  Pfam annotation: Domain name=dsrm; Domain location=51-125; Score =19.2; E_value=0.014; Accession=PF00035.15; Description=Double -stranded RNA binding motif
  Pfam module annotation: Pfam domain module=Gemini_AL1_M::dsrm; Domain location=298-392::51-125
MARKSYPSETVLILMDNTRVDQEWVQYSGWSELFAMEAREHVAPKKPILTPKAIIHQNFGSRACYVVEEVKEAPQTECPGLNIPQMGPCLYRCTLQLPELSVISGTFRKKKDAEQSAAEIAIDKSYFGDDHGQVLVFLHLRMSMSDTLILPHLGICTETIDPTPQEAQESLVSRITFIFSEKFVVCDHPLSGHIRATLWRKGDLCGSIPLSVIAFYDAKLFNLCKCINPEVESNPFLVISYIMRATANLHQFLATSERHLWIRRLSPYPQDIIESLMKEHGSQKCIQVTAVHIPSSVEQSIEAVTLHISSREYYLDIIANELGFEDASNVLISRNLGKASSETRLFFTAPKSYLPDLSSKFPNGKETLYLKGSLNVRASYFAGQDITGDAILASIGYTRKSRDLFYEDVTIRLYYRMLLGKTPGGIYKLSREAMLASELPSRFTSRANWRGSLPRDILCMFCRQHRLSEPLFSFHPIKTTSGLSGSCLKVAESGENVIECVNGFSVTSPKHSDSELFKCEIKLLSRCGDLILLCSPKDCYKKQNDAIQNASLKVLSWLNMCFKSMILPFEQLYETVDNFNIQIYSKNIIRDLLAGQSTHNGQLNGIHCNKFVESIYMNSSYDMLGNIVDSLKIEGPYSGVCPSSGSLPCIRYSVSLAVEGENLKEVIEVCDEFEFEVGVGAVVSYVEEVVMQMSVGQYAYFSTNLLSTELIFAASAEKCCMEYEISLIRVAEPPEERMEQALFSPPLSKQRVEFAVQQILESHASTLIDFGCGSGSLLEALLNYPTSLKKMAGVDISQKGLSRAAK

SEQ ID NO: 138973 - protein, 429 aa, Glycine max
  Coding DNA Sequence Number=SeqID_22195
  Homolog annotation: Hit_ID=Q64EX4; Match level="QueryCoverage=99%, HitCoverage=97%, E-value=0.0, Identity=73%"; Hit description=MtN19 -like protein
  Pfam annotation: Domain name=SURNod19; Domain location=22-412; Score =852.1; E_value=2.8e-253; Accession=PF07712.3; Description=Stress up -regulated Nod 19
MDLYFPLAILVLILGTPYSSAFGKSESNVKTAVFLSPKFELGPGSVANKFDYDIDFPRGHIALKSFNAEVVDEAGNSVALHETYLHHWVVARYYQPKYVKTHTSYDGHRILHNSDFVFVRNSGLCQRNTLGQYFGLGSETRGTATDVPDPFGIAVGDPAEIPEGYEEKWMFNIHAIDTRGVVDKRGCTECKCELYNVTKDAYGKPLMPDYKGGLKCCYDQTQCRLREGFEGPKRSLYLRYTVKWVDWDKFLVPVKIYIFDVTDTIKISDDSGGMIPEHDCQIEYDVESCSTDQKDGNGCLHVQKTSLPLQKGGYVIYGVAHQHSGGTGSTLYGQDGRVICSSIPSYGKGKEAGNEADYIVGMSTCYPRPGSVNIIDGETLTLESNYSSSREHTGVMGLFYLLVAEQLPHQHLKHTSRSSFFIDINSIVH

SEQ ID NO: 138974 - protein, 394 aa, Glycine max
  Coding DNA Sequence Number=SeqID_22196
  Gene Ontology: Mol. function=histidinol dehydrogenase activity; Cellular component=chloroplast; Biological process=amino acid biosynthetic process
  Homolog annotation: Hit_ID=Q9C5U8; Match level="QueryCoverage=86%, HitCoverage=70%, E-value=1e-159, Identity=80%"; Hit description =Histidinol dehydrogenase, chloroplast precursor
  Pfam annotation: Domain name=Histidinol_dh; Domain location=2-358; Score=612.1; E_value=5e-181; Accession=PF00815.10; Description =Histidinol dehydrogenase
MTCVFLRDVAERASPINYLNLACLQGVQCKRVARSINSVGLYVPGGTAVLPSTALMLSVPAQIAGCKTIVLATPPAQDGTICKEVVYCAKKGGVTHILRAGGAQAISAMAWGTETCPKVEKIFGPGNQYVTAAKMILQFIPLYIIVENILQNSEAMVSIDMPAGPSEVLVIADKHAIPRHVAADLLSQAEHGPDSQVVLVISGEGVDLNVIEEELNKQCQSLPRGEFAAKALSHSFIVYAHDMLESIKFSNLYAPEHLIVNTNDAEKWEGFIENAGSVFLGPWTPESVGDYASGTNHVLPTYGYARMYGGVSLDSFLKFITVQSLTEEGLRKLGPYVVTMAEVEGLDAHKLAVTLRLEDIEVRQSTLIIVEFFEDRKGESGQCKAKSFDTIFEI

SEQ ID NO: 138975 - protein, 265 aa, Glycine max
  Coding DNA Sequence Number=SeqID_22197
  Gene Ontology: Mol. function=protein phosphatase type 2C activity; Cellular component=protein serine/threonine phosphatase complex; Biological process=protein amino acid dephosphorylation
  Homolog annotation: Hit_ID=Q6QLU0; Match level="QueryCoverage=97%, HitCoverage=94%, E-value=6e-82, Identity=54%"; Hit description =Protein phosphatase 2C
  Pfam annotation: Domain name=PP2C; Domain location=25-258; Score =225.4; E_value=1.3e-64; Accession=PF00481.12; Description=Protein phosphatase 2C
EQHHKGLVTKDANEKNKPSTRHFIHGYHLIQGQMNHGMEDHIFAQHRNLDGYDLGLYAIFDGHSGHEVAKYLQSHLFENILSEPEFWENPVHAVKKACKATDDEILENIADSRGGSTAVAAILINGVKLLVANIGDSRAISCKNGRAKPLTVDHEPEKEKDLIESRGGFVSKKPVDGQLEMTRAFGDGKLKEHITAEPDVTIRKIDEDTEFIILASDGLWKVMTNQEACDCIRDEDDAQKASKKLVKEAKSQGSYDDISCIVIIF

SEQ ID NO: 138976 - protein, 65 aa, Glycine max
  Coding DNA Sequence Number=SeqID_22198
  Subcellular localization annotation: CTP_CleavageSite=17; ConfidenceScore=5.37e-01
MMKANSNLHKRKSSLISGGHPSAFKMSFKQNNMSSKRKIAPPYIAFQTLPSKHSHRLAHKRNHGN

SEQ ID NO: 138977 - protein, 204 aa, Glycine max
  Coding DNA Sequence Number=SeqID_22199
MSSMMDPMLEMKQLMESNAATAAAVSSAAEADPTLPNATHHPIPNVLIPTDYHPITHHQPYMKTWVTFLPSSSTGNLLDILTGSTRILESMLRETSTPTPRFPLRGRGPPPAPEGKGKLDIIEERLRAVEGFGDYPFADMTDLCLVPDVVIPPKFKVPDFDRYKGTTCPKNHLKMYCHKMGAYSRDEKLLMHFFQDSLAGAAVI

SEQ ID NO: 138978 - protein, 206 aa, Glycine max
  Coding DNA Sequence Number=SeqID_22200
  Homolog annotation: Hit_ID=Q1RYI2; Match level="QueryCoverage=25%, HitCoverage=8%, E-value=2e-10, Identity=50%"; Hit description =Ribonuclease H
MPVIDRRRQGTNLWRGIVKCWSNFQLNLIWKLGNGRSIHFWEDYWVPGSGNLNQFCTNQSRSGANVPVCFLVDASGGWDSQRLNSELPMKDGKFSTKNAYLTLSQAGDLVESPMNKEVLLEKLTPKQVLCLSLFLDKYRWGGEQSSGTDQGYWQKDESGIWKAPKKGFLKINCDGAYFPTLKENGSCESDSKNCPHAVKLIDECFK

SEQ ID NO: 138979 - protein, 524 aa, Glycine max
  Coding DNA Sequence Number=SeqID_22201
  Gene Ontology: Mol. function=hydrolase activity; Cellular component =membrane; Biological process=proteoglycan metabolic process
  Homolog annotation: Hit_ID=Q1RX76; Match level="QueryCoverage=99%, HitCoverage=100%, E-value=0.0, Identity=72%"; Hit description =Glycoside hydrolase family 79, N-terminal
  Pfam annotation: Domain name=Glyco_hydro_79n; Domain location=34-351; Score=569.7; E_value=2.8e-168; Accession=PF03662.4; Description =Glycosyl hydrolase family 79, N-terminal domain
MGSQIRLLGLCLWMYLSSLSFIGAGAVYGREGEVVKGIVLVHGKTAIGRIDDDSVCATLDWWPPQKCDYGKCSWGHASLLNLDLNNKILLNAVKAFSPLKIRLGGTLQDKVMYGTEDCRQPCTPFVLNANEMFGFTQGCLPMYRWDELNSFFQKAGAKVVFGLNALAGKSMKSGSAVGPWNYTNAESLIRYTVRKKYTIHGWELGNELCGSGIGASVAADQYASDVAALRNIVENAYRGIEPKPLVIAPGGFFDSDWFKEFISKSGKSADVITHHIYNLGPGVDDHLTEKILDPSYLDGEANTFSSLKGILQSSSTSVKSWVGEAGGAYNSGHHLVSDAFVYSFWYLDQLGMSAVYDTRTYCRQSLIGGNYGLLNTSTFVPNPDYYSALLWHRLMGGRVLLTTFYGTKKIRTYAHCAKESKGITILVLNLDNSTTVQVNVALKFNKLPYRRVGEPARREYHLTAPDRNLHSQTMLLNGKMLSVNSAGEIPPLEPLYVNSRKPIIVGPLSIVFAHIPNVLLSACS

SEQ ID NO: 138980 - protein, 378 aa, Glycine max
  Coding DNA Sequence Number=SeqID_22202
  Gene Ontology: Mol. function=transporter activity; Cellular component= integral to membrane; Biological process=transport
  Homolog annotation: Hit_ID=Q1RX82; Match level="QueryCoverage=99%, HitCoverage=68%, E-value=1e-130, Identity=63%"; Hit description =Major facilitator superfamily MFS_1
  Pfam annotation: Domain name=MFS_1; Domain location=110-362; Score =14.5; E_value=6.9e-05; Accession=PF07690.6; Description=Major Facilitator Superfamily
  Subcellular localization annotation: CTP_CleavageSite=67; ConfidenceScore=5.84e-01
MARLTLRPDNSCFFSHTQRANSHTPFTRTTSFQRFHFHLSSSNHTLRLSRIVSSAQQNAKETQRVSMAKAKAKVLTDLQVEEVEKQHETLSWNWPPWKNLPQRYKLIGTTSLAFIICNMDKVNLSIAIIPMSHQFGWNSSTAGLVQSSFFWGYALSQLPGGWLAKIFGGGAVLEVGVLIWSVATALVPFLAGYMPGLLLSRVLVGIGEGVSPSAATDLIARHLPPKIDKTSCFRSLGFVPRSIPLEERSRAVALVFGGLSVGSVMGLLLAPPLIQNLGWESVFYIFGLLGIAWFLGFQVLEGGETQLNAESLSSQDIMTQSWKTSLRELNGSLKDVPWKAFFQNRAVWAMIYAHFCGSWGHYNCLSWLPTFFRYSVSI

SEQ ID NO: 138981 - protein, 181 aa, Glycine max
  Coding DNA Sequence Number=SeqID_22203
MRTIFTIRFTAPISKAIYKPYKIAHNSASTIEPCPNLLAKARKTLLQRREVSTITVNLQEALLWRLPNSRLIPSNTNQFRIKDIVQNFTSANILDQCLSFVHHPICICPGIAKDKGPVWVSASKEVYPNRPKVISSPPKYIQDNTEHSSIDILAITNISDHPAIDILLKKGVIEIFINCSP

SEQ ID NO: 138982 - protein, 56 aa, Glycine max
  Coding DNA Sequence Number=SeqID_22204
MNNNGTTSNNNNNIAHQHLKLRRYIQRSIFTVELQEKGVALKAPLGSQCQARGSRV

SEQ ID NO: 138983 - protein, 103 aa, Glycine max
  Coding DNA Sequence Number=SeqID_22205
MLGHCNTAPTGMFIYQALHCSICVQHGQKYGQPDINRTTIFAQNIGANLRIMKISQENKAIEITYMRTKRAVKESTRKILTISKAKYYNKSLIPLGEVDYMDR

SEQ ID NO: 138984 - protein, 86 aa, Glycine max
  Coding DNA Sequence Number=SeqID_22206
MSHAVKDHRGKWAPNYEGPFVVKRAFSGGALGQDHLGLPSGVKTKHERQKPIKILKDERERGWGHDRPIVTFLRAKQAGNVAARQP

SEQ ID NO: 138985 - protein, 441 aa, Glycine max
  Coding DNA Sequence Number=SeqID_22207
  Gene Ontology: Mol. function=nucleic acid binding; Cellular component= extracellular region; Biological process=chitin metabolic process
  Homolog annotation: Hit_ID=Q95193; Match level="QueryCoverage=53%, HitCoverage=51%, E-value=3e-10, Identity=25%"; Hit description=TGN47 protein precursor
MATTQSFEDLEAKYETKETSESVILVVHIPDGFVREHIGAKIEYEFSRVRIHGERSLGNNKRARFNALYQFPEYCDINKIKGKFDGKTVIITIPTIPGKVPKLETQPTEQEPPKEPSEEEESNPEEEKEGTPTDDNQDSKEEANHVTSTPPNATQESMHQKDQEGIPQKATLTKVESEKHVGQEASTSTPPKDTQESKGQEGIPTKDTITKVDSKKQVAHEASSTSSQDTPESKAQKGQEEICTKDTITKVDSKIQVGHEGSTSTPSQDTEESMPQKGQEVIPPNATLAKNGKLQGEQNSEGEIDENVEKQKLVEKEETEDHSKKTWESGKPPEKAMVDDSPNKEGKEESKGLGPSEGEKRREINGKIGNNVGKKSDKKAIPESTTRARIKEVAASASQAITSLAKKFNEEDKQRIVYMGAAVLVVALGVYGTYKLRSRRP

SEQ ID NO: 138986 - protein, 205 aa, Glycine max
  Coding DNA Sequence Number=SeqID_22208
MYVNVLKYGRGKVRFDEHTTILRTQMEGHNNEVAIARHTSMHYRTPLKSYAKVVSTTKADVEHKNHFPPTHPRQAESQSSVHLEVAVGEKKWLTDAWELGVNVVSKYIGDDMILLLGLSDIKVEEIINEETQHDTSPFHSIEKWNPTIRPGNRLVCVQCLGVPLEAWDIGNIRKIVAAVGDLIEVADDVEELRRLDGARILIRTP

SEQ ID NO: 138987 - protein, 118 aa, Glycine max
  Coding DNA Sequence Number=SeqID_22209
MNGVLIMRERERERVRGSESEWTTVIRGRGRQREGERKREDPKTNYAYNKPGQSQRYYHENWRDKDAITTFYFTRFPEHTTKKDLWAHFKKWGDVREIFIPNHRNKRGRRYGFVRFKG

SEQ ID NO: 138988 - protein, 168 aa, Glycine max
  Coding DNA Sequence Number=SeqID_22210
  Gene Ontology: Mol. function=DNA binding; Cellular component =cytoplasm; Biological process=DNA integration
  Homolog annotation: Hit_ID=Q1S325; Match level="QueryCoverage=66%, HitCoverage=24%, E-value=1e-31, Identity=56%"; Hit description =Integrase, catalytic region
MRSLGARDVVGGLFGVGDDAWGISSNNNNLSWNNRLINQRCIIVNSLKEKWSRLKESDISRNNIPLKLWTKATISFMEARVIEKTTLKRLGREFIFTWSKIMGKTSTSKDIERNMVEVLLRVQNRIWGLIVEDRRGHAIDQGMCSKNRITLEADKNIIVKEKGTSGFN

SEQ ID NO: 138989 - protein, 606 aa, Glycine max
  Coding DNA Sequence Number=SeqID_22211
  Gene Ontology: Mol. function=sugar binding; Cellular component =histone methyltransferase complex; Biological process=histone H3-K4 methylation
  Homolog annotation: Hit_ID=Q9LJC6; Match level="QueryCoverage=87%, HitCoverage=96%, E-value=0.0, Identity=65%"; Hit description =Retinoblastoma-binding protein-like
  Pfam annotation: Domain name=WD40; Domain location=115-152; Score =22.5; E_value=0.0015; Accession=PF00400.22; Description=WD domain, G- beta repeat
  Pfam annotation: Domain name=WD40; Domain location=266-303; Score =15.1; E_value=0.25; Accession=PF00400.22; Description=WD domain, G -beta repeat
  Pfam annotation: Domain name=WD40; Domain location=385-423; Score =22.9; E_value=0.0012; Accession=PF00400.22; Description=WD domain, G- beta repeat
  Pfam annotation: Domain name=WD40; Domain location=71-108; Score =16.5; E_value=0.096; Accession=PF00400.22; Description=WD domain, G -beta repeat
  Pfam module annotation: Pfam domain module=WD40::WD40::WD40::WD40; Domain location=115-152::266-303::385-423::71-108
MEMYMCVEVVRRLVTVLEVWGAAVVLGPLRGAAVMTVLSVGSVEVWGAERRCFAAVRCRVAVLCGGAGDFPEVIEEYLEYGCMKCIAFNRRGTLLAAGCNNGSCVIWDFETRGIAKILRDDECSSPITSICWSKYGHQILVSAADKSLILWDVMSSKKITRIVLQQTPLQARLHPGSSTPSLCLACPLSCAPMIVDLNTGNTTLLKVSVLETCNGPTPTPPSRNKCSDGITSFTPTAACFNKYGTLVYVGNSKGEILAIDYKNGDVRAVVPISGGSVVKNIVFSRNGQYLLTNSNDRIIRIYENRLPLKDEVRALDDLSENHNVLNNIENLKAVGSKCLTLFREFQDSITKVHWKAPCFSGDGEWVVGGSASKGEHKIYIWDRAGHLVKILEGPKEALIDLAWHPVHPIVVSVSLNGLVYIWAKDYTENWSAFAPDFKELEENEEYVEREDEFDLIPETEKVKGPDVNEDEEVDIITVEKDAAFSDSDMSQEELCYLPSTPSRDVPEQQEKCVESSSKLLDSNNTGSPLSEEAGPNGHMMNHASSPLEDDAGRMKRKRKPSEKVLELQAEKVKKPSKSSKLAKPKSKSLADQDNGNGFHGDGLYDE

SEQ ID NO: 138990 - protein, 100 aa, Glycine max
  Coding DNA Sequence Number=SeqID_22212
MINIMAETVSIVPKEAIKSENKNIAKQGACVGRFRWKRPGLSCQQASVIGDASRAGKEGKCELHAPKLCIVETFLRGEEEINSPLWKYFEVGRKQSIHHQ

SEQ ID NO: 138991 - protein, 127 aa, Glycine max
  Coding DNA Sequence Number=SeqID_22213
MNLHGYSNFSNSSNLETPRALSLFVIIKPLFTLHLIRLTGDVKDMEHFLHLKNPTLTLLASSKRPAAPAPPLTLTTPLLPHENISNQHDTTPKQDKLIEAKERTTSQALNPKAKKKAEAKRETKQQK

SEQ ID NO: 138992 - protein, 242 aa, Glycine max
  Coding DNA Sequence Number=SeqID_22214
  Homolog annotation: Hit_ID=Q0KIN0; Match level="QueryCoverage=42%, HitCoverage=7%, E-value=2e-11, Identity=33%"; Hit description =Integrase core domain containing protein
MIEPIGGKSTPLYVVSFGSLLIQALYQAFDTCYKAWSKAKKVYSNDVHHLYSEITTMLSTKLENVDIWTYLALAALLNDLHSMRNQILSAPTVPTYDMVSEQLLHLSTSHVFDHSSTSASSADSFTLVSHSSPGKRYGEVAEVVVGRIDVAIIVKFMCQTAQQSASTVTVTTQSGNPIAFVSQSSSLGPWILDSSASDHMTDNNLFSLNCHYQILCLLLLSQMALRLNFVALVKPTPFLTSL

SEQ ID NO: 138993 - protein, 76 aa, Glycine max
  Coding DNA Sequence Number=SeqID_22215
MANWLLSKDGNTLAYNIGIGVNSPGFLSGNWYWGELSGFSFWEVPPWGMDFVGDVGEVFVVEWAFSIGWASDREKI

SEQ ID NO: 138994 - protein, 130 aa, Glycine max
  Coding DNA Sequence Number=SeqID_22216
  Gene Ontology: Biological process=translation
  Homolog annotation: Hit_ID=P62768; Match level="QueryCoverage=96%, HitCoverage=99%, E-value=3e-58, Identity=86%"; Hit description =UPF0325 protein yaeH
MYDNLKSLGISNPEDIDRYSLRQEANNDILKIYFRKDKGEFFAKSVKFKYPRQRKTVVADHTTQGYKEIQEISPNLRYVIDELDQICQRDQVEVDLKRKILADLRHLENVVSNKIAEIESDLDQLTRNGR

SEQ ID NO: 138995 - protein, 414 aa, Glycine max
  Coding DNA Sequence Number=SeqID_22217
  Gene Ontology: Mol. function=transcription factor activity; Cellular component=signal recognition particle, endoplasmic reticulum targeting; Biological process=regulation of transcription, DNA -dependent
  Homolog annotation: Hit_ID=Q6D1Z7; Match level="QueryCoverage=91%, HitCoverage=98%, E-value=1e-173, Identity=79%"; Hit description =Carbohydrate diacid regulator
  Pfam annotation: Domain name=Diacid_rec; Domain location=35-339; Score=509.1; E_value=5e-150; Accession=PF05651.3; Description =Putative sugar diacid recognition
MLLRPQSSVPSQCDRCRNSGNHPAAMCSCTMPGAIGMRILSDIVARTMKIIDSNVNVMDARGRIIGSGDRERIGELHEGALLVLSQGRVVDIDEAVAKHLHGVRPGINLPLRIDGDIVGVIGLTGQPSTLRHYGELVCMTAEMMLEQARLLHMLAQDSRLREELVLNLIRSDTLSSALNEWAQRLGIDLNQPRVVAVVEVDSGQLGVDSAMSELQQLQTLLTTPDRDNLIAIVSLTEMVVLKPALNAHGRYDQDDHRRRVDQLLQRMKESGQVRMRIALGNFFTGPGSIARSYRTARTTMMVGKQRMPQQRSFFYQDLVLPVLLDSLRGGWQASELARPLAKLKSMDNNGLLRRTLVAWFSHNVQPSATARALFIHRNTLEYRLNRISELTGLNLANFDDRLLLYVALQLDEQA

SEQ ID NO: 138996 - protein, 60 aa, Glycine max
  Coding DNA Sequence Number=SeqID_22218
MTYQGKTCGVYPDLSSFTGSGIYPDLSSVIGRGVNQISVACIKRSAPSQVRIIWYQSFGS

SEQ ID NO: 138997 - protein, 52 aa, Glycine max
  Coding DNA Sequence Number=SeqID_22219
MEETMARERRRERESTDMNGRETNQNSAREQQQYQKVSFHNIISMLSNLRKL

SEQ ID NO: 138998 - protein, 255 aa, Glycine max
  Coding DNA Sequence Number=SeqID_22220
  Gene Ontology: Mol. function=protein binding; Biological process=two -component signal transduction system (phosphorelay)
  Homolog annotation: Hit_ID=Q1SH09; Match level="QueryCoverage=89%, HitCoverage=39%, E-value=1e-104, Identity=81%"; Hit description =Leucine-rich repeat; Leucine-rich repeat, ribonuclease inhibitor subtype; Leucine-rich ...
  Homolog annotation: Hit description=repeat, cysteine-containing subtype
MGGVCSRKRDQHVVEDDLHRGVSGRYCRSGSTKWLRARSLRAKPNHCAGGGTCPSLMDLCIKKMREDFHKYNSFSILPRDISQQIFNELVDSHCLTEVSLEAFRDCALQDIDLGEYVGVNDDWMDVISSQGLSLLSVDVAGSQVTDDGLRLLKDCSSLQALTLSYCDQFSEYGLKHISGLSNLTSLSIRKSSSVKPDGMRAFSNLFNLEKLDLERCSEIHGGFVHLKVRYGWLIGLPDIWGVWWGVGPPVGYQNH

SEQ ID NO: 138999 - protein, 577 aa, Glycine max
  Coding DNA Sequence Number=SeqID_22221
  Gene Ontology: Mol. function=oxidoreductase activity; Cellular component=membrane; Biological process=electron transport
  Homolog annotation: Hit_ID=Q1S4Y7; Match level="QueryCoverage=88%, HitCoverage=94%, E-value=0.0, Identity=68%"; Hit description =Berberine and berberine like, putative
  Pfam annotation: Domain name=BBE; Domain location=480-537; Score =109.2; E_value=1.2e-29; Accession=PF08031.2; Description=Berberine and berberine like
  Pfam annotation: Domain name=FAD_binding_4; Domain location=86-225; Score=96.7; E_value=7e-26; Accession=PF01565.13; Description=FAD binding domain
  Pfam module annotation: Pfam domain module=BBE::FAD_binding_4; Domain location=480-537::86-225
  Subcellular localization annotation: CTP_CleavageSite=58; ConfidenceScore=5.27e-01
MKKSSLFPSGNFLFLFLLLLLNVSASLAAPTPESVYTSFLQCLTNYTKSPDQVSNIVFAQTNASFSSVLQAYIRNARFNTTSTPKPLLVVTPSEEPHVQGAVICAKSIAIQLKIRSGGHDYEGISYVSDQPFIILDMFHFRNITVDIENEVAVVQAGATLGELYYRIWEKSKVHGFPAGVCPTVGVGGHLSGGGYGNMLRKHGLSVDHVVDAKIVDAKGRILDKESMGEDLFWAIRGGGGASFGVILSYNVKLVPVPEVVSVFRIAKSLDQNESATELVLQWQQVAPHTDDRLFMRLLLQPVSSKVVKGQRTIRATVMALFLGGADEVATLMGKEFPALGLSKENCTELSWIDSVLWWGNFDNTTKPDALLDRDLNSASFLKRKSDYVQKPIPKKGLEGIWEKMIELGKTGFVFNPYGGKMSEVSSDATPFPHRAGNLFKIQYSVNWDDPGVELENNFTSQARMLYSYMTPFVSSSPRSAFLNYRDLDIGTNSFGKNSYAEGAVYGVKYFNDNFERLVKIKTEVDPENFFRNEQSIPVHPRLDSEAIKSGAGKLLHLTLYWTLMVLIEVSWIIQQKE

SEQ ID NO: 139000 - protein, 214 aa, Glycine max
  Coding DNA Sequence Number=SeqID_22222
TIDKFDSYLVSSGYIPFNSSVTRLFFCNYFPRYHKLAGTFQNLAIAQHNSDGTCAHYGTKEIVSFDHEMVATRRDDIRLYARSTQVETSTIQEIRAQMKQLRNKIEANLKVSRQKHEADMRRLREENANIRARHVIHHPPPPPPSLLTPPHSPSFQAPIHAQTRNQENHTLLSSYSNREETPIHSKLRSLNIHNDVIHLHSFVDDIIDIPLPIT

SEQ ID NO: 139001 - protein, 348 aa, Glycine max
  Coding DNA Sequence Number=SeqID_22223
  Gene Ontology: Mol. function=transferase activity, transferring nitrogenous groups; Cellular component=intracellular; Biological process=regulation of transcription, DNA-dependent
  Homolog annotation: Hit_ID=UPI0000E698AF; Match level="QueryCoverage =98%, HitCoverage=71%, E-value=3e-84, Identity=48%"; Hit description =transcriptional regulator, GntR family
  Pfam annotation: Domain name=GntR; Domain location=19-82; Score=68.6; E_value=2e-17; Accession=PF00392.11; Description=Bacterial regulatory proteins, gntR f
MRHSLVTLFQQSPHTAGTLRDRLCGALRQAIHQGALNVGQRLPSSRVLASDLSLSRVTVEAAYGQLEAEGYLQRRVGQGTFVAITIAKSPPPASGSGMPRLSQRGQQIVQTGGCRDPQQPQAFAAGSPDLRAFPLALWKQLTAQRLRLQGESLLRYGDPQGYLPLREAIAAHVNQTRGVVCDARQVIVLTSSQQALQLIATLLLDRGDSVWMEEPGYTGARNAFISAGAALTPVAVDGDGLRAESSLPDPRLIYLTPSHQYPTGAALSLARRLALLALAERQQAWIIEDDYDSEFHYDGLPIPAMQGLDRRGRVLYLGTFSKSLFPSLRLAYLIAPPALVEAFVTART

SEQ ID NO: 139002 - protein, 527 aa, Glycine max
  Coding DNA Sequence Number=SeqID_22224
  Gene Ontology: Mol. function=oxidoreductase activity; Cellular component=membrane; Biological process=electron transport
  Homolog annotation: Hit_ID=Q1S4X9; Match level="QueryCoverage=99%, HitCoverage=99%, E-value=0.0, Identity=68%"; Hit description =Berberine and berberine like, putative
  Pfam annotation: Domain name=BBE; Domain location=469-525; Score =105.8; E_value=1.3e-28; Accession=PF08031.2; Description=Berberine and berberine like
  Pfam annotation: Domain name=FAD_binding_4; Domain location=80-219; Score=78.0; E_value=3e-20; Accession=PF01565.13; Description=FAD binding domain
  Pfam module annotation: Pfam domain module=BBE::FAD_binding_4; Domain location=469-525::80-219
  Subcellular localization annotation: CTP_CleavageSite=64; ConfidenceScore=5.44e-01
MATSMVKLAFLSITVFISIFPSASTSAGHDKGFLQCFQTMLGVDNTTSGVIFTKTSSSYEPILKSSIRNARFLDTSVPKPNLIVTPHNLFHIQVALFCSKKSGLQVRIRSGGHDYEGLSYVSHVPFIIIDLFNLRSITINMDEETAWVESGATLGELYYAIEKKSEVHGFPAGSCSTVGVGGHLSGGGFGTIFRKYGLASDNIIDAQIINVNGKILNRTLMGEDLFWAIRGGGGSSFGVITAWKIKLVPVPSKVATFDVSRTLDQGATTLFHKWQTIAPKLPKELFLHTVVGVTNSASEEGGKTVVVSFSGLYLGTPENLLPLMQNSFAELGLRRDNFTEMTWIQSGLYFAGFSKDESLEVLLRRNPTSPSFKAKSDYVKEPIPLHGLEGLWKMLLLENPPPFIFTPYGGIMSEISESETPFPHRKGNLYGIQYSVNLVSNEEAPKHIEWLRRLHAYLAPYVSKFPRQAYLNYRDLDLGVNRGNSSYENGKSWGLKYFNCNFERLARVKAEVDPGNFFRDEQSIPPL

SEQ ID NO: 139003 - protein, 529 aa, Glycine max
  Coding DNA Sequence Number=SeqID_22225
  Gene Ontology: Mol. function=oxidoreductase activity; Cellular component=membrane; Biological process=electron transport
  Homolog annotation: Hit_ID=Q1S4X9; Match level="QueryCoverage=99%, HitCoverage=99%, E-value=0.0, Identity=66%"; Hit description =Berberine and berberine like, putative
  Pfam annotation: Domain name=BBE; Domain location=471-527; Score =99.2; E_value=1.2e-26; Accession=PF08031.2; Description=Berberine and berberine like
  Pfam annotation: Domain name=FAD_binding_4; Domain location=80-221; Score=82.2; E_value=1.6e-21; Accession=PF01565.13; Description=FAD binding domain
  Pfam module annotation: Pfam domain module=BBE::FAD_binding_4; Domain location=471-527::80-221
  Subcellular localization annotation: CTP_CleavageSite=63; ConfidenceScore=5.47e-01
MANSMVNLVFLSLTLFISIFPATSTFAGHQKGFLQCFQTMLGVDNTTSGVIFTKTSSSYEPILESSIRNARFLNSSAPKPNLIVTPHSLFHIQVALFCSKKSGLQVRIRSGGHDYEGLSYVSHSHIPFLIIDLVNLRSITINMDEETAWVQSGATVGELYYAIAKKSKVHGFPAGSCSTIGIGGHLSGGGFGTIFRKYGLGSDNVIDAQIIDVNGKILNRTLMGEDLFWAIRGGGGSSFGVITAWKIKLVPVPSKVTTFDVSRTLDQGATTLFHKWQTIAPKLPKELFLHTVVGVTNSASQEGGKTVVVSFSGLYLGTPENLLTLMQNSFAELGLRRDNFTEMTWIQSVLHYAGFSIDESLEILLRRNHSPPSFKAKSDYVKEPIPLRGLEGLWKMLLLDNSPLLILTPYGGIMSEISESETPFPHRKGNLYGIQYMVNFASNEDAPKHIDWIRRLYAYMTPYVSKFPRRAYLNYRDLDLGANQGKPWYEKAKSWGLKYFNCNFERLALVKARVDPGNFFRDEQSIPPL

SEQ ID NO: 139004 - protein, 59 aa, Glycine max
  Coding DNA Sequence Number=SeqID_22226
MEAWMWDTCVGATMKVTAEIGREGSEWRERHWRMVSEVAVRTWSRKIETKGRITDMVLD

SEQ ID NO: 139005 - protein, 549 aa, Glycine max
  Coding DNA Sequence Number=SeqID_22227
  Gene Ontology: Mol. function=oxidoreductase activity; Cellular component=membrane; Biological process=electron transport
  Homolog annotation: Hit_ID=Q1S4Y7; Match level="QueryCoverage=71%, HitCoverage=73%, E-value=1e-115, Identity=51%"; Hit description =Berberine and berberine like, putative
  Pfam annotation: Domain name=BBE; Domain location=349-394; Score =36.7; E_value=8.3e-08; Accession=PF08031.2; Description=Berberine and berberine like
  Pfam annotation: Domain name=FAD_binding_4; Domain location=1-99; Score=13.8; E_value=0.00029; Accession=PF01565.13; Description=FAD binding domain
  Pfam module annotation: Pfam domain module=BBE::FAD_binding_4; Domain location=349-394::1-99
MSQTPFVIVDMFMLKSVEVDVEDQTAWVDSGSTIGELYYAIAEKSRVLGFPAGVCHSVGVGGHFSGGGYGNMMRRFGLSVDNVLDALIVDSEGRVLDRATMGEDLFWAIRGGGGASFGVIVSWKIRLVPVPEVVTVFRIEKTLEQDASDLVFQWQYVADKIHDGLFIRVVLSPVTRSDRKTIKAKFNALFLGNSQELLSVMNQSFPQLGLVAEQCIQMSWIQSVLFWDNYPVGTSVDVLLQRHATKEKFLKKKSDYVQQPISKAALEGIWKMMMELEKPVFTFNPYGGKMGEISEFETPFPHRFGNIFKIQYSVSWDEEGEDVAKQYLYQIRRLYDYMTPYVSYSPRSSYLNYRDVDIGVNGPGNATYAQASVWGRKYFKRNFDRLVQKRRSLEGLKSANSSHSHVSPHYAPPETESLLNHCYQRDLPRAMHVLDAMERRGVWADAISYSELIKCCLAHGAVRERKRVHRHIFSNGHHPKTFLTNSLINMSNSTSWKKRRVGVVPNMFTFSSVLRACESLSDLKQLHSLIMKVGLESDVFVRSALIDVY

SEQ ID NO: 139006 - protein, 248 aa, Glycine max
  Coding DNA Sequence Number=SeqID_22228
  Gene Ontology: Mol. function=oxidoreductase activity; Cellular component=integral to membrane; Biological process=cytochrome complex assembly
  Homolog annotation: Hit_ID=UPI00005F8A95; Match level="QueryCoverage =100%, HitCoverage=36%, E-value=9e-93, Identity=65%"; Hit description= COG4232: Thiol:disulfide interchange protein
MLKIIRLACACLFMLWLPALQAADSGWLQNPANDHAKVRLRADTSQPGETRLLLSVELQKGWKTYWRSPGEGGIAPAIVWQGNPPPATWHWPTPQRFEVAGISTQGYHDRVTLPIVMSGQVAGPLAGTLTLSTCSNVCILTDYPFSLDLTTPNDPQFNHDFAQAMGQVPIAAGVAESVKAGYLNGELQIAAERAAGWQQPALFFDTLADADLGKPQVETDGAQLLARVPVSDGWGDAAPDLRGKTLTL

SEQ ID NO: 139007 - protein, 201 aa, Glycine max
  Coding DNA Sequence Number=SeqID_22229
  Homolog annotation: Hit_ID=O33917; Match level="QueryCoverage=51%, HitCoverage=85%, E-value=4e-19, Identity=50%"; Hit description =Suppressor for copper-sensitivity A
  Subcellular localization annotation: CTP_CleavageSite=10; ConfidenceScore=5.57e-01
MARGGGMRRRAAMVGANSASSRPSPNSTVSNIIGGAASNDLALSSQGVGCASAAVSPDRTAVAAGIPSVCCSACRPAMRWVMHVSTTRQARHKNHFAIRCRLTMPSSRSGIIVGKPVLFAGYDDDSLLQAFCGDTQRRTGDMQPLSGPGTPIAGERPPSPGKTAATDDQPLSPAQRTTLEKLIVKIMTLSPAKPAEIWATL

SEQ ID NO: 139008 - protein, 663 aa, Glycine max
  Coding DNA Sequence Number=SeqID_22230
  Gene Ontology: Mol. function=transporter activity; Cellular component= intracellular; Biological process=transport
  Homolog annotation: Hit_ID=Q94FN1; Match level="QueryCoverage=93%, HitCoverage=99%, E-value=0.0, Identity=75%"; Hit description =Phosphatidylinositol transfer-like protein III
  Pfam annotation: Domain name=CRAL_TRIO; Domain location=161-347; Score=145.7; E_value=1.3e-40; Accession=PF00650.10; Description =CRALTRIO domain
  Pfam annotation: Domain name=CRAL_TRIO_N; Domain location=69-144; Score=54.7; E_value=3e-13; Accession=PF03765.5; Description=CRALTRIO, N-terminus
  Pfam module annotation: Pfam domain module=CRAL_TRIO::CRAL_TRIO_N; Domain location=161-347::69-144
MSGPLDRFARPCFEGFSGSDEKKERRSDFENSEDERRTRIGSLKKKALNASSKFKHSLKKKSSRRKSDGRVSSVSIEDVRNFEEQQAVDAFRQALIMEELLPEKHDDYHVMLRFLKARKFDIERAKHMWADMLQWRKEFGTDTIMEDFEFKEVDEVVKYYPHGHHGVDKEGRPVYIERLGKVDPNKLMQVTTMDRYVKYHVQEFEKAFKIKFPACTIAAKRHIDSSTTILDVQGVGLKNFTKSARDLIMRLQKIDGDNYPETLCQMFIINAGPGFRLLWNTVKSFLDPKTTSKIHVLGNKYQSKLFEIIDASELPEFLGGTCTCADQGGCLRSDKGPWKNPEILKMILSGEARRARPVVKVLNSEGKVIAYARPQYPMVKGSDTSTAESGSEAEDIASPKVTKSYSHLRLTPVREEAKVVGKSSSAGGGNLAGYDEYVPMVDKAVDAAWKNQASLQRSQTSKGKPPLPDTPNPPEGIRARIVVALTVFFMTLFTLFHSFACRVTKKLPAVSSNDDQGTSEPTLDITKINNDDYRPPSPTPAYAEANLLSSMMKRLGELEVKVDTLQSKPSEMPYEKEELLNAAVCRVDALEAELIATKKALYEALMRQEELLAYIDSQEEARLRVSLSFVSSEHHCKLRKRLWERVFSNHGVSSADLAHDVKL

SEQ ID NO: 139009 - protein, 82 aa, Glycine max
  Coding DNA Sequence Number=SeqID_22231
MWILASQFSINLNIDAANVNCIDTNLTQRLKNIFFLENETCHQTNANFAQCQGQVIRAWVKSNPNIDIYDPSNPGFILSVDQ

SEQ ID NO: 139010 - protein, 200 aa, Glycine max
  Coding DNA Sequence Number=SeqID_22232
MGIYRSAKKLKYHKEYANANSTIQALANCDASFFKEIQNDGNLKSLIPSLDISMLKTTGKLSFPTTFTSPEGIEVNSFIVTYTDFDKYKEISTFDVKGQFYYWGFESLQSFNEIVKILSQKINLVKIGNIYTYNPMIRNTVDGQWMANNSAVDGVAPEENSAEKLFIIEDNKEKGVVSIMCTLQGEITDKDLYLTGLLKK

SEQ ID NO: 139011 - protein, 123 aa, Glycine max
  Coding DNA Sequence Number=SeqID_22233
MVILRLLSSRGGGPDDMRRQTMVILLTFCHLDRVVFDGTQRQIMVILRLLSSRGGGPDDMREPFGTALFHLLSSRGGGPDDMREPFGSALFHLLSSRGGGPMTCGNNLVTHFFTFCHPEAAAR

SEQ ID NO: 139012 - protein, 230 aa, Glycine max
  Coding DNA Sequence Number=SeqID_22234
VQSNYLGLVGYQPNLVSRQFGLSQIRPKSLFEDPQDVIRGANLSEKTFKKFLKISLDENYNLHPFEFNHSHFCTMGFVTWWEKYYSTRSVGDTTIMISRLESGFTQPTVENIRSNLQARGKTIMTKKSAETSRADVRPKKPTGVKIQEGKQEEKIQKKDDSTETTTTSKRSKHAGVELDEEKDASFISNVNIIAFFQVYTLTILYPRNTGRRGKTTHKKKKVTYDFDQVC

SEQ ID NO: 139013 - protein, 92 aa, Glycine max
  Coding DNA Sequence Number=SeqID_22235
  Subcellular localization annotation: CTP_CleavageSite=50; ConfidenceScore=5.09e-01
MSENHTGTTIVEKEKLTDKKDIKGLIKPISNSPTMKSSACMRLFSASLPRFSMRWNYAIILLLAMPFLNMKNNMRTMFHTFFATTISSACFL

SEQ ID NO: 139014 - protein, 375 aa, Glycine max
  Coding DNA Sequence Number=SeqID_22236
  Homolog annotation: Hit_ID=Q7XDI4; Match level="QueryCoverage=98%, HitCoverage=38%, E-value=7e-49, Identity=32%"; Hit description =Expressed protein
  Pfam annotation: Domain name=DUF810; Domain location=1-373; Score= -117.7; E_value=2.6e-15; Accession=PF05664.2; Description=Protein of unknown function (DUF810)
VWNPRANKECFAPSALEILGIIEDSLEAFFLLPIPMHAALLPELMSALDKSLQQYLLKAKSGCGNRNTFIPIMPALTRCSARSKFHDVFRKKEKSQATDQRRIFHHGTTNVDSSFGLPQFCVRINTMQRIGMGLKVLEKRTVARLGNSKSTKEDGIEKGLKFKLSKAASVEGIRQLSEAMAYKVIFQDLRYVLWDGLYVGEVSSTRIEPFLEELNQCLKIILSTVHDRVLTHVITEVMKASFDGFLLVLLAGGPARAFSLEDHVIIEEDFKLLTDLFWSNGEGLPADLIEKHCTTVKEVLPLFRMDTEDLTELFSELILGMYGSSAKFHLPLPTTSGHWSPREPNTLLRILCHRSDDAAAKFLKKNYNLPKKSNR

SEQ ID NO: 139015 - protein, 322 aa, Glycine max
  Coding DNA Sequence Number=SeqID_22237
MQKNGVSIFWKSPETKRSSTQETIQRTIAIKPKLDEGHGVILLGRKGMPSRLDQMDFPDSGNVDFAGEAKESSSGRDDESDGAKEDKAEEEFGHINEIFGRGKEVELEPESTQPEESSKIQHKHLCKTKSEKVGLESRSESGHKEHGNEKYRNRPIINDSKSSNKEEDVQLREQLNEVHVRKNATSGFSKKENDGDEGSRIREKETRKHKNVAENDTNAEVTEEIDEVQSFHDENGVPPDVNETEIVFAQAHIVHEENISNVRKGSWLRKHTYEVTYVEDNIVEVNLEASKNDADVESNTESIAHVDISGVKCNSEISEGNS

SEQ ID NO: 139016 - protein, 162 aa, Glycine max
  Coding DNA Sequence Number=SeqID_22238
  Gene Ontology: Mol. function=sequence-specific DNA binding; Cellular component=nucleus; Biological process=regulation of transcription, DNA-dependent
  Homolog annotation: Hit_ID=Q1T5K9; Match level="QueryCoverage=98%, HitCoverage=98%, E-value=6e-28, Identity=40%"; Hit description =Transcription factor, MADS-box
MGRRKIEITEVKDSNTKQVTFSKRRTEVAIVVFSPGNNPYSFGHPSVDVVVDKFLKQEPKSNVVQGTSNEAGDIDRLNQQLSNVEDQIREEQKKAAELNERMKQKGVTQTFQNKELQGSYLEIQKMKDYFDAIEVSDYMLLLAKEPLVGITKQVATKKRRRN

SEQ ID NO: 139017 - protein, 415 aa, Glycine max
  Coding DNA Sequence Number=SeqID_22239
  Homolog annotation: Hit_ID=Q7XDI4; Match level="QueryCoverage=99%, HitCoverage=44%, E-value=2e-86, Identity=39%"; Hit description =Expressed protein
  Pfam annotation: Domain name=DUF810; Domain location=1-415; Score =4.1; E_value=7.5e-19; Accession=PF05664.2; Description=Protein of unknown function (DUF810)
MVLPLELIQQLKCSDFPSEQEYEAWLRRNLKVLEAGLLLHPRLPLDKADTSALRLQQIIHEGLEKPMDIGKDSESMLALRSVVMSLAWRSFDGSVPDTCHWADGFPLNLRIYQTLLEACFDNHDETCVIQEVDEVLELIKTTWAMLGVNEMLHDVCFSWVLFQRYVANGQVDNDLLFASSNLLAEVEKDAKAMKDPFYAKSLSYALNLMLSWAEERLLAYHDTFHNGNIESMQSVVSLAVSSAKILAGDISLECNKEADKLEKLDPRNSKHVPRQQDKVFPTLSVLARDISELAFNEKATFSPILKRWHPLAAGVAVATLHVCYGHEVKQYVKSVTELTPDAVEMLMAADKLEKDLVQIAVEDSVDSEDGGKSVIREMYPYEAEALIINLVKSWIKTRVEGLEECVDRNLQEERI

SEQ ID NO: 139018 - protein, 56 aa, Glycine max
  Coding DNA Sequence Number=SeqID_22240
MHEHAVEFEDLPFPFAPNLSESEIRETAYEMLVGACRSSGPKPLTFFSHSEQSNRG

SEQ ID NO: 139019 - protein, 394 aa, Glycine max
  Coding DNA Sequence Number=SeqID_22241
  Gene Ontology: Mol. function=catalytic activity; Cellular component =intracellular; Biological process=metabolic process
  Homolog annotation: Hit_ID=Q1S1R8; Match level="QueryCoverage=95%, HitCoverage=100%, E-value=2e-90, Identity=41%"; Hit description =Tetratricopeptide-like helical
  Pfam annotation: Domain name=PPR; Domain location=125-159; Score =12.8; E_value=0.23; Accession=PF01535.11; Description=PPR repeat
  Pfam annotation: Domain name=PPR; Domain location=160-194; Score =10.0; E_value=0.49; Accession=PF01535.11; Description=PPR repeat
  Pfam annotation: Domain name=PPR; Domain location=90-124; Score=47.6; E_value=4.1e-11; Accession=PF01535.11; Description=PPR repeat
  Pfam module annotation: Pfam domain module=PPR::PPR::PPR; Domain location=125-159::160-194::90-124
MEERRMLGCCLVTCYVEMLKPDSYTISSMVSSCAKLASLYHGQVVHGKVVVMGIDNSMLMSSALVDMYCKCGVTLDARVIFETMPIRNVITWNALILGYAQNGQVLEALTLYERMQQQNFKPDNITFVGVLSACINADMVKEVQKYFDSISEQGSAPTLDHYACMITLLGRSGSVDKAVDLIQGMPHEPNCRIWSTLLSVCAKGDLKNAELAASRLFELDPRNAGPYIMLSNLYAACGRWKDVAVVRFLMKEKNAKKFAAYSWVEVGNKVHRFVSEDHSHPEVGKIYGELNRLISILQQIGYNLDTNIVLHNAGEEEKFRSISYHSKKLALAFALIRKPNGVAPIRIIKNIRVCDDCHVFMKFASITISRPIIMRDSNRFHHFFGAKCSCNDNW

SEQ ID NO: 139020 - protein, 77 aa, Glycine max
  Coding DNA Sequence Number=SeqID_22242
MGYMRFNLKKFLKVTSKESAIIAGDLRPRDVGNASTVGATVKAPLLLAIQPRGLQRSFPRRLAACDVQRRCSRVSPG

SEQ ID NO: 139021 - protein, 64 aa, Glycine max
  Coding DNA Sequence Number=SeqID_22243
METSTCKRGSLPCASPNVVISWVADRMSKFSEKRAMLSLSSKENPNPTQMNPVHDDVTEQDDVS

SEQ ID NO: 139022 - protein, 582 aa, Glycine max
  Coding DNA Sequence Number=SeqID_22244
  Gene Ontology: Mol. function=transporter activity; Cellular component= integral to membrane; Biological process=transport
  Homolog annotation: Hit_ID=Q6ERI3; Match level="QueryCoverage=73%, HitCoverage=63%, E-value=2e-35, Identity=28%"; Hit description =Ankyrin repeat family protein-like
  Pfam annotation: Domain name=Ank; Domain location=114-150; Score =15.4; E_value=0.19; Accession=PF00023.20; Description=Ankyrin repeat
  Pfam annotation: Domain name=Ank; Domain location=163-193; Score =18.6; E_value=0.022; Accession=PF00023.20; Description=Ankyrin repeat
  Pfam annotation: Domain name=Ank; Domain location=197-229; Score =10.1; E_value=1.1; Accession=PF00023.20; Description=Ankyrin repeat
  Pfam annotation: Domain name=Ank; Domain location=230-262; Score =10.5; E_value=0.96; Accession=PF00023.20; Description=Ankyrin repeat
  Pfam annotation: Domain name=Ank; Domain location=266-299; Score =19.5; E_value=0.012; Accession=PF00023.20; Description=Ankyrin repeat
  Pfam annotation: Domain name=Ank; Domain location=300-332; Score =16.8; E_value=0.081; Accession=PF00023.20; Description=Ankyrin repeat
  Pfam annotation: Domain name=Ank; Domain location=370-401; Score=0.1; E_value=30; Accession=PF00023.20; Description=Ankyrin repeat
  Pfam module annotation: Pfam domain module=Ank::Ank::Ank::Ank::Ank::An k::Ank; Domain location=114-150::163-193::197-229::230-262::266 -299::300-332::370-401
MEIQPAADLDEEDISAVSSRLLSLSSPSSFLLPYQTDDSNQNFTRIDRKLYVAAMKGDFQELSNEQNLESLLTPNKNTVLHIHLTSTTSQTVSEEFVTKILKECGCLVLLPNAKRETVLHIAARYGHSNIAKLLLEHVKAFPPSDIEKGIGAEKKFMRATNNEKDTALHEAVRYHHIEVVKTLLEMDPDYSYDANNADETPLYLASQRQNQQVVAEILNKMKSPAYGGPNNRTALHAAVINQDIVMARDLVKNKHVRKAVKHADKEGWIPLHYAVKTGNLGLTKLLLAQDGNTAYMQDNEGMTALHIAAYDGDWLIMNMIIEYYPDCSEIVDKKGLNVLHYAVNGGSGTTVDIIMENLSLSNLYSEKDFDGNTPIHHLTNSNLMCESFVFHRRVDKLAVNKEAQTALDVAYCKIEDSDQSDFSSISITEEAKETHLLVATLIATVSFAAGITVPGGTIQDGENKGSPVLVQSSFFKAFMVSNTISMVLAATAVSIYLFTPVTRNKRKENAFSKTALVFTLIALAAMIIAFITGTYVVLESSRVIAVAIFLIGLSSFMLAYYVVAFWHGYGKPLPPTCGIYLK

SEQ ID NO: 139023 - protein, 253 aa, Glycine max
  Coding DNA Sequence Number=SeqID_22245
  Gene Ontology: Mol. function=transporter activity; Cellular component= intracellular; Biological process=transport
  Homolog annotation: Hit_ID=Q1SKK1; Match level="QueryCoverage=100%, HitCoverage=55%, E-value=3e-82, Identity=54%"; Hit description =Cellular retinaldehyde-binding/triple function, N-terminal
GLRSLNKAARDLIQRLQKIDGDNYPEVLGNKYQSKLLEIIDASELPEFLGGTCTCADKGGCMLSDKGPWNDTEIMKMVQNGEGKCKRKTLSGIEEKTIIQDETACQKFPVQLGAVPEVTFVPVIDKQVNASWEKAVQNIQFAVSKDCFPCDASKTLNGLRIPFTGVIMAILMGVITMIRMTRNMPGKVTEAAMYAPANSMDDQMCLMKHMAELEDKVNVLSMKPAMSSEMEELLNNALNRASTLEQELDTTKK

SEQ ID NO: 139024 - protein, 94 aa, Glycine max
  Coding DNA Sequence Number=SeqID_22246
  Gene Ontology: Mol. function=transporter activity; Cellular component= intracellular; Biological process=transport
  Homolog annotation: Hit_ID=Q1T5S4; Match level="QueryCoverage=92%, HitCoverage=16%, E-value=3e-27, Identity=70%"; Hit description =Cellular retinaldehyde-binding/triple function, N-terminal
MSMSSLPIADHRPVKDEDDKKTKLGSLKKVAISASSKFKHSLQKKGRRHSRVLAVAIEDDVDAEQLQVVHAFRQALILEELLPAKHDDHHKMLR

SEQ ID NO: 139025 - protein, 167 aa, Glycine max
  Coding DNA Sequence Number=SeqID_22247
  Gene Ontology: Mol. function=dihydrofolate reductase activity; Cellular component=cellular_component; Biological process=one-carbon compound metabolic process
  Homolog annotation: Hit_ID=Q1T5S8; Match level="QueryCoverage=100%, HitCoverage=31%, E-value=5e-71, Identity=75%"; Hit description =Bifunctional dihydrofolate reductase/thymidylate synthase
  Pfam annotation: Domain name=DHFR_1; Domain location=1-167; Score =213.7; E_value=4.1e-61; Accession=PF00186.9; Description =Dihydrofolate reductase
MGISKDAKLPWTLPTELKFFEEITTTTSDPGKKNAVVMGRKTWESIPPENRPLPGRLNVVLTRSGSFDIATAENVLICGSMASAMELLASSPYCLSIEKVFLTGGGEIFREALNAPGCEAAHITEIEASIECDTFMPRVDTNVFQTWYSSFPLVEDNLRYSFTTYAR

SEQ ID NO: 139026 - protein, 201 aa, Glycine max
  Coding DNA Sequence Number=SeqID_22248
  Homolog annotation: Hit_ID=Q9FJZ5; Match level="QueryCoverage=96%, HitCoverage=96%, E-value=1e-21, Identity=29%"; Hit description =Arabidopsis thaliana genomic DNA, chromosome 5, TAC clone:K1F13
MDSFSFNNLQAEKANAILKHRKLRRVASFIRIIEVCTILVFISRFSMQLPVAVKNSSVYFKDLSLFMNSPRFVFLIGNVIIIALFAQFSAQGNNVPEPDLYQEFVQNTTKNHRHTETVVAEYSKKKQRMKTGQVNNGLKKGYRRCETENGRKSIEPAPVEEVARISCPEDGMSNEEFRRTVEAFIARQQRMRKEEEDYYLM

SEQ ID NO: 139027 - protein, 87 aa, Glycine max
  Coding DNA Sequence Number=SeqID_22249
MGSTIDIGVPFKHCFLLYASLASSSHQTESPRWWKSKTNLAAMATNMKHHCTVASIVCPLLLTLSYPNMKEIFISKREPQNSRWINY

SEQ ID NO: 139028 - protein, 192 aa, Glycine max
  Coding DNA Sequence Number=SeqID_22250
  Gene Ontology: Mol. function=dihydrofolate reductase activity; Cellular component=nucleus; Biological process=one-carbon compound metabolic process
  Homolog annotation: Hit_ID=P51820; Match level="QueryCoverage=97%, HitCoverage=36%, E-value=1e-101, Identity=90%"; Hit description =Bifunctional dihydrofolate reductase-thymidylate synthase (DHFR-TS) [Includes: ...
  Homolog annotation: Hit description=Dihydrofolate reductase (EC 1.5.1.3); Thymidylate synthase (EC 2.1.1.45)]
  Pfam annotation: Domain name=Thymidylat_synt; Domain location=1-192; Score=339.7; E_value=5.1e-99; Accession=PF00303.9; Description =Thymidylate synthase
MACIGLTEREKGDLGPVYGFQWRHFGAKYTDMHADYSGQGFDQLLDVINKIKHNPNDRRIILSAWNPSDLKLMALPPCHMFAQFYVANGELSCQMYQRSADMGLGVPFNIASYALLTCMIAHVCGDFIHVIGDAHVYRNHVRPLQEQLQNQPKPFPILKINPKKKDIDSFVAADFKLIGYDPHQKIEMKMAV

SEQ ID NO: 139029 - protein, 324 aa, Glycine max
  Coding DNA Sequence Number=SeqID_22251
MPKKKKKVKQVEPEPPVAVEGGESIKKKKKKTKSSKEQGNNQPVDVQPPSTNIDGTEVEATPSIAEMGNPVDRPNSPREQSVVEVQQNVSVEEIPSHARTSPAPETDAVNVEEQGEGQGIGPSSPHGSSQKSSSEENFFDEEPIEEAEAGGSDIYPASSTSKLSASIGIAEDTFIQMQDEDPAAALRLLLNTSQANTSSEKNPGASSSSDAEINSSVRQDCLLLKLSMEYAREDVLKSIEENPSAAFGHLNFLKKLHNPLTSDEILGKVIQIESINLQVLCRKNAKMAPDSMPRNRPISFCSRKPERLNVKSNVSPKRQKKDLL

SEQ ID NO: 139030 - protein, 166 aa, Glycine max
  Coding DNA Sequence Number=SeqID_22252
MKADMKAMKEQMATMMEAMMSMKKIMEANAVAIAATRTVVETHEMPHHNLADFEPCLGYATEGRAVGAGKNPHAMAEMGKLDHLEERLMVIEGGKDYAFANLEELFLVPNIITPPKFKVPNFDKYKGTTCSKNHLKMCCRKMGAYAKDEKLLIHFFQESFTGIAVT

SEQ ID NO: 139031 - protein, 452 aa, Glycine max
  Coding DNA Sequence Number=SeqID_22253
  Gene Ontology: Mol. function=protein kinase activity; Biological process=protein amino acid phosphorylation
  Homolog annotation: Hit_ID=Q2N1D8; Match level="QueryCoverage=31%, HitCoverage=29%, E-value=8e-13, Identity=29%"; Hit description=CMV 1a interacting protein 2
  Pfam annotation: Domain name=LRR_1; Domain location=118-140; Score =7.2; E_value=13; Accession=PF00560.23; Description=Leucine Rich Repeat
  Pfam annotation: Domain name=LRR_1; Domain location=142-165; Score =13.6; E_value=0.72; Accession=PF00560.23; Description=Leucine Rich Repeat
  Pfam module annotation: Pfam domain module=LRR_1::LRR_1; Domain location=118-140::142-165
MAISSTWYLFLPIILSLCLITLCGTVLEDLKNLHQPPDFNTTIFSKCLKNPSLRYCSSNPMMDLEKILGFTIVASYLCNEPKNPNCVESFPKVDLRNRPNIAPLYLSFDFFWKYFPLSIISIDLSNNSMKGDFPIDVLHCTQIQSLDLSINAFSGDIPIQSFSPLINLTFLNRSYNCFSESKLSDSQFSKRFNSSSFLHSGALLDQKRPDFLPSKLQRSRRFTPAILKAAIDGFSNKYLVGKSDVVHIYKGILRDGTEVKIEMYWDDIPRDSYRKFVEEFNVLSKLHHKNLFRVLGWCRSRKFRSIITEWTREENVEMWLSGHQDEWPEVDYELNTSSILLSDKMEPLISRFKVGDQNSNRRKICRFGVFLLEMRDLQQKIDERMEVTETNFHQVKQALSIGLMCIDQSNSEKPSLGMIFNTIARGYKASLVSANHRISHGEKFKGHMHVQT

SEQ ID NO: 139032 - protein, 60 aa, Glycine max
  Coding DNA Sequence Number=SeqID_22254
MGQRVRWQAEIPYGRPHHSLTKENEFDGFYSSRPETSSPTTHEILLCWAGMIKFDSMWKR

SEQ ID NO: 139033 - protein, 509 aa, Glycine max
  Coding DNA Sequence Number=SeqID_22255
  Gene Ontology: Mol. function=translation initiation factor activity; Cellular component=cellular_component; Biological process=regulation of translational initiation
  Homolog annotation: Hit_ID=Q2R678; Match level="QueryCoverage=85%, HitCoverage=97%, E-value=1e-179, Identity=73%"; Hit description =Expressed protein
  Pfam annotation: Domain name=W2; Domain location=411-490; Score=70.1; E_value=7e-18; Accession=PF02020.8; Description=eIF4-gammaeIF5eIF2 -epsilon
  Subcellular localization annotation: CTP_CleavageSite=44; ConfidenceScore=5.83e-01
PNSVLFCPLFSVSPFLSVSLSLFFSSSTESQTHRSSDSLSSWFMSSKERPTLGGTRIKTRKRNIAAPLDPAAFSDAVVQIYLDNAGDLELIAKSIESSDLNFSRYGDTFFEASFLNYLKTFTLIVDCSAMGLDAFRFIKTFSIYVVFTGGRTQPGTTKPDEGDRHPYSIIECEPKREVILPSVIYIQKILRRRPFLIKNLENVMRKFLQSLELFEENERKKLAIFTALAFSQKLSGLPPETVFQPLLKDNLVAKGLVLSFMTDFFKEYLIDNSLDDLISILKRGKVEENLLDIFPPTKRSNEAFSEHFTKEGLVALVEYNEKKNFEVKLKEMKSSLTAQLTDEADTSEVIETVKLRVRDAKLPDIEVVRILWDVLMDAVQWSGKNQQQNANAALRQVKTWAELLNTFCTTGKLELELMYKVQMQCYEDAKLMKLFPEIVRSLYDQDVLAEDTILHWFRKGTNSKGRQTFVKALEPFVNWLEEAEEEDFIELNVNVSIVQGEEESRNLTS

SEQ ID NO: 139034 - protein, 594 aa, Glycine max
  Coding DNA Sequence Number=SeqID_22256
  Gene Ontology: Mol. function=diaminohydroxyphosphoribosylaminopyrimidi ne deaminase activity; Biological process=riboflavin biosynthetic process
  Homolog annotation: Hit_ID=Q1S453; Match level="QueryCoverage=84%, HitCoverage=38%, E-value=0.0, Identity=82%"; Hit description =CMP/dCMP deaminase, zinc-binding; Bacterial bifunctional deaminase- reductase, C-terminal
  Pfam annotation: Domain name=DUF1768; Domain location=425-581; Score =230.4; E_value=4e-66; Accession=PF08719.1; Description=Domain of unknown function (DUF1768)
  Pfam annotation: Domain name=RibD_C; Domain location=185-390; Score =193.7; E_value=4.3e-55; Accession=PF01872.8; Description=RibD C -terminal domain
  Pfam annotation: Domain name=dCMP_cyt_deam_1; Domain location=30-128; Score=26.0; E_value=1.8e-06; Accession=PF00383.13; Description =Cytidine and deoxycytidylate deaminas
  Pfam module annotation: Pfam domain module=DUF1768::RibD_C::dCMP_cyt _deam_1; Domain location=425-581::185-390::30-128
MALSCLTLTANPSSVICKCKVSLPTAPHALDATYIRRAAHLADKSAGFTSPHPNFGCVIVSPSGKVSGEGYLYAQGTTAAEVQAVASAAELCRGATAYLNLEPSDCHGDHSAVSALLQGGVKRVVIGMRHPLQHLRGNAVRALRNQGLHVDLLGEDLTSNLIEDAQKECLLVNAPLICRASLRVPFSVLKYAMTLDGKIAATTGHASWISCKQSRNLVFELRGRSDAVIVGGNTVRRDNPRLTARHGGGHMPMRIVMTQTLDLPEEANLWDMSEVSTIVVTQRGARRSFQKLLASKGVEVVEFDILNPREVMEYFHDCGYLSILWECGGTLAASAISSGVIHKVYAFVAPKIIGGKNAPSPVGDLGMVAMSQALNLIDVCYEQVGPDMLISGFLQPLPDMVPVIPSLNETFVVDPTVSPYESRIIFFYKTWDPYGVLSNYSPHPIQMPDENGDCVTWMSVEHYYQAHKFIRVDDPLAQDCVERIKSAISPEEAARIGRSMQKQKPYLIRSDWDNIKIDVMYRALKCKFSIYPQLNSMLLSTAGSVLVEASPHDLFWGRGRDGEGLNYLGKLLMKLRSEFLGESSSSSETPSLTV

SEQ ID NO: 139035 - protein, 109 aa, Glycine max
  Coding DNA Sequence Number=SeqID_22257
  Homolog annotation: Hit_ID=Q9FI20; Match level="QueryCoverage=66%, HitCoverage=29%, E-value=9e-17, Identity=58%"; Hit description =Arabidopsis thaliana genomic DNA, chromosome 5, P1 clone:MFC16
  Pfam annotation: Domain name=DUF858; Domain location=29-103; Score= -137.5; E_value=0.049; Accession=PF05891.2; Description=Eukaryotic protein of unknown function (DUF858)
MDAAGLDSDGREFKTPEDMWREQAGDPSKKTQWYRDGVSYWEGVKANMDGVLGGFANVNEPDITCSEDFLNILFSERFHAADARHQPLVVLGTHSLFLSPTCENQCGSC

SEQ ID NO: 139036 - protein, 250 aa, Glycine max
  Coding DNA Sequence Number=SeqID_22258
  Gene Ontology: Mol. function=zinc ion binding
  Homolog annotation: Hit_ID=Q1T1D9; Match level="QueryCoverage=92%, HitCoverage=83%, E-value=4e-39, Identity=40%"; Hit description=Zinc finger, RING-type; RINGv
  Pfam annotation: Domain name=zf-C3HC4; Domain location=60-106; Score =51.0; E_value=3.9e-12; Accession=PF00097.15; Description=Zinc finger, C3HC4 type (RING finger)
MGDNVTVSTTQHHIAIPIEKLNASLEAAKEENSVTDDAYVDNDVQKSQEKDEETEEKGECRYCQEEDLVSNMESPCNCNGSVKYVHRRCIDQWYNSKGRMILCEICRKPYNPNDYPPLPELHSDNDDTEIIILRQEWTIPGTNTQIRSPLVLADRATKGLIDSMNKDFSLRNPTGGVIFGMSLVIFIAVLLIKDAYEFAPPKEEKFAHFLYSAVMTISVPVYILSWVLQCQAYRKSERERERERQRDRNA

SEQ ID NO: 139037 - protein, 168 aa, Glycine max
  Coding DNA Sequence Number=SeqID_22259
  Gene Ontology: Mol. function=methyltransferase activity; Cellular component=cytoplasm
  Homolog annotation: Hit_ID=Q10CT5; Match level="QueryCoverage=96%, HitCoverage=39%, E-value=1e-61, Identity=67%"; Hit description =AFR615Wp, putative, expressed
  Pfam annotation: Domain name=Bin3; Domain location=50-139; Score= -46.6; E_value=0.039; Accession=PF06859.3; Description=Bicoid -interacting protein 3 (Bin3)
  Pfam annotation: Domain name=DUF858; Domain location=1-145; Score =181.5; E_value=2.1e-51; Accession=PF05891.2; Description=Eukaryotic protein of unknown function (DUF858)
  Pfam annotation: Domain name=Methyltransf_11; Domain location=3-87; Score=2.4; E_value=0.032; Accession=PF08241.2; Description =Methyltransferase domain
  Pfam module annotation: Pfam domain module=Bin3::DUF858::Methyltransf_ 11; Domain location=50-139::1-145::3-87
MEVDLLEPVSHFLETARETLALGCQTNSDMHKAVNFYCVPLQDFTPDTARYDVIWIQWCIGHLTDEDFVSFFKRAKVGLKPGGFFVLKENIARSGFVLDNEDRSVTRSDLYFKELFSRCGLHVYKSKDQKGFPEELFAVKMYALTTDPPKKAPRAKSKTSTNRPRTIM

SEQ ID NO: 139038 - protein, 1289 aa, Glycine max
  Coding DNA Sequence Number=SeqID_22260
  Gene Ontology: Mol. function=transmembrane receptor activity; Cellular component=membrane; Biological process=defense response
  Homolog annotation: Hit_ID=Q2HUD1; Match level="QueryCoverage=98%, HitCoverage=97%, E-value=0.0, Identity=65%"; Hit description=TIR; Disease resistance protein; AAA ATPase
  Pfam annotation: Domain name=LRR_1; Domain location=1167-1188; Score =4.0; E_value=51; Accession=PF00560.23; Description=Leucine Rich Repeat
  Pfam annotation: Domain name=LRR_1; Domain location=1190-1212; Score =10.8; E_value=2.7; Accession=PF00560.23; Description=Leucine Rich Repeat
  Pfam annotation: Domain name=LRR_1; Domain location=1237-1258; Score =11.5; E_value=2; Accession=PF00560.23; Description=Leucine Rich Repeat
  Pfam annotation: Domain name=LRR_1; Domain location=1261-1282; Score =9.0; E_value=6; Accession=PF00560.23; Description=Leucine Rich Repeat
  Pfam annotation: Domain name=LRR_1; Domain location=560-585; Score =3.8; E_value=56; Accession=PF00560.23; Description=Leucine Rich Repeat
  Pfam annotation: Domain name=LRR_1; Domain location=626-647; Score =3.5; E_value=62; Accession=PF00560.23; Description=Leucine Rich Repeat
  Pfam annotation: Domain name=LRR_1; Domain location=649-671; Score =10.8; E_value=2.7; Accession=PF00560.23; Description=Leucine Rich Repeat
  Pfam annotation: Domain name=LRR_1; Domain location=673-692; Score =2.7; E_value=88; Accession=PF00560.23; Description=Leucine Rich Repeat
  Pfam annotation: Domain name=LRR_1; Domain location=696-717; Score =9.7; E_value=4.3; Accession=PF00560.23; Description=Leucine Rich Repeat
  Pfam annotation: Domain name=LRR_1; Domain location=720-741; Score =9.8; E_value=4.2; Accession=PF00560.23; Description=Leucine Rich Repeat
  Pfam annotation: Domain name=LRR_1; Domain location=743-765; Score =10.8; E_value=2.8; Accession=PF00560.23; Description=Leucine Rich Repeat
  Pfam annotation: Domain name=LRR_1; Domain location=767-789; Score =10.3; E_value=3.4; Accession=PF00560.23; Description=Leucine Rich Repeat
  Pfam annotation: Domain name=LRR_1; Domain location=791-812; Score =10.9; E_value=2.6; Accession=PF00560.23; Description=Leucine Rich Repeat
  Pfam annotation: Domain name=LRR_1; Domain location=862-885; Score =10.2; E_value=3.5; Accession=PF00560.23; Description=Leucine Rich Repeat
  Pfam annotation: Domain name=LRR_1; Domain location=887-908; Score =14.1; E_value=0.52; Accession=PF00560.23; Description=Leucine Rich Repeat
  Pfam annotation: Domain name=LRR_1; Domain location=910-929; Score =0.5; E_value=2.3e+02; Accession=PF00560.23; Description=Leucine Rich Repeat
  Pfam annotation: Domain name=LRR_1; Domain location=931-956; Score =3.2; E_value=73; Accession=PF00560.23; Description=Leucine Rich Repeat
  Pfam annotation: Domain name=LRR_3; Domain location=603-622; Score =27.7; E_value=4.1e-05; Accession=PF07725.3; Description=Leucine Rich Repeat
  Pfam annotation: Domain name=NACHT; Domain location=214-366; Score= -31.1; E_value=0.015; Accession=PF05729.3; Description=NACHT domain
  Pfam annotation: Domain name=NB-ARC; Domain location=177-469; Score =153.9; E_value=4.2e-43; Accession=PF00931.13; Description=NB-ARC domain
  Pfam annotation: Domain name=TIR; Domain location=23-152; Score =166.3; E_value=7.9e-47; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_3::NACHT::NB-ARC::TIR; Domain location=1167-1188::...
  Pfam module annotation: Domain location=1190-1212::1237-1258::1261 -1282::560-585::626-647::649-671::673-692::696-717::720-741::743 -765::767-789::791-812::862-885::887-908::910-929::931-956::603 -622::214-366::177-469::23-152
  Subcellular localization annotation: CTP_CleavageSite=9; ConfidenceScore=5.06e-01
MGSSNEGSSSSTLTSGRSWSNHVFLSFRGDDTRKGFTGHLFASLERRGIKTFKDDHDLQRGKLISVELMKAIEGSMLALIILSPNYASSTWCLDELKKILECKKEVFPIFHGVDPSDVRHQRGSFAKAFSEHEEKFREDKKKLERWRHALREVASYSGWDSKEQHEATLIETIVGHIQKKIIPRLPCCTDNLVGIDSRMKEVYSLMGISLNDVRFIGLWGMGGIGKTTIARFVYEAIKGDFNVSCFLENIREVSKTNGLVHIQKELLFHLNVRSSDFYNLHDGKNIIANSLSNKKILLVLDDVSELSQLENLAGKQEWFGSGSRVIITTRDKHLLKTHGVHLTCKAKGLAQNEALKLFCLKAFKQDQPKEEYLNLCKEVVEYARGLPLALEVLGSHLYGRTVEVWHSALEQIRSFPHSKIQDTLKISYDSLQPPYQKMFLDIACFFKGMDIDEVKNILKNCGYHPEIGIDILIERCLVTLDRMKKLGMHDLLQEMGRNIVFQESPNDPGKRSRLWSQKDIDYVLTKNKGTDEIQGIVLNLVQPCDYEGRWSTEAFSKTSQLKLLMLCDMQLPRGLNCLPSSLKVLHWRGCPLKTLPLNNKLDEVVDLKLPHSRIEQLWRGTKLLEKLKSINLSFSKNLKQSPDFGGAPNLESLVLEGCTSLTEVHPSLVRHKKLAMMNLKDCKRLKTLPSKMEMSSLKDLNLSGCSEFKYLPEFGESMEHLSVLSLEGTAIAKLPSSLGCLVGLAHLYLKNCKNLVCLPDTFHNLNSLIVLNVSGCSKLGCLPEGLKEIKSLEELDASGTAIQELPSSVFYLENLKSISFAGCKKPVSNSVSGFLLPFQWVFGNQQTPTAFRLPPSKLNLPSLMRINLSYCNLSEESFPDGFRHLSSLQFLDLTGNNFVTLPSCISNLTKLEILLLNLCKKLKRLPELPSRMKHLDASNCTSLETSKFNPSKPCSLFASSPSNFHFSRELIRYLEELPLPRTRFEMLIPGSEIPSWFVPQKCVSLAKIPVPHNCPVNEWVGFALCFLLVSYANPPEACHHEVECYLFGPNGKTIISSRNLPPMELDCPHLYILYLSIDKYRDMICEGVVGSEIEFVLKSYCCQSLEIVRCGCRLVCKQDVEDIYENSIISSSEEIGVASEKFELNPFACFIEMIRANVNQDIKLLEKLKSIDLSFSKNLKQSPDFDGAPNLESLVLEGCTSLTEVHPSLVRHKKPVMMNLEDCKRLKTLPSKMEMSSLKYLSLSGCSEFEYLPEFGESMEQMSVLNLEETPITKLPSSLGCLVGLAHLD

SEQ ID NO: 139039 - protein, 48 aa, Glycine max
  Coding DNA Sequence Number=SeqID_22261
MASGGILTGAVTSYKANISMCIVQLCAELMNASELLYSMLDAGSECLS

SEQ ID NO: 139040 - protein, 116 aa, Glycine max
  Coding DNA Sequence Number=SeqID_22262
MTPSQQHDAPMATPNAPFAPQWNRLSKQNRGDNAAAEEILIVKREDGIDHVAHLHDITDTIMTDFDGFMDYGLVWPMDYGLWVRGLDYGLWLGLEVWGLRVEGLRDRVELFGLGLG

SEQ ID NO: 139041 - protein, 81 aa, Glycine max
  Coding DNA Sequence Number=SeqID_22263
  Homolog annotation: Hit_ID=Q5VRV5; Match level="QueryCoverage=50%, HitCoverage=4%, E-value=3e-08, Identity=70%"; Hit description =Putative transcriptional corepressor LEUNIG
MALSSPLDTCLPCTKSPSEMVAGYIASISGFSFSEVGSICKSNNKVVCCHFSSDGKLLASVGLDKKVCPPSGNFMSLFVIW

SEQ ID NO: 139042 - protein, 392 aa, Glycine max
  Coding DNA Sequence Number=SeqID_22264
  Gene Ontology: Mol. function=transferase activity, transferring glycosyl groups; Cellular component=integral to membrane; Biological process=metabolic process
  Homolog annotation: Hit_ID=Q9ZWQ5; Match level="QueryCoverage=96%, HitCoverage=79%, E-value=1e-172, Identity=76%"; Hit description=UDP -glycose:flavonoid glycosyltransferase
  Pfam annotation: Domain name=UDPGT; Domain location=1-377; Score= -114.7; E_value=7.7e-05; Accession=PF00201.9; Description=UDP -glucoronosyl and UDP-glucosyl transferase
MAAHLIMPQLESLVKHSPPDVFIPDILFTWTKDFSQKLSISRLVFNLISIFDVCMIHAIKTHPEAFASDSGPFLIPDLPHPLTLPVKPSPGFAALTESLLDGEQDSHGVIVNSFADLDAEYTQHYQKLTGRKVWHVGPSSLMVQKTVKSSTVDESRHDCLTWLDSKKESSVLYICFGSLSLISDEQLYQIATGLEGSGHCFLWVVHRKNKDGEEGDSSSSSGKWLPEGFEEKIAKENRGMLIKGWAPQPLILNHPAVGGFLTHCGWNAVAEAISSGVPMVTMPAFGDQYYNEKLITEVHGFGVEVGAAEWSISPYEGKKKVVSGERIESAVKRLMDDGEKGKRMRSKAKEMQEKAWKAVQEGGSSYDSLTALIHHFKTLVPNHVNGNGNIDH

SEQ ID NO: 139043 - protein, 63 aa, Glycine max
  Coding DNA Sequence Number=SeqID_22265
MRRHVDLVGGFIVGGGGEGARCLPGALRGRWGNFDDVGRGCGGPEAGVLCRMFWVKEFERLAG

SEQ ID NO: 139044 - protein, 49 aa, Glycine max
  Coding DNA Sequence Number=SeqID_22266
MESQFPLPVFFPQLEASNAYNGMGDRRSSRVHQMKMLSRQMEIMMKAQV

SEQ ID NO: 139045 - protein, 212 aa, Glycine max
  Coding DNA Sequence Number=SeqID_22267
  Gene Ontology: Mol. function=transferase activity, transferring glycosyl groups; Cellular component=membrane
  Homolog annotation: Hit_ID=Q9FN55; Match level="QueryCoverage=90%, HitCoverage=37%, E-value=1e-87, Identity=78%"; Hit description =Arabidopsis thaliana genomic DNA, chromosome 5, P1 clone:MYC6
  Pfam annotation: Domain name=DUF604; Domain location=128-211; Score= -42.4; E_value=5.8e-11; Accession=PF04646.3; Description=Protein of unknown function, DUF604
FGIGASAKLWKQRKEYIKLWWRPNEMRGVVWLEQKVKTEAQNEDFLPPLRISSDTSRFKYKNQKGHRSAIRISRIVSETLRLGMEGVRWFVMGDDDTVFVAENLVKVLQKYDHNQFYYIGSSSESHLQNIYFSYNMAYGGGGFAISYPLAVALEKMQDRCIQRYPGLYGSDDRIQACMAELGVPLTKEKGFHQENYREIGGRVKIDRKWKDI

SEQ ID NO: 139046 - protein, 455 aa, Glycine max
  Coding DNA Sequence Number=SeqID_22268
  Gene Ontology: Mol. function=transferase activity; Biological process= alkaloid metabolic process
  Homolog annotation: Hit_ID=Q9LU88; Match level="QueryCoverage=98%, HitCoverage=95%, E-value=8e-63, Identity=33%"; Hit description =Acetyltranferase-like protein
  Pfam annotation: Domain name=Transferase; Domain location=3-442; Score=260.0; E_value=4.9e-75; Accession=PF02458.6; Description =Transferase family
MKVEVEIISREDIRPSSPTPSHLRVFNLSLLDHLIPSPYAPIILYYTSPNSDKTCFSEVPKRLELLKKSLSETLTQFYPLGGKIKELDFSIECNDEGANFVQAKVKCPLDKFLVQPQLTLLHKFLPTDLVSEGSNSGTYVTNIQVNIFECGGIAIGLCISHRILDGAALSTFIKGWSERAKGFNCDQLTKPNFIGSALFPTNNNPWLRDLSMRMWGSFFKQGKWVTKRFLFRNSDIAKLKAQTLGTATSTRLEIVSSMLWKSLMGVSKVRFGTQRPSLVTHLVNLRRRMDEALCPQHAMGNLLWLVAAEKMCDDHDEMGLEDLVGKLRKSISQVDEKFVEELRGDKGRSIMKESLGAISEKGSKGEVVDYVGFSSWCNFGYYEADFGWGKPTWVSGVGSIGSVSMFMNLIILVDTRLGDGIEAWVTLDEEDMTHLEANTELLTCATLDPSPLTMS

SEQ ID NO: 139047 - protein, 586 aa, Glycine max
  Coding DNA Sequence Number=SeqID_22269
  Gene Ontology: Cellular component=membrane
  Homolog annotation: Hit_ID=Q6EPN3; Match level="QueryCoverage=88%, HitCoverage=88%, E-value=3e-96, Identity=39%"; Hit description =Mechanosensitive ion channel domain-containing protein-like
  Pfam annotation: Domain name=MS_channel; Domain location=391-577; Score=43.4; E_value=7.5e-10; Accession=PF00924.9; Description =Mechanosensitive ion channel
MAAVRSSSVRRLGSTIKGSFSMELVHHSMCMNLARFPSDSFNDPYYKRELQFSKNQFSNLASESLGSSHHFGTRANVLVKPTFSGYCFWSSLPFASMSNHVLNRRMYSSSSVGDKGSRDGGTEVSAGSGASDMNTGGDSVVGGDWAERIKDAWKSVAEAASYAGDKVKETSDDLTPYAQQLLDSHPYLDKVVIPVGGTLTATIIAWFLLPRILRKFHKYAMQGPVSLLPASVAGEPVPYEKSFWGAMEDPVRYLVTFIAFSQIYMTADFDFQWCYGGSNNYNLTISCSRLEGWKTNVFARSLSSQSLLGLDREKVFALDKISSIGLFVIGIMALAEACGVAVQSIVTVGGIGDFIGICKPTERIGWGCVNGALCLQNGSKSTPIHLEELDTWILLLVVKAKYKINSVATAFATKDILGNVFSGLSMQFSKPFSIGDTIKAGSIEGQVVEMGLTSTSLLSSEKFPVIVPNSFFSSQVIVNKSRAEYRAIITKIPLQTEDLSKIPQISDDVKSMLRSNANVFLGKDVPYCFLSRIESSYAELTLGYNLKHMRKDELYSAEQDILLQAVQIIKNHGVALGSTWQDTSSK

SEQ ID NO: 139048 - protein, 55 aa, Glycine max
  Coding DNA Sequence Number=SeqID_22270
MNEGEKGIGAEKQQLLTDPAIDLVVEPLSEYEEEMEEARNHHALWRSSTADTALC

SEQ ID NO: 139049 - protein, 135 aa, Glycine max
  Coding DNA Sequence Number=SeqID_22271
MQRLLRAEAKERSKKKGVHGEPFFPRDCVRRRGWCEGADRATKARSVRAVVLQAAGGAFDGADSGGWLGFEFGVSAFSLQAVFVSADGNIFISYLRIAIGLGDYLEDLEKLRSNQAIKEASAYLPRGQRLCGFDG

SEQ ID NO: 139050 - protein, 338 aa, Glycine max
  Coding DNA Sequence Number=SeqID_22272
  Gene Ontology: Mol. function=signal transducer activity; Cellular component=membrane; Biological process=signal transduction
  Homolog annotation: Hit_ID=Q6D133; Match level="QueryCoverage=71%, HitCoverage=37%, E-value=4e-64, Identity=56%"; Hit description =Putative methyl-accepting chemotaxis protein
  Pfam annotation: Domain name=MCPsignal; Domain location=63-270; Score= 206.6; E_value=5.6e-59; Accession=PF00015.11; Description=Methyl -accepting chemotaxis protein (MCP) signaling domain
MAIFRSSLPVTRRDEVGQLIDAINGIGGGLQKIVLQVREAAGEIQTGTNALASDTGEISEQINKQASSVEETSASMEQLAATVQQNAANMEQTQQLVGETSRAVHEGGETVTHAVATMDDIREASKRIEDITRVIESIAFQTNILALNAAVEAARAGEHGKGFAVVAQEVRALAGRSANAVKEIEQLIGDTLRKVSEGHALSEQTRLAMDSIIVHIDNISQLVTEINHASREQSAGIGQVNLAMTHIVCSSLNASQPCPWRAAANRFAPARSSAYRHGYPASCGTTPAPRAAMRAAASGSRPPARKAAARSPAPAPPVVYAAFAEAGASCGQSVCPAL

SEQ ID NO: 139051 - protein, 56 aa, Glycine max
  Coding DNA Sequence Number=SeqID_22273
  Gene Ontology: Mol. function=acyl-CoA dehydrogenase activity; Biological process=electron transport
  Homolog annotation: Hit_ID=P33224; Match level="QueryCoverage=97%, HitCoverage=10%, E-value=5e-18, Identity=76%"; Hit description =Protein aidB
AMELLGGVGYCEESELSPPVSRNAGEQYLGRLRQYHVPGRAARADEAAGDPRPAGR

SEQ ID NO: 139052 - protein, 218 aa, Glycine max
  Coding DNA Sequence Number=SeqID_22274
  Pfam annotation: Domain name=Reg_prop; Domain location=114-138; Score= 13.3; E_value=0.92; Accession=PF07494.2; Description=Two component regulator propeller
  Pfam annotation: Domain name=Reg_prop; Domain location=70-94; Score =5.4; E_value=44; Accession=PF07494.2; Description=Two component regulator propeller
  Pfam module annotation: Pfam domain module=Reg_prop::Reg_prop; Domain location=114-138::70-94
MDVANHLLYLTDDTQKVIAYDILTRKKILCNISLPKSAIYRKGDFLVAYRGNTIDIFKRKNKFEFIKTQSFSVGEPIHQLVIDRNDRLWVCLDKGGVLYYKNTLRNGNLSRPMKIMNDFVMNHILVDKDKNIWFSTRNNGIYFITDKFFNNYIHLPVKNNSSYITAIGKSGKNIIMGVLHFIISLPVPNLTCLMKEPIQPYATTKTVSLLEVLRMCIK

SEQ ID NO: 139053 - protein, 79 aa, Glycine max
  Coding DNA Sequence Number=SeqID_22275
  Homolog annotation: Hit_ID=UPI00005F93A3; Match level="QueryCoverage =50%, HitCoverage=6%, E-value=4e-07, Identity=67%"; Hit description =COG1960: Acyl-CoA dehydrogenases
MEPAINARLCASGCITILTERAGSPACDPPPMQRARGLSILILIATEGGRQHALADPYRFQSTGTAFKQQSFPLRLRPA

SEQ ID NO: 139054 - protein, 269 aa, Glycine max
  Coding DNA Sequence Number=SeqID_22276
  Gene Ontology: Mol. function=transporter activity; Cellular component= integral to membrane; Biological process=transport
  Homolog annotation: Hit_ID=Q82MF2; Match level="QueryCoverage=99%, HitCoverage=59%, E-value=3e-78, Identity=52%"; Hit description =Putative integral membrane transport protein
  Pfam annotation: Domain name=MFS_1; Domain location=3-263; Score= -14.2; E_value=0.0014; Accession=PF07690.6; Description=Major Facilitator Superfamily
  Pfam annotation: Domain name=Sugar_tr; Domain location=1-269; Score= -153.0; E_value=0.044; Accession=PF00083.14; Description=Sugar (and other) transporter
  Pfam module annotation: Pfam domain module=MFS_1::Sugar_tr; Domain location=3-263::1-269
MATVIARNFFQLEGEAGLTSLILTWASFAIAFFFRPLGAVVFGRIGDRIGRKPTLIIVLVLMTLATTAIGLVPVYASIGIAAPLIVTLLRILQGLFAGGEYGGAVSLMTEFAPRGKRGLYGAWQSFTVALGLLAGAGIVALLSALLTPEALHDWGWRIPFFLALPMGAVALWLRVSMEETPSFVRQKEKPVVAQASTSATLKTILMGICRVMVWSAAGYTYLVIMPTYLQSALHTGFNQALLIAVISNIGFALTIIPSGILSDKIGRRT

SEQ ID NO: 139055 - protein, 91 aa, Glycine max
  Coding DNA Sequence Number=SeqID_22277
  Subcellular localization annotation: CTP_CleavageSite=28; ConfidenceScore=5.24e-01
MDSLSYPITSCTSHFFTSSLLLQVKSSSCNHQRCSLPEPNPYPMPKETKGVTYLQWRQGGCRRMGGATVAGWFNLLRESLEGDAVSWERKC

SEQ ID NO: 139056 - protein, 336 aa, Glycine max
  Coding DNA Sequence Number=SeqID_22278
  Gene Ontology: Mol. function=protein binding; Cellular component =integral to membrane; Biological process=defense response
  Homolog annotation: Hit_ID=Q0WX04; Match level="QueryCoverage=89%, HitCoverage=90%, E-value=1e-104, Identity=64%"; Hit description =Polygalacturonase inhibiting protein precursor
  Pfam annotation: Domain name=LRRNT_2; Domain location=25-65; Score =49.1; E_value=1.5e-11; Accession=PF08263.3; Description=Leucine rich repeat N-terminal domain
  Pfam annotation: Domain name=LRR_1; Domain location=123-142; Score =6.4; E_value=18; Accession=PF00560.23; Description=Leucine Rich Repeat
  Pfam annotation: Domain name=LRR_1; Domain location=147-169; Score =12.3; E_value=1.4; Accession=PF00560.23; Description=Leucine Rich Repeat
  Pfam annotation: Domain name=LRR_1; Domain location=171-193; Score =14.1; E_value=0.53; Accession=PF00560.23; Description=Leucine Rich Repeat
  Pfam annotation: Domain name=LRR_1; Domain location=196-218; Score =11.4; E_value=2.1; Accession=PF00560.23; Description=Leucine Rich Repeat
  Pfam annotation: Domain name=LRR_1; Domain location=219-240; Score =1.6; E_value=1.4e+02; Accession=PF00560.23; Description=Leucine Rich Repeat
  Pfam annotation: Domain name=LRR_1; Domain location=266-288; Score =12.2; E_value=1.5; Accession=PF00560.23; Description=Leucine Rich Repeat
  Pfam annotation: Domain name=LRR_1; Domain location=72-96; Score=6.2; E_value=20; Accession=PF00560.23; Description=Leucine Rich Repeat
  Pfam annotation: Domain name=LRR_1; Domain location=98-121; Score =6.9; E_value=15; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1; Domain location=25-65::123 -142::147-169::171-193::196-218::219-240::266-288::72-96::98-121
MSHSSTLFLFLIVLFFTPALSELCNPQDKEALLQIKKEFGNPTTLSSWLPTSDCCNNNWVGVSCANKTQSYRVNHLDLNDLNLPKPYPIPPSVGNLPYLNFLSITNTNNLVGTIPPTITKLTMLRELQIRFTNVSGEIPHFLSQIKTLESIIFHYNNFSGNLPPWLPSLPNLYRVSLDGNRISGTIPDSFGSFSDSLKLMTFSDNRLTGEIPATLAKLDFDFVDLSQNMLEGDASVLFGSEKHTLQINLANNSFAFDFGKVRVSKTLLILYLSHNRLYGALPEGLTSLKNLGTFDVSYNELCGTSLEAPTVKLNLQFAHPSPTWRIASQEASTSPF

SEQ ID NO: 139057 - protein, 71 aa, Glycine max
  Coding DNA Sequence Number=SeqID_22279
MVEYSFILHIISGGGDGAIASVGRGVEDGLLHGLREGEVVEEESDDGLEELVVGLGERGLALVREESHLGR

SEQ ID NO: 139058 - protein, 163 aa, Glycine max
  Coding DNA Sequence Number=SeqID_22280
  Gene Ontology: Mol. function=protein binding; Biological process =defense response
  Homolog annotation: Hit_ID=Q0WX04; Match level="QueryCoverage=88%, HitCoverage=55%, E-value=3e-28, Identity=49%"; Hit description =Polygalacturonase inhibiting protein precursor
MTQVHKLQVQLRQFRRNLPGEAVVGERHHPVSDFEKEPEMRFASKEISEKLGREGSQAGRLPEKMGHMAGEIGESDIEITKLGEFGDGGGYCANDVGGADDGKKFEVGKVTYGGGYRVEFGVVKVGEFEVVDAQSVVGSHEERVVEFPSSFLVLRRTFVSWVA

SEQ ID NO: 139059 - protein, 63 aa, Glycine max
  Coding DNA Sequence Number=SeqID_22281
MGENAYKIELPAEYEVSETLKVSDLFPYYEPVLFGGADSAASPRFVVTSPDSRGRVVSPTSGD

SEQ ID NO: 139060 - protein, 475 aa, Glycine max
  Coding DNA Sequence Number=SeqID_22282
  Homolog annotation: Hit_ID=Q9FFD9; Match level="QueryCoverage=63%, HitCoverage=78%, E-value=5e-60, Identity=43%"; Hit description =Genomic DNA, chromosome 5, P1 clone:MQK4
  Pfam annotation: Domain name=DUF1226; Domain location=154-472; Score=- 119.9; E_value=0.091; Accession=PF06775.4; Description=Protein of unknown function (DUF1226)
MLRSRDRKQERSVSCAKNLVGNVSSCLLFPNSSSIRILTDLVIKTHGGFGDVVLNMRQCAASSYYLDMDKSSHRVAKLPSIGNATTLSYSHADDTCGATLCNNTAPTCVYSSLPKSYHRAEETKDSVESAVQRAPSQSTHGSALLLKKLGLCFLSVAYVCMVMILALILAAVVGVALVRLWVEEPVSVKENLHFDYTEAHPTAVFLFNGVRSFKGHLKKKQISVPVGHSFFASLVLVMPESDFNRELGVFQLTAELISVNGNVIAKSSQPCMLRFRSSPIRLARTFMMGVPLVLGISGETQNINVEILRHKEDYRRSNAIRVTLHPRAGTSSLPQLYEADIVIKSHLPWTKELVRNWKWTFYVWVSLYVYIVLLVSLLCCYRPLVFLVTPEYFNDHRVSELTREEPGQLGDESEVSELLRKWRRSRSKRKTVLAHGGVPETIVGSSASSISMTAREDVTSVVMEDEVEDSESVCI

SEQ ID NO: 139061 - protein, 53 aa, Glycine max
  Coding DNA Sequence Number=SeqID_22283
  Subcellular localization annotation: CTP_CleavageSite=57; ConfidenceScore=5.52e-01
MVSGPVLPSGVDSAASPCFVVTSPVSRGRVASPTSGVTSPDSREHVVSPTSCG

SEQ ID NO: 139062 - protein, 101 aa, Glycine max
  Coding DNA Sequence Number=SeqID_22284
MALSLLLKLRKRNLSPLRIKHGSSKLSEKSNHKNTNRKSRDRAIEIEDETENEEKEERERERHTDEEIDLKFERDGNRKAKGVKSVEARDKEIFFPSPLQI

SEQ ID NO: 139063 - protein, 253 aa, Glycine max
  Coding DNA Sequence Number=SeqID_22285
  Gene Ontology: Mol. function=sequence-specific DNA binding; Cellular component=nucleus; Biological process=regulation of transcription, DNA-dependent
  Homolog annotation: Hit_ID=Q9SA80; Match level="QueryCoverage=99%, HitCoverage=53%, E-value=4e-32, Identity=38%"; Hit description =Probable WRKY transcription factor 14
  Pfam annotation: Domain name=WRKY; Domain location=232-253; Score= -11.7; E_value=0.019; Accession=PF03106.6; Description=WRKY DNA -binding domain
  Subcellular localization annotation: CTP_CleavageSite=65; ConfidenceScore=5.07e-01
MENYQGDLSDIIRASGASYGSCSTGTSSSEAANPFSRNYHLQFSSDPMIFSSVLEGFNSNFGDPFSNMRDPFLHELDLPLSAYFNSTSSSAEIKSSGALEEATCFGGGVVAGSSSSSNSCVLAQKILDEDDMRRPCNSILSNMIQISPNDKLPISPVVDSLSRPFKPSGAVSGHNMIDAKTSSDYCLVDNTKVQISSPRNPGLKRRKSLAKKSICVPAPAAPNSRQSGEVVPSDLWAWRKYGQKPIKGSPYPR

SEQ ID NO: 139064 - protein, 218 aa, Glycine max
  Coding DNA Sequence Number=SeqID_22286
  Homolog annotation: Hit_ID=O82268; Match level="QueryCoverage=54%, HitCoverage=56%, E-value=5e-46, Identity=72%"; Hit description =Expressed protein
  Pfam annotation: Domain name=DUF640; Domain location=1-133; Score =193.8; E_value=4.2e-55; Accession=PF04852.3; Description=Protein of unknown function (DUF640)
MSAAVAASAAAATMSGYHHNSSSRQQQHIDHELALTPQRVCVSPPLSSGAHVLEFLRYLDQFGKTKVHAETCGYFGNSHPPGPCACPLRQAWGSLDALIGRLRAAFEENGGAPEMNPFGTRAVRLYLREVRDAQAKARGIAYEKKKRRKPQQSGHDHDHDAMMMVGSTSDVNYSSGYSGGGGGAFVPHQQMLSDSNGTASTSDGVSYFSSSSQCGGFN

SEQ ID NO: 139065 - protein, 115 aa, Glycine max
  Coding DNA Sequence Number=SeqID_22287
  Gene Ontology: Mol. function=protein serine/threonine kinase activity; Cellular component=spindle pole body; Biological process =protein amino acid phosphorylation
  Homolog annotation: Hit_ID=Q39008; Match level="QueryCoverage=97%, HitCoverage=18%, E-value=1e-38, Identity=68%"; Hit description =Mitogen-activated protein kinase kinase kinase 1
  Pfam annotation: Domain name=Pkinase; Domain location=1-108; Score= -98.3; E_value=0.01; Accession=PF00069.15; Description=Protein kinase domain
  Pfam annotation: Domain name=Pkinase_Tyr; Domain location=1-108; Score=-152.1; E_value=0.0039; Accession=PF07714.7; Description =Protein tyrosine kinase
  Pfam module annotation: Pfam domain module=Pkinase::Pkinase_Tyr; Domain location=1-108::1-108
ATKFNDIKSSKGSPYWMAPEVVNLKNQGGYGLAADIWSLGCTVLEMLTRQPPYSDLEGMQALFRIGRGEPPPIPEYLSKDARDFILECLQVNPNDRPTAAQLFYHSFLRRTVLSP

SEQ ID NO: 139066 - protein, 91 aa, Glycine max
  Coding DNA Sequence Number=SeqID_22288
MEEKEGNLKGERQRGIRFSSSKGSKAKAKESRGKWKGREVSLSSCSDGFFRERKLRIAKMESFLRYAQRETQSLTPLLFSYFTHALQYAHL

SEQ ID NO: 139067 - protein, 295 aa, Glycine max
  Coding DNA Sequence Number=SeqID_22289
  Gene Ontology: Mol. function=protein serine/threonine kinase activity; Cellular component=cell cortex; Biological process=protein amino acid phosphorylation
  Homolog annotation: Hit_ID=Q7XTK4; Match level="QueryCoverage=58%, HitCoverage=21%, E-value=2e-40, Identity=51%"; Hit description =Putative mitogen-activated protein kinase 1
  Pfam annotation: Domain name=Pkinase; Domain location=96-295; Score= -67.0; E_value=0.00014; Accession=PF00069.15; Description=Protein kinase domain
  Pfam annotation: Domain name=Pkinase_Tyr; Domain location=96-295; Score=-139.5; E_value=0.00065; Accession=PF07714.7; Description =Protein tyrosine kinase
  Pfam module annotation: Pfam domain module=Pkinase::Pkinase_Tyr; Domain location=96-295::96-295
QDDDVSVPAAVSSSSPWSSGEHYVGRGSVGRLNLRHGERSVLFTDSDSFTTSHDDDSDVGGERERAGLASNSAAADELVIPFNSSNEWFRQTFASWQKGDVLGNGSFGTVYEGFNDDGFFFAVKEVSLLDEGGQGKQSFFQLQQEISLLSKFEHKNIVRYYGSNKDLGNRHKHFSNLKAFTWLKITLFIKHLGVYDISNNFFYLLICTWEKEMDKSKLYIFLELMSKGSLASLYQKYRLNDSQVSAYTRQILCGLKYLHDHNVVHSLKLDDNRYLSKCMTMTFRNPAFVVSLELI

SEQ ID NO: 139068 - protein, 173 aa, Glycine max
  Coding DNA Sequence Number=SeqID_22290
  Gene Ontology: Mol. function=oxidoreductase activity; Cellular component=endoplasmic reticulum; Biological process=steroid biosynthetic process
  Homolog annotation: Hit_ID=Q9ZT29; Match level="QueryCoverage=89%, HitCoverage=63%, E-value=8e-60, Identity=62%"; Hit description =Delta(7)-sterol-C5(6)-desaturase (EC 1.3.3.-) (Delta-7-C-5 sterol desaturase) (Delta(7)-sterol-C5-desaturase)
  Pfam annotation: Domain name=Sterol_desat; Domain location=39-171; Score=7.7; E_value=5.9e-06; Accession=PF01598.8; Description=Sterol desaturase
MEDPTTLLNSEYSRLFGEDTDLYNRIVLGALLPHSVWGPLPRFLQTWLRNYLGGVLLYLLSGLLWCFYIYYWKRNVHVPKDAIPSQRAMLLQISVAMKAMPWYSLLPTVSEYLVETGWTKCYPRLYNVEFGIYWMHRELHDIKPLYKYLHATHHIYNKQNTLSPFADVTGFKA

SEQ ID NO: 139069 - protein, 100 aa, Glycine max
  Coding DNA Sequence Number=SeqID_22291
MAIVLMDRLKFGGEDESRTSSPPYEAMDKNLKPNFSNDQSCKMHRQAMMVVLLTTTIVGSGNNGGGGSGSLSGNGRGNGGSRSDHDDCNIGGLAPLCAYV

SEQ ID NO: 139070 - protein, 176 aa, Glycine max
  Coding DNA Sequence Number=SeqID_22292
MKVNIKETMEKEEEDRRREAAIASSSCLRPNFNPKGITQDQLSKFRVGAPFHSVHYSFFSTSPTSKKLVNFRFFLHSKTWELHKRRLQLKSKSKFKMKSKDRANKKSHGDVLSSQNGGTQGSNVDHKESNLWNDCEGFDSRYEDSKDDIPVMSAPKKQKLHWGLDTKNRWERKSNM

SEQ ID NO: 139071 - protein, 190 aa, Glycine max
  Coding DNA Sequence Number=SeqID_22293
  Gene Ontology: Mol. function=chitin binding; Cellular component =extracellular region; Biological process=chitin metabolic process
  Homolog annotation: Hit_ID=UPI0000612705; Match level="QueryCoverage =99%, HitCoverage=93%, E-value=1e-14, Identity=25%"; Hit description =UPI0000612705 related cluster
GLHILTFRGQHVLTFKALDAIAFRGLHVLTFKRLHALTFRRLHVLALRGLHALAFRRLHVLAFRGLHVLDFRGLHAFSFRELHVLAFRGIHVLAIRGLHALTLRRLHVLTFRGLHALTFRGLNTLTIRGLHVLTIRGCTPSPLKGYMSLPIDGCTPSPLEGYAPSPLEDYMSSPTEGCTPSPSEGRTPSH

SEQ ID NO: 139072 - protein, 128 aa, Glycine max
  Coding DNA Sequence Number=SeqID_22294
  Gene Ontology: Mol. function=protein serine/threonine kinase activity; Cellular component=nucleus; Biological process=protein amino acid phosphorylation
  Homolog annotation: Hit_ID=Q40353; Match level="QueryCoverage=92%, HitCoverage=32%, E-value=1e-57, Identity=86%"; Hit description =Mitogen-activated protein kinase homolog MMK2
  Subcellular localization annotation: CTP_CleavageSite=23; ConfidenceScore=5.09e-01
MTIFFSFKKLIGSPDDASLGFLRSDNARRYVKQLPQYPKQNFSARFPTMSPGAVDLLEKMLIFDPNRRITVDEALSHPYMSPLHDINEEPVCTRPFSFDFEQPSFTEEDIKELIWRESVKFNPVPPVY

SEQ ID NO: 139073 - protein, 181 aa, Glycine max
  Coding DNA Sequence Number=SeqID_22295
  Gene Ontology: Mol. function=protein serine/threonine kinase activity; Cellular component=nucleus; Biological process=protein amino acid phosphorylation
  Homolog annotation: Hit_ID=Q40353; Match level="QueryCoverage=93%, HitCoverage=37%, E-value=5e-65, Identity=76%"; Hit description =Mitogen-activated protein kinase homolog MMK2
MSAVESAEHNNIRGVPTHGGRYVQYNIYGNLFEVSRKYVPPIRPVGRGAYGIVCAAVNAETGEEVAIKKIGNAFDNRIDAKRTLREIKLLRHMDHANIINNAQISSLAFILQSGLTAWLSIIYPMQIMSIKDIIRPPQKENFNDVYLVSELMDTDLHQIIRSNQQLTDDHCRVRTLTTFSI

SEQ ID NO: 139074 - protein, 497 aa, Glycine max
  Coding DNA Sequence Number=SeqID_22296
  Gene Ontology: Mol. function=protein serine/threonine kinase activity; Cellular component=membrane; Biological process=protein amino acid phosphorylation
  Homolog annotation: Hit_ID=Q10SE3; Match level="QueryCoverage=87%, HitCoverage=88%, E-value=1e-143, Identity=58%"; Hit description =Protein kinase domain containing protein, expressed
  Pfam annotation: Domain name=Pkinase; Domain location=162-433; Score =140.5; E_value=4.5e-39; Accession=PF00069.15; Description=Protein kinase domain
  Pfam annotation: Domain name=Pkinase_Tyr; Domain location=162-433; Score=129.0; E_value=1.3e-35; Accession=PF07714.7; Description =Protein tyrosine kinase
  Pfam module annotation: Pfam domain module=Pkinase::Pkinase_Tyr; Domain location=162-433::162-433
MFSVYDAAFVDTELSKRTSIFGLRLWVLIGILVGSLIVITLFLLSLCLTSRRRHHHHHHHHHKHRRHPTPPISKEILEIVHVPPPPDTGHLPPPPPLPPKPDHPRSAAMAALYSSGESRAAASVCETASSSLGSGSVGPEVSHLGWGRWYTLRELESATNGLCEENVIGEGGYGIVYCGLLPDGTKVAVKNLLNNKGQAEREFKVEVEAIGRVRHKNLVRLLGYCVEGEYRMLVYEYVNNGNLEQWLHGDAGPVSPMTWDIRMNIILGTAKGLAYLHEGLEPKVVHRDVKSSNILIDRQWNPKVSDFGLAKLLSADHSYVTTRVMGTFGYVAPEYACTGMLTEKSDVYSFGILIMEIITGRSPVDYSKPQGEVNLIEWLKSMVGNRKSEEVVDPKIAEKPSSRALKRALLVALRCVDPDAAKRPKIGHVIHMLEAEDLLFRDDRRSGGESSRSHRDYQLEHKDSRLDKRKIGGEITDQSEDDSTTSSRHHPQPTRWR

SEQ ID NO: 139075 - protein, 61 aa, Glycine max
  Coding DNA Sequence Number=SeqID_22297
  Gene Ontology: Mol. function=nucleoside-triphosphatase activity; Cellular component=membrane
  Homolog annotation: Hit_ID=Q8L5U8; Match level="QueryCoverage=82%, HitCoverage=10%, E-value=8e-13, Identity=70%"; Hit description =Rubisco expression protein, putative
MNSRSQDQRSRPAKPATIHGCALSGDLVGLQRLLRDNPSLLNERNPVIYLVLTHDDFGCRV

SEQ ID NO: 139076 - protein, 84 aa, Glycine max
  Coding DNA Sequence Number=SeqID_22298
  Gene Ontology: Mol. function=DNA binding; Cellular component=nucleus; Biological process=regulation of transcription, DNA-dependent
  Homolog annotation: Hit_ID=Q0PJI6; Match level="QueryCoverage=89%, HitCoverage=22%, E-value=2e-23, Identity=72%"; Hit description=MYB transcription factor MYB133
  Subcellular localization annotation: CTP_CleavageSite=63; ConfidenceScore=5.05e-01
MPDFAQVYSFIGSVFDPNSTNHLQKLQQMDPINVETSSQVLLLMTNLSVNLMSPEFEDHMIVLGMQDNESPVRSLLEAILCTVC

SEQ ID NO: 139077 - protein, 161 aa, Glycine max
  Coding DNA Sequence Number=SeqID_22299
  Gene Ontology: Mol. function=DNA binding; Cellular component=nucleus; Biological process=regulation of transcription, DNA-dependent
  Homolog annotation: Hit_ID=Q0PJI6; Match level="QueryCoverage=89%, HitCoverage=43%, E-value=2e-55, Identity=75%"; Hit description=MYB transcription factor MYB133
  Subcellular localization annotation: CTP_CleavageSite=100; ConfidenceScore=5.34e-01
IRSHAQKYFLKVQKNGTSEHVPPPRPKRKAARPYPQKAPKTPTVSQVMGPLQSSSAFIEPAYIYSPDSSSVLGTPVTNMPLSSWNYNTTPQPGNVPQVTRDDMGLTGAGQAAPLNCCYSSSNESTPPTWPRSKRINQGDQGKPIKGWNAFLSLNLHLILLE

SEQ ID NO: 139078 - protein, 141 aa, Glycine max
  Coding DNA Sequence Number=SeqID_22300
MAENLSKIILDMSKIEPLDGSNYRRWSQKLLILFEALEVDYVLFEDPPADVNASESSTPETPATPVVIVYAYMFLVEVGIVGARYAEKRKELEPEKWHANRGMILAFQRSDFLTFVTEYRSQSKEKVGPFCSTQMGTCGRA

SEQ ID NO: 139079 - protein, 97 aa, Glycine max
  Coding DNA Sequence Number=SeqID_22301
  Homolog annotation: Hit_ID=Q10DL9; Match level="QueryCoverage=50%, HitCoverage=16%, E-value=3e-13, Identity=68%"; Hit description =Dehydrogenase, putative, expressed
FLLPSKCIDLLAQIVKIWVVEITDSEVDDYDSDGKMGNGFYCQEMYLNEDGQLSWFNAGVRVGVGIGLGMCVGLGIGVGLLMRSYQTTTRNFRRRFF

SEQ ID NO: 139080 - protein, 190 aa, Glycine max
  Coding DNA Sequence Number=SeqID_22302
  Gene Ontology: Mol. function=nucleic acid binding; Biological process= DNA integration
  Pfam annotation: Domain name=RVP; Domain location=51-158; Score=-9.9; E_value=0.037; Accession=PF00077.10; Description=Retroviral aspartyl protease
MEQIHEYENLVGDILNEGMKMCHKAYECKLRKVQQSNNSKPAAPHAPQAHLAENEEVIAAVVVEANMVDNKVDWILDTGASKHLCANKELFHQIEDADDGECVFMGNSATAGVLGKGKIILKLTSGKTLSLSDVLYVPSLRWNLISGSCLNRAGLKLVFEADKVVITRNDERYVIKFCAFTFAYFFLCNK

SEQ ID NO: 139081 - protein, 250 aa, Glycine max
  Coding DNA Sequence Number=SeqID_22303
  Gene Ontology: Mol. function=oxidoreductase activity, acting on the CH-OH group of donors, NAD or NADP as acceptor; Cellular component =nucleus
  Homolog annotation: Hit_ID=Q10DL9; Match level="QueryCoverage=74%, HitCoverage=61%, E-value=7e-16, Identity=31%"; Hit description =Dehydrogenase, putative, expressed
MDQQDEEAIATKPSNSLSFPSLTHSACLEIRLFYVRISPCLVDTLPDHLTLCLPRRHAAVSLVVNAAPVPASAPTTLPLRRGRVDRHAAEVTYVATDTVSLSGSADFEVYENDKLFLCGSLERLDADWGAGSAPASASGWGMDCHVAAGSAGSGCSAFFGPRLGVSAPSIEVYVAGCCSGVPVILSKTIQLSPRKRVPRHATLDAIPEDEEMMVLEKNRVNGFVPNHKLQFSMNFKQLECVLALLLVLMF

SEQ ID NO: 139082 - protein, 276 aa, Glycine max
  Coding DNA Sequence Number=SeqID_22304
  Gene Ontology: Mol. function=protein serine/threonine kinase activity; Cellular component=membrane; Biological process=protein amino acid phosphorylation
  Homolog annotation: Hit_ID=Q1S9U2; Match level="QueryCoverage=94%, HitCoverage=38%, E-value=3e-96, Identity=68%"; Hit description =Protein kinase; Concanavalin A-like lectin/glucanase
  Pfam annotation: Domain name=Lectin_legB; Domain location=36-271; Score=283.6; E_value=3.7e-82; Accession=PF00139.10; Description =Legume lectin domain
  Subcellular localization annotation: CTP_CleavageSite=6; ConfidenceScore=5.52e-01
MAFFTSASYSNQTQKQTSLLIFIIFTLFHTLFYTAVSVSFNFSTFQPNSNNLIDFDGDAFSSNGVLLLTKNQLDGSITFSVGRASYDQPVRLWDRRTNKLTDFTTHFSFVMKAVDPSRFGDGLAFFIAPFDSSIPNNSAGGYLGLFSNESAFNTKKNQLVAVEFDSFQNTWDPSSDHVGINVNSIQSVATVAWKSSIKNGSVADAWIWYNSTTKSLSVFLTYAHNQTFSGNSSLSYAIDLRDVLPEFVRIGFSAATGSWIEIHNILSWSFNSNLLS

SEQ ID NO: 139083 - protein, 71 aa, Glycine max
  Coding DNA Sequence Number=SeqID_22305
MEKEHTDTGEEDGVRILRVRKMVQARKLLLCERNLQREQILSGRRQLFNDGLRDQEGWFTERENCGARVDS

SEQ ID NO: 139084 - protein, 50 aa, Glycine max
  Coding DNA Sequence Number=SeqID_22306
MKKFVLKLDLHDDKDKQKALKTVSTLSESVKKTVVKGCTSLIPPSSVFLP

SEQ ID NO: 139085 - protein, 60 aa, Glycine max
  Coding DNA Sequence Number=SeqID_22307
MTTRKLHSQPSVVDIFLDLCQRIATSGTNNGGCNIDQNRARAIVFLGRQCDGRRRNPYIV

SEQ ID NO: 139086 - protein, 51 aa, Glycine max
  Coding DNA Sequence Number=SeqID_22308
MGMGLLGCSFGGLKREIEVRFNVIGTKDIWEQNVDACPTPNSEKLPKKEDP

SEQ ID NO: 139087 - protein, 165 aa, Glycine max
  Coding DNA Sequence Number=SeqID_22309
MAPKKLSTKRSRRNAAAEGSSATPKFDSHHFRRGGHCPAVMHTGAGFRPDRYREAGADHAHQHDHFDPDVDDTATQQCMPATRHPLDPDKSNRALGFPALITGLFQSFGIPVTPSKVIRPPITRAFIEKYCTPRQAQDDAHQAADAPAPPRQADPAGSLGMERYL

SEQ ID NO: 139088 - protein, 390 aa, Glycine max
  Coding DNA Sequence Number=SeqID_22310
  Gene Ontology: Mol. function=5-formyltetrahydrofolate cyclo-ligase activity; Cellular component=nucleus; Biological process=folic acid and derivative biosynthetic process
  Homolog annotation: Hit_ID=Q2QX67; Match level="QueryCoverage=80%, HitCoverage=77%, E-value=1e-117, Identity=69%"; Hit description=5 -formyltetrahydrofolate cyclo-ligase family protein, putative, expressed
  Pfam annotation: Domain name=5-FTHF_cyc-lig; Domain location=85-325; Score=106.7; E_value=7e-29; Accession=PF01812.10; Description=5 -formyltetrahydrofolate cyclo-ligase family
  Subcellular localization annotation: CTP_CleavageSite=40; ConfidenceScore=5.62e-01
MDAFRLSHSFMLSTNIHSPSSLCTLRSLSTNPRNRWFKVEATAGGSQKKNNNKAFDAAAFEAERLALDAEARRTMADAADPKAWKWIIRKRIWDMMEARNFANNPRPVHHRIPNFVGASVAAEKMRELDVFQDAQCVKVNPDSPQKQVRWFHVQQKSCVRDITQAVNGRQLLSAIADQYIPYGKKLLTPQPRLRTGFFSVLDSNMLTLDTIKEACTSVGVAKHGRPIGLDEKIKVDLIVIGSVAVDPKTGARLGKGETLNLNVPSTKRIEVQGFAELEYGMLRYMGAIDDSTRVVTSVHDCQLVDDIPVEKLLIHDVPVDIICTPTQVIFTNTSIPKPQGIYWDKLSPEKLGQVRILRELKKRIEQETGQKLPTGPSEKLPPTAQRSRRG

SEQ ID NO: 139089 - protein, 38 aa, Glycine max
  Coding DNA Sequence Number=SeqID_22311
MQCCTRAVLSGTGPPQGGRSVLVYSVAVAAAIPKWQSW

SEQ ID NO: 139090 - protein, 70 aa, Glycine max
  Coding DNA Sequence Number=SeqID_22312
MARSVFAPCPYFRDLHGRELKGILVIIPKVVISLLMVSRGIIPFEEYIAAVGTTSNNMLSKRKTLDEGSL

SEQ ID NO: 139091 - protein, 56 aa, Glycine max
  Coding DNA Sequence Number=SeqID_22313
MTELKLVQLSNGKTMTRSYNKNKYQLFCFHYNSSMQENSHSETLNNTLTANQDSNG

SEQ ID NO: 139092 - protein, 50 aa, Glycine max
  Coding DNA Sequence Number=SeqID_22314
MHEDWAVFAHRDTTYLSGCEIYQQVHWIVKLKYETPMSREFSLILIKLRS

SEQ ID NO: 139093 - protein, 227 aa, Glycine max
  Coding DNA Sequence Number=SeqID_22315
TAAIGWAVLGFGTLKAKYLPYKYVNNYTVPVLIIGLAILASASRSSSDEARAHNLGFKDGREFSHARENNITNTTDYAKYLAEQKSKAESKAAQDAALAAEKEQKAREEEIECMRSDNPECYISKHERGDYVCAKAVEDSAKYDFKWTDGFTEPKFSNLSWAQAQNGFGAFKHIEYSCTYNADTVAAVPDGLSYNDTVGLRLQIKRVDPGLNDRIADLDYYWLQERG

SEQ ID NO: 139094 - protein, 68 aa, Glycine max
  Coding DNA Sequence Number=SeqID_22316
MGKSAFGGVYYTRIDIDMVKERDEGEIFFFAEQLMVKEFSRFQLSFAFMHGWDHPWTLEINLNIAKLP

SEQ ID NO: 139095 - protein, 117 aa, Glycine max
  Coding DNA Sequence Number=SeqID_22317
  Gene Ontology: Mol. function=ribonuclease H activity
  Homolog annotation: Hit_ID=Q1T365; Match level="QueryCoverage=67%, HitCoverage=14%, E-value=1e-10, Identity=45%"; Hit description =Ribonuclease H
MALSWSQFALTMVMLLKLQSIFSLIVPLCLIYDSGFMQSSMTKFNILKFFLVKIYPSKAPAMKFVMWEPPADGWIKINTNGAAPGSPGIAACVVLFRNPLGDFLGGFAHHMGISFAL

SEQ ID NO: 139096 - protein, 409 aa, Glycine max
  Coding DNA Sequence Number=SeqID_22318
MEGSDHSLVPQWLKGSGNDSRVAGINNQFTSSSYSDHITYSGRQWSSSSKGPGHSRSYSSSERSWQDTYWEKDIGSDGLNSASHDIPMTVSKAMMMHRYNVPTSTSSITLGTMGLSMAETLAQGPPRSHSPQLSASTQKLEALALKQSRLLIPVTPSTPRSLVSSSSEKSKVKTGQQQYSFSHSRRPNHSLHGAHPNLDIQKISSGNSLSVNTSREWNGVSSAAKDNLSPNSRVVLSPVGATRSTSLSAPSRNLGNNSTPSAWITLEKRPTFPIQSRNDFFKNLSRKSSLEKPCSDVLSIDMSCALENSEASMRNVSSCPILESRDASLVDTSGLNMLTDYGSTITENGNAANEPLKLSSSSEKQDSRNPFPYPDEEEIAFLRSLGWEESAGEYDEGLTEEEIQDFYEK

SEQ ID NO: 139097 - protein, 68 aa, Glycine max
  Coding DNA Sequence Number=SeqID_22319
MENWRTTLDNDIHGAPDSKVEDTRIALGNDIHGAPKKVENGELANNARQWYSRGSRLEGGGIMNSARQ

SEQ ID NO: 139098 - protein, 376 aa, Glycine max
  Coding DNA Sequence Number=SeqID_22320
  Gene Ontology: Mol. function=chromatin binding; Cellular component =chromatin; Biological process=chromatin assembly or disassembly
  Homolog annotation: Hit_ID=Q1SAV4; Match level="QueryCoverage=66%, HitCoverage=64%, E-value=2e-75, Identity=56%"; Hit description =Integrase, catalytic region
  Pfam annotation: Domain name=Chromo; Domain location=201-251; Score =10.7; E_value=0.053; Accession=PF00385.14; Description='chromo' (CHRromatin Organisation MOdifier
DGQTEVLNRVPEQYLQSFVHTHQARWSRFLSLTEWSYNTSVHTATGLSPFHFIFGKPPPSIPHYLLGSSPIEAVDQLLTECQELLIVLKRKLEKAKHQMKVQADCKCRDVSYAVHELVYVRLCPYRQLSATGGPYHKLSIWFYGPFQILEKIGSVAYKLALPNTSKILPVFYCSLLKPHIGPLPNSFNQLPASSHYNHPLVLPLTILKSKWDHSTIPPTRHVLVQWLGLPDDSSWENWEEMCSVSHLEDNITCEEGNSDVANNKLTEEGRPKRKLPSPFVTRTSMAQDNKYLPFYHPFCMLKQPTECNTYADIDAAYKCLKEQYGVKDEQLILYGQSVGSGPTLDLASRIPELRGVVLHSPILSGLRVLYPVKRTY

SEQ ID NO: 139099 - protein, 92 aa, Glycine max
  Coding DNA Sequence Number=SeqID_22321
MAVLLEERWGIGIVVTVVCESVKFGGSGIQICVSHLAQSKRIRTESTRWTNHRRPVSWRSNKVELVEGMSKAFSEESKQVESIRIKVSNALA

SEQ ID NO: 139100 - protein, 779 aa, Glycine max
  Coding DNA Sequence Number=SeqID_22322
  Gene Ontology: Mol. function=binding; Cellular component=nucleus; Biological process=metabolic process
  Homolog annotation: Hit_ID=Q2QTL4; Match level="QueryCoverage=78%, HitCoverage=90%, E-value=1e-122, Identity=36%"; Hit description =Pentatricopeptide, putative, expressed
  Pfam annotation: Domain name=PPR; Domain location=136-170; Score =41.8; E_value=2.3e-09; Accession=PF01535.11; Description=PPR repeat
  Pfam annotation: Domain name=PPR; Domain location=232-266; Score =26.0; E_value=0.00014; Accession=PF01535.11; Description=PPR repeat
  Pfam annotation: Domain name=PPR; Domain location=276-310; Score =31.7; E_value=2.6e-06; Accession=PF01535.11; Description=PPR repeat
  Pfam annotation: Domain name=PPR; Domain location=369-403; Score =37.3; E_value=5.3e-08; Accession=PF01535.11; Description=PPR repeat
  Pfam annotation: Domain name=PPR; Domain location=470-504; Score =44.7; E_value=3.2e-10; Accession=PF01535.11; Description=PPR repeat
  Pfam annotation: Domain name=PPR; Domain location=505-539; Score =10.4; E_value=0.44; Accession=PF01535.11; Description=PPR repeat
  Pfam annotation: Domain name=PPR; Domain location=541-575; Score=6.3; E_value=1.3; Accession=PF01535.11; Description=PPR repeat
  Pfam annotation: Domain name=PPR; Domain location=607-641; Score=6.4; E_value=1.3; Accession=PF01535.11; Description=PPR repeat
  Pfam annotation: Domain name=PPR; Domain location=71-105; Score=33.1; E_value=9.7e-07; Accession=PF01535.11; Description=PPR repeat
  Pfam module annotation: Pfam domain module=PPR::PPR::PPR::PPR::PPR::PP R::PPR::PPR::PPR; Domain location=136-170::232-266::276-310::369 -403::470-504::505-539::541-575::607-641::71-105
  Subcellular localization annotation: CTP_CleavageSite=51; ConfidenceScore=5.01e-01
MATLYGRLSRRNIFHQLPRIRYCHASASPTHKYNNSSPLNRSNKKISNLIRSGRLSEARALFDSMKHRDTVTWNSMITGYVHRREIARARQLFDEMPRRDVVSWNLIVSGYFSCRGSRFVEEGRRLFELMPQRDCVSWNTVISGYAKNGRMDQALKLFNAMPERNAVSSNALITGFLLNGDVDSAVDFFRTMPEHYSTSLSALISGLVRNGELDMAAGILCECGNGDDDLVHAYNTLIAGYGQRGHVEEARRLFDGIPDDRGDGDEGQRRFRRNVVSWNSMMMCYVKAGDIVSARELFDRMVEQDTCSWNTMISGYVQISNMEEASKLFREMPIPDVLSWNLIVSGFAQKGDLNLAKDFFERMPLKNLISWNSIIAGYEKNEDYKGAIQLFSRMQFEGERPDRHTLSSVMSVCTGLVNLYLGKQIHQLVTKIVIPDSPINNSLITMYSRCGAIVDACTVFNEIKLYKDVITWNAMIGGYASHGLAAEALELFKLMKRLKIHPTYITFISVMNACAHAGLVEEGRRQFKSMINDYGIERRVEHFASLVDILGRQGQLQEAMDLINTMPFKPDKAVWGALLSACRVHNNVELALVAADALIRLEPESSAPYVLLYNIYANLGQWDDAESVRVLMEEKNVKKQAGTSISNICQIMPLLEMLAFNLTMFILSDRKNDLDWLSIDINSLVSTIRDFNLGWLEDWRSNFKSQPMHRFRDAECHGIGPRMECSGLSLDTGEWRQLKLPVEHEKKLQDNYSVLDVISGKVSRPNTTIPVSMKYDETE

SEQ ID NO: 139101 - protein, 233 aa, Glycine max
  Coding DNA Sequence Number=SeqID_22323
  Gene Ontology: Mol. function=endonuclease activity
  Homolog annotation: Hit_ID=O23408; Match level="QueryCoverage=68%, HitCoverage=29%, E-value=4e-61, Identity=68%"; Hit description=SEN1 like protein
MQLCSLSTIAREYLAVRTISCLPYKDLILNAVGENFGTEAEGWKIPIPLKEYVESTFNQYQREAITAGLSSKAFVLIQGPPGTGKTQTILGILSTILHATPTRMHSKTYELRQGPQLPIEEKQRHWALASPWLNGINPRDSLMPKDGNDGFFPTTGNELKPEAITSNRKYRVRVLVCAPSNSALDEIVLRVFNGGIHDENDHVYCPKIVRIGLKAHHSIKAVSLDELVCGRLD

SEQ ID NO: 139102 - protein, 145 aa, Glycine max
  Coding DNA Sequence Number=SeqID_22324
MEEYFDETSLEEPPHSDSTLTLLEDSNLTLRLRLASTLFRVTLLTKPYIYWVTWPNTQSQSLWIVGAHIISCKTKLQMSYPNPPHPLHQTLPLIPTHSFLSSSTTLTIYSLPHPHFLQTTPPTIKSIYFPTQPQPTFVLVVTFTL

SEQ ID NO: 139103 - protein, 123 aa, Glycine max
  Coding DNA Sequence Number=SeqID_22325
  Subcellular localization annotation: CTP_CleavageSite=18; ConfidenceScore=5.18e-01
MNCLASTGKQLNRFSKPKSMAKSRSQSKTCHDGKARRFLLKLGSEYYSSGQAICGPKMLLGIENCYFEFLPRSKVVLTFKLLYKVEPCCQLDDFIQVAYTLEYITGACQGQKQKKIEQYQSCK

SEQ ID NO: 139104 - protein, 70 aa, Glycine max
  Coding DNA Sequence Number=SeqID_22326
MEVLQRLQDAGGCLKIARMSVGCQKMMVSEAQTMGGQFLKLKPDGKCNRDVAIQHLQLGTELECLQLETG

SEQ ID NO: 139105 - protein, 50 aa, Glycine max
  Coding DNA Sequence Number=SeqID_22327
MVKESSEPKVTEGKQSNTEIRNANLLRERMTSRARVTERVPIVSSEGSME

SEQ ID NO: 139106 - protein, 93 aa, Glycine max
  Coding DNA Sequence Number=SeqID_22328
MVGVPEKDNTGPMDAIFDQRKRNPNGVEEEDAWVGKNKLKQGLKRAQKNTTRRLGLVRQAFSGRTAARGLHASELARTGDGAWLRFWSRDLQG

SEQ ID NO: 139107 - protein, 158 aa, Glycine max
  Coding DNA Sequence Number=SeqID_22329
  Gene Ontology: Mol. function=peptidase activity
  Homolog annotation: Hit_ID=Q2QTQ5; Match level="QueryCoverage=69%, HitCoverage=26%, E-value=6e-17, Identity=43%"; Hit description =Expressed protein
MGGVTSSIAAKFAFFPPHPPSYTVVAAEVGGVSDPPPAPPRLEIPEVPSKDNVDVLKLRTRRGNEIVAVYVKYHRPTCTMLYSHGNAADLGQMFELFVELSNRLRLNVMGEKVIKGRFCFLWVKGSCGIEMTAAEAAMLKRKGSVVAELNAVAASVTI

SEQ ID NO: 139108 - protein, 171 aa, Glycine max
  Coding DNA Sequence Number=SeqID_22330
  Homolog annotation: Hit_ID=Q47522; Match level="QueryCoverage=22%, HitCoverage=46%, E-value=2e-14, Identity=94%"; Hit description=LacZ protein
MRKEKIPHQAPFAIQAAQLLGRAIGAGLFAITPAGERGMCCKAIKLAKKSSQYMIPKALKETPNADGNDVKGAHSEQVVCFAATANSCYEEGIKQESATSTSMHQRTTTTPKGFYVNPFCYKNTELLGRDWLLKNILSALLPHPAAPCNAALHISFLFYSIIANIPFSVIL

SEQ ID NO: 139109 - protein, 277 aa, Glycine max
  Coding DNA Sequence Number=SeqID_22331
  Gene Ontology: Mol. function=molecular_function; Cellular component =ribonucleoprotein complex; Biological process=rRNA processing
  Homolog annotation: Hit_ID=Q8S1Z1; Match level="QueryCoverage=43%, HitCoverage=52%, E-value=7e-47, Identity=72%"; Hit description =Probable U3 small nucleolar RNA-associated protein 11
  Pfam annotation: Domain name=Utp11; Domain location=1-277; Score =183.6; E_value=4.9e-52; Accession=PF03998.4; Description=Utp11 protein
SSRKKFGLLEKHKDYIQRAKAFHKKEDTLRKLREKAANRNEDEFYFKMVRTKTVDGVHKPESEANKYTQEELMLMKTQDMGYILQKIQSERNKIERLTASLHSIDNQPANKHVFFAEDRHENLTGLMINYVEYIIMAIMIQKGMLGEVAQCKVGIHREQGERIVFIKLTERENDFHSFIYQRALHREEAKELESRHQKSKIPLTSGDIPAGIKRKTDRSYQELEARRGRLSQLEKIYMDMTMQKELQKKGRKRKLREDEIVCPTTKPVYMWRAERKR

SEQ ID NO: 139110 - protein, 247 aa, Glycine max
  Coding DNA Sequence Number=SeqID_22332
  Pfam annotation: Domain name=DUF292; Domain location=154-236; Score =0.7; E_value=2.1e-05; Accession=PF03398.5; Description=Eukaryotic protein of unknown function, DUF292
MDMKEKKLTVIGTVDPVTVVSKLRKNWKADIVAVGPVKEPEKKEDPKKVEAKKEGEKKEEGKKEEGKKEEKKEDEKKKDPPPVPDPVLEWVKAYRAYNPYMTTHYYAPSMEENPNASSESINSLSQTAESRSLNMLDGILGRGFTAKCKSLIKLTNRRIDVIRRKRRATEKFLKKDIADLLLNGLVVELTLSSCYGFVENCCEFVLKHLPAMQKLSVLAAAIGLSSPRHCAAVPPRHCTATLSRPLC

SEQ ID NO: 139111 - protein, 466 aa, Glycine max
  Coding DNA Sequence Number=SeqID_22333
  Gene Ontology: Mol. function=transferase activity, transferring nitrogenous groups; Cellular component=cytoplasm; Biological process= ethylene biosynthetic process
  Homolog annotation: Hit_ID=Q9SEJ9; Match level="QueryCoverage=99%, HitCoverage=98%, E-value=0.0, Identity=79%"; Hit description=1 -aminocyclopropane-1-carboxylate synthase 1
  Pfam annotation: Domain name=Aminotran_1_2; Domain location=43-416; Score=455.6; E_value=6.4e-134; Accession=PF00155.11; Description =Aminotransferase class I and II
  Pfam annotation: Domain name=Beta_elim_lyase; Domain location=90-357; Score=-125.6; E_value=0.03; Accession=PF01212.11; Description=Beta -eliminating lyase
  Pfam module annotation: Pfam domain module=Aminotran_1_2::Beta_elim _lyase; Domain location=43-416::90-357
MVSQQLLSKIATNDKHGENSPYFDGWKAYDRNPFHPTKNPQGVIQMGLAENQLCFDLIEEWIRNNPRASICTPEGVHQFRNIANFQDYHGLREFTNEMANFMSKVRGGRVKFDPDRILMSGGATGANELIMFCLADPGDAFMIPTPFYPGTGVQIIPVHCDSSNNFKITREALEVAYKKAKEDNINVKGLIITNPSNPLGTTLDKDTLKSLVNFINEKNIHLVCDEIYAATVFSSPSYVSVAEVIQEMEHCKRDLIHVIYSLSKDMGFPGFRVGIVYSFNDEVVNCGRKMSSFGLVSTQTQHMLASMFSDEKFVTRFLSENSRRLEQRHEKFMKGLEEVNITRFPSNAGLFCWMNLKSLLEEPSFEAELKLWRVIIHEVKLNVSPGSSFNCSEPGWFRVCFANMDDETVDVALNRIRAFVGKETKKSVGFKRWQPNLRLSFSSRIFDESVMSPHSPIPTSPLVGAN

SEQ ID NO: 139112 - protein, 88 aa, Glycine max
  Coding DNA Sequence Number=SeqID_22334
MWKALSKCINDIKFLVSSWLTSGDNCGAKLKGVVIFGACVDLVLEMKNQAVTKLKWLISHFGEKLMFLMASIFKREIMTTRENPDAPS

SEQ ID NO: 139113 - protein, 123 aa, Glycine max
  Coding DNA Sequence Number=SeqID_22335
  Gene Ontology: Mol. function=protein binding; Cellular component =nucleus; Biological process=Notch signaling pathway
  Homolog annotation: Hit_ID=Q6EE07; Match level="QueryCoverage=97%, HitCoverage=31%, E-value=3e-39, Identity=54%"; Hit description =Notchless-like protein
  Pfam annotation: Domain name=NLE; Domain location=17-67; Score=10.5; E_value=0.0048; Accession=PF08154.2; Description=NLE (NUC135) domain
  Pfam annotation: Domain name=WD40; Domain location=73-111; Score =52.6; E_value=1.3e-12; Accession=PF00400.22; Description=WD domain, G-beta repeat
  Pfam module annotation: Pfam domain module=NLE::WD40; Domain location= 17-67::73-111
MEAETETMVEKREIINNVMCLLTDPDGTPFGAPMYLPQNAGPQHLNQIVNKLLNNALPIVCQPQAIFRIRPVNRCTATISGHAEAVLSVAFSPDGQQLASGSGDTTVRFWDLTTQTPLYTCTV

SEQ ID NO: 139114 - protein, 621 aa, Glycine max
  Coding DNA Sequence Number=SeqID_22336
  Gene Ontology: Mol. function=peptidase activity
  Homolog annotation: Hit_ID=Q84VS3; Match level="QueryCoverage=86%, HitCoverage=99%, E-value=5e-82, Identity=37%"; Hit description =Potyviral helper component protease-interacting protein 1
  Pfam annotation: Domain name=zf-C3HC4; Domain location=13-60; Score =35.3; E_value=2.1e-07; Accession=PF00097.15; Description=Zinc finger, C3HC4 type (RING finger)
MVDSGSDFAGIICSICYEPLNPINEDLQSVSICGHVFHELCLQQWFEYSSKGKKHTCPICKQGCRASDACRLYFQSVGDANNSVKPSKCFELEEDAGVLRREVKRLEVKVSGLNSQVEGQTKELEGLNEEKGSAQGSEEVGDVTKCVTLDVQKGIRNRKTNWRKLLCTCKEQAKIETALKNEALNQKASIQFQLQMKSEELEKSTLECFRLKERNMALAKELAALKLVSDLDIDEEEVLKLATLGNGANSKDTIDTLKRSLVMRNRSYKELMAKCNILGRGEARYSKKLEKAKEKITKLKERVQELETLAESKENKYLRSLKLSKITKSSKNLEENIKSDSEVLTACKFSSKEQSKQISIPKSGIDLTANNNSKSFQSFKIENSNVTKNKTVNISNGSRSTFSLDIKREYISIDDNDSEGTNALQGCSKHNYKDQDWDDIAFSKPSLVKLEPVSGIKAETSLQGKCTLAESPRVDIDIDMANISASAMDEDVTLQANIKQPMVNIRKESPLTLSNSAPGSICFSGGLLGPDGTHRYLGKWCKRGQNSEPSSAKRSSDGDLIAVGADGRGGRIKVLRTSSQILSGGKENLLSSKRSKLGVKTSGLQSQGCLQIEHFFGRVSQ

SEQ ID NO: 139115 - protein, 149 aa, Glycine max
  Coding DNA Sequence Number=SeqID_22337
  Gene Ontology: Mol. function=carbon-sulfur lyase activity; Cellular component=vacuole
  Homolog annotation: Hit_ID=Q942G1; Match level="QueryCoverage=94%, HitCoverage=29%, E-value=4e-41, Identity=57%"; Hit description =Alliin lyase-like
  Pfam annotation: Domain name=Alliinase_C; Domain location=3-149; Score=-21.0; E_value=2.4e-12; Accession=PF04864.4; Description =Allinase, C-terminal domain
MPSLGMQLITEGKYIVFGSGSTQLLNAAVYALSLNSSMSPAKVVATAPYYSLYRGQKQLFNSRDFSYEGDTSLWKNNTNSSFRFIEFVTSPNNPDGNLNKEVLKGSDVKTIYDRAYYWPHFTAIPSPADDDLMVFTISKLTGHAGSRFG

SEQ ID NO: 139116 - protein, 553 aa, Glycine max
  Coding DNA Sequence Number=SeqID_22338
  Gene Ontology: Mol. function=calcium ion binding; Cellular component =mitochondrion; Biological process=protein amino acid phosphorylation
  Homolog annotation: Hit_ID=Q1SMD3; Match level="QueryCoverage=94%, HitCoverage=97%, E-value=0.0, Identity=59%"; Hit description=TonB box, N-terminal; Tetratricopeptide-like helical
  Pfam annotation: Domain name=PPR; Domain location=123-157; Score =19.4; E_value=0.013; Accession=PF01535.11; Description=PPR repeat
  Pfam annotation: Domain name=PPR; Domain location=158-192; Score =23.7; E_value=0.00066; Accession=PF01535.11; Description=PPR repeat
  Pfam annotation: Domain name=PPR; Domain location=193-227; Score =46.5; E_value=8.8e-11; Accession=PF01535.11; Description=PPR repeat
  Pfam annotation: Domain name=PPR; Domain location=228-262; Score =44.8; E_value=2.8e-10; Accession=PF01535.11; Description=PPR repeat
  Pfam annotation: Domain name=PPR; Domain location=263-297; Score =43.5; E_value=7e-10; Accession=PF01535.11; Description=PPR repeat
  Pfam annotation: Domain name=PPR; Domain location=298-332; Score =39.9; E_value=8.9e-09; Accession=PF01535.11; Description=PPR repeat
  Pfam annotation: Domain name=PPR; Domain location=333-367; Score =42.2; E_value=1.8e-09; Accession=PF01535.11; Description=PPR repeat
  Pfam annotation: Domain name=PPR; Domain location=368-402; Score =39.1; E_value=1.5e-08; Accession=PF01535.11; Description=PPR repeat
  Pfam annotation: Domain name=PPR; Domain location=403-437; Score =48.1; E_value=3.1e-11; Accession=PF01535.11; Description=PPR repeat
  Pfam annotation: Domain name=PPR; Domain location=438-472; Score =43.0; E_value=9.9e-10; Accession=PF01535.11; Description=PPR repeat
  Pfam annotation: Domain name=PPR; Domain location=473-507; Score =50.8; E_value=4.7e-12; Accession=PF01535.11; Description=PPR repeat
  Pfam annotation: Domain name=PPR; Domain location=508-542; Score =22.7; E_value=0.0013; Accession=PF01535.11; Description=PPR repeat
  Pfam annotation: Domain name=PPR; Domain location=53-87; Score=7.1; E_ value=1.1; Accession=PF01535.11; Description=PPR repeat
  Pfam annotation: Domain name=PPR; Domain location=88-122; Score=31.7; E_value=2.6e-06; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR; Domain location=123 -157::158-192::193-227::228-262::263-297::298-332::333-367::368 -402::403-437::438-472::...
  Pfam module annotation: Domain location=473-507::508-542::53-87::88 -122
MSFSLSRRFSSFLPNPTFPLYFHSQPPSIDNVVDDAISQFNGMLLMHHTPPIVEFGEILGYLAKMKHYSTAISLSKQMEVKGIEPNLVTLNILINCFCHLGQMSFSFSVLGKILKLGYQPNTITLTTLMKGLCLKGEVQKSVHFHDKVVAQGFQMNQVSYGTLLNGLCKIGETRCAIKFLRMIEDSSTGLNVVMYNTIIDGLCKDKLVNEAYDFYSEMNARGIFPNVITYTTLIGGFCLAGQLTGAFSLLNEMILKNINPNVYTYAILIDALCKEGKVKEAKNLLAVMTKEGVKPNVVAYNTLMNGYCLAGEVQGAKQMFHAVLQMGVNPNVCSYSIIINGLCKSERVDEAMNLLREMLHKYMVPDAATYSSLIDGLCKSGRITTALSLMKEMHYRGQPADVVTYTSLLDGFCKNQNLDKATALFMKMKEWGIQPNKYTYTALIDGLCKGGRLKDAQKLFQDLLVKGCCIDVCTYNVMIGGLCKEGMLDEALAIKSKMEDNGCIPNVVTFEIIIRSLFKKDENDKAEKLLHEMIAKGLLRFRNFHGERSLDTN

SEQ ID NO: 139117 - protein, 335 aa, Glycine max
  Coding DNA Sequence Number=SeqID_22339
  Gene Ontology: Mol. function=sequence-specific DNA binding; Cellular component=nucleus; Biological process=regulation of transcription, DNA-dependent
  Homolog annotation: Hit_ID=O04609; Match level="QueryCoverage=55%, HitCoverage=59%, E-value=3e-53, Identity=61%"; Hit description=WRKY transcription factor 22
  Pfam annotation: Domain name=WRKY; Domain location=157-217; Score =142.2; E_value=1.4e-39; Accession=PF03106.6; Description=WRKY DNA -binding domain
  Subcellular localization annotation: CTP_CleavageSite=72; ConfidenceScore=5.70e-01
MEADWDLHAVVRGCTTTTSSAATTTTNSSSVSSSGFGACNPPSTSSCFFSVYNPAEQGGHVLSLSENPFEARSSNSIEGLHELCKPFFLKPQPQTLQTSSPLSSFSYSSTPKSPHKQQEQKQSQPQFHHAGSATTPRSKRRKNQLKKVCQVAAENLSSDIWAWRKYGQKPIKGSPYPRGYYRCSSSKGCLARKQVERNRSDPAMFIVTYTGEHNHPAPTHKNSLAGSTRHKPQTATAEDAATIKPASPSTSGMEEEVAQHSAKSESTEEEDMEDLMKNDEELPNEFGLTETVVSDDFFEGLEELTGSATDPFTAISSNIDRWPLANNSATAAGGS

SEQ ID NO: 139118 - protein, 276 aa, Glycine max
  Coding DNA Sequence Number=SeqID_22340
GKEVEDPVGSGNVGTKKGTPRCVGGKDINAEMVDLVTPGPGLEERSVVSAKNLKGLEIERLEFEMNSSPEITRGDSGICGVEEDMKSGLNEEQVVNSQGNLHSEPLVVALEELNSPLVEEEVEKLGDKNNLLEGVCENGKGRDEAVEQGDHNSPQGSNMKDVNVLHVSQVESLYPMVEEDEAAEQGSLSSPQTSKMKDVNVYVSQEESGYLMVEEYEAAPQGDHSSPQGLNMKDMNVLHVSHEESVYPLVEDDEAVEQGNQNSPQASNIKDVNVLL

SEQ ID NO: 139119 - protein, 109 aa, Glycine max
  Coding DNA Sequence Number=SeqID_22341
MPRCPLIITVVAEAFVSFKGHFFGEVGNGGESWGGGGDGYGGDLRAYLPEASPVPWPEVRGQPRYEAAQQQGRSEADDPISKALEFGQILVYSTALLEFEERPIWIIVI

SEQ ID NO: 139120 - protein, 493 aa, Glycine max
  Coding DNA Sequence Number=SeqID_22342
  Pfam annotation: Domain name=DUF793; Domain location=102-485; Score =664.4; E_value=9.1e-197; Accession=PF05633.2; Description=Protein of unknown function (DUF793)
MDAAYPLLSVITETGGLPSGSLGPAIGHHVVAVIMPSVAYWDLVDLFTQIDVLIVLLKGSKTETGKFNAAVSEEFQVISVVLVRFIEDLEGAFAEGCDSVTMPSTENQGFSLSFSSFGRSIFGVGQEQVHSVEASNESDSCNLELGSFQKRVTDRFQDLSVASDEQFLSIDWIQKLLGAFICCQEEFRAILLNNKEQVTKPPLDRMISEFFERSVKALDICNASRDGIEKIRTWQKHLEIVFCALGSSKRALTEGHFRRARKALMDLALAMLDEKESGSVFSQRNRSFGRHNSGKDHHSSSGHSRSHSWSVSRSWSAAKQLQSIANNLVPPRATEVAATSGLATPVYTMNCILLIVLWTLVAAIPCQDRGLNIHFSVPRQLSWSTPVTSLHERITEESKKRERRNSNGLLKEIYQVEISSRRLTDLIDSAQFPLADDQKTEVERNVMELMRVCEAFRNGSDPLERQVREVFQKIMACRTEGLDYLGTPSHTEQ

SEQ ID NO: 139121 - protein, 77 aa, Glycine max
  Coding DNA Sequence Number=SeqID_22343
MASLFTGHGKSILVAFKVQGTLASNQAYTLDPSFLLIVLRDNDDGIRAAVSLTTTTTSAETEPRCGCVDGGAGSLES

SEQ ID NO: 139122 - protein, 54 aa, Glycine max
  Coding DNA Sequence Number=SeqID_22344
  Gene Ontology: Cellular component=membrane
  Homolog annotation: Hit_ID=Q2HV25; Match level="QueryCoverage=85%, HitCoverage=70%, E-value=1e-08, Identity=61%"; Hit description =Proteinase inhibitor I25, cystatin; Beta tubulin
MKKIAFAAVNVMYKLAINDGMSMRVASAYRLAFASAFTVPVALVFDRSMIIACL

SEQ ID NO: 139123 - protein, 34 aa, Glycine max
  Coding DNA Sequence Number=SeqID_22345
MKVMPGIRLTMANINVADVKAMASRFACSKKLPC

SEQ ID NO: 139124 - protein, 360 aa, Glycine max
  Coding DNA Sequence Number=SeqID_22346
  Gene Ontology: Mol. function=cytochrome-c oxidase activity; Cellular component=membrane; Biological process=electron transport
  Homolog annotation: Hit_ID=Q4PT23; Match level="QueryCoverage=89%, HitCoverage=91%, E-value=5e-52, Identity=34%"; Hit description =Nodulin MtN21 family protein
  Pfam annotation: Domain name=DUF6; Domain location=199-328; Score =22.2; E_value=0.0019; Accession=PF00892.11; Description=Integral membrane protein DUF6
  Pfam annotation: Domain name=DUF6; Domain location=24-157; Score =39.3; E_value=1.3e-08; Accession=PF00892.11; Description=Integral membrane protein DUF6
  Pfam annotation: Domain name=TPT; Domain location=190-328; Score= -31.1; E_value=0.037; Accession=PF03151.7; Description=Triose -phosphate Transporter family
  Pfam module annotation: Pfam domain module=DUF6::DUF6::TPT; Domain location=199-328::24-157::190-328
MENLYKVEATGNVKPVLLMIAVQTLYAVVNIMLKIVADDGMSLSVLVAYRFFFASAFIVPLALIFERKSLQYVTGKVLFQGLLCGLFGGSLLQGFYVKSLALTTAVYVTAMLNLIPAVTYILSVTLRLEKSNLGTAGGMTKLLGTLTGIGGAMILTFYKGRRLCLWSTNIALLHREPSSHDAPIGSLLLGCILAFAAALSYSVWLIIQTKMSEKFPWHYSIAALTSATASILSVIFALSTERDWSQWKLGWDFRLLTAASAGILASGVCYPLLAWCVRRKGPLFTSAFCPLMLVIVTLSETLVLDECLSVGSLTGSVLIVGGLYMLLWGKSKEKRMEHSDIVSSKGTLQCEAIHNTDPSS

SEQ ID NO: 139125 - protein, 163 aa, Glycine max
  Coding DNA Sequence Number=SeqID_22347
MTSKEAYVSFMACLSAYIAKNKKQAAIAAVENEKMVSETVEIERTTTATIEIVKMAIMTIEKNMKDVDAIKEEKNMMDIHVIKKEKGVMDTDTIKVSRNKSQYSLEEINPGTEENRKPTYEYEDMFALNREFVEHRLTTCEDKKPMKQTPRRFAPNVLETINA

SEQ ID NO: 139126 - protein, 55 aa, Glycine max
  Coding DNA Sequence Number=SeqID_22348
MEIGRRTRVEGGRGAPVVLATSCMADTWLDGRASTVSDFKQGRATAVGALYQFLL

SEQ ID NO: 139127 - protein, 37 aa, Glycine max
  Coding DNA Sequence Number=SeqID_22349
MKVVQELKPAILMKEHTKVDMEGAFDVILLRSIRVYG

SEQ ID NO: 139128 - protein, 102 aa, Glycine max
  Coding DNA Sequence Number=SeqID_22350
MADTCRRGEGRASSSGDFSPREVGNASSVGATMEAPVLFAIQPRVGSFSAAARTALQQEKEENATSFADGSATPLGDLGEGRKRHFLWHFRRRKKTLLPLAI

SEQ ID NO: 139129 - protein, 229 aa, Glycine max
  Coding DNA Sequence Number=SeqID_22351
  Gene Ontology: Cellular component=integral to membrane; Biological process=nitrogen fixation
  Homolog annotation: Hit_ID=P16313; Match level="QueryCoverage=86%, HitCoverage=96%, E-value=7e-73, Identity=75%"; Hit description =Nodulin 21
  Pfam annotation: Domain name=DUF125; Domain location=50-222; Score =199.5; E_value=7.7e-57; Accession=PF01988.9; Description=Integral membrane protein DUF125
MANATPNGSVPHNHVGAVLPTIPTIKIDEKQTLATSEDHTSIDYLQRAQWLRAAVLGANDGLVSVTSLMMGVGAVKKDAKAMLVAGFAGLVAGACGMAIGEFVAVCTQYEVELGQMKREMNMSEGGERDLETEKRTLPNPLQATWASALSFSIGALVPLLSAAFVADYRTRVIVVVAMASLALVVFGSVGAQLGKTPKLKSCVRFLLGGWIAMSITFGLTKLMGASALE

SEQ ID NO: 139130 - protein, 119 aa, Glycine max
  Coding DNA Sequence Number=SeqID_22352
  Homolog annotation: Hit_ID=Q6CQF3; Match level="QueryCoverage=47%, HitCoverage=59%, E-value=8e-08, Identity=72%"; Hit description =Kluyveromyces lactis strain NRRL Y-1140 chromosome D of strain NRRL Y- 1140 of Kluyveromyces lactis
IAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEAPSDSALCAYSERES

SEQ ID NO: 139131 - protein, 760 aa, Glycine max
  Coding DNA Sequence Number=SeqID_22353
  Gene Ontology: Mol. function=protein kinase activity; Cellular component=plastoglobule; Biological process=protein amino acid phosphorylation
  Homolog annotation: Hit_ID=Q014Z3; Match level="QueryCoverage=83%, HitCoverage=90%, E-value=1e-177, Identity=51%"; Hit description=[R] KOG1235 Predicted unusual protein kinase
  Pfam annotation: Domain name=ABC1; Domain location=232-375; Score =101.4; E_value=2.6e-27; Accession=PF03109.7; Description=ABC1 family
  Pfam annotation: Domain name=APH; Domain location=325-494; Score= -9.0; E_value=0.025; Accession=PF01636.13; Description=Phosphotransfer ase enzyme family
  Pfam module annotation: Pfam domain module=ABC1::APH; Domain location= 232-375::325-494
  Subcellular localization annotation: CTP_CleavageSite=63; ConfidenceScore=5.99e-01
MATVASSMVASSSPSSQPFCSFSNPNSSSSSLSFKTKAITRTRPRTKTRTRTTRLTWLNPHPRGALVEATPPPTSSPPSPKDGSIKVLALPENRADDIQAEARALARAANATAYTPQLVASKYGSQPIKVVGRALQVLSAVGLFGLKLLLDQKSGVLDQNKRIRAIELRDTFTRLGPTFVKLGQGLSTRPDICPAEYLEELTELQVALIISVLYQDGLPTFPDEEAFACIERELGLSIDSIFSTISPTAVAAASLGQVYKARLKYSGKLVAVKVQRPDIEEAIGMDFYLIRGLGSLINKYVDFITSDVVALIDEFARRVFQELNYVQVLNHGCGRDCSFVAILDDVVIVVTEGLNARRFKKLYADKEDIFVPDVFWDYTSAKVLTMDWVDGVKLNEQEAIERQGLKVLDLVNAGIQCSLRQLLEYGYFHADPHPGNLLATPEGKLAFLDFGMMSETPEEARYAIIGHVVHLVNRDYEAMARDYYDLNFLSRDVDVSPIVPALRNFFDDALNYTVSELNFKTLVDGLGNVLYQYPFNVPAYYALIFRSLTVLEGLALYADPNFKVLAASYPYFAKRLLTDPNPYLRDALIELLFKDGKFRWNRLENLLDQGKKDRDFSAKEALQPVLKVLLSPDGEELRNLVIKEAARVSEAFTLGTMSETYLYIPDFIRTLVFNGNANGPFMMSESEMQSMLELRDQVIRIWGLLRSSSDFDPAMLLPILQVLEQPEARRLGGRVVGGITQRLAARFLQQVLRVPTTASE

SEQ ID NO: 139132 - protein, 226 aa, Glycine max
  Coding DNA Sequence Number=SeqID_22354
  Gene Ontology: Mol. function=transition metal ion binding; Cellular component=integral to membrane; Biological process=nitrogen fixation
  Homolog annotation: Hit_ID=P16313; Match level="QueryCoverage=79%, HitCoverage=87%, E-value=3e-65, Identity=75%"; Hit description =Nodulin 21
  Pfam annotation: Domain name=DUF125; Domain location=43-217; Score =189.7; E_value=6.9e-54; Accession=PF01988.9; Description=Integral membrane protein DUF125
MATSTLSHAEEALPSPANLTDQKQTRAITEYHSSIDYLQRAQWLRAAVLGANDGLVSVTSLMMGVGAVKRDEKAMLLAGFAGLVAGTCGMAIGEFVAVCTQYEVELGQMKRDMNMTVGEEKDLEMGMEKRALPNPLQATLASAVSFSIGALVPLLSAAFIENYRNRVIVVVAMASLALVVFGRVVAQLGKTHKMKSCVRFLLGGWIAMAITFGLTKLLGAKALDNE

SEQ ID NO: 139133 - protein, 157 aa, Glycine max
  Coding DNA Sequence Number=SeqID_22355
  Gene Ontology: Mol. function=transferase activity; Biological process= DNA integration
  Homolog annotation: Hit_ID=O21999; Match level="QueryCoverage=35%, HitCoverage=36%, E-value=4e-26, Identity=100%"; Hit description=LacZ- alpha
MENCNTTPIPMMPNLKLTEELDEKLVDATLFKFMGNPLAPHMTATKHILRYFKGTSDFGLLFPIGNDQNRSCIEAWSDSDWCGDKVERKSTFGYLFKHASLALAVVLQRRDWENPGVTQLNRLAAHPPFASWRNSEEARTDRPSQQLRSLNGEWRLM

SEQ ID NO: 139134 - protein, 251 aa, Glycine max
  Coding DNA Sequence Number=SeqID_22356
MKFPSNEGPQHPHIGNGKLSLLLRMFITSMTQLTRPSNSLKNHCLEWKDEKREVQQAKIKEKKEENQKKPKSNKALSAGRAQRARSQGAKRTTRAERDVALSTRLCAQRDYEKPKPKFAPINKREHPELKLSSHGRKVYQAIAERLLMKSVELLEVSADEARVEAVQCHGAYVTLFLLTTVNRRACGVLGRLSRPQLERKLRMGSFCLSAYCWIYEHFSSVAKAITATDYHERKPRVCRWTSAKALPVSTY

SEQ ID NO: 139135 - protein, 193 aa, Glycine max
  Coding DNA Sequence Number=SeqID_22357
  Gene Ontology: Mol. function=nucleic acid binding; Biological process= cold acclimation
  Homolog annotation: Hit_ID=Q9LIN3; Match level="QueryCoverage=65%, HitCoverage=51%, E-value=4e-38, Identity=62%"; Hit description =Similarity to RNA-binding protein
  Pfam annotation: Domain name=RRM_1; Domain location=9-80; Score =108.2; E_value=2.4e-29; Accession=PF00076.12; Description=RNA recognition motif. (a.k.a. RRM, R
MSDVEEYRCFIGGLAWSTSDRKLKDTFEKFGKLIEAKVVVDKFSGRSRGFGFVTFDDKKAMDEAIDAMNGMDLDGRTITVDRAQPQQGSTRGDGDRYRDRGRDRDRDHGGGGGRGSNGGECFKCGKPGEESMVVGKVDMVEAVVVVMDQIEQIVLQGGAAGDGGSHGDSGSDRFYRDRSGPYERERRGSGGFR

SEQ ID NO: 139136 - protein, 127 aa, Glycine max
  Coding DNA Sequence Number=SeqID_22358
MDEEEGTLPLENVRNARGRGELVWHSNFVCRDDATVEEEWENMELMDGNHHHPIVGGNDATAIPDHCCKHALMATVNAIPRNLPMFDGKGYEDWCMKMDAILGFQELDEIVRDGFQEPSNNALAEQD

SEQ ID NO: 139137 - protein, 323 aa, Glycine max
  Coding DNA Sequence Number=SeqID_22359
  Gene Ontology: Mol. function=methyltransferase activity; Cellular component=chromatin silencing complex; Biological process=methylation
  Homolog annotation: Hit_ID=Q9LIN4; Match level="QueryCoverage=92%, HitCoverage=61%, E-value=1e-130, Identity=75%"; Hit description =Arabidopsis thaliana genomic DNA, chromosome 3, BAC clone:F20C19
  Pfam annotation: Domain name=UPF0020; Domain location=199-323; Score=- 42.6; E_value=0.0017; Accession=PF01170.9; Description=Putative RNA methylase family UPF0020
MWYLCVFFHRLLDYRKPEVESLAQLFGATEDPQNGDVSSQLQWKLPHHYHADSPFHFVNLPSEQLARNIATRSILVKGMYELWGEGSSYEELKESVLSYPDERKLPYLDSDSTFKITVDCFGKVISLEEQKELIQGLSYIPFKGRVKLKNPDHNFWLIEVDNYGGNNGLPPIVQKRVFFGREVGGADRKLLPTYQLKSRTYLGPTAMDAEIAFLMANQALATSGKLVYDPFVGTGSILVAAAHFGAMTMGADIDIRVVRDGRGPNCNVWSNFKQYGLPMPVGLLRADNNLPPWRSTLKEESIQLASRLNIFSNISNFTGVFAI

SEQ ID NO: 139138 - protein, 112 aa, Glycine max
  Coding DNA Sequence Number=SeqID_22360
MDDSKIMEKVLRTLTPNFDHIVVVIKMQKHTVQLPKIIVLEAIQMSSMIIPVLEEETLSEVEVVKGLLTKERSSVTIVINLGTFPMNASRLATTMSSKDGSDLDQISPPAFI

SEQ ID NO: 139139 - protein, 167 aa, Glycine max
  Coding DNA Sequence Number=SeqID_22361
  Gene Ontology: Mol. function=DNA binding; Biological process=DNA integration
  Homolog annotation: Hit_ID=Q1T010; Match level="QueryCoverage=50%, HitCoverage=6%, E-value=9e-25, Identity=62%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MALGMPSIHSPQKTCDGCLIGKQPRKAFKTKAPQRAKQPLVIVHLDEFKEFYEAKGIEHEGKDYQIATGDKLSPQTTYVLNRCPTKRLQSVTLEEAWIGDKPMVNHLRIFGSLSYIHIPDERRRKLYDKSEALILNGYHPTGAYKLYSPLKQQVVISRDVVVDGTAA

SEQ ID NO: 139140 - protein, 58 aa, Glycine max
  Coding DNA Sequence Number=SeqID_22362
MVYPFSRSYPKLSRFLFIEGVRGAEGRVQHLNIERISVKFEEKKKKNEAEALPNCDHN

SEQ ID NO: 139141 - protein, 121 aa, Glycine max
  Coding DNA Sequence Number=SeqID_22363
  Gene Ontology: Mol. function=methyltransferase activity; Biological process=methylation
  Homolog annotation: Hit_ID=Q9LIN4; Match level="QueryCoverage=54%, HitCoverage=13%, E-value=1e-18, Identity=61%"; Hit description =Arabidopsis thaliana genomic DNA, chromosome 3, BAC clone:F20C19
MVKTGPYTEEIAEAAREKHIEFKENHVKWLEDGNLHSAVFSPADAQLTEAGDPKLIKDPKPKYRGKFQKKEKQMSELRKSVKKEVENNLFHESMETCISELVMISETEFYLLIFLSGSILV

SEQ ID NO: 139142 - protein, 87 aa, Glycine max
  Coding DNA Sequence Number=SeqID_22364
MTMIKITDESRVTTVTIVTIMVMMVTTTMVVGWNKGTIDGGYGGEMVMWRNDSGGDDNTNSCSSGMVEVAMTMWWRQRQWWWQAWWW

SEQ ID NO: 139143 - protein, 816 aa, Glycine max
  Coding DNA Sequence Number=SeqID_22365
  Gene Ontology: Mol. function=nucleoside-triphosphatase activity; Biological process=defense response
  Homolog annotation: Hit_ID=Q1STU5; Match level="QueryCoverage=95%, HitCoverage=98%, E-value=5e-51, Identity=27%"; Hit description =Leucine-rich repeat
  Pfam annotation: Domain name=LRR_1; Domain location=115-139; Score =1.1; E_value=1.8e+02; Accession=PF00560.23; Description=Leucine Rich Repeat
  Pfam annotation: Domain name=LRR_1; Domain location=312-339; Score =3.5; E_value=63; Accession=PF00560.23; Description=Leucine Rich Repeat
  Pfam annotation: Domain name=LRR_1; Domain location=340-365; Score =5.8; E_value=24; Accession=PF00560.23; Description=Leucine Rich Repeat
  Pfam annotation: Domain name=LRR_1; Domain location=367-388; Score =2.9; E_value=83; Accession=PF00560.23; Description=Leucine Rich Repeat
  Pfam annotation: Domain name=LRR_1; Domain location=490-510; Score =2.6; E_value=94; Accession=PF00560.23; Description=Leucine Rich Repeat
  Pfam annotation: Domain name=LRR_1; Domain location=5-27; Score=8.7; E_value=6.8; Accession=PF00560.23; Description=Leucine Rich Repeat
  Pfam annotation: Domain name=LRR_1; Domain location=544-566; Score =13.9; E_value=0.59; Accession=PF00560.23; Description=Leucine Rich Repeat
  Pfam annotation: Domain name=LRR_1; Domain location=596-616; Score =1.5; E_value=1.5e+02; Accession=PF00560.23; Description=Leucine Rich Repeat
  Pfam annotation: Domain name=LRR_1; Domain location=637-658; Score =1.4; E_value=1.6e+02; Accession=PF00560.23; Description=Leucine Rich Repeat
  Pfam annotation: Domain name=LRR_1; Domain location=709-732; Score =1.5; E_value=1.5e+02; Accession=PF00560.23; Description=Leucine Rich Repeat
  Pfam annotation: Domain name=LRR_1; Domain location=86-109; Score =3.2; E_value=72; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =115-139::312-339::340-365::367-388::490-510::5-27::544-566::596 -616::637-658::709-732::86-109
MLTPNLQHLTLGQNELKMILHGEIQGNHLNKLKVLTLCFHVESDVFPHGFLQLVPNIEELVVCDGSFKEIFCLQSPNVDDTTLLSQLKVLRLESLPELVSIGSLNLVPCTMSFSNLTKLEVKSCNSLLCLFTSSTAKNLAQLQIMKIEFCESIKEIVSKEGDESHEDEIIFPRLKCLELKDLPDLRSFYKGSLSFPSLEQLSVIECHGMETLCPGTLKADKLLGVVLKRYVYMPLEIDLKSTIRKAFLAELTATAPPPSLLGPIQLDNYLIYLDSASAKQKIMTLLDFLVVVIIVVTSVGGDKSPISKSARQVSDLRLRNNPLQKIWQGSLPIPDLCFSKLHSLIVDGCQFLSDAVLPFNLLRLLTELETLEVRDCDSVKTIFDVKCTRQDRIMTTMEPTIFPLPFPLKKLVLQRLPNLENVWNDDPHRILRMQLLQQVHVEKCENLTSVFPATVAKDIVKLENLVVQHCEGLMAIVAEDNADPNGTNLELTFLCLTSLTICDLPELKCFLQCDMLKTFSHVEPNTKNQICIEKVPLLLQLTPNLQHLTLGENELKMIPHGEFPGNVLHNLKALILLNFSVESYEFAYGFLQQVPNIEKLEVYCSSFKEIFCFQSPNVDDTGLLSQLKVLSLESLSELETIGFENTLIEPFLRNLETLDCHGLENLFTSSTAKSLSRLKIMEIRSCESIKEIVSKEGDGSNEDEIIFRQLLYLNLESLPNLTSFYTGRLSFPSLLQLSVINCHCLETLSAGTIDADKLYGVKFQKKSEAIPLDIDLNSTIRNAFQATLENLLDGKCMVFVSNHHIYNLLTKRVHSQ

SEQ ID NO: 139144 - protein, 112 aa, Glycine max
  Coding DNA Sequence Number=SeqID_22366
MHRVRSYPASVSNSFKALKLLINDPILEIQEFKERLLDLGVEVSEFCYLAIKQAHKFQGGDAVCVTVGTISKIVMDNHSWYYPACAQCHRKTDIQTGPFTCGCDKDNHQPVL

SEQ ID NO: 139145 - protein, 134 aa, Glycine max
  Coding DNA Sequence Number=SeqID_22367
  Subcellular localization annotation: CTP_CleavageSite=76; ConfidenceScore=5.07e-01
MQNSGVTLRAESQHFASVHDDNPCVASIPYYMCFQMTMATPPASPPPPVVASVFMSTQKRTRKATRLRSLATRPPRAKRPVVNVEDIQAEFEIPEASDSSTKKKIFRLWASGGGTDKDDVDDTVCEKYGISKEK

SEQ ID NO: 139146 - protein, 71 aa, Glycine max
  Coding DNA Sequence Number=SeqID_22368
MARGGPESMGGNGSDSKMNPFEEGGNDVGAPSPSNDPLHGIGGPMTRFKTKRTKQTLQGLILNIKEKEYQR

SEQ ID NO: 139147 - protein, 80 aa, Glycine max
  Coding DNA Sequence Number=SeqID_22369
  Subcellular localization annotation: CTP_CleavageSite=21; ConfidenceScore=5.14e-01
MGRSLIISAFVATSLAFACFSATALVGRRREYLYLAGLLSSGLSILQFHSSSLRSLAMLFYSFSVTDKLEIYPAYMPNSR

SEQ ID NO: 139148 - protein, 107 aa, Glycine max
  Coding DNA Sequence Number=SeqID_22370
  Homolog annotation: Hit_ID=Q1SP80; Match level="QueryCoverage=45%, HitCoverage=12%, E-value=8e-08, Identity=80%"; Hit description=Heat shock protein Hsp70
MVDEGGKLGGGFMRLSSVNYNEFFSRGSFLSGLIRYPTVVGHLGGTQKRNGKLLLLLLHMALTRGLIALESKTFSSLTLVVVLLTIKDKVFQDKATTGNTHLRWRGL

SEQ ID NO: 139149 - protein, 298 aa, Glycine max
  Coding DNA Sequence Number=SeqID_22371
  Gene Ontology: Mol. function=calpain activity; Cellular component =intracellular; Biological process=proteolysis
  Homolog annotation: Hit_ID=Q1T2S5; Match level="QueryCoverage=94%, HitCoverage=78%, E-value=7e-34, Identity=34%"; Hit description =Cyclin-like F-box; F-box protein interaction domain; Galactose oxidase, central
  Pfam annotation: Domain name=FBA_1; Domain location=152-291; Score= -37.8; E_value=0.004; Accession=PF07734.3; Description=F-box associated
ADPTDQLLIKSYWETHSRDIEASLYDDSTKAVVNIPYPSPSYIDEGIKFEGSCRGFLLVTTTVVSSGKVVYFMIWNPSTGLRKRFNKVFPTLEYLRGIGYDPSTDDYVVVMIRLGQEVQCFSLRSNSWSRFEGTLPFRKNTSVTHTHALLNGSYLNGALHWLVYSYDYYFKIIAFDLVERKLFEIPLPRQFVEHRCCLIVMGGCLCLFCTTYVPAQPAQMWMMKEYNVQSSWTSTSVPDAPYGFHPICFTKNGEILGYEHGDKMLMRLSDKGKLLDKRRSLCEKFVLYKESLLSLPPN

SEQ ID NO: 139150 - protein, 238 aa, Glycine max
  Coding DNA Sequence Number=SeqID_22372
  Homolog annotation: Hit_ID=Q1SP02; Match level="QueryCoverage=97%, HitCoverage=61%, E-value=4e-24, Identity=28%"; Hit description=IMP dehydrogenase/GMP reductase
  Pfam annotation: Domain name=DUF1723; Domain location=43-92; Score =47.2; E_value=5.5e-11; Accession=PF08330.1; Description=Protein of unknown function (DUF1723)
ERPDLKLVSHGRKVDKFGRPDAEIEGVIVATGLDPLIRCSVITIDPGLIFAFVERWHRETSSFHLPVEEVTITLDDVSSLLHILITGALHSFKQLVTSNAVALLTKLLKVTPDEATAETRQAGGPHAFRDLGQAGAFSWGATALVHLYDQLNEASQAPTRQMVGYISLLQCWNYEHFPSVHRCVVDDGYAEASPRAYRWHTVTNVCWMPYAEHRGVRGYDLISSYTGQVRWGQIIVYI

SEQ ID NO: 139151 - protein, 88 aa, Glycine max
  Coding DNA Sequence Number=SeqID_22373
MVGAFSQNIVTLTGLRMFLLSESDLTNPLCGVSCYVLLSAPGWFFTDMRVSQVSPRIFPPLESAPVSLALARPRRARCDNRYEFIFLH

SEQ ID NO: 139152 - protein, 254 aa, Glycine max
  Coding DNA Sequence Number=SeqID_22374
  Gene Ontology: Mol. function=DNA binding; Cellular component=nucleus; Biological process=regulation of transcription
  Homolog annotation: Hit_ID=Q9FLG5; Match level="QueryCoverage=70%, HitCoverage=95%, E-value=1e-62, Identity=61%"; Hit description =Similarity to NAM
  Pfam annotation: Domain name=NAM; Domain location=8-128; Score=136.6; E_value=7e-38; Accession=PF02365.6; Description=No apical meristem (NAM) protein
MGDNNVNLPPGFRFYPTDEELVVHFLQRKANLLPCHPDVIPDLELYPYDPWELHGRALAEGKQWYYYSRRTQNRVTSNGYWMPMGMEEPVISNSSNKRVGMKKYYVFHLGEAPDGNTTNWIMQEYRLLDSASSSISSRRRSQPKPDHSKWVICRVYERDNDEDDGDGTELSCLDEQFLAAIVISEVAIARFLYSSLSSGALDEIHGQTICNMTLCFQRSHSLAAQVNLGKFYALYSLFQHVDNHISSIYSQPLI

SEQ ID NO: 139153 - protein, 205 aa, Glycine max
  Coding DNA Sequence Number=SeqID_22375
  Gene Ontology: Mol. function=metal ion binding; Cellular component =nucleus; Biological process=multicellular organismal development
  Homolog annotation: Hit_ID=Q5DPY0; Match level="QueryCoverage=62%, HitCoverage=65%, E-value=1e-41, Identity=67%"; Hit description=Inner no outer
  Pfam annotation: Domain name=YABBY; Domain location=59-200; Score =173.4; E_value=5.9e-49; Accession=PF04690.4; Description=YABBY protein
MGSDKCQERAQKEGSILFHWSISFAVIQERQIHKMPHCPLFVPLWKLTLPSTMETFSALSFSSWTERGLGEVSVPCSSLSMVVTVRCGHCTNLLSVNMLKASFIPFHLLASLSHLEPKESSPEEDANKTLNSHSASMMTYSDCEEEDIIPMSHHVVNKPPEKRQRTPSAYNCFIKEEIKRLKAENPEMTHKEAFSTAAKNVKSNF

SEQ ID NO: 139154 - protein, 117 aa, Glycine max
  Coding DNA Sequence Number=SeqID_22376
  Homolog annotation: Hit_ID=Q9FLG5; Match level="QueryCoverage=40%, HitCoverage=25%, E-value=9e-20, Identity=85%"; Hit description =Similarity to NAM
MKFPRIIRVEFKIRDDIWMARKKICLSLKEMNNKLFICGVEAKPGWEVDIVISHFLEQTRKEGRFGVKEQWKMKVVGDKHSTSSKPRRRITERDVPLSQNEISKTMLEREREKEAYV

SEQ ID NO: 139155 - protein, 142 aa, Glycine max
  Coding DNA Sequence Number=SeqID_22377
  Gene Ontology: Mol. function=microtubule motor activity; Cellular component=microtubule associated complex; Biological process =microtubule-based movement
  Homolog annotation: Hit_ID=Q9FME7; Match level="QueryCoverage=97%, HitCoverage=11%, E-value=8e-23, Identity=44%"; Hit description =Kinesin-like protein
TEIAELRQQRQGSDSSATRNGVEKLKKEYLQKLNLLEDQVTELKMKLGTRSQFSTQRKKVDESTKQLQFDIQNLKAQKVQLQCKIKLESVQFRLCKALLEKEVLQWKTGEVLQRKTEEASAATKRLQDMITARKAVSHRSTG

SEQ ID NO: 139156 - protein, 161 aa, Glycine max
  Coding DNA Sequence Number=SeqID_22378
MNVAFSHLSWWLWNGKYHKPRISNGSTINSSADSVMWELDGLRFPLVMQANVPSSSKKVKHKGHSKEEIDREHDVVIVSSDGGCVSGSESDGSDWSIGWLEPHGTGFSSDDDVEARETDNSFAVLVPCYGSNYSAMVEEDTKSNLLTHFGYFPNSYSDVVN

SEQ ID NO: 139157 - protein, 312 aa, Glycine max
  Coding DNA Sequence Number=SeqID_22379
MAGEISQLKEENEILRQEKLGSQLQEVDCDSQEKDSDIQDLKEQMNSLGSLLRELQSRKEKLDFKDKKQGDLGLFLLSEESNDKIKMNTPEMGSASENSVKRERTSEGICCSCSKKSLCKTNKCKCRSSGGSCGASCGCTRLKCTNREPNQLEGSEPLKSGNTECTQEASAEDKDGSVIASECAKLLQSALVQKPASCKDNLVPKKKPLRDIQNSMAKLDDQKQGKKKKARKPVIQLITNDPISSSPENSSSIETQENNPTGLDKVANSTTENNSGQTNEFATSISDAPGFRRLRNPTRQAKSVVEKDNCLI

SEQ ID NO: 139158 - protein, 949 aa, Glycine max
  Coding DNA Sequence Number=SeqID_22380
  Gene Ontology: Mol. function=kinase activity; Cellular component =nucleus; Biological process=regulation of transcription, DNA -dependent
  Homolog annotation: Hit_ID=Q94CG5; Match level="QueryCoverage=98%, HitCoverage=96%, E-value=1e-120, Identity=31%"; Hit description =Kinase interacting protein 1
  Pfam annotation: Domain name=KIP1; Domain location=1-52; Score=54.1; E_value=4.5e-13; Accession=PF07765.3; Description=KIP1-like protein
MEDVMAETLNIIHNEGESFSQRAEMYYRKRPQLVGYVEEVFRSYRALADRYDLLSKELQSANRTIAIVFPEQVRCRIDEDDVEESFPGTNSSSQDHNNQTPKPGIPKAPNFPNKDLRSPSMLLSKKGPLKRVASSAKSPSSSPSSGLSKAEALAKVDKLQKEILALQTEKEFVWSLYENSYEKHWEIEDRITEMQKRVCSLQDEFGINTMIEDNDARALMAATALNSCKETLAKLQETQAQSSEEAKESYQRVKEARDMFETIRGQFISKLNSQEDQGTEPKSIEEEDMSSLEEERHEPDVELLRDTIKEKLEKDSGSSLSMTEMTEKIDELVNKVITLEIAVSSQTGLVKRLRSEADKLQKNILSLEEDKEVLTEDSEGTKKKLEEVEEELRRVKILYQSANRQDNSLQTHFAEASCDLEHLSGKLNDVKLDEEGENLQLHKNKSAHDGEIKVEFEKSGDNTEHMKDVETAKEDCSVNFGDVENEDNKSNSKENIDFRTEEIPEQMLQNKDDLSEARSNLDTESLDQGTGEEENQSNRSQMMASGLDDGEKILTEFTSVLKNYEDVKDELNDVVKKNQDSIFQLALQKLYTWHYITSSSENVDLHLQVRELRDTVETKDQEINILQQMLTCSKTNPDESPSTPLTDYKHTPQEALLGTAAQGTDPQDPENPSSNTNASAVTTSYAGQHQKYVENKARIGILMKVRSNQLDRTHSLSTLEKKFRSNMDDLLEENLEFWLRFSTSVHQVQKFQSSIQDLKFELKTIRDNMSQENSSSIQSEIKPIFRHLREIRTELSLWLEHSEELHEELQCRHPSLCTLQDEIARAANPNSASSNNMAKLSGYQAAKFQGEILNMKQESIKVSSELQACVSFVKELKGEVEKMVEELSQEVGVNNHDHMKHSTSRPRIPLKSFLFGIKLRKQKQTVLSCVTPTKKQHRDLALAEEDAPI

SEQ ID NO: 139159 - protein, 300 aa, Glycine max
  Coding DNA Sequence Number=SeqID_22381
  Gene Ontology: Mol. function=GTPase activity; Biological process =catabolic process
  Homolog annotation: Hit_ID=Q84N64; Match level="QueryCoverage=97%, HitCoverage=40%, E-value=1e-129, Identity=74%"; Hit description =Dynamin-like protein
MAEFRFLVGGIKCPPITREEIVNACGVEDIHDGTNYSRTACVIAVAKARDTFEPFLHQLGSRLLYILKRLLPISVFLLQKDSEYLSGHEVFLRRVASAFNNFAESTEKSCREKCMEDLVSTTRYVSWSLHNKSRAGLRQFLDSFGGTEHSNACNNPTATVLSQTSAHEKEDTKSQPDVKLSHVASGTDSSSSIQTTETKLADLLDSTLWNRRLAPSSERIVYGLFNCFLLMPIVDKLPALLREDLESAFQDDLDNVFDITNLQHSFGQQKRETEIELKRIKRLKEKFRMIHEQLIQNQTM

SEQ ID NO: 139160 - protein, 357 aa, Glycine max
  Coding DNA Sequence Number=SeqID_22382
  Gene Ontology: Mol. function=protein serine/threonine kinase activity; Cellular component=cell surface; Biological process =protein amino acid phosphorylation
  Homolog annotation: Hit_ID=Q6UY58; Match level="QueryCoverage=88%, HitCoverage=46%, E-value=5e-99, Identity=55%"; Hit description =Lectin-like receptor kinase 7;3
  Pfam annotation: Domain name=Pkinase; Domain location=41-313; Score =175.6; E_value=1.2e-49; Accession=PF00069.15; Description=Protein kinase domain
  Pfam annotation: Domain name=Pkinase_Tyr; Domain location=44-313; Score=114.7; E_value=2.6e-31; Accession=PF07714.7; Description =Protein tyrosine kinase
  Pfam module annotation: Pfam domain module=Pkinase::Pkinase_Tyr; Domain location=41-313::44-313
IGAFHVLRRLRNGDEILEDWELEFASHKFKYSELHSATGKFGDSNLIGYGGFGKVYRGVIASTGLEVAVKRVAPDSRQGIREFVSEITSMAQLKHRNLVQLHGWCRKKDELLIVYNYVPNGSLDKLLFENEHQKKKLLTWDQRYTIITGVAQGLLYLHEECELQVVHRDVKPSNVLIDEDLQPKLGDFGLARTYEHGINPQTTNVVGTLGYMAPELTKTGKARTSTDVYGYGILILEVACGRKPIEPQKNPEELVLVDWVRELHHQGKISRAIDPSLDEYDKDEARLVLSLGLFCAHPNPDYRPSMRRIVQFLLGETSLPPLPPDIHCEDPTAIRKCPNNFADDSGSSSSMVSSSKY

SEQ ID NO: 139161 - protein, 461 aa, Glycine max
  Coding DNA Sequence Number=SeqID_22383
  Gene Ontology: Mol. function=transferase activity
  Homolog annotation: Hit_ID=Q39048; Match level="QueryCoverage=91%, HitCoverage=96%, E-value=6e-72, Identity=38%"; Hit description=Cer2 protein
  Pfam annotation: Domain name=Transferase; Domain location=30-457; Score=1.6; E_value=5e-11; Accession=PF02458.6; Description =Transferase family
SQPSLPVFASAITPTLEMGSLPDLDTLPPLSSRISTVVPATPREDENGAFQLNYMDLLVKLHYIRPVFFFTSEAVQGLSISDLKKPMFPLLDPYYHVSGRVRRSESGRPFIKCNDAGVRIAESHCDRTLEEWFRENGNGAVEGLVHDHVLGPDLAFSPLVFVKFTWFKCGGLSVGLSWAHVLGDAFSAFNFLSKWSQILAGQAPPKSLHVSSFPEPKISHNSIVDDPPVSIKKTNILGEYWLATNYHDVATHSFHITSKQLHHLVTATFNQTNDNTNKAKTTTYFEIISALLWKCIANIRGQKIGPNVVTICTSESNRAENEFPTNGFLVLSKIEADFSTGKYEISELVKLIAENKMVENHVMEKLVEADEGKEDFIVYGVNLTFVNLEEANIYDGMNLNGQKPIMANCTFRGVSDKGVVLVLPAPEDDEDGGNGRIVTVSLPREELYQLKDKLGGEWGIH

SEQ ID NO: 139162 - protein, 389 aa, Glycine max
  Coding DNA Sequence Number=SeqID_22384
  Gene Ontology: Mol. function=GTPase activity; Cellular component =postsynaptic membrane; Biological process=catabolic process
  Homolog annotation: Hit_ID=Q84N64; Match level="QueryCoverage=95%, HitCoverage=52%, E-value=1e-167, Identity=75%"; Hit description =Dynamin-like protein
  Pfam annotation: Domain name=Dynamin_N; Domain location=36-217; Score= 157.0; E_value=4.8e-44; Accession=PF00350.13; Description=Dynamin family
  Pfam annotation: Domain name=MMR_HSR1; Domain location=34-218; Score=- 15.3; E_value=0.025; Accession=PF01926.13; Description=GTPase of unknown function
  Pfam module annotation: Pfam domain module=Dynamin_N::MMR_HSR1; Domain location=36-217::34-218
MEKEEEEQREWRLYEGYNELHALAQDLHTPFDAPAVLVVGHQTDGKSALVEALMGFQFNHVGGGTKTRRPITLHMKYDPQCESPSCHLVSDSDPSLSHHKSLPQIQAYIEAENARLEQDTSQFSAKEIIIKVEYKYCPNLTIIDTPGLIAPAPGRKNRALQAQARAVESLVREKMQHKEFIILCLEDCSDWSNATTRRVVMQVDPELARTVIVSTKLDTRIPQFARPSDVEVFLSPPPSTLDGCILGDSPFFTSVPSGRVGCGSGYLHSSNDEFKQAVCFREIEDVASLEEKLGRALSKQERSRIGVSKLRLFLEELLQKSTLDEAKLKEKGRAFHDMFLTKLSLLLKGTVVAPPDKFGETLQDERINGGAFIGADGVQFPHKLIPRTG

SEQ ID NO: 139163 - protein, 382 aa, Glycine max
  Coding DNA Sequence Number=SeqID_22385
  Homolog annotation: Hit_ID=Q8GUP8; Match level="QueryCoverage=45%, HitCoverage=61%, E-value=2e-49, Identity=59%"; Hit description=DsRNA- binding protein
  Pfam annotation: Domain name=dsrm; Domain location=125-191; Score =68.2; E_value=2.7e-17; Accession=PF00035.15; Description=Double -stranded RNA binding motif
  Pfam annotation: Domain name=dsrm; Domain location=32-105; Score =47.6; E_value=4.2e-11; Accession=PF00035.15; Description=Double -stranded RNA binding motif
  Pfam module annotation: Pfam domain module=dsrm::dsrm; Domain location=125-191::32-105
MADAEPINLDEAIVSEYGPYDEAEKKMNKRGIVSDGPDEWAFYREYAQKAGLPTPVYETIKEGPSHEPSFRSTVIVNDVRYDSLPGFFNRKAAEQSAAEVALVELIKSNLVNQSITQPVHETGLCKNLLQEYAQKMNYAMPMYQCKKDETPGRASVFSCTVDIGGILYIGGAAKTKKEAEIKAARTALLAIQSSASQASQDQVGHPQLTVLPCRKRATESVAIADENSNPPKPKKARFKRKSSKRKPSRDKMGQIHTENLGIGANINHEVETHASVNGESGVLEKKSETFTSEAANNFENGVSVNYQEKETLAGESSLAVNSQEGIFENGKSTELYSKENNLVTVVTELSSVSNGGIPETGVEVNKQQYNGEMVSDHCVVGG

SEQ ID NO: 139164 - protein, 165 aa, Glycine max
  Coding DNA Sequence Number=SeqID_22386
  Gene Ontology: Mol. function=nucleic acid binding; Cellular component= endoplasmic reticulum membrane; Biological process=DNA integration
  Homolog annotation: Hit_ID=Q1T010; Match level="QueryCoverage=98%, HitCoverage=24%, E-value=7e-20, Identity=39%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=6-159; Score=-7.1; E_value=0.023; Accession=PF00665.16; Description=Integrase core domain
MKKSKVRFADNRVIQAEGVGNVAIRRLDGRQAMITNVLYVPGMKSNLISMGQLLEKGFSMKMSNGSLEVYDTTKEMIMKVPLAKNRTFKSGKCMKTLRTDGGGEFTSSELKDFCKEHGIVHEKNLSHSFWGEAAMTAAHVLNRCPTKRLNSVVPEEAWSSSKPSV

SEQ ID NO: 139165 - protein, 44 aa, Glycine max
  Coding DNA Sequence Number=SeqID_22387
VVHNIWIMDLNMKALLSPHDAELRKDDNFGDTTLCLNGIGFGET

SEQ ID NO: 139166 - protein, 608 aa, Glycine max
  Coding DNA Sequence Number=SeqID_22388
  Gene Ontology: Mol. function=protein prenyltransferase activity; Biological process=protein amino acid prenylation
  Homolog annotation: Hit_ID=Q9M0L4; Match level="QueryCoverage=98%, HitCoverage=83%, E-value=1e-138, Identity=46%"; Hit description=Rab geranylgeranyl transferase like protein
  Pfam annotation: Domain name=PPTA; Domain location=120-150; Score =45.3; E_value=2.1e-10; Accession=PF01239.12; Description=Protein prenyltransferase alpha subunit repeat
  Pfam annotation: Domain name=PPTA; Domain location=155-185; Score =38.4; E_value=2.5e-08; Accession=PF01239.12; Description=Protein prenyltransferase alpha subunit repeat
  Pfam annotation: Domain name=PPTA; Domain location=190-220; Score =43.7; E_value=6.4e-10; Accession=PF01239.12; Description=Protein prenyltransferase alpha subunit repeat
  Pfam annotation: Domain name=PPTA; Domain location=236-266; Score =29.1; E_value=1.5e-05; Accession=PF01239.12; Description=Protein prenyltransferase alpha subunit repeat
  Pfam annotation: Domain name=PPTA; Domain location=77-107; Score =38.3; E_value=2.6e-08; Accession=PF01239.12; Description=Protein prenyltransferase alpha subunit repeat
  Pfam module annotation: Pfam domain module=PPTA::PPTA::PPTA::PPTA::PPT A; Domain location=120-150::155-185::190-220::236-266::77-107
MHGRPRKALKQEDEAASAAKTEKLRSVQAQFLANHHNHMLLLLPSTFFSLSLSLSLSLSLDLFKNCANLVGCRYSKEALDLSAKLLEVNPECYTAWNYRKLAVQHFLSNSDSDPHSIFDDELKLVENALRKNFKSYGAWHHRKWVLNKGHSSIDNEMRLLNGFQKMDPRNFHAWNYRRFVAELMKRSDEDELKYTEEVIATNFSNYSAWHNRSVLLSNLLKRKAEGYFPKEKVLEEEFEHVHNAIFTDPDDQSGWFYHLWLIQQTVKIDAPLLVSSWPSHGSNITLIGDNDLRGCGLSLLNGTLSNPGTLPIILYFNQAVEGINSSTVAIKSELLKEELIWKPLSMNNSNTAQFWVVYLNLGNFELQPSKTYSVEINIGHSKGIISSNGNHFDDPSQISCKVFVQTASSEPTEGQGGKRTTWKDTNFQKIDHFQESDSILPADQNHHIPTTSNWCTEEIGEEITKVRDLLSEYDCKIGKLTLARLLSALDSLSFQYDGRKSNTEEVLQLYTDLMKLDPTHYLYYKDEHSLISLKRITSTRDSLLPYCHYYKDATETITGYVCLRLRNLSLSRMGSIENLLWVQMLDLSHNELQSVEGRTCISDYFTVT

SEQ ID NO: 139167 - protein, 97 aa, Glycine max
  Coding DNA Sequence Number=SeqID_22389
MTKLPLLASGWNKRHMLAGHAYFWSKKMAGKFLYGSRSCRGALVSTNIEQNIFGGVIRCGNGGFTTVDVVEVNDLTNATNLRFWCNVKILVATTREN

SEQ ID NO: 139168 - protein, 50 aa, Glycine max
  Coding DNA Sequence Number=SeqID_22390
MAVEKDLKTKIKLNLKSLLKAKSLEDSLRFEFEVPPDGNINEDDHQLWRI

SEQ ID NO: 139169 - protein, 864 aa, Glycine max
  Coding DNA Sequence Number=SeqID_22391
  Homolog annotation: Hit_ID=Q6H7S8; Match level="QueryCoverage=75%, HitCoverage=23%, E-value=1e-146, Identity=46%"; Hit description =Putative LvsC
MNIVKGVADLIRRTSAGHTGESSSLQAQKYSPPGPRIRFSDVGDEAIANTLWERHEKVDDKVEKRRLLHVFIKQFVIAYKDWEPVNLGILLESTSVESLSSADDVVVGCSAGHPVEVIRVLIEEVTQLSSLVTEWAVVQLKTISGALSADESFISHADAPIISSNSSKVLSTEARLHWRQKAIVSVMEAGGLNCFGNVNNLQFLCENGRVHKFANSFCSPAFLLQDLGWEKDFAGQDAVGMPGLDIQENQNCSKPDPVVVSAGLPSRASFSDFWNNYVVMLSRGLCSFLLVPEGSKSLHVQVSSGRLALPISSAYYELSIKWVMRVLFTIFPCIKTCSSQNELPSYLRVFVSTLQNTVLNAFRNLLSSSPMSLEIFHEEGIWDLIFSENFFYFESGSDESAGQIFADTEKSEISSASRSTGNTEEVTGVNSLQMQVISFVEFASTSDGNTQNMRELAALLDALEHSACNPEIARVLVGSLVHILQLSPGRTIASFKKLNAVSRVLHVACVQAQESRRPGSMEPSNENSGMEALFIAAAEDTRSLILHSFTCIDYLFDLFWVEGLRDDVLRHIVDLMKIMPFSEEDKKAKLQLCSKYLEMFTHLREHEKSFVDLSIDLLVGMRDMLQANQAYYQTLFRDGECFLHVVSLLNSNLDEANGEKLVLNVLQTLTCLLASNDTSKAAFRTLAGKGYQTLQSLLLDFCQWHSSESLLDALLDMLVDGKFNVKMSPMIKSSESLQHHGLDIFQQLLRDSISNRASCVRAGMLDFLLNWFSQEDNDSVIFQIAQLIQSIGGHSISGKDIRKIFALLRSEKVGMRRQYCSVLLTSLLTMLHEKGPTAFFDLDGIDSVSPEAIIDISLELHVLL

SEQ ID NO: 139170 - protein, 142 aa, Glycine max
  Coding DNA Sequence Number=SeqID_22392
MGDKLHRREGNSPDHQLRPLNDRSVIKEMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDT

SEQ ID NO: 139171 - protein, 124 aa, Glycine max
  Coding DNA Sequence Number=SeqID_22393
MRLPGKESLLMKSPITINEILDVSILFLNDHLEETLGSTKIEEIHSKCINLAQGKDYGESGFWLKVCRMARHDTCQGLVWFKDKRDAPHYFHDTNAKMMIWKLYAKLVMHAPMRTLKCQIFMVM

SEQ ID NO: 139172 - protein, 98 aa, Glycine max
  Coding DNA Sequence Number=SeqID_22394
MERDEKRFEYRICYSSEENSVEEDKEGGIGVVDALVITIGEIKRKMKKKKIASYGSRFDEEMSKIGRFEGLGMEGHRKEEEAAQGFLKNVVFIDQDAL

SEQ ID NO: 139173 - protein, 136 aa, Glycine max
  Coding DNA Sequence Number=SeqID_22395
  Homolog annotation: Hit_ID=O23255; Match level="QueryCoverage=45%, HitCoverage=12%, E-value=4e-19, Identity=77%"; Hit description =Adenosylhomocysteinase 1
MVGAFSQNIVTLTGLPMILLSESDLTNPWCGEQMNRWMTMKNLMLEDTGTQRSDRMGRGCRTGPLEGLGWTELGLAGHEVGHLDLSQLDLEATKVGLGKVLDHVLATTCGFLHQQSHCLCIEKEEERKKEKRLNGG

SEQ ID NO: 139174 - protein, 66 aa, Glycine max
  Coding DNA Sequence Number=SeqID_22396
MLEYGMQLCIANAPRDIVSNQEPEPSPLGNNEAAVQPEVPSTQEGRPKRALSDQFILMISYRGCRV

SEQ ID NO: 139175 - protein, 94 aa, Glycine max
  Coding DNA Sequence Number=SeqID_22397
  Homolog annotation: Hit_ID=Q69L69; Match level="QueryCoverage=68%, HitCoverage=9%, E-value=6e-10, Identity=45%"; Hit description =Calcineurin-like phosphoesterase-like protein
MTCSTYAWGPAVLAFLYREMCSATDYKIKLIGGMCILIQMWAWERCTTLTPKRTPPVMENKPLGHRWLRRGNQHIGNDDLIVFRRKLDIMKRHE

SEQ ID NO: 139176 - protein, 77 aa, Glycine max
  Coding DNA Sequence Number=SeqID_22398
  Gene Ontology: Mol. function=protein binding
  Homolog annotation: Hit_ID=Q10Q27; Match level="QueryCoverage=87%, HitCoverage=25%, E-value=7e-17, Identity=64%"; Hit description =Leucine Rich Repeat family protein, expressed
MESVQVRLYVGQIPLNLLKDCIALQNISLHGNPISMDQFQQMEGFQEFEARRKKKFDKQIDSNVMIGSKGLDEGVDL

SEQ ID NO: 139177 - protein, 44 aa, Glycine max
  Coding DNA Sequence Number=SeqID_22399
MEVVLMLQILAENLIERLPVNLGKLQSLKLMNLDGNRITSLPDE

SEQ ID NO: 139178 - protein, 117 aa, Glycine max
  Coding DNA Sequence Number=SeqID_22400
MQCDDVMLCMYMGGAVTLFNISGEKLEGAATGVSLSLTHALSEYHPLSEASACLASKRNLEGNLPCKHALSVLSARPASHLSLQALSAPGSLSHCSLTRAKRAFEDRKPFLKPEVEN

SEQ ID NO: 139179 - protein, 91 aa, Glycine max
  Coding DNA Sequence Number=SeqID_22401
MTIARQKGVHKENEGGACHPTRPGKLSSPRRARLLPPEGTAFLRNILEGPSEPGCYLHPLFTKYTPAFFADSFSVTLRKFTNSVTILVFFP

SEQ ID NO: 139180 - protein, 231 aa, Glycine max
  Coding DNA Sequence Number=SeqID_22402
MEEFSTQVAWPGVQPSSFGGGKASTAQEPKPKLEAAAQKANLEDIPEATPVAQEDIVEATPETTSYASPVTTPMLELSKEEDDATDMDYADRAAAGVSLSLAHALSEYHPLSNASARLASKRNLEGNLPRKHALSALSARPVSHLSLLALSAPGSLSQSSLTRAKRENGAKRTFEDKKPFLKLEVENQRERSVERRECEEQRTEVEETSPPLCNLLFSLITHFSLVKGVAL

SEQ ID NO: 139181 - protein, 93 aa, Glycine max
  Coding DNA Sequence Number=SeqID_22403
  Gene Ontology: Mol. function=oxidoreductase activity; Biological process=ethylene biosynthetic process
  Homolog annotation: Hit_ID=Q1SGA8; Match level="QueryCoverage=86%, HitCoverage=32%, E-value=7e-13, Identity=47%"; Hit description=2OG -Fe(II) oxygenase
MDLSAHTDHGLLTLVMQNELGGLQIQHDGNWMPLHAFLINTGDHLEILTNGKYKSWLVMIILLHTVPLNTEITYTFSKAMNWTEGSCLHRIRI

SEQ ID NO: 139182 - protein, 201 aa, Glycine max
  Coding DNA Sequence Number=SeqID_22404
  Gene Ontology: Cellular component=membrane
  Homolog annotation: Hit_ID=Q9M7R1; Match level="QueryCoverage=92%, HitCoverage=54%, E-value=3e-43, Identity=48%"; Hit description =Purine permease
  Pfam annotation: Domain name=C4dic_mal_tran; Domain location=7-201; Score=-91.0; E_value=0.1; Accession=PF03595.8; Description=C4 -dicarboxylate transportermalic acid transport protein
  Pfam annotation: Domain name=DUF6; Domain location=17-150; Score =18.6; E_value=0.0057; Accession=PF00892.11; Description=Integral membrane protein DUF6
  Pfam module annotation: Pfam domain module=C4dic_mal_tran::DUF6; Domain location=7-201::17-150
MMKRILLLINTILLATGTSGGALVMRLYFIHGGKRIWLSSFLETAAFPIIILPIIISYIHKRRRHRSSALISIKPPLFLASALIGLLTGLDDYLYACGVARLPVSTFSLIQASHLAFTAVFAFLLVRHRFTPYSVNSVVLLTVAAVVLALRSSGDRPAGESSRQYVIGFVMILAAAALYGFVLPLMELVYKKSRQRITYSL

SEQ ID NO: 139183 - protein, 107 aa, Glycine max
  Coding DNA Sequence Number=SeqID_22405
MDNQLGISACHLTSRVRINRNRLCGQPLGYLRMSSDFTGYDSKKVQMTTLASACQSNLRSPNDEVRITERCLRMLPDSWVMRAKGGVVDKNEGFAPTYPPFVMKNSD

SEQ ID NO: 139184 - protein, 167 aa, Glycine max
  Coding DNA Sequence Number=SeqID_22406
  Homolog annotation: Hit_ID=Q9ME62; Match level="QueryCoverage=25%, HitCoverage=100%, E-value=1e-08, Identity=66%"; Hit description =Hypothetical protein rrn16
LADAYSPDTVIASSPGKEVMTRRPSTFTRHCSESGPCLSPSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVKVTLYR

SEQ ID NO: 139185 - protein, 68 aa, Glycine max
  Coding DNA Sequence Number=SeqID_22407
MEKGRTVVVSALQFACTDDISTNVATAESFQNVTKQGCSDKLVEGGARYKAECGIEEEVKQDENRRKR

SEQ ID NO: 139186 - protein, 407 aa, Glycine max
  Coding DNA Sequence Number=SeqID_22408
  Gene Ontology: Mol. function=protein serine/threonine kinase activity; Cellular component=integral to membrane; Biological process=protein amino acid phosphorylation
  Homolog annotation: Hit_ID=Q94F62; Match level="QueryCoverage=91%, HitCoverage=61%, E-value=1e-152, Identity=72%"; Hit description =BRASSINOSTEROID INSENSITIVE 1-associated receptor kinase 1 precursor
  Pfam annotation: Domain name=Pkinase; Domain location=86-360; Score =143.3; E_value=6.4e-40; Accession=PF00069.15; Description=Protein kinase domain
  Pfam annotation: Domain name=Pkinase_Tyr; Domain location=86-360; Score=111.5; E_value=2.5e-30; Accession=PF07714.7; Description =Protein tyrosine kinase
  Pfam module annotation: Pfam domain module=Pkinase::Pkinase_Tyr; Domain location=86-360::86-360
MVSKPGEELVGLGVGNGIKAIGVIAGGVAVGAALLFASPVIALVYWNRRKPLDDYFDVAAEEDPEVSLGQLKKFSLPELRIATDNFSNKNILGKGGFGKVYKGRLTNGDDVAVKRLNPESIRGDDKQFQIEVDMISMAVHRNLLRLIGFCMTSSERLLVYPLMANGSVESRLREPSESQPPLDWPKRKNIALGAARGLAYLHDHCDPKIIHRDVKAANILLDEEFEAVVGDFGLARIMDYKNTHVTTAICGTQGHIAPEYMTTGRSSEKTDVFGYGMMLLELITGQRAFDLARLARDEDAMLLEWVKVLVKDKKLETLLDPNLLGNRYIEEVEELIQVALICTQKSPYERPKMSEVVRMLEGEGLEEKWDEWLNMTEDIQNFTFNLCTPTPNDSNPNIQPDVLSGPR

SEQ ID NO: 139187 - protein, 168 aa, Glycine max
  Coding DNA Sequence Number=SeqID_22409
  Gene Ontology: Mol. function=nucleic acid binding; Cellular component= nucleus; Biological process=embryonic development ending in birth or egg hatching
  Homolog annotation: Hit_ID=Q9FYA7; Match level="QueryCoverage=79%, HitCoverage=45%, E-value=7e-41, Identity=63%"; Hit description =Splicing factor RSZ33
  Pfam annotation: Domain name=RRM_1; Domain location=48-111; Score =50.9; E_value=4.2e-12; Accession=PF00076.12; Description=RNA recognition motif. (a.k.a. RRM, R
MGSVLVWTRQFTLKGFGNSVYGETPIHSESWKKSTMPRHDDKYSNTRLDVGHLSSMTRSRDLERVFSRYGRVQGVDMKNFFAFVDFGDPRDADDARYNLDGREVEGRHVTVEFAKGGPRGSWESSGQGQGPPTGPGRCFDCGLMVIGPEIAKLGMGRTSVSLVGKEVI

SEQ ID NO: 139188 - protein, 129 aa, Glycine max
  Coding DNA Sequence Number=SeqID_22410
MQWWFQSQKRCKDKLKLTRNKRRTIVTSKENKSWKILLQSKGSSQCGVATENNDGLWWLMVAVGDGESAWDVRNGFGRKKEEEIVFFLSYTKAKAENVQVRNGLGHRNVAHTPDIFSKIPTVRSWTSVL

SEQ ID NO: 139189 - protein, 876 aa, Glycine max
  Coding DNA Sequence Number=SeqID_22411
  Gene Ontology: Mol. function=RNA-directed DNA polymerase activity; Cellular component=chromatin; Biological process=chromatin assembly or disassembly
  Pfam annotation: Domain name=RVP_2; Domain location=246-371; Score= -34.8; E_value=0.00052; Accession=PF08284.2; Description=Retroviral aspartyl protease
  Pfam module annotation: Pfam domain module=RVP_2::RVT_1::Retrotrans _gag; Domain location=246-371::413-582::90-168
MADHGTRKTTTDRLEEAITRLTNSQASLTDGYTDLSGKVDSILDHLRLHDSGRNAANIANHQNHQRNSVKLDIPRFDGRDPLGWIFKITQLFQYQNTSEEERITEGFLQALESRFAPTFYDDPKGAFFKLTQKGTVNDYLTEFKRLANRVVGLPPPFLLSCFIYGLCPDFHREVMTLQPISLLQATALAKLQEEKLRDRAASTPRNFYQPKPPPPHTPNPTTKAKPSYDESCSSSLMNNHLTLTLHALSGSPSTETFRIYGTVKNAQLAILIDSGSTHNFLQPHIAQFLKHPVQATHPLQVLVGNGSTLDCNQVCPETQVTIQGHPFLVSFHLLQINGVDAVLGIDWLKKLGPITTDYAACIMNFTHQASSSLIPSPVPDPFTTTSTTPSGPPYYTTTFHGPNKPGLIRPCSSPYSSPVLLVKKKDGTWRLCVDYRALNAVTIRDHFPIPTIDELLDELGQATWFSKLDLQQGFHQILMHEADVEKTTFRTHNSHFEYLVMPFGLSNAPSTFQSAMNHLLQPFLRRFVTVFFDDILVYSSSLSSHIQHLEAIFEMPQNGEFYLKKSKCLFAQETIEYLGHVVSSKGVNPEPSKIQAMVQWPTPRTVRELRAFLGLTGFYRKFIKGYAAIAAPLTSLLCKDAFTWTTESQEAFTQLKSAMTNAPVLALSNFFEPFVIEIDASAMAIGTVLTQNGHPLAYFSKGLSPRITQASTYICKLHAIVAAVRKWRQYLLGRPFTILTDHKSIRELMTQIIQTPEQHYYLSKLLGYDYSIQYKAGATNVVADALSRAPPPTGQLLILSVPQLDFLSNIRKSLESTLEFQQLTRSIQSNPANHPGYTLCNNLILFKGRIWLHSDNPASLACYLNIMQLHWVAISA

SEQ ID NO: 139190 - protein, 427 aa, Glycine max
  Coding DNA Sequence Number=SeqID_22412
  Homolog annotation: Hit_ID=Q2Q9T4; Match level="QueryCoverage=35%, HitCoverage=60%, E-value=1e-74, Identity=89%"; Hit description=Beta -hydroxyacyl-ACP dehydratase
  Pfam annotation: Domain name=4HBT; Domain location=334-417; Score =5.5; E_value=0.08; Accession=PF03061.12; Description=Thioesterase superfamily
  Pfam annotation: Domain name=FabA; Domain location=293-419; Score =188.7; E_value=1.4e-53; Accession=PF07977.3; Description=FabA-like domain
  Pfam module annotation: Pfam domain module=4HBT::FabA; Domain location=334-417::293-419
GQWAEPAQAAANWQNSSLDQAGMWEIWEKKECSATPTMEARLVDLTPSWGSKGGEMSPTEGVEARGFAVSGFGLGGVEGEEDGFEPGEGRRFRGVDSGEVEAREEGDEGEDDEAEVGVGGEEGVVEPVAEGVGVGAGEGRGDGGVGSGGGQEESEEEEGRMAARAWIRERALETDSHHECIGSEEEVLLGSALLGVGVDEDGDDDESLRIVTFAHLTSLHNDKCILVQTMTTTVSALSNTFFISQISQLEISASGYPSSPSIFLPTWFSCFAIVAGYPAFPTSLDINKIRDILPHRFPFLLVDRVIEHNPGVSAVAIKNVTINDNFFPGHFPERPIMPGVLLVEAMAQVGGLVMLQPEIGGSRNNFFFAGIDKVRFRKPVIAGDTLVMRMTLIKLQKRFGIAKMEGKAYVGGEVVCEGEFLMATGSE

SEQ ID NO: 139191 - protein, 188 aa, Glycine max
  Coding DNA Sequence Number=SeqID_22413
  Gene Ontology: Mol. function=GPI anchor binding; Cellular component =anchored to membrane; Biological process=lipid transport
  Homolog annotation: Hit_ID=Q8VYI9; Match level="QueryCoverage=78%, HitCoverage=75%, E-value=2e-36, Identity=53%"; Hit description =Nonspecific lipid-transfer protein-like protein At5g64080 precursor
  Pfam annotation: Domain name=Tryp_alpha_amyl; Domain location=39-117; Score=63.0; E_value=9.8e-16; Accession=PF00234.12; Description =Protease inhibitorseed storageLTP f
  Subcellular localization annotation: CTP_CleavageSite=81; ConfidenceScore=5.06e-01
MASKLTLIALVLAVALCAVDLTHSASASSPHAPAPSVDCTNLVLTMADCLSFVTNGSTVTKPEGTCCSGLKSVLKTAPACLCEAFKSSAQFGVVLNVTKATSLPAACKVSAPSATNCGLSETPAAAPAGGLSPQASPSPQQADASTNGPVNEISPAPAPAQGNTASALFPISAGSLLLGILVATFSGF

SEQ ID NO: 139192 - protein, 158 aa, Glycine max
  Coding DNA Sequence Number=SeqID_22414
  Gene Ontology: Mol. function=lipid binding; Cellular component =anchored to membrane; Biological process=lipid transport
  Homolog annotation: Hit_ID=Q8VYI9; Match level="QueryCoverage=43%, HitCoverage=37%, E-value=6e-22, Identity=71%"; Hit description =Nonspecific lipid-transfer protein-like protein At5g64080 precursor
MERNSSQKPENVATNMPRSKDPAEIGNNADAVFPWAGAGAGDISFTGPLVEASACGGERGGLGDIQNDAELSAALESLAEARRSSFENRFQTGAACALWLGDGATVGDEGQAVGHGEDEDADALWVRSTAHRATARTNAMRVNFDAIFGLGREKGSGN

SEQ ID NO: 139193 - protein, 203 aa, Glycine max
  Coding DNA Sequence Number=SeqID_22415
  Gene Ontology: Mol. function=metal ion binding; Biological process =metal ion transport
  Homolog annotation: Hit_ID=Q94CS5; Match level="QueryCoverage=96%, HitCoverage=89%, E-value=2e-20, Identity=34%"; Hit description=Heavy- metal-associated domain-containing protein-like
  Pfam annotation: Domain name=HMA; Domain location=139-199; Score =45.3; E_value=2.1e-10; Accession=PF00403.16; Description=Heavy-metal- associated domain
  Subcellular localization annotation: CTP_CleavageSite=21; ConfidenceScore=5.03e-01
MTSLKSSERKMMKRGFMCHSRASTAVCMSTRDPRSVVVPKKLERRVFLDDTRLINYAKYSKLVEPPRSSPVPKIKLRGQEQDQANNEPREFQKKQTDNNVFQFATEEGMCVLQLYGHTHILNFERNNGISYSNLLKIVVVMRVAIHCQGCAGKVKKHLSKMEGVTSFSIDVESKRVTVMGHISPVEVLESISKVKRAEFWTAC

SEQ ID NO: 139194 - protein, 110 aa, Glycine max
  Coding DNA Sequence Number=SeqID_22416
  Subcellular localization annotation: CTP_CleavageSite=42; ConfidenceScore=5.25e-01
MDSLMKITEIYPKQLVKKSAKSSSRSPSQGTSSSCLQFALHRAKEEAAQQREHRVAEVTSIERDGVTYGPMKEKRELGVFKSQVKGDLTLKSRSSCRTGDHPTRKIATLF

SEQ ID NO: 139195 - protein, 124 aa, Glycine max
  Coding DNA Sequence Number=SeqID_22417
MEYREQFELLSVPLCFIDEELMRRVFMNGLEEEIKTEVKMMGARSLNALMMLVWKVEDQKSDLDLGFFIQMRMSLPEAVTNLRRGPASMCKGEKTNTRSSEVTIDAELQTCWVLGLPELLLMQH

SEQ ID NO: 139196 - protein, 318 aa, Glycine max
  Coding DNA Sequence Number=SeqID_22418
  Gene Ontology: Mol. function=catalytic activity; Cellular component =peroxisome; Biological process=metabolic process
  Homolog annotation: Hit_ID=Q84P23; Match level="QueryCoverage=74%, HitCoverage=42%, E-value=5e-50, Identity=45%"; Hit description=4 -coumarate-CoA ligase-like protein
  Pfam annotation: Domain name=AMP-binding; Domain location=66-318; Score=-111.5; E_value=0.007; Accession=PF00501.18; Description=AMP -binding enzyme
  Subcellular localization annotation: CTP_CleavageSite=58; ConfidenceScore=5.08e-01
MDERKRIDPRSGFNRASRIFHSLKPPLPLPPPKRHLSPPQPTPSPSAATRYFPTPPPPSSMPPPATASPTTRRHCAHSLPNLIQVPILCFALLSLGVVVSPANPISTRSDLTRFFHLSKPAIVFTVTSVVEKTQDFHVRTVLLDSPEFDSLTKTRIQIHPPSPLVSPVTQSDVAAILYSSGTTGMMKGVVMTHRNLTALAAGYDAVRVNRKYPAVFFFTMPFFHVYGFTLSFRAMVLSETVVIMERFSLRGMLSAVERFGVTHLAVVPPLMVALTKDSVTNGYDLKTLEGVTCGSSPLGKETAEAFKAKFPNVMILQI

SEQ ID NO: 139197 - protein, 151 aa, Glycine max
  Coding DNA Sequence Number=SeqID_22419
  Gene Ontology: Mol. function=catalytic activity; Biological process =metabolic process
  Homolog annotation: Hit_ID=Q69RG7; Match level="QueryCoverage=88%, HitCoverage=31%, E-value=3e-09, Identity=31%"; Hit description =Putative 4-coumarate--CoA ligase 1
MYLNPSLRERVELGRVEEYGSNMKVLFAEVEEAREIGARGDRVRGRDDHAKRKKCEAEDWNLDEGFDAVDDLVVGEAVAGGGIDEGGGGGEWWLEAVEDSGSAVETAPWIYSFSLVHGTRQWSWQVGHVAAPGGLASGVGELLSTWRVPPL

SEQ ID NO: 139198 - protein, 477 aa, Glycine max
  Coding DNA Sequence Number=SeqID_22420
  Gene Ontology: Mol. function=protein binding; Cellular component =protein complex; Biological process=red or far red light signaling pathway
  Homolog annotation: Hit_ID=Q1SNG8; Match level="QueryCoverage=79%, HitCoverage=91%, E-value=1e-140, Identity=68%"; Hit description =Proteasome component region PCI
  Pfam annotation: Domain name=PCI; Domain location=248-351; Score =82.5; E_value=1.3e-21; Accession=PF01399.17; Description=PCI domain
MDPLEALVAQIQGLSSTPGDLTRLHSVLKQADDSLRSESTRLAPILTQLDPSIHSLGFLYILEASMTDPVTKTQAETVVPIVTRFIGACSPEQIRLAPDKFLSVCKRLKDQVMLLEAPIRGVAPLFTALRKLQVSTEHLTPLHSEFLLLCLLAKCYKTGLSILDDDVFEQYCIVEFLGCAIVTPSTNVAAVDVMAAVVTAPMSTINAIAVEAYKKYILVSLIRHGQFSTSLPKYSSSTAQRNLKNFCQPYVELANSYGTGQIEELEAYARANAEKFESDNNLGLVNQVVSSMYKRNIQRLTQTYLTLSLHDIASTVQLNSPKEAEMHVLQMVDGEIYATINQKDGMVRFLEDPEQYKTCEMIEHIDSSIQRLEERDKDMTLMTLTFHKSSTFKGLGMMEVDLVMVHHPFPLSFVIPGSESGGVFYFSPKWKSACSEDWIRFTLKAAQYARLGRPSIHVLKSRGMKLAALAIDGAFLK

SEQ ID NO: 139199 - protein, 97 aa, Glycine max
  Coding DNA Sequence Number=SeqID_22421
MNSTSFQDLENQKTSESFWYKEEEEEEVQRDSRLVKDCKRLIGKRYLLVFDLLVRNTVLFFILLILIIGMLLPKVAPAELEQYLLSHPEINDAAVIP

SEQ ID NO: 139200 - protein, 175 aa, Glycine max
  Coding DNA Sequence Number=SeqID_22422
MYVYEKGILGANRDKIFFLMCPRNNQKKLIKGGALSGITMFKFNNIETTKNKIRQANLIKGGALICLLRIKLIRKRLTDQVIRKQPSNFSIAVSAIVGNNGGRRRNAKEKRTSKKKQKREEEAFHLIPATMAATKMRKKQKCEEEDFTWEEEAESRREEEEERRRCRMKQKNEEV

SEQ ID NO: 139201 - protein, 353 aa, Glycine max
  Coding DNA Sequence Number=SeqID_22423
  Gene Ontology: Mol. function=DNA-directed DNA polymerase activity; Biological process=DNA replication
  Homolog annotation: Hit_ID=Q9ZQI9; Match level="QueryCoverage=81%, HitCoverage=66%, E-value=1e-106, Identity=62%"; Hit description =Expressed protein
MESRGDSEVEEPVHILAYYSSIGPSRFEELDKFLSNIRDGRFLRAQNIVLKLNKLKLPLKWEHVCRIAGKGVAPGRLHVARAMLEAGYVENLRQAFARYLFDGGPAYSTGSEPLAEEAIKMISHTGGVAVLAHPWALKNPVPIVRRLKEAGLHGMEVYKSDGRLAAYSDLADAYGLLKIGGSDYHGRGGHNESELGSVNLPVIVLHDFLKVARPIWCNAIREILECYAEEPSDSNLATITRFGRTWSFKGGSPFSCGQDLIDHCLPLWLSSQEMENAEFEAIKLKLSNVSVSQGGIQLLLVVIESNLVSLDCRLGNHKWKLEKHVLCYFCAGVALYFMLSHFHRQSKQALSLC

SEQ ID NO: 139202 - protein, 67 aa, Glycine max
  Coding DNA Sequence Number=SeqID_22424
MAERKIGGEGFQESERLQGRAVIDYKNMVIDYQRATFPEITACNRLHYYGNRLPVVILARRQKQKAF

SEQ ID NO: 139203 - protein, 135 aa, Glycine max
  Coding DNA Sequence Number=SeqID_22425
  Subcellular localization annotation: CTP_CleavageSite=74; ConfidenceScore=5.17e-01
MVEPSKKRKGTSSRSQRHSGSQEAPITSSIPSGSLFSSEEQRIRYTNLFSSRSIADPKFIDMKFFSNENFECFQAFENSNLIPFMSLKLPVYSKLVKAFYSNFEIHEGVLMSEIYGIKMVIDQSLFYDLTKLPSE

SEQ ID NO: 139204 - protein, 176 aa, Glycine max
  Coding DNA Sequence Number=SeqID_22426
NKVDDQGDEREEGIGVVGAPEGRYEVLKIWKLGALSREVLGMRKVRGDDGQQQRWWRKILCVSSMILLFDEVLMNFNLWVNSGGGGGVFVASYCDASPCACLGNRQRPVIRARTLGPYWTSSGPLDVLRARSLQIVDGIRDQLSHVHTYLCHDGINQLTLRQGEIGVVVAGKKVAK

SEQ ID NO: 139205 - protein, 216 aa, Glycine max
  Coding DNA Sequence Number=SeqID_22427
  Gene Ontology: Mol. function=chitin binding; Cellular component =extracellular region; Biological process=chitin metabolic process
  Homolog annotation: Hit_ID=UPI000044A8F0; Match level="QueryCoverage =77%, HitCoverage=100%, E-value=4e-24, Identity=31%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAEVDEVQERMKTDMKAMKEQMATMMEAMMSMKKIMEVNATTVVAISAVSRRATGVRLQRAACPHLLRATRPRLKRTACPHLQRIARPRLQRATRDCLQRATGARLQRAACPHLLRATRLRLQRATRIHAIAFRGLHALAFKGLHALAFRVLHVLTFRGLHVLTFRGLHVLTFRGVHVLPFRGHQVLAFKGLQVLAFRGLHVLAFRGLPSSPSEGY

SEQ ID NO: 139206 - protein, 52 aa, Glycine max
  Coding DNA Sequence Number=SeqID_22428
  Homolog annotation: Hit_ID=Q10M68; Match level="QueryCoverage=52%, HitCoverage=7%, E-value=2e-07, Identity=82%"; Hit description =Serologically defined breast cancer antigen NY-BR-84, putative, expressed
MYRKTSKCCTELLGNERLRDPYRNMVADLDMMKSIVVHVLVQKRCQCGLTKL

SEQ ID NO: 139207 - protein, 87 aa, Glycine max
  Coding DNA Sequence Number=SeqID_22429
  Subcellular localization annotation: CTP_CleavageSite=43; ConfidenceScore=5.10e-01
MKRKKKKMGAILSSEKKRNSMTAAETTVTTPPASVRLYPSRAVAEAFWGNIKAVTALRRGRWPENDAWGRNGLVEELRKDPNKHGII

SEQ ID NO: 139208 - protein, 132 aa, Glycine max
  Coding DNA Sequence Number=SeqID_22430
  Gene Ontology: Mol. function=2 iron, 2 sulfur cluster binding; Cellular component=mitochondrion; Biological process=electron transport
  Homolog annotation: Hit_ID=Q1RV94; Match level="QueryCoverage=98%, HitCoverage=64%, E-value=3e-48, Identity=74%"; Hit description =Adrenodoxin
MTTNNTTEEGSEQEQMISVTFIDKDGEEKHIKVPVGMSMLEAAHENDIELEGKSFDFRILLLRLKILDLEQYNKLEDPTDEENDMLDLAFGLTETSRLGCQVIAKPELDGIRLAIPAATRNFAVDGYVPKPH

SEQ ID NO: 139209 - protein, 331 aa, Glycine max
  Coding DNA Sequence Number=SeqID_22431
  Homolog annotation: Hit_ID=Q9FMI4; Match level="QueryCoverage=59%, HitCoverage=96%, E-value=7e-22, Identity=40%"; Hit description =Arabidopsis thaliana genomic DNA, chromosome 5, P1 clone:MHJ24
NRGVGFVRSFESNTMSLSLIQGYSSAEEEQDEDQPQPHNSDLEDSDDDDAAAGTITAANHPSLGDRSIFDHVPNPPSASGLPSAFDAFSEIAGPPQFLNNSVEEYKPSRDADEQQGKHANRRRRKNKKDLPTVVEAKPQLVGIHERVRSDINGSQPPTSAALGTSEGGKRVPTATNPNAEDAADLLRMCLQCGIPKTYSNARGMVCPVCGDRPPKDDTSAESKKKGSTVKDKEKSKRMKGQSSHATWKSETEMHLRQQKGRNLHATRRGVQWSSSLLHILLPSVGVWNLGMKAEREVEEGWWETATFVGGGGCVSTEPPEAVEEWSEKEEK

SEQ ID NO: 139210 - protein, 251 aa, Glycine max
  Coding DNA Sequence Number=SeqID_22432
  Gene Ontology: Mol. function=zinc ion binding
  Homolog annotation: Hit_ID=Q9ZU41; Match level="QueryCoverage=73%, HitCoverage=46%, E-value=2e-28, Identity=40%"; Hit description =Predicted by genscan and genefinder
  Pfam annotation: Domain name=DUF789; Domain location=4-244; Score =245.6; E_value=1.1e-70; Accession=PF05623.3; Description=Protein of unknown function (DUF789)
MFHIYLLSQIYTNKSVVASRNRREDSDGVEFESDSWSEDSSSDNLSRSLSNNSSKAWEDAVSEDSSCDQEGSWLRDNKLGCLYLQYTEMASPYSRVPLAEKIDELARSHPALLTLKSVDLSPASWMAVSWYPIYTVPCRNTEKDLEACFLTYHTLSSSFEDCAMECDDIDIGNDPHCSIQGEKCKEKNSGHVSLLPFGLATYKMQGDIWLNPEPYDNEKISYLYSAADSWLKQLNVHHHDFNFFTLHNNTL

SEQ ID NO: 139211 - protein, 585 aa, Glycine max
  Coding DNA Sequence Number=SeqID_22433
  Homolog annotation: Hit_ID=Q9C9R6; Match level="QueryCoverage=23%, HitCoverage=21%, E-value=8e-51, Identity=69%"; Hit description =Putative RNA-binding protein; 42664-44784
  Pfam annotation: Domain name=PUF; Domain location=456-490; Score =35.5; E_value=1.8e-07; Accession=PF00806.9; Description=Pumilio -family RNA binding repeat
  Pfam annotation: Domain name=PUF; Domain location=492-526; Score =43.2; E_value=8.9e-10; Accession=PF00806.9; Description=Pumilio -family RNA binding repeat
  Pfam annotation: Domain name=PUF; Domain location=531-566; Score =23.3; E_value=0.0009; Accession=PF00806.9; Description=Pumilio -family RNA binding repeat
  Pfam module annotation: Pfam domain module=PUF::PUF::PUF; Domain location=456-490::492-526::531-566
MLENVKDDGGLEELEMLLNEIPQATSLNLYHGKSHHHHDVVVVHRGDDDHDRHHDSFVVSHGMCDDFTQIQYPSVSSPVSGFSLQSDGSSSSLFSSSGHALSDTGSPTPPPLEDLKSTTMPSSSHPNNRFITPDSTTLMRNANGGFVDELGGLCANLSQMYISNQQESPCDFKDASMAMHRPRPPPFPECVSFTGNGPSNNVQYHGDSYSFRRGSFDCVGGVQSPLSWTPVNHDAEINSALMAKFFGSRQCAKMSYETMLSQLHDFSSSMDHHRHSRPLLVDNYYRGGSGNQPPECTASLSRNPMVDALLNAQRNGMNVTEETGMSRSPSSSSRGINLRPYLGVQDLLQYSHSLPNYSARAVPLSNARILQGNIDAIAREESFIIQGEGVNYAASIGLDRSMYRSKAVVRDTGFARHLKRSELDVPYQVVGTYDNDRGARIGCSFPLLPKYSSLAEAQGYIYLMSKDQHGCRFLQKMFDEGTPEDVQVIFNEIIDHVVEPMVNPFGNYLMQKLLDVCNEEQRMQILLIITEEPGQLVRISLNTHGTRVVQKLIETLKNRQQISLAVSALEPGFLALIKDLNGNHV

SEQ ID NO: 139212 - protein, 893 aa, Glycine max
  Coding DNA Sequence Number=SeqID_22434
  Homolog annotation: Hit_ID=UPI000060F08D; Match level="QueryCoverage =37%, HitCoverage=52%, E-value=4e-18, Identity=22%"; Hit description =UPI000060F08D related cluster
MVLVFALILLGFLLGVAAVVAAEALGFLWVIKRLQSKISKDQAKIASKTQLGSAQSDRPQQQLLKKEVAFWFPMGVVWVLEPDKVSKFWVEKQSSKELKRKKEVLEVTPVRKYGKINGQSLVLTDADGFHTTIQLKGCLVEAVSATSLPSKKCGENGTHNLSLPPFSFYHQANLINFQGGGGLLPSFVDKCVYMLRAEKAKKFPIKVEAKTSVIYHGSKTFCIYLETACEKEAWCKALRLASSDNKEKHEWFAQLQEEFHSYLTSLNTEYLSLVKPSVGSSAETIEKASKPDGSSSKVRQFLKKLTKKSSRVGVENKSAWTSLSGREERKNTEKLRACQDAVLATGLMKSAAAANHLKSPLLDNSTPSSSTLPHSGSQSQFSVCSDADEKLGTDEGTLCWNLLVSRLFFDVKGNVRMKKSIQERIQRTLANMRTPSYVGEVICTDINMGNVPPCIIRMRVLPMEMSEVCALEFDIEYSGGALLEIETRLEVRELEHERGTEDSNPESSNVGAVPSDLLEGFEYLGEQLNLAEGMNDLLEPKGDDMSKSFKHSTSSSTQGSRWKSMLNSVAKQVSQCGSACMKCVSLHYIVSLQACWHKFILRPVRRCYSKLEEREVPLSLAIRIASLKGTLRLQIKPPPSDQLWFGFTFMPDIDFSLESFVGEHKITNSHIALFLVNRLKAAIRETLVLPNCESICIPWMLAEKDDWVPRSVAPFIWIHPESGNEISTSVDTNNQPCGGLKASARTLSGDGPELKQHKPPKCTKSSQEPARKSDSVALPPISSSSVTLRSSKSSEELTRPLLENDKPQETRDLQELRTTSLQNDNTNEASEEKMGDISVSESPPRNVVMDKQYSSIEQDDSRPRKIGKRERILDLKKRMSEKLEERVGTLLRR

SEQ ID NO: 139213 - protein, 89 aa, Glycine max
  Coding DNA Sequence Number=SeqID_22435
  Gene Ontology: Mol. function=metal ion binding; Biological process =metal ion transport
  Homolog annotation: Hit_ID=Q1SJ50; Match level="QueryCoverage=85%, HitCoverage=52%, E-value=1e-07, Identity=40%"; Hit description=Heavy metal transport/detoxification protein
  Pfam annotation: Domain name=HMA; Domain location=3-62; Score=19.1; E_ value=0.013; Accession=PF00403.16; Description=Heavy-metal-associated domain
VVELKVEMVCIHEKRLRKCLSKLKGIEKVEVDTNCQKVVVTGYTHKNKILKAVRRGGLKADFWSAQNELLNAYVSSNYANFRFNPFNFF

SEQ ID NO: 139214 - protein, 283 aa, Glycine max
  Coding DNA Sequence Number=SeqID_22436
  Gene Ontology: Mol. function=binding; Cellular component =intracellular; Biological process=protein kinase C activation
  Homolog annotation: Hit_ID=Q6K8H8; Match level="QueryCoverage=96%, HitCoverage=54%, E-value=3e-47, Identity=36%"; Hit description =Selenium binding protein-like protein
  Pfam annotation: Domain name=PPR; Domain location=100-134; Score =26.9; E_value=7e-05; Accession=PF01535.11; Description=PPR repeat
  Pfam annotation: Domain name=PPR; Domain location=138-172; Score=9.6; E_value=0.54; Accession=PF01535.11; Description=PPR repeat
  Pfam module annotation: Pfam domain module=PPR::PPR; Domain location =100-134::138-172
MHINDCRNVHSGHTGEALDLFRSMIRTDIRPNGATLATLLSACAALGSLGIGQEIEEYIFLSGLESEQQVQMSLIHMYSKCGSIMKAREVSERVTNKDLTVWTSMINSYAIHGMGNEAISLFHKMTTAEGIMPLPDAIVYTSVLLACSHSGLVEERLKYFKSMQKDFEIAPTVEHCTCLIDLLGRVGQLHLALDAIQGMPPEVQAQAWGPLFDACGIHGNVELGEIATVRLLDSSLGSSESYVLMANLYASLGKWKEAHMRNLIDGKGLVKECGWSQVEVSGS

SEQ ID NO: 139215 - protein, 345 aa, Glycine max
  Coding DNA Sequence Number=SeqID_22437
  Gene Ontology: Mol. function=nucleic acid binding
  Homolog annotation: Hit_ID=O82021; Match level="QueryCoverage=29%, HitCoverage=36%, E-value=5e-51, Identity=96%"; Hit description =Putative arginine/serine-rich splicing factor
  Pfam annotation: Domain name=RRM_1; Domain location=18-89; Score =92.7; E_value=1.1e-24; Accession=PF00076.12; Description=RNA recognition motif. (a.k.a. RRM, R
MSHFGRSGPPDISDTYSLLVLNITFRTTADDLFPLFDKYGKVVDIFIPKDRRTGESRGFAFVRYKYADEAQKAVERLDGRMVDGREITVQFAKYGPNAERIMECLEKEVTKEGLLKHPRDQGDQGAVAQGKGIVMITKIEIIGGEVAAEVMIGMNVTGTVGETKIIVAEAGAVVPVLITRVVVGDAMMMSVIVEAGADQLIAAPLHGAVLVLEGVLPLRGALPLKGVLPLGRVHGVKVLQIVAAMGVLLPLAVSHHAVALMLLEALPLEIQMGIYVHEKFWRRRTIAPVAVLLLLDLLVYVNDLIGVIEGFYDLSAAHVDFVAVDAVSMSLMIGREFDAGCKSML

SEQ ID NO: 139216 - protein, 686 aa, Glycine max
  Coding DNA Sequence Number=SeqID_22438
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=Q6ZDR8; Match level="QueryCoverage=97%, HitCoverage=71%, E-value=0.0, Identity=60%"; Hit description =Putative potential copper-transporting ATPase
  Pfam annotation: Domain name=E1-E2_ATPase; Domain location=160-397; Score=310.0; E_value=4.4e-90; Accession=PF00122.10; Description=E1 -E2 ATPase
  Pfam annotation: Domain name=Hydrolase; Domain location=401-645; Score=112.2; E_value=1.5e-30; Accession=PF00702.16; Description =haloacid dehalogenase-like hydrolase
  Pfam module annotation: Pfam domain module=E1-E2_ATPase::Hydrolase; Domain location=160-397::401-645
MDVAQPQVSSASVNLTTETAIVWPVSEAKNAPNWQKQLGEALAEHLTSCGYNSSLRGRELAVSWALCAVCLVGHFSHFFAAKAPWIHVFHSIGFHLSLSLFTLLGPGRQLILDGLKSLLKRTPNMNTLVGLGALSSFTVSSFAALLPKLGWKAFFEEPIMLIAFVLLGRNLEQRAKIKAASDMTGLLSLLPPKARLLLNNGETEVGSVVEVPSDSLSVGDQIIVLPGDRIPADGVVRSGRSTVDESSFTGEPLPVTKVPGSEVAAGSINLNGTLTMEVQRPGSETAMANIVRLVEEAQSREAPVQRLADKVAGHFTYGVMATSAATFTFWSLYGTHILPPALYQGRAVSLALQLACSVLVVACPCALGLATPTAVLVGTSLGAKRGLLLRGGNILEKFAMVDTVVFDKTGTLTVGRPVVTNIVIPICIKNAISSQTEENALSDVEVLRLAAAVETNSVHPVGKAIVDAAQAANCHNAKQNLQVKDGTFLEEPGSGAVATIYDKKVSVGTLEWITRHGVINSIHQEVEKSNNQSFVYVGVDDTLAGLIYFEDEIREDARDVVDRLSKQNIGVYMLSGDKRNAAEHVASLVGIPKEKVLSEVKPDEKKKFINELQKDNNIVAMVGDGINDAAALASSHVGIALGGGVGAASEVSSIVLMRNQLSQEIYYVKMACEKSFPQYRKVELLS

SEQ ID NO: 139217 - protein, 55 aa, Glycine max
  Coding DNA Sequence Number=SeqID_22439
  Subcellular localization annotation: CTP_CleavageSite=47; ConfidenceScore=5.13e-01
MAEINQGTQGRMQVGLGSRPTDRCPFPALNKQRTSLQGSPVSFAFTVSFTIVCFK

SEQ ID NO: 139218 - protein, 42 aa, Glycine max
  Coding DNA Sequence Number=SeqID_22440
MYRGPRGSFGVEGRSKVGPCDHTSTNAPDPIRTPQLSVLGRE

SEQ ID NO: 139219 - protein, 120 aa, Glycine max
  Coding DNA Sequence Number=SeqID_22441
QGSKKSKVVSQWGLLSWEPDLDIWGKTNSWVKVSVSGRTSILFHKARATMMIWKQHAKLVMATTRWALKHPVHGIVILRLGIYTNRPNVSKLCSVISSMNSSILILVIQENKLLALVPCF

SEQ ID NO: 139220 - protein, 125 aa, Glycine max
  Coding DNA Sequence Number=SeqID_22442
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9CAC1; Match level="QueryCoverage=99%, HitCoverage=26%, E-value=6e-32, Identity=52%"; Hit description =Endoglucanase 8 precursor
VFDFANKYRGSYNNSVGAGACPFYCDISGYMDELIWGAAWLYKASNKPNYRDFVKANIQSMGNLDEFGWDCKHAGINVLVSQWAMADASSRDLFIPNADKFICSLLPSSPTKSVSYSKGVLVYMT

SEQ ID NO: 139221 - protein, 80 aa, Glycine max
  Coding DNA Sequence Number=SeqID_22443
MKFCKEKNRFASGSGENGHSRDGGGCGCNGNNQWQWFGRWGKEVEATVESVMIVEVIGGGNGSPYNGRGGGGGHHDSSKS

SEQ ID NO: 139222 - protein, 173 aa, Glycine max
  Coding DNA Sequence Number=SeqID_22444
MELAWDGAKFGLPNASNGFFITHADVTEIILGDKCLNISVLQLWMMFMNDWSTSIGFSPVYGFLEPQSIRCTKDTCEECQKAHWQLLVLCPRENIIVWFCSVRRKPDVHIKFAVNNAMKKICSNLQGKDNAPPPPPQWIEAKYFSDGTTLDTDTMTTIRKKWAAYFLEVGKWM

SEQ ID NO: 139223 - protein, 125 aa, Glycine max
  Coding DNA Sequence Number=SeqID_22445
MPISPCERVAPTRHSMDPEKSNRALGFPALVTGLYQSYRVPVPPGKGSRPQDTQWTQRSPTGSTECPSPPTRSSGLLLTELSSRSTAPPRKVQGETPQQPGDGRQRAINAPPPPLEFTSAHPQKG

SEQ ID NO: 139224 - protein, 118 aa, Glycine max
  Coding DNA Sequence Number=SeqID_22446
  Gene Ontology: Mol. function=phosphoprotein binding
  Homolog annotation: Hit_ID=Q1T2L0; Match level="QueryCoverage=98%, HitCoverage=21%, E-value=2e-21, Identity=51%"; Hit description =Serine/threonine dehydratase, pyridoxal-phosphate-binding site; t- snare
  Subcellular localization annotation: CTP_CleavageSite=35; ConfidenceScore=5.39e-01
VGASEVPQKKSPATPRTARQLKTPNSDAYSVSSPNAAKKTPKDRSPKKKRPSKVQELESQIARLQEDLKNAKDQLNSSESWKRKAQQEAEEAKKQLVDLTKELQESHQQLLDFSASEE

SEQ ID NO: 139225 - protein, 86 aa, Glycine max
  Coding DNA Sequence Number=SeqID_22447
GVVLAEVLLADSRFTRPDMGFHPTKLNFVPSDADEAPLDVSICLHAFGIVGCGSFSGVKSCEREDPFHPGLFVGDAGRFQVPHVNH

SEQ ID NO: 139226 - protein, 446 aa, Glycine max
  Coding DNA Sequence Number=SeqID_22448
  Gene Ontology: Mol. function=protein transporter activity; Cellular component=membrane; Biological process=protein secretion
  Homolog annotation: Hit_ID=Q1H0S7; Match level="QueryCoverage=65%, HitCoverage=70%, E-value=3e-99, Identity=60%"; Hit description=Type II and III secretion system protein
  Pfam annotation: Domain name=Secretin; Domain location=17-259; Score =194.5; E_value=2.6e-55; Accession=PF00263.11; Description=Bacterial type II and III secretion system protein
VAISGEAESLEAHALARQAIDTESQPEKHAACRIFFGKNSSNTTLAIGSPANLSGVQSQDGGFILNSASGFLPNASAFNFVAGNASRGLLSTLSILEANGFAYTLAEPSLTAFSGQSASFLAGGEFPIPIQSGAGGLGAVTIRYKEYGVRLMLTPTVLDANRIFLKVSPEVSEVDFTNAVQSGGVAVPGLRVRRTDTSVSLGNGESFVISGLVSRNTLQNVDKFPGLGNLPIIGAFFRSTRFDLEDKELLMIVTPHLVRPIAKDAAQPELPGGNLREYRPSFSDLFFQKGTKPDSGIPVTGEIIPADSPTVERIVQLADAIGASAIFVQLNPAEYRQETLLIEGIISAKPFLPVIVVADSFDQNLLLTVIRLGARDFIKIGTRASEVVAEVKRLTPRDAARHSTETDQRGKITAVISARPGSDSPMLALHLALAVQETEPTLLLDL

SEQ ID NO: 139227 - protein, 46 aa, Glycine max
  Coding DNA Sequence Number=SeqID_22449
MEEAAYYYLIYDYRLFEGLKKNLETDRGRIEFFLPSIGCLQPTMCL

SEQ ID NO: 139228 - protein, 61 aa, Glycine max
  Coding DNA Sequence Number=SeqID_22450
NSDDAPEYYQPISSLDLSNVTEKSKEDENRRNVPLTTENAMRVMEAMRGVSFAGVVPDWAG

SEQ ID NO: 139229 - protein, 468 aa, Glycine max
  Coding DNA Sequence Number=SeqID_22451
  Gene Ontology: Mol. function=[acyl-carrier-protein] S-malonyltransfera se activity; Cellular component=fatty acid synthase complex; Biological process=fatty acid biosynthetic process
  Homolog annotation: Hit_ID=Q2VA66; Match level="QueryCoverage=53%, HitCoverage=72%, E-value=1e-118, Identity=88%"; Hit description =Malonyltransferase
  Pfam annotation: Domain name=Acyl_transf_1; Domain location=179-468; Score=-97.8; E_value=5.8e-05; Accession=PF00698.11; Description=Acyl transferase domain
MVPTTHRHNNPHGGTMHEKKHGQRNDLDSFTRINIRPAMIWINNNTPEGHPEQQSFVVAIFLGALVMGFLTDMFGIAIANGPVFLGLVIPDGPRVGATIVQKTETIMADILLPFSFIMVGSYTDFYAMSASGWSSLEPLIVMVITGYVLKFFSTWIVLHFWRMPLREGLTLSLTLSLRGHIELILFVHWMDKNILHIPDFTLLVLMTTILQMQCLPSDSLLLQPAIYVTSLAAVELLRARDGGQQIIDSVDVTCGLSLGEYTALAFAGAFSFEDGLKLVKLRGEAMQDAADAAKSAMVSVIGLDSEKVQQLCDAANQEVPEAEKVQIANYLCPGNYAVSGGLKGVEVLESKAKSFKARMTVRLAVAGAFHTSFMKPAVSRLEAALATTEIRTPRIPVISNVNAQPHTDPDSIKKILACQVTSPVQWETTVQTLLTKGLKKSYELGPGKVIAGIIKRTDKGADIENIGA

SEQ ID NO: 139230 - protein, 62 aa, Glycine max
  Coding DNA Sequence Number=SeqID_22452
  Gene Ontology: Mol. function=ATPase activity, coupled to transmembrane movement of ions, phosphorylative mechanism; Cellular component=integral to membrane; Biological process=proton transport
  Homolog annotation: Hit_ID=Q9SU58; Match level="QueryCoverage=92%, HitCoverage=6%, E-value=5e-20, Identity=79%"; Hit description=ATPase 4, plasma membrane-type
  Pfam annotation: Domain name=Cation_ATPase_N; Domain location=10-62; Score=5.8; E_value=0.00096; Accession=PF00690.16; Description=Cation transporterATPase, N-terminus
MGDKSQVLEAVLKEAVDLENIPIEEVFENLRCSKEGLSSEAAEERLVIFGHNKLEEKKRASS

SEQ ID NO: 139231 - protein, 153 aa, Glycine max
  Coding DNA Sequence Number=SeqID_22453
LQVVPSVVRLMKQANVFPLKKTLKKFTIWEINRDKDILKEDFQASNKVLITNKPIPQGPNIFQRMTKLEETLTQFMQIADKSSNSFRANTEKNPKEECKAVMTRSKWFVEAEDEDSVVSKKKAVEKKGNDEKKDDVRGESNQEKEKQIMVKKK

SEQ ID NO: 139232 - protein, 80 aa, Glycine max
  Coding DNA Sequence Number=SeqID_22454
MGRGAGTDEERSLYFRGNTRFNKNRRKSLKVYQSHTGQGLTFSPWVKVYDKLGFWLKACRTAGHDICQGMPHIISMILMQ

SEQ ID NO: 139233 - protein, 229 aa, Glycine max
  Coding DNA Sequence Number=SeqID_22455
  Gene Ontology: Mol. function=aspartyl esterase activity; Cellular component=cell wall; Biological process=cell wall modification
  Homolog annotation: Hit_ID=Q42920; Match level="QueryCoverage=100%, HitCoverage=51%, E-value=3e-99, Identity=74%"; Hit description =Pectinesterase precursor
  Pfam annotation: Domain name=Pectinesterase; Domain location=1-229; Score=385.9; E_value=6.3e-113; Accession=PF01095.10; Description =Pectinesterase
MTHVTIIGEGATKTKFTGSLNFVDGSTTLESATFAVNGANFMAKDIGFENTAGSSKQQAVALLVTADQAVFYNCQMDGFQDTLFAQSQRQFYRDCTISGTIDFIFGDAFAVFQNCQLIVRNPLKGARCMVTAGGRVKANSASALVFQSCHFTGEPELASAEPKLAFLGRPWMPYSKVVIMDSQIENIFLPEGYEAWTANANKDTCTYYEYNNKGPGADTSKRVKWQGVK

SEQ ID NO: 139234 - protein, 335 aa, Glycine max
  Coding DNA Sequence Number=SeqID_22456
  Gene Ontology: Mol. function=RNA-directed DNA polymerase activity; Biological process=RNA-dependent DNA replication
MDIVEQENQSLREEVATLREGMDRLTTMMSALLSAQNSQAAAAAVEQPLVVHGECHLQSVESSQPAVSEAPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLAVESTPAA

SEQ ID NO: 139235 - protein, 403 aa, Glycine max
  Coding DNA Sequence Number=SeqID_22457
  Gene Ontology: Mol. function=RNA-directed DNA polymerase activity; Biological process=RNA-dependent DNA replication
  Homolog annotation: Hit_ID=Q1S982; Match level="QueryCoverage=39%, HitCoverage=36%, E-value=4e-14, Identity=30%"; Hit description =ValRS/IleRS editing
MKTNQYIKDIGNFVQREQESLPEAWERLQEIIRSCPHHGFSQQRLVHIFNGGVSSHNRTILDATCGGNLMLNPLIDAIKIIKDMRSNPYNNLGDMGIMKNGINQVEKDDSQTELGKHMQALTLKIKTLMKAQAQAPIITPLFLTCDRCRIVHRPGECTIDDKLATTMDEINFVKEGIVLIINTPTISIMDRASENSNEKEGYFPKTADGIFIEKDEAPKNVDVPNDGNPVPKKEGDENKDILTSPQSVDIDALMEGEFLSMEMPNLLERVLTNKDLDWELNSKVEEILTFLHSQHSLGSPSCERLEWDNVLKLKPAVEEPPKLELKPFPSNFKYIFINPSSFLLVMIVGLDPTLCTHKLNTKQGSLPKWSSQRKLFPNMMEVVKGEDAKPTFKMKTYHEGFQQ

SEQ ID NO: 139236 - protein, 124 aa, Glycine max
  Coding DNA Sequence Number=SeqID_22458
MVVVKSTMVMVESDIEALGYCGLTMTFVVDCDPRELTTTVVGLLTLFYKARLERFEAGLKNLQKSIFLVVYLKLSVRKLRLGVRTFKCTLDGLFVKLDVGRTNARCGNANVALVRLIHKHKTSN

SEQ ID NO: 139237 - protein, 163 aa, Glycine max
  Coding DNA Sequence Number=SeqID_22459
MTQGYIYLGLTENKRGYISCGSVLVEGTSTRLFKENKGEYIPCGSLLIKGFLQETWEEALKSKLTTIESSAKVLQGEIEHLKKESSLFKVNAKKPKEKLKTDLNKVEAEILKTHEVGFFKTTRQAKYFLQEVNLSLSNIDKDVNREGELVPEAEVDCTIEEPI

SEQ ID NO: 139238 - protein, 63 aa, Glycine max
  Coding DNA Sequence Number=SeqID_22460
MHPRAPRRPPAEGISHGKVGREAPSVVALLAANGNDEKKPSRSKVDTSDQGKSAVVEAHSKAA

SEQ ID NO: 139239 - protein, 128 aa, Glycine max
  Coding DNA Sequence Number=SeqID_22461
MELTDSSLVLATGVKGYLTYVTLGYKSLLELRRSLGDVDPLNLIKDKDATLQKGQEHADVLTREVDGELRQTYPRAPGTINEDFVAKEVDDPETPDAKMADGFIKTKKINVDDRATGDFDVDVDLGGS

SEQ ID NO: 139240 - protein, 69 aa, Glycine max
  Coding DNA Sequence Number=SeqID_22462
IAPARYPVDPEKSNRVLGFPALITSLYQFYGVPVPPSKVIKPPTNRAFIKEYCTPRQAQGETLQQPGDG

SEQ ID NO: 139241 - protein, 79 aa, Glycine max
  Coding DNA Sequence Number=SeqID_22463
MEWFFRISHPFMIRTQAGDQPRDAPAADPEEYIQSPSPQVPVAFDPPRHVVDDYDGYEVIAQRLERMLNLRMVTAGTEL

SEQ ID NO: 139242 - protein, 242 aa, Glycine max
  Coding DNA Sequence Number=SeqID_22464
  Gene Ontology: Mol. function=transcription factor activity; Cellular component=intracellular; Biological process=regulation of transcription, DNA-dependent
  Homolog annotation: Hit_ID=Q4ZQL0; Match level="QueryCoverage=90%, HitCoverage=91%, E-value=9e-44, Identity=45%"; Hit description =Regulatory protein, GntR:Bacterial regulatory protein, GntR
  Pfam annotation: Domain name=FCD; Domain location=88-211; Score=40.1; E_value=7.7e-09; Accession=PF07729.2; Description=FCD domain
  Pfam annotation: Domain name=GntR; Domain location=16-78; Score=65.6; E_value=1.6e-16; Accession=PF00392.11; Description=Bacterial regulatory proteins, gntR f
  Pfam annotation: Domain name=HTH_11; Domain location=26-77; Score =1.9; E_value=0.057; Accession=PF08279.2; Description=HTH domain
  Pfam annotation: Domain name=TrmB; Domain location=7-82; Score=-13.3; E_value=0.084; Accession=PF01978.9; Description=Sugar-specific transcriptional regulat
  Pfam module annotation: Pfam domain module=FCD::GntR::HTH_11::TrmB; Domain location=88-211::16-78::26-77::7-82
MNNVNGLQTAPDLHDKDESIFQALMTAIVEHQLLPGSKLPEEALAEVFGVSRTGIRKVLQRLAAVQMVTLTPKRGAHVASPTVEEARHIFRTRALLEVANLPDVLAHCQPPHLAALEAIIRQEQQAHEAYDGPAAIRHSANFHIQLQAISGNQVLTEMVTGLSQRSSLVIATWGAPWRQGCRCNDHEQLVDLLRQKALQPLSEALMHHFEHIVASLCFERAGECLPDFARLFARPQGVVMSS

SEQ ID NO: 139243 - protein, 147 aa, Glycine max
  Coding DNA Sequence Number=SeqID_22465
  Gene Ontology: Mol. function=nucleobase transporter activity; Cellular component=membrane; Biological process=nucleobase, nucleoside, nucleotide and nucleic acid transport
  Homolog annotation: Hit_ID=Q74S68; Match level="QueryCoverage=99%, HitCoverage=28%, E-value=1e-51, Identity=69%"; Hit description =Putative permease
MPNSQNAQQGTAADSGAVYSPRLCNEDLAPTRDQNWSWYNIFSFWMSDVHSMGGYVVAASFFTLGLASWQVLLCLLVGICIVQLCANLVAKPSQMAGVPYAVISRQAFGVFGANIPAVIRGLIAFAWYGIQTYLAANALMLVALKFW

SEQ ID NO: 139244 - protein, 569 aa, Glycine max
  Coding DNA Sequence Number=SeqID_22466
  Homolog annotation: Hit_ID=Q66AC0; Match level="QueryCoverage=75%, HitCoverage=97%, E-value=5e-42, Identity=52%"; Hit description =Putative virulence factor
MASQNAPGIATLQAHGYRPPVSALTGWTGLIALLLSPFGGFSVCIAAITAAICMGDDVDPDPARRWRLAAGADRYAGRSGTAGHAGGQPAARAGGTRAARQRHRGISDHRQRHLPARRRLGVLGPDRGRPHPFAAQPAPERGNLDALLALGENGQPVWASALQIRETLRLRRQTTLANCLAIPQANERGDRLDWYAPFSGKVKSWLAASDREKRQALDQLTLNQQDLQALSLRARDADNPAMRLFGALLAKTLQFPDQQYVYLVDGKPVITFWGFVDPQARTRDDALACLRDSLDEELPPLVVPAPEPERAAAPEPVEAPVVAEPEPELLAEPEPQPEPAPLSVVADAPARKKSALRPLLLVLPLAAAAAAGVAFWLHNAPVQPAETETAPVVSAAPALAPAMLAKAQTLAATMPHSSATVTPAPAPAAPPAPPEVVAEHTEPAKADDLVMTADDARLGSVKFINGTWRVTLRQTNLPTGKPPSLRYQIRNGKGSAVITQGDNIRCKADVTAAMTSAGTMVVRSRYTASCSDKSRYRMPELVCKAGDGIASCTAQYGADQVFPLTIKRE

SEQ ID NO: 139245 - protein, 220 aa, Glycine max
  Coding DNA Sequence Number=SeqID_22467
  Gene Ontology: Mol. function=sequence-specific DNA binding; Biological process=regulation of transcription, DNA-dependent
  Homolog annotation: Hit_ID=Q6CYN5; Match level="QueryCoverage=59%, HitCoverage=74%, E-value=3e-34, Identity=56%"; Hit description =Putative DNA-binding protein
  Pfam annotation: Domain name=HTH_3; Domain location=28-82; Score =66.1; E_value=1.1e-16; Accession=PF01381.12; Description=Helix-turn -helix
MARTSGTLRARFSGEFMENLHQHLSQALKQLRQANGWSLTLAAARTGVSKAMLGQIERGESSPTIATLWKIATGFNVPFSFFVQSGAQPSGDVATFSQPNAQMQVKPLLPYDARLRFDLLEVTLAAGAQSDSSAHESGVIEQVVVLEGFRAGVSGARRRNDSDRAGRARRGAQPVDECYGRQPADAGPGTGRGRCAGWPQNPLSAYRCLPAAHRQQSRPA

SEQ ID NO: 139246 - protein, 320 aa, Glycine max
  Coding DNA Sequence Number=SeqID_22468
  Gene Ontology: Mol. function=isochorismatase activity; Biological process=metabolic process
  Homolog annotation: Hit_ID=Q397H5; Match level="QueryCoverage=93%, HitCoverage=83%, E-value=3e-41, Identity=68%"; Hit description =Isochorismatase hydrolase
ENIENRAGSTSPGGKRSVQQREDFLSGAGFAEAREAALNAVVVGFSVQAAHCLSRQRDATLLLQLLMQLLMQVVIVVVNACTRGRESECGKTAFKEYSKFASGTFAGMTGGTLGASAGIGICFAVGIATAGAGGVACAAVGSLVAGSAASSATQHPVAPDSLQGAAKIRAGSASPGGKRSVQQREDFVSGAGFAEAREDALNAVVVGFSVQAAHRIGRQRNVVAQLVRLTRRGFHADTGGNPAHHHLRHATLLQLLVQIGIVERAPAPPSLPAEQHRDAAADCGPARRPPRSPAPPAAVSRETPASAAWRVQSLHPDGAA

SEQ ID NO: 139247 - protein, 308 aa, Glycine max
  Coding DNA Sequence Number=SeqID_22469
  Homolog annotation: Hit_ID=UPI00005F7F94; Match level="QueryCoverage =58%, HitCoverage=19%, E-value=2e-53, Identity=59%"; Hit description =COG4457: Uncharacterized protein conserved in bacteria, putative virulence factor
MAETGGDGKIEIAGIDVLKIVQGFVAETGDQLALRVADHFTQQPGFTRLRLTKQRQGDRSRQLSRQRVALNAGATQLEPQRIGFQRQTRRVRLVALHPVQRAVNRLLQQAQAFSRCRRRGFFGSSHRLHTLPLSIQYCALALPLLQRHARAIVHACLAQYQPLRAEVIRPRLYRQPDAQHAFARYLARQLRIGNAQAVERCRRPAVVLQLAETEADVTANAEAAFTVQREAVAVEINLAIAQIVIAQRGVFIQHAKIANGRVGFKIAGAEPEAAETQIECQQTQHGTDRRGGFRVINASLFVERIPVA

SEQ ID NO: 139248 - protein, 455 aa, Glycine max
  Coding DNA Sequence Number=SeqID_22470
  Homolog annotation: Hit_ID=UPI00005F7BF9; Match level="QueryCoverage =91%, HitCoverage=53%, E-value=1e-95, Identity=44%"; Hit description =COG4458: Uncharacterized protein conserved in bacteria, putative virulence factor
MLELPAPGTPADRDQQDERARLQARDALRASLLEQKRALLPGFYAARQGIDLMLICTAASQRQDADLAASALREWQLQQSATASADKPRLIWAITPHDARYQQSQINVDEAVQRQIGQPGQSWGSMLARDRAGVDRMSSWLQDEMQPEARRDRLALQLSTLQQKLVERLQPWTEASATPEQAARKQAIADTLLKCLQHRTGLHGELLERLQPSREAVRQLWLSQSHGSTPSTGGQPAAVEQSYFGIGFEFDLFNDEPVTTAEPRSSSGQRDQQFPQQVFALWLAHLRQLPESQSLLALLNVDKPTLELLVEELITASFRLQVLSKLQSALNETETQASAHEARTDRQVSRAMTVLGDFVAWLGFLQRDERERPQSRVNRGSPIFARPPAPSVSFSSGQRLTRLSAAPANHTAYYIYDWLVGLNSLIVENNGYTGGGDLSASARQTLAIMLLPLHA

SEQ ID NO: 139249 - protein, 276 aa, Glycine max
  Coding DNA Sequence Number=SeqID_22471
  Homolog annotation: Hit_ID=Q47522; Match level="QueryCoverage=13%, HitCoverage=45%, E-value=7e-14, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSSYAVKELIAHLLNVIAVIKCHCNNPAPGLQVHIWIFNVNCARQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139250 - protein, 205 aa, Glycine max
  Coding DNA Sequence Number=SeqID_22472
MGKVEEVQEQMKADMEAMKEQMATMMEAMMSMKKIMEANVVAVAATNVVAKVNLMPPSGLNQMNHPTSDMVGKDLGSTSGPHYAQIQNNHSFPPYGLPPNYTPPNVAYIPNDDVNNSAPMLIKSRQPHHPCLGYATEGKTVGDIPLQSTLEGPQYHPQPHPSHSTVIKNPHAMAEIGKLDHLKERLRAIEGGEDYAFVNLEELFL

SEQ ID NO: 139251 - protein, 283 aa, Glycine max
  Coding DNA Sequence Number=SeqID_22473
  Homolog annotation: Hit_ID=O04892; Match level="QueryCoverage=15%, HitCoverage=8%, E-value=1e-08, Identity=64%"; Hit description =Cytochrome P450 like_TBP
GELCLSGAKPEETLVEARSDTDVQIVRLTWVGRCGCSVEPRHGIESSKWAIFGKQNWRCGMNRKLGYGAQLRANLDPTKGVGRLRQQDGGHGSRNPLRSGAAVAANSGASSGERRRCRSGGSSKYSNENFEGRRGERFHGIGLKFLNRDVAADGNVRESGDVGGGPGKSYLFLFNSLPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQN

SEQ ID NO: 139252 - protein, 214 aa, Glycine max
  Coding DNA Sequence Number=SeqID_22474
MGSTLLSLSLNNSGQSLNQMGMLRIKLEEAKKENEILKAMLNQVNEHCTTLQNRILFEMQQHQLSASSSSPRNNNNHHDSQGNEQDAEKPMLHTRQFLNIGESSILDGNTKACAIAENVEKKILGKNLASDINKYNVKGEINSQITLNEVKSTEDQASEVTCRRARVSIRARSDFSLVLKAFVYLLNQILHEVEGCKLVFLNYNFYYFIYLIID

SEQ ID NO: 139253 - protein, 183 aa, Glycine max
  Coding DNA Sequence Number=SeqID_22475
  Gene Ontology: Mol. function=transferase activity; Cellular component= mitochondrial inner membrane; Biological process=metabolic process
  Homolog annotation: Hit_ID=Q0XSA8; Match level="QueryCoverage=95%, HitCoverage=59%, E-value=4e-58, Identity=62%"; Hit description =NAD(+) kinase
KAAADLDAQLHHAGGAAAVDHHVVHGQGLEHAFALADHAGAHQGTQVLFVLALQHGRERGLEVLQRDVGDKAQAALVHPDQGRSVLRQVPAHAEHGAVAADDQAQVAMPAQAIDIEGGVVCEPCVQGRLGIEHDFAALAPEEVRNALERVAGILGRGACAGSVVLPDQGNVAKRGRHFWKLHH

SEQ ID NO: 139254 - protein, 66 aa, Glycine max
  Coding DNA Sequence Number=SeqID_22476
MWIWHGEVIDIQNGSQAESFDVEMGDRLEDMIHDLEQESFQQAHTPVYEGLQSDSKKPLYRGARIP

SEQ ID NO: 139255 - protein, 156 aa, Glycine max
  Coding DNA Sequence Number=SeqID_22477
MQLPQEPLNEKPRGLARKSMAETNSVELCWAATELAACSRSKRSLSKHLCETETNMLAIVRKYQEELNLATTHEHKVAGEYARVYAEKEARGRVIDSLHQEATIWMDRFALTLNGSQELPRLLAMAKAMADTYSTPEEIHGLLSYCDAILPRKGVG

SEQ ID NO: 139256 - protein, 117 aa, Glycine max
  Coding DNA Sequence Number=SeqID_22478
  Gene Ontology: Mol. function=hydrolase activity, acting on glycosyl bonds; Biological process=carbohydrate metabolic process
  Homolog annotation: Hit_ID=Q84K13; Match level="QueryCoverage=62%, HitCoverage=15%, E-value=4e-22, Identity=66%"; Hit description =Putative polygalacturonase
MVKKKREIACEIETAGEPSFGGDIKLGPTAVLKALHVPNRPPKRFGLGCFPVSDATEILDRQDDPPRQNITEEADAGWCSCLKGRKLKPGGGGGRWRFEPHGNMTIEKKKKMEEREC

SEQ ID NO: 139257 - protein, 79 aa, Glycine max
  Coding DNA Sequence Number=SeqID_22479
MGMKKKKVWSGKEKMKAWLLCAREGLDGRSGVQHESLMPEIETTQPRIMVWYHPLECYIMGNIRKLDQMILLCSVPGIG

SEQ ID NO: 139258 - protein, 103 aa, Glycine max
  Coding DNA Sequence Number=SeqID_22480
  Pfam annotation: Domain name=G-patch; Domain location=2-43; Score =24.8; E_value=0.00019; Accession=PF01585.13; Description=G-patch domain
MVVARVMLGNGYEPGMGLGKNHGGRTSLVSARGNHVKFGLGYKPTQADIRKSVAGRKSRSQGSQLGRQVKGGPPCHISRSFISAGLGHECPATSVGAVYYMRG

SEQ ID NO: 139259 - protein, 77 aa, Glycine max
  Coding DNA Sequence Number=SeqID_22481
  Subcellular localization annotation: CTP_CleavageSite=39; ConfidenceScore=5.10e-01
MGVWQPNAHLPLRKAHTEPMDPKSTLRLMRTLGPSLASLAESSWSLLSSALGGRIASDRSQDWPTRSLLTIRSSPSS

SEQ ID NO: 139260 - protein, 218 aa, Glycine max
  Coding DNA Sequence Number=SeqID_22482
MKRKRSKYEAHAFFINKLKENFDRSWAKKKVVCKYIDFLKIKENVNEPVYPRLVKAFFGATEVDINNFILKAKLKGIGILILEHLLAGLLGVLTDSSRLYDDWLKIMGLRKKKIQKKFLEDKDEEFKLKNSSLALRLNPQLRMETAYTCSKKKKPQLQRTMNEFFERFLRLEGWISNKIRPTLIPEFEPIQHEPPLPLRATTTSSSSSSSENSPNKHE

SEQ ID NO: 139261 - protein, 112 aa, Glycine max
  Coding DNA Sequence Number=SeqID_22483
MAPELWKDIDGLPNEGMIANEKGLKDVGGNMKIKWVNVVMDNMLKTKRIGTFKCSYVVLISRILDHFKVEVKTKIKDLVEPEYELKTKVLKHMGYVEGEDGSDWIEKSKESI

SEQ ID NO: 139262 - protein, 666 aa, Glycine max
  Coding DNA Sequence Number=SeqID_22484
  Homolog annotation: Hit_ID=Q6Z0F1; Match level="QueryCoverage=19%, HitCoverage=31%, E-value=3e-07, Identity=27%"; Hit description =Enhancer of polycomb-like protein
MPAAGMRRTTRVFGMKGAETARVLRSGRRLWPDSGEVKTKRSHDGDEWPLPPLKAAKFDAAATPRKGKRSEEAAVVDRRFGKGLVYQRRKKGLKREVSRRNVEVWRCVLSVAVNRCAGNSGRFLRLLASVARYVARVRVSPRKLSGFFMSEAIHGAFASKGMLFVKGPPAVNTGIGQFFGVTGSVPSFSVDFSAVPPCFEYLQSAMFLKFMFRSFFLVHNPINVHRDEDTESDDDLLENQNEQQISSDTFKRKPSDIVTVTSDVVEINDVLSLHSSVKVTTRAAGRNGQYRNMLNSRGIQKRRSSLRKRKARSPSMVSIRRNGAVASDLTGGRKNNSQLPVVTSSRKLRSMANDSTKGNLKEARSAIVDSKDRLGSSSCFANLLVSEIDQCCRAEGAIVTLETSSPKEWLFTVKKGGLTRCTFRAEKVMRPFSTNRFTHAVMYSLDNGWKLEFTNRQDWNVFKDLYKKCFDRNTPATAAKVIPVPGVREVSSYAESNSFPYHRPVTYISAFGDELTRAMTRETANYDMDSEDEKWLKKFNEFQEHVSEDNFELIIDAMEKVYYYNPDETFDEKSAANGCQDLGSKEVVEAVYNYWMRKRKQKRSFLLRVFQGHQSKRAPLIPKPLLRKRRSFKRQPSQFSRGNQPSVLKVNSARVQLLWMFRITKL

SEQ ID NO: 139263 - protein, 348 aa, Glycine max
  Coding DNA Sequence Number=SeqID_22485
  Gene Ontology: Mol. function=nucleotide binding
  Homolog annotation: Hit_ID=P76116; Match level="QueryCoverage=60%, HitCoverage=56%, E-value=5e-13, Identity=28%"; Hit description =Hypothetical protein yncE precursor
MAEITPNHPDYGLNQQIRQGVAALDAQHGRAFDQTSERLTSSLAVLAREQGLQQVDHVLVCNATANQPAGHNIFVVQGDPANPAHLRAMMPTALAAQTPVEQSMQKLGLGVPQPVEAQAQEMQNPAPRLGSPPSGTVTVVRGHRTGFAVGHVQALARCIQQDAQRAGVGRDAGQFLAGVAVHHQHALARMLADQPAALGLVATQEFRALVGHEQALAGRVQRDVLGCSAAILCCATTLFESVAGVDALVGRIQRQARRLGIAQAVDGVDHLQRGGIDHEQHAAHVRLAAVAGHVQAVGRAVDHQLAQVVGVGGLAVLAGLLLHQLDGADGLVLRGVDHGHRQVHGVAH

SEQ ID NO: 139264 - protein, 46 aa, Glycine max
  Coding DNA Sequence Number=SeqID_22486
MVVADHPLGQPAPVHVMPDLDEARLDSPVLDALCITLMEAVIADLQ

SEQ ID NO: 139265 - protein, 240 aa, Glycine max
  Coding DNA Sequence Number=SeqID_22487
  Homolog annotation: Hit_ID=Q1SKD7; Match level="QueryCoverage=60%, HitCoverage=41%, E-value=5e-13, Identity=29%"; Hit description =Ankyrin
MAPGKLASKRSRKDKAVEEDKAAEGTSSAPEYDSHHFRSAEHQQRFKTIKGWSLLWEIRVQLRDDEYTNFQEEIVRRQWASLVTPMAKFDPDIVLEFYANAWPIEEGVNFDADALSQFLGYPLVLEEGQECEYGQRRNRANGFDEEAIAQLLCIPGQDFAWTTAGRRVRIMRTNMTTLTQTWMTLLLSNILPSDHNSNLPLPKCMPPTRHPLDPDKSNRALGFPALIIGLCQLFGVPVAP

SEQ ID NO: 139266 - protein, 124 aa, Glycine max
  Coding DNA Sequence Number=SeqID_22488
MFDLYFVPSLECQTCRRPKVMSRQHIWTLEITQSILGTPGPLRLPNCAMTHVNACGQHMTILRRFGPPLQWNVVVVDGGVRCRYVVQPWYQFLADNDFSHGDEVSFYYRTIDKIWEIVIRRRKN

SEQ ID NO: 139267 - protein, 85 aa, Glycine max
  Coding DNA Sequence Number=SeqID_22489
MDLQRLNRHEDNDKKKRGISLKASSSIQEESDIEDSIDLDEDEDLSLFVKRFNKFIRMRGKVKRRQNFKPKRRTKESFQIPKCFE

SEQ ID NO: 139268 - protein, 50 aa, Glycine max
  Coding DNA Sequence Number=SeqID_22490
MHEGMHMTQMQSRNAGARGIVSFLDTTSREGIKTEPMCDAYAKDAMRECT

SEQ ID NO: 139269 - protein, 148 aa, Glycine max
  Coding DNA Sequence Number=SeqID_22491
MNEVLSELWGLRTYVGERFDSLDGRFEGMDTRITQLEEDMTYLHRYIGLYECSCIVYHGLNCHHQKGGDCRSKDFDFDVLMMPYDHENALLKFNSRQKSKNTRYNIKKISSDLGREFQIETTKGLAKKFKLKCLFQEIYSLVIDYQRM

SEQ ID NO: 139270 - protein, 111 aa, Glycine max
  Coding DNA Sequence Number=SeqID_22492
LTNLTGGSIDVTIVKEFYANLYVPDDKFPKQVRVRGNLIKFDVDSLNTFLETPVVVEQGESLPFYSRFAKLRPDPQELAARLCIPGRGFVLNVEGLPWKLLRKYLTTLAQT

SEQ ID NO: 139271 - protein, 60 aa, Glycine max
  Coding DNA Sequence Number=SeqID_22493
MDLRTKLELIQSNWGSRFSNLGHNIEHKSMIDRCAFRRSTADDLIPIDLEINVTCRRRNS

SEQ ID NO: 139272 - protein, 213 aa, Glycine max
  Coding DNA Sequence Number=SeqID_22494
MPTDTREIEAALCIPNRGFILNAEGHPGKILRKDLIILAQVWSVLSYSNLAPTSHTSDLTMDRARTRGVAFDSLVFERLSPIINLAYIRKNCWNPDDPTIIIKGTRRPRASPAETPSTSMAPHLASTSAAPPPTPWPGTQPPPHRDDEDPAAQVPHQSSDESSESSTPEPLIRKRRIVVTQEAATTPEKSPEATPEPLTPMADTTSPQLAADP

SEQ ID NO: 139273 - protein, 94 aa, Glycine max
  Coding DNA Sequence Number=SeqID_22495
MAIVVSAFCWTRSSLGDETQNDHNLSLRTTEHDRLWMAKRAQNSSMRVYPLSLLLLNDKGRRIRLCTFITQFAKSEWQRAQNSSIRVYHSTRCS

SEQ ID NO: 139274 - protein, 119 aa, Glycine max
  Coding DNA Sequence Number=SeqID_22496
MKCYDHLNFARVSVVQFRVSRYIVGLNRTPESNVNGHLILPRAFLFKFQACQYDEDMTKRKGKDPLEGLGGPMTRDRARKAKEALQQVLSILFEYKPKFQGEKSKVVSCIMAQKWRRTK

SEQ ID NO: 139275 - protein, 338 aa, Glycine max
  Coding DNA Sequence Number=SeqID_22497
  Gene Ontology: Mol. function=phenylalanine-tRNA ligase activity; Cellular component=cytoplasm; Biological process=phenylalanyl-tRNA aminoacylation
  Homolog annotation: Hit_ID=Q8PJE5; Match level="QueryCoverage=54%, HitCoverage=23%, E-value=2e-65, Identity=68%"; Hit description =Phenylalanyl-tRNA synthetase beta chain
MALVVAAVASALGRLKAGKLGFPVAQDVRLDVAQLADFTDGEVALGRDRRISFHPLLELLARTEGDHRTGGNRNFLAGLGVATRALVLAPQIEITEARQLHLTSLFQCFTQHIEKRVDEFLGFPLVQTDFVEQLFRHLRLGQCHCLLPPSAARSAADPGVVFTLDGSDRLGHHRIHVAVRQSARLVLQNQAHSETLESRLDALADIAVEQVQVAQQRAGGLADGRRQIGPGHLFRHQERQVAAHGREARQLARTRQAAGGQRFQIQFEGVDVGFDVHRLDQARMDLTDPADRHAIAEHLGRARRVAVRTGRRAELQLRATGSGQRFQVALHIVEVDLA

SEQ ID NO: 139276 - protein, 75 aa, Glycine max
  Coding DNA Sequence Number=SeqID_22498
  Gene Ontology: Mol. function=oxidoreductase activity; Biological process=electron transport
  Homolog annotation: Hit_ID=Q7NSC5; Match level="QueryCoverage=81%, HitCoverage=16%, E-value=2e-23, Identity=81%"; Hit description =Flavoprotein NADH-dependent oxidoreductase
MRLRGRWGQEGLLRQKRIVGIAFGAAAVEGFRLRFVQRSVLTETLYQIRVGDVAAAEGHRVDEAFFDQRFGFLGG

SEQ ID NO: 139277 - protein, 96 aa, Glycine max
  Coding DNA Sequence Number=SeqID_22499
  Gene Ontology: Mol. function=lactoylglutathione lyase activity; Cellular component=cytoplasm; Biological process=carbohydrate metabolic process
  Homolog annotation: Hit_ID=Q8D0L9; Match level="QueryCoverage=91%, HitCoverage=60%, E-value=6e-40, Identity=86%"; Hit description =Lactoylglutathione lyase
  Pfam annotation: Domain name=Glyoxalase; Domain location=1-94; Score =56.4; E_value=9.7e-14; Accession=PF00903.15; Description =GlyoxalaseBleomycin resistance proteinDioxygenase superfamily
MIRVGDLQRAIDFYTKVLGMRLLRTSENPEYKYSLAFVGYTEESEGAVIELTYNWGTDSYDMGTAFGHLALGVDDVAATCDSIRRAGGRSPAKPAR

SEQ ID NO: 139278 - protein, 94 aa, Glycine max
  Coding DNA Sequence Number=SeqID_22500
MAEINQGKTMPVHGWPHILFPTYRYIGTDRVGLGSRPTDRCPFTALNKQKTSLQGSPVQVRQMLARKGGGDMVNVPLKKKKKWQVSSPGRAELA

SEQ ID NO: 139279 - protein, 136 aa, Glycine max
  Coding DNA Sequence Number=SeqID_22501
  Homolog annotation: Hit_ID=Q1S5Q3; Match level="QueryCoverage=68%, HitCoverage=65%, E-value=2e-08, Identity=33%"; Hit description=Zinc finger, GRF-type
  Pfam annotation: Domain name=zf-GRF; Domain location=20-65; Score =39.6; E_value=1.1e-08; Accession=PF06839.3; Description=GRF zinc finger
  Subcellular localization annotation: CTP_CleavageSite=30; ConfidenceScore=5.37e-01
MSQRSNASSSRTRVSSQVVLFCGCGRRAVRRVAGTNINRGRAFFTCSINKDEVGYCGYFIWVDQLIEALGVDDSLGTFSMEQRRQFGREEDKTMWKAQVNSKLDCMGIEMKMFRTIVYGMFLIQLLSMVVFVCIHK

SEQ ID NO: 139280 - protein, 99 aa, Glycine max
  Coding DNA Sequence Number=SeqID_22502
  Gene Ontology: Mol. function=RNA-directed DNA polymerase activity; Biological process=DNA integration
MEGAVKERGRKRVLRKEREKVVFIGKDERVQNRIFGQIDCTCIVTTDRYMIKFKAIIRKLLSRPKDTCTTTSSINITLLQLIRQHYFVFYYAMILEQNQ

SEQ ID NO: 139281 - protein, 147 aa, Glycine max
  Coding DNA Sequence Number=SeqID_22503
  Gene Ontology: Mol. function=heat shock protein binding; Cellular component=mitochondrion; Biological process=protein folding
  Homolog annotation: Hit_ID=Q69QB3; Match level="QueryCoverage=72%, HitCoverage=24%, E-value=7e-28, Identity=56%"; Hit description =Putative chaperone protein DnaJ
  Pfam annotation: Domain name=DnaJ_CXXCXGXG; Domain location=33-89; Score=3.8; E_value=3.6e-06; Accession=PF00684.9; Description=DnaJ central domain (4 repeats)
MTSVYSEVSLFLNIMITPFDANDFHCIHPDGQGYPLDAIPKVCPTCRGSGRVTIPPFTSTCITCKGSGRIIKDSCLTCGGSGAVEGVKEVKVTIPAGVDSGDTIHVPEGGNAAGSGGRPGSLYIKIKAIFFPNILTLTCATCWPMNL

SEQ ID NO: 139282 - protein, 337 aa, Glycine max
  Coding DNA Sequence Number=SeqID_22504
  Gene Ontology: Mol. function=phosphoribosylaminoimidazolesuccinocarbox amide synthase activity; Cellular component=chloroplast; Biological process=purine nucleotide biosynthetic process
  Homolog annotation: Hit_ID=Q07463; Match level="QueryCoverage=87%, HitCoverage=95%, E-value=1e-140, Identity=78%"; Hit description =Phosphoribosylaminoimidazole-succinocarboxamide synthase, chloroplast precursor
  Pfam annotation: Domain name=SAICAR_synt; Domain location=98-331; Score=346.4; E_value=4.9e-101; Accession=PF01259.9; Description =SAICAR synthetase
  Subcellular localization annotation: CTP_CleavageSite=50; ConfidenceScore=5.63e-01
MGDFTVALNPPKTFRADILLSTTNNRTSPAARGFQTVLAFKPPRAFRGIRASVMPREGQQASLGDALVNTPRRSDFVEAIRRTAALSSCLSETSLHATVPGLESKTRGKVRDIYDAGDYLVLVTTDRQSAFDRILASIPFKGQVLNQTSLWWFERTKHIVSNAVVLAPDNNVTIARKCSVFPVEFVGFVTGSTDTSLWTVYNKGVRNYCGNVIPDGMVKNQKLPKNILTPTTKAADHDVPITPDEQVALEHGLILVDTKYEFGKANDGSIMLIDEVHTPDSSRYWIANSYLERFQNGLEPENIDKEFLRLWFISHCNPYEDEVLPDAPEDLVCELAW

SEQ ID NO: 139283 - protein, 54 aa, Glycine max
  Coding DNA Sequence Number=SeqID_22505
MASKSAIIVKSVKMKDIFGAYERASSQALNLHKFEIFFNSNVKQQDHREIIQVL

SEQ ID NO: 139284 - protein, 143 aa, Glycine max
  Coding DNA Sequence Number=SeqID_22506
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q6YXH1; Match level="QueryCoverage=97%, HitCoverage=31%, E-value=8e-45, Identity=68%"; Hit description =Putative calcium-dependent protein kinase
  Pfam annotation: Domain name=Pkinase; Domain location=1-135; Score= -4.4; E_value=2.7e-08; Accession=PF00069.15; Description=Protein kinase domain
MGVVHRDIKPENILLTAAGKIKLADFGLAIRISEGQNLTGVAGSPAYVAPEVLLGRYSEKVDIWSSGVLLHALLVGGLPFKGDSPEAVFEEIKNVKLDFQTGVWESISKPARDLVGRMLTRDVSARITADEGIHGYCSILNAH

SEQ ID NO: 139285 - protein, 107 aa, Glycine max
  Coding DNA Sequence Number=SeqID_22507
  Gene Ontology: Cellular component=endoplasmic reticulum; Biological process=ER to Golgi vesicle-mediated transport
  Homolog annotation: Hit_ID=Q8VXX9; Match level="QueryCoverage=75%, HitCoverage=62%, E-value=2e-23, Identity=65%"; Hit description=Bet1 -like protein At4g14600
MVANSHRVGSSYGGAAPYRSRDGLSPRPVGASEEIQLRIDPLDLDDEITGLHRQVRRLKHVAEEIGTEVKYQKNFLEELKLNAPWQKTFLKLEKYGQLVLTLRTSEV

SEQ ID NO: 139286 - protein, 462 aa, Glycine max
  Coding DNA Sequence Number=SeqID_22508
  Gene Ontology: Mol. function=binding; Cellular component=outer membrane; Biological process=hemolysis by symbiont of host red blood cells
  Homolog annotation: Hit_ID=P15320; Match level="QueryCoverage=98%, HitCoverage=28%, E-value=0.0, Identity=84%"; Hit description =Hemolysin precursor
TLEDPLAVGGETALGGGFDVETAVVFALLIVGLIEANIAAGVDGGFTAAAVQRGALIDRILFHVDVDAVGRVDRAGHRLAGVAVAALGAAFALGVYGQIAAGGGVDAYAGAAAGIAVLLFLAVRRGFAAVAVRRQRDRAFARLILRALIAHFAFGVDVDAAGFHRADHRLRAAAACFAAAALRADIQADVRRADAANVVDDAGGVQLGRLADRALNRAGHGAVIDVGADVHTDVGFGGGAAGGVGGGQMIDALGVLFVGAADAVLRALLGQLVTGVDSQVAFDVAAGGDRLAALRLRFAVLVAGFHAAAELVDAAGVIETAADLGLLGVRGGFIVGRQERNLVAADAGVAFVGDQFGAAEGHVLLRLELHAAAAEGRGAVFGAGGFLAVAGVFDAQTGAVLLVAGFFGVAVDGKRGLLLIDFLLLFGSLDVDAAGLRGDAQLAAAGDLTADHVGILTADQLQ

SEQ ID NO: 139287 - protein, 168 aa, Glycine max
  Coding DNA Sequence Number=SeqID_22509
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=96%, E-value=9e-14, Identity=34%"; Hit description =UPI00006A17C9 related cluster
VPITFRGLHVLALRGLRVLALRGLHVLTTRGLHALTSRGLHVLALRGLHALTLGLHVLALRGLHALTLGTSYPHRHRTTRPRLERTTCPHLQRATCPRLQRTSCPRHERAARPHLRVLAVLTLRGLHVLALNYLERTTRPHHQRAARPHLQRTISPRLDWATRPHLGY

SEQ ID NO: 139288 - protein, 171 aa, Glycine max
  Coding DNA Sequence Number=SeqID_22510
MTVIRTGSMKPKYWNKNPFKATAKAFPLEFHFKPIANNKTRTFYEYNKTEHNKQFPSLERHAFLKRWNQFDTTKAESDKVKIRFKAHPEFLKAADLETSLFLNQKSKLVAFLAGSKSKDHLTKNLKKVLQLLQSQEERESSSKKADANSLNSSEDFYQNEDDCFCINLAED

SEQ ID NO: 139289 - protein, 200 aa, Glycine max
  Coding DNA Sequence Number=SeqID_22511
  Gene Ontology: Mol. function=cAMP-dependent protein kinase regulator activity; Cellular component=protein serine/threonine phosphatase complex; Biological process=protein amino acid dephosphorylation
  Homolog annotation: Hit_ID=Q6K3D4; Match level="QueryCoverage=87%, HitCoverage=16%, E-value=2e-60, Identity=62%"; Hit description =Putative PKG-Ib
  Pfam annotation: Domain name=Pkinase; Domain location=1-142; Score= -85.4; E_value=0.0018; Accession=PF00069.15; Description=Protein kinase domain
MGVIHNVNHNSIILPRCHSTITCCNLVDFRFGKQLSGERTFTICGMADSLAPEIVLGKGHGFPADWWALGVLIYFMLRGEMPFGSWRENELDTVAKIAKRKLHLPETFSPEAVDLISKLLEVEENTRLGSQGPDSVKNHPWFNGVEWEGIRNHTFPVPQEIISRITQHLEVHSEDCSTGYLGSPLQEVKELNVPEWLEDW

SEQ ID NO: 139290 - protein, 479 aa, Glycine max
  Coding DNA Sequence Number=SeqID_22512
  Homolog annotation: Hit_ID=Q9SFV5; Match level="QueryCoverage=17%, HitCoverage=9%, E-value=2e-07, Identity=30%"; Hit description =Putative RNA-binding protein
  Pfam annotation: Domain name=DUF1675; Domain location=310-453; Score=- 58.2; E_value=0.0013; Accession=PF07897.2; Description=Protein of unknown function (DUF1675)
MEDESGLELSLGLSFGGSSAKPKGKNGSSSDARDEEVGRGGKMVDDFKSMFDNVPQKPESITGTRTTDSPKPEENFFSDLSKAKEDNASLNLNERGFLVANINKPVEIEEDKRSEAANKRKMPFDEIPRASHISITEDGSTAENEDVADSETENPTSRPISHHSDGSKGFIRVSASSDAAKEVRGSADSNATDLSGQKRFTGSSEKDFKHAGMTYGASFSVQPVNMLNVPYPSVKESSSVGVPSPQIPGVMHVMPTAATGERSGAQSVSNGSLPVMFGYSPVQLPMLEKDNSWGLVSRPQQLHPSFVGRGPTNSAALQVISNNISEAMPYEGRPLERTKGDGKQRVTEEGSSSQSEDVKAISTNLRAKDASDKSTGEGAIIDFSNIKPGLAADVKFGGCGSYPNLPWVSTSGSGPNGRTISGVTYKYGTNQVRIVCACHGSHMTPEEFVRHSNEDQAAAEGNTVLGTVANGNPAASSHS

SEQ ID NO: 139291 - protein, 542 aa, Glycine max
  Coding DNA Sequence Number=SeqID_22513
  Gene Ontology: Mol. function=sugar porter activity; Cellular component=integral to membrane; Biological process=carbohydrate transport
  Homolog annotation: Hit_ID=Q1SRU5; Match level="QueryCoverage=99%, HitCoverage=98%, E-value=0.0, Identity=68%"; Hit description=Sugar transporter superfamily
  Pfam annotation: Domain name=MFS_1; Domain location=35-476; Score =31.7; E_value=2.6e-06; Accession=PF07690.6; Description=Major Facilitator Superfamily
  Pfam annotation: Domain name=Sugar_tr; Domain location=29-519; Score =449.4; E_value=4.6e-132; Accession=PF00083.14; Description=Sugar (and other) transporter
  Pfam module annotation: Pfam domain module=MFS_1::Sugar_tr; Domain location=35-476::29-519
MAGGGFSDAGTLKRAHLYQYKITGYFIFSCIVGALGGALFGYDLGVSGGVTSMDDFLIQFFPKVYEKKHAHLAETDYCKYDDQILTLFTSSLYFAALVSTFGASSVTKTKGRKASILAGSVSFFIGAILNAAAKSITMLILGRILLGVGIGFGNQPLCICKGKAAYNIPPPYLRIAKSLWAMGYEAVPLYLSEMAPAKVRGAVNQLFQLTTCLGILIANLVNYGTEKIHPWGWRLSLGLATVPAVFMFIGGCLCPETPNSLVEQGRFDEGRAVLEKVRGTPNVDAEFDDLIEASREAKSIKNPFQNLLLRKNRPQVIIGAFAIPAFQQLTGNNSILFYAPVIFQTLGFGSGASLYSSVITSVALVVATLISMAFVDKFGRRAFFLEAGAEMIICLVAMAIVLSVEFGKGKELSYGVSIFLVIVIFLFVLAYGRSWGPLGWLVPSELFPLEIRSAAQSVVVCVNMIFTALVAQFFLVSLCHLKYGIFLLFAALIVLMSCFVFFLLPETKQVPIEEIYLLFENHWFWKRVVGEGKNTSGSSSNV

SEQ ID NO: 139292 - protein, 1096 aa, Glycine max
  Coding DNA Sequence Number=SeqID_22514
  Gene Ontology: Mol. function=cAMP-dependent protein kinase regulator activity; Cellular component=protein serine/threonine phosphatase complex; Biological process=protein amino acid dephosphorylation
  Homolog annotation: Hit_ID=Q6K3D4; Match level="QueryCoverage=80%, HitCoverage=76%, E-value=0.0, Identity=59%"; Hit description =Putative PKG-Ib
  Pfam annotation: Domain name=AT_hook; Domain location=760-772; Score =14.9; E_value=0.061; Accession=PF02178.9; Description=AT hook motif
  Pfam annotation: Domain name=PP2C; Domain location=273-552; Score =108.6; E_value=1.9e-29; Accession=PF00481.12; Description=Protein phosphatase 2C
  Pfam annotation: Domain name=cNMP_binding; Domain location=671-815; Score=24.7; E_value=0.00032; Accession=PF00027.19; Description =Cyclic nucleotide-binding domain
  Pfam annotation: Domain name=cNMP_binding; Domain location=846-955; Score=42.3; E_value=1.6e-09; Accession=PF00027.19; Description =Cyclic nucleotide-binding domain
  Pfam module annotation: Pfam domain module=AT_hook::PP2C::cNMP _binding::cNMP_binding; Domain location=760-772::273-552::671 -815::846-955
MPYRTKLSNDKWNLFLSVLGFEDIILGFLKDGEDVKEAISVSVYDKGGHEFDMMLKKWVKVSNHYYVLNRGWFSFCDLQCLGENDLVALRTFRHAKTDMRWLWGGFSGIDAYGGGGLKGSNLNDCDDINDGGNVNDNDNENIGDIDVDNDNDRIDNHDQDNAILGVDGDDNGDGGYDVNVCIGDNCRGSSINGDPIIARNDVAEVANFSPSSSDVEEGEIRDQLNQLSITRDSEAGIRRLARVSAQFLPPDGSRIVKIPSGNFELRYSFLSQRGYYPDALDKANQDSFCIHTPFGTSPNDHFFGVFDGHGEFGAQCSQFVKRKLCENLLRNSKFRADPVEACHAAFLATNSQLHNDVVLDDSMSGTTAITVLVRGRTIYVANSGDSRAVIAERRGKEEEVVAVDLSIDQTPFRSDELERVKMCGARVLTLDQIEGLKNPDVQCWGTEEGDDGDPPRLWVPNGMYPGTAFTRSIGDSIAETIGVVANPEIVVFELTQDHPFFVLASDGVFEFLSSQTVVEMVAKFKDPRDACAAIVAESYRLWLQYETRTDDITVIIVHVNGLTESAVGQSASYGDVLRNPVPQVVEVTGSESPSTFGWSARNHRVRHELSRARLRALENSLENGQTWVPPSSAHRKTWEEEAHIEQALHDHFLFRKLTDSQCHVLLDCMQRVEVQPGDIIVKQGGEGDCFYVVGSGEFEVSATQTRQDKIRNGAIRERVGVAPIVEKMVENRLRWFGHVERRPVDSVVRRVDQMERRQTIRGRGRPKKTIREVIKKDLELNDLDRSMASVCAVTKGTLWSLKREDFRGILMSEFSNLSSLKLLRSVDLLSRLSILQLSQISDSLSEVSFSNGQTIIDKNEVLALYIIQKGRVKITLDSDLLSCPNAYSLKPDIQSEDDVQSGKELSIEKPEGSYFGEWALLGENIGSLSAVAVGDVVCALLTKEKFESVIGSLQKISQEDHKDYSRNYEFSSLDKVQLSDLEWRKTLYSTDCSEIGLANFRDSENLLTLKRFSKPKVKKLGKESQVFKERDLIMGMGSLACTPQVLCTCADLMYAGILLNTRLACPLSSILSSPFSESAAQFCAASVVTALEDLHK

SEQ ID NO: 139293 - protein, 173 aa, Glycine max
  Coding DNA Sequence Number=SeqID_22515
  Pfam annotation: Domain name=B3; Domain location=86-168; Score=24.1; E_value=0.00013; Accession=PF02362.12; Description=B3 DNA binding domain
MTENSSSNSGKGKNIIDEQQHEESGKSEEGNNNRLVNEILSYNESQLKFLLNVGIVKDCELSMPYITQLTSDKWNLFLRTPQFEGIFLGFLKEGEDVRDGIPVNVYDKHGHEFEMMLKKFHKGSISYYVLNRGWLSFCNQQHLGENDIIALRTFRHAITDKLSFVVTYVRVAW

SEQ ID NO: 139294 - protein, 126 aa, Glycine max
  Coding DNA Sequence Number=SeqID_22516
MLESARARARERVGDVREVFITKRRNRGGRKYEFVRFKGVDNVGRLEHQLDNMIIEGLKLHANRPEHEREPTKKGESTIDVKHKVGIDHTFWNGGALKQQQHPCRIQAPISYATVVAKGSNTMERR

SEQ ID NO: 139295 - protein, 442 aa, Glycine max
  Coding DNA Sequence Number=SeqID_22517
  Gene Ontology: Mol. function=transferase activity; Cellular component= membrane; Biological process=metabolic process
  Homolog annotation: Hit_ID=Q9FGV3; Match level="QueryCoverage=55%, HitCoverage=45%, E-value=1e-80, Identity=60%"; Hit description =Similarity to limonene cyclase
  Pfam annotation: Domain name=Exostosin; Domain location=270-442; Score=-32.4; E_value=3.3e-07; Accession=PF03016.6; Description =Exostosin family
MGISVVVMKLCHVAIRRLLIVGVFVAVIVVFQCCWTAYYSLLDAGGSSVALPIKVFLSGTSQQEGVFRSTAATNVMFNVTFASHSKEYASEKEADLESDGGTSSREGSIPNKGFKVASHHEDAIYSYTQKRPKYADLSTSDMLLAVKKPSNESIIQSVEMKSQNENAQVLKSPLSKSNSKPKMGTSSTSSKLVWPTSITQMNSLMLQSFNSSASMRPRWSSRRDRELLSAKLEIENAHVMSNSSGLYASIFWDVSKFSRSYELMERKLKVFIYREGAKPIFQQPKMRGIYASEGWFMKLMEGNKRFIVRDPQKAHLFYLPFSSQMLRVTLSNRKQMKQHLEKYVELIAGRYCFWNRTDGADHFLVACHDWASQITRQPMKGCIRSLCNSNVAKGFQIGKDTTLPVTYVHSVMGPLRRFAGIQKGLFWPFSLEACMVMSVRSC

SEQ ID NO: 139296 - protein, 331 aa, Glycine max
  Coding DNA Sequence Number=SeqID_22518
  Gene Ontology: Mol. function=histone-lysine N-methyltransferase activity; Cellular component=nucleus; Biological process=chromatin modification
  Homolog annotation: Hit_ID=Q1S3B8; Match level="QueryCoverage=97%, HitCoverage=58%, E-value=2e-83, Identity=51%"; Hit description=6,7 -dimethyl-8-ribityllumazine synthase; SET-related region; AWS; Pre- SET; Histone H3-K9 methyltransferase
  Pfam annotation: Domain name=Metallothio_2; Domain location=86-140; Score=-20.7; E_value=0.1; Accession=PF01439.8; Description =Metallothionein
  Pfam annotation: Domain name=Pre-SET; Domain location=40-143; Score =89.9; E_value=7.6e-24; Accession=PF05033.6; Description=Pre-SET motif
  Pfam annotation: Domain name=SET; Domain location=145-308; Score =129.6; E_value=8.7e-36; Accession=PF00856.18; Description=SET domain
  Pfam module annotation: Pfam domain module=Metallothio_2::Pre -SET::SET; Domain location=86-140::40-143::145-308
MSELKGDDHLIKNLRRVARNVNKIVAEGQISRAPSSYPSDLSNGLEAIPIPVTNEIDDSPITPNGFTYITSSQVANNVKVPSSDDYGCQCKGNSCRTNKNCCFRLNNMYPYVRRRKCSRLIQARDIVFECGPRCGCGPDCGSRVSQKGLQYQLEVYRTSDKGWAVRTRNFIPVGALVCELVGVLKRTEDLDNDSHNDYIVEIDGWETIKEIGGRKKRLPDEPLPAKIFLENKDDETTKNDPEFCIDCSSFGNVARFINHSCDPNLFVQCVLNSHYGIKQARIVLFAGRNIRPKQELTYDYGYRLDSVADVDGKIKQLPCYCGEATCRKRLY

SEQ ID NO: 139297 - protein, 101 aa, Glycine max
  Coding DNA Sequence Number=SeqID_22519
MGLTDTRAEEMCREGAANGTTLFYSLEKWQSSMRTRLLIFDDWTRLRRHATVQTLVNGGLGAWWGRRRKSVPMVGSTEEMELPLTAAFELSVSKTTTAKME

SEQ ID NO: 139298 - protein, 93 aa, Glycine max
  Coding DNA Sequence Number=SeqID_22520
MVARPGELRLTPEVTSSPRRAGSFSLKSFEGPGELEAGLGESGSIKLSKRPFCPSFLIFFAFLIETLNGSLLCTVTGVQHYKSSSKDQKINER

SEQ ID NO: 139299 - protein, 217 aa, Glycine max
  Coding DNA Sequence Number=SeqID_22521
  Gene Ontology: Mol. function=hydrolase activity, acting on ester bonds; Cellular component=cytosol; Biological process=one-carbon compound metabolic process
  Homolog annotation: Hit_ID=P36591; Match level="QueryCoverage=85%, HitCoverage=43%, E-value=7e-16, Identity=28%"; Hit description =Dihydrofolate reductase
  Pfam annotation: Domain name=FSH1; Domain location=5-217; Score=-3.5; E_value=3.7e-07; Accession=PF03959.4; Description=Serine hydrolase (FSH1)
MGSDGVRKPRFLCLHGFRTSGEILNTQLHKWPQTVFDNLDLVFVDAPFPCQGKSDVEGIFDPPYYEWFQFNKEFTEYTNFDECLQYIEECMIKHGPIDGLLGFSQGAILSAALPGLQEKGVALTKVPKVKFLIIVGGAKLRSPSVADKAYSSSIRCPSLHFLGETDFLNKYGAELLESCNEPVVIHHPKGHTIPRLDDKSLKTMMDFIERIKKDVSK

SEQ ID NO: 139300 - protein, 68 aa, Glycine max
  Coding DNA Sequence Number=SeqID_22522
MECIPIMQGNVQYNIIILHRKKGGWAMWMKPGHTVSMRKGPGDGKCDENNHMSSFFLHLWLPFGCITP

SEQ ID NO: 139301 - protein, 423 aa, Glycine max
  Coding DNA Sequence Number=SeqID_22523
  Gene Ontology: Mol. function=ATP binding; Cellular component=nucleus; Biological process=apoptosis
  Homolog annotation: Hit_ID=Q9AUH6; Match level="QueryCoverage=94%, HitCoverage=63%, E-value=1e-179, Identity=75%"; Hit description=F -box containing protein TIR1
LLRVLELVESVVEFEDDEEVDWISCFPETQTNMESLVFDCVEVPINFEALEGLVARSPRLKKLRLNQFVSMAQLYRLLLRAPQLTHLGTGSFSATEAGVVGDQEPDYAAAFEACRSLVCLSGFREIWADYLPAIYPVCANLTSLNLSYADINTDQLKSVICHCHKLQIFWVLDSIRDEGLQAVAATCKDLRELRVFPMDAREETDGPVSEVGFEAISQGCRKLESILFLCQRMTNAAVVAMSKNCPDLVVFRLCIIGRYRPDPVTQEPMDEGFGAIVMNCKKLTRLAVSGLLTDRAFEYIGTYGKLVRTLSVAFAGDTDVGLKYVLKGCPNLQKLEIRDSPFGDGALRSGLHHYYNMRFLWMSTCKLTLQACQEVARVLPNLVFEVINNNSEENAGDEVETLYMYRSLDGPRDDAPRFVTILQ

SEQ ID NO: 139302 - protein, 105 aa, Glycine max
  Coding DNA Sequence Number=SeqID_22524
  Subcellular localization annotation: CTP_CleavageSite=86; ConfidenceScore=5.14e-01
MEHATRDTARRTRQQQGNAPDASASGSALPLGATGSAQRVGATGAWVVPASGALPVAPSGRALPDAPASWGLPCCCLVRRAVPRVACSMEVPFWRALCNKKQTPR

SEQ ID NO: 139303 - protein, 222 aa, Glycine max
  Coding DNA Sequence Number=SeqID_22525
  Gene Ontology: Mol. function=nucleic acid binding; Biological process= DNA integration
  Homolog annotation: Hit_ID=Q1S7C5; Match level="QueryCoverage=98%, HitCoverage=78%, E-value=4e-11, Identity=57%"; Hit description =Integrase, catalytic region
  Pfam annotation: Domain name=GRP; Domain location=41-126; Score= -15.5; E_value=0.0027; Accession=PF07172.2; Description=Glycine rich protein family
MEATVDALGSCGDSILPREHLDVVLDGLLEEYIPVISVIESKSKPLSIGEVKALLLSHETRMKKFHKHFANSPLFNVAQGYNSSSNNYNSQNRSNYPGNHGGFNHGGGHSRGGNNFGRGGGCLGGGRGCDRYANFQCQVCFKFGHTTTVCHFGYDSDFQPNVSPTLMELVFQSNSLNTFGSEQQIVAHGGPRNNRLWLDLPLKLNTGAWLKSRMKLHGFKVF

SEQ ID NO: 139304 - protein, 304 aa, Glycine max
  Coding DNA Sequence Number=SeqID_22526
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=1e-40, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ILVIRRLHVLAIRGLHVLTFIGLHVLTYTRLHTLAFKGLHVLAFRGLHVLAFRGLHVLTFRGLHLLILRGLHLPTFRGLHALAIRGLHFLAFRGLHVFTFRGLHVLTFRRLHALAFRGLHIHTFRGLHVLAFRGLHVLAFKGLHVLVFIELHVLAFRGTHILVIRGLHVLSFRTLHIPAFIGLHVLTFRGQHVLAFRGLHVHTFRKLHVLAIRGLHGVAFRGLHVLTFIGLHVLAFTGLHVLAFIGLHILAIRRLHVLAIRGLHVLTFIGLHVLTYTRLHALAFKGLHVLAFRGLHALAFRGLH

SEQ ID NO: 139305 - protein, 165 aa, Glycine max
  Coding DNA Sequence Number=SeqID_22527
  Gene Ontology: Mol. function=ATP binding; Cellular component=nucleus; Biological process=apoptosis
  Homolog annotation: Hit_ID=Q9AUH6; Match level="QueryCoverage=92%, HitCoverage=23%, E-value=5e-57, Identity=72%"; Hit description=F-box containing protein TIR1
MRDKSESHPSTNSEDDHRSSPLLDLACAEITESSNSKTRTCGPFPGSGPSEPQAPFPDQVLENVLENVLHFLPSRRDRNAASLVCRSWYRAEALTRSELFIGNCYALSPTRATARFTRVMSVTVKGKPRFADFDLMPPDWGAHFGPWASALAQAYPWLEKLHLKR

SEQ ID NO: 139306 - protein, 403 aa, Glycine max
  Coding DNA Sequence Number=SeqID_22528
  Gene Ontology: Mol. function=DNA binding; Cellular component=beta -galactosidase complex; Biological process=DNA integration
  Homolog annotation: Hit_ID=Q1SS72; Match level="QueryCoverage=90%, HitCoverage=26%, E-value=1e-106, Identity=53%"; Hit description =Integrase, catalytic region
MSSKAETQSLLQGFIKSVERQFDTKVKAIRSDNGAEFIMSHFFQATALSVLTEKSWILEPYLVRFWDLNPTRKLDVNNVFLHGDLNEEVYIVLPPGMKSTKPGQVCKLQRSLYGLKQASRQWYAQLSTFLVAHGFKQSVTNYSLFTLKRENSFIALLIYVDDIVLSGNDLSVISHITKLLDDTFKMKDLGNLEYFLGFEVARGTSGINICQRKYALDLLTDTDMLNSKPVSTPFDYCTRLIYLTNTKPDITFAVQHLSQFIASLTIAHYMTLYCILQYIKVAPSLGIFFPSTSEFQLKAFSDSDWAGCIDTRKSITDFSVYLGSSLISWKSKKQATVSRSSFEAEYRALATVTCEIQWLIYLLHDFGIIQKPALVLCDNKSALHIAANLSSMKEPNILRLIVT

SEQ ID NO: 139307 - protein, 481 aa, Glycine max
  Coding DNA Sequence Number=SeqID_22529
  Gene Ontology: Mol. function=protein serine/threonine kinase activity; Cellular component=flagellin-based flagellum; Biological process=protein amino acid phosphorylation
  Homolog annotation: Hit_ID=Q10NJ0; Match level="QueryCoverage=95%, HitCoverage=63%, E-value=4e-99, Identity=47%"; Hit description =Protein kinase domain containing protein, expressed
  Pfam annotation: Domain name=Pkinase; Domain location=6-208; Score =158.5; E_value=1.8e-44; Accession=PF00069.15; Description=Protein kinase domain
  Pfam annotation: Domain name=Pkinase_Tyr; Domain location=4-208; Score=-24.9; E_value=6.1e-11; Accession=PF07714.7; Description =Protein tyrosine kinase
  Pfam module annotation: Pfam domain module=Pkinase::Pkinase_Tyr; Domain location=6-208::4-208
MTDVIFCLSEKLAEIGLRVHGKIHLVLEYCKGGDLSLYIQRHGKVPEATAKHFMLQLAAGLQVLRDNNLIHRDLKPQNLLLSRNDEKSVLKIADFGFARSLQPRGLAETLCGSPLYMAPEIMQLQKYDAKADLWSVGAILFQLVTGRTPFTGNNQIQLLQNIMKSTELQFPSDSQSLSFECKDLCQKLLRRNPVERLTFEEFFNHPFLSQKQTEQDEPLRNRSSPRLVGGFCSTGSDPLRRTEENYQEDCLPFMLDDDSSGPEGSPSFSRKKSSMKSTYGFDLNAKLDKAESSSPISNNINHTSGFGSVTQRSENTTKRLDNHKISRNLTNPLESPEQLFTSPYPKAAVTDSLENIDQEYVLVSGPPIDVSSSSVGASRPSHTPYRSGSLPQESSSTITRLSVPMPIVGVPSNSICQIGSSGSQDSAPGTSLGSMDTGDEQPSAHCMTRVKSLQQCASSITELVNEKVNAAKSLLATVFLK

SEQ ID NO: 139308 - protein, 111 aa, Glycine max
  Coding DNA Sequence Number=SeqID_22530
  Gene Ontology: Mol. function=unspecific monooxygenase activity
  Homolog annotation: Hit_ID=O04892; Match level="QueryCoverage=98%, HitCoverage=26%, E-value=1e-29, Identity=59%"; Hit description =Cytochrome P450 like_TBP
  Subcellular localization annotation: CTP_CleavageSite=44; ConfidenceScore=5.47e-01
SGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 139309 - protein, 187 aa, Glycine max
  Coding DNA Sequence Number=SeqID_22531
  Homolog annotation: Hit_ID=Q6I666; Match level="QueryCoverage=33%, HitCoverage=98%, E-value=5e-26, Identity=78%"; Hit description =Cytochrome P450 like_TBP
EGRIKATRAESQWIVAARPLCHLQYPVAYLSRLQRILPAARWELRFKASRRANPPHEGHAFTVRIVLEIRIKRALPFCPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 139310 - protein, 113 aa, Glycine max
  Coding DNA Sequence Number=SeqID_22532
  Subcellular localization annotation: CTP_CleavageSite=51; ConfidenceScore=5.05e-01
MVTIQCSKGKTSVGKALIDLGARINLMPFSMCRRLGNFKVVHSRMTLHLADCSMTRPYGVVEDVLVKIEQFTFPRTWAGLAHTYSLAKRGKLAKPNLNSRTSVDLSAEQATIG

SEQ ID NO: 139311 - protein, 74 aa, Glycine max
  Coding DNA Sequence Number=SeqID_22533
MSVINIEHVVNILIVIDGNNMAHLLLDFSFQGIQGHASLHRNKYIFFALKLFANVTIGYIGIIVDYDKDCLVYG

SEQ ID NO: 139312 - protein, 82 aa, Glycine max
  Coding DNA Sequence Number=SeqID_22534
MNETEQRANENDKLCNSMSWFEVETVAVGRFAAPDFDRHDMCDLEVEGARAPRSGCATSTFRVRKVYDARCSGCARFRVQDV

SEQ ID NO: 139313 - protein, 68 aa, Glycine max
  Coding DNA Sequence Number=SeqID_22535
MGWLQVRREKEEKQLWIAISIIGLDKGRPKFREADPRNMFKIIRVKNSNKISPDLEELQVNIQQYPIN

SEQ ID NO: 139314 - protein, 74 aa, Glycine max
  Coding DNA Sequence Number=SeqID_22536
MKKKNTESRRDEDENIQSKNEPPRVLNPSLQPPTPFISQNRGGGCRLVHPDYVAMNVKHLNLISKADRGRTRIK

SEQ ID NO: 139315 - protein, 375 aa, Glycine max
  Coding DNA Sequence Number=SeqID_22537
  Gene Ontology: Mol. function=protein serine/threonine kinase activity; Cellular component=integral to membrane; Biological process=protein amino acid phosphorylation
  Homolog annotation: Hit_ID=Q9SV05; Match level="QueryCoverage=71%, HitCoverage=75%, E-value=6e-66, Identity=48%"; Hit description =Putative serine/threonine protein kinase
  Pfam annotation: Domain name=APH; Domain location=9-171; Score=-17.6; E_value=0.1; Accession=PF01636.13; Description=Phosphotransferase enzyme family
  Pfam annotation: Domain name=Pkinase; Domain location=1-261; Score =86.1; E_value=1.1e-22; Accession=PF00069.15; Description=Protein kinase domain
  Pfam annotation: Domain name=Pkinase_Tyr; Domain location=1-261; Score=53.5; E_value=9.5e-16; Accession=PF07714.7; Description =Protein tyrosine kinase
  Pfam module annotation: Pfam domain module=APH::Pkinase::Pkinase_Tyr; Domain location=9-171::1-261::1-261
KGSHGTVYKAAFHGGALVAAVKITKPKTSNEIEILSHLKKNPRLVNLIGFCNDQTQTNNINNNKLIVVEYMPNGSLHELLHSTKKPVRPPSWTARVRFAVQVAKAVRLLHSSEPPVIHRDIKSSNVLIDEKWNARLGDFGLAVRGHVADSRVPPAGTLGYLDPCYLAPGDLSSKSDVFSFGVLLLEIASGRHALDVRHSPPSVLDWAVPLVRRGEFKEICDPRIGAPPDMAAFRRMAVLAARCVRSTPERRPSMVEVLECLTAVRKCFRAPVMWKRIKRRVEIARGDLFHDWDRSEEVVRVVKLGSSSSRRNGKVSSVSGVEYEGGHANPAVRSRSVGSGSGLVGFGFKNRKGKVRLKRSRSMGSPVRGKEIAGL

SEQ ID NO: 139316 - protein, 229 aa, Glycine max
  Coding DNA Sequence Number=SeqID_22538
  Gene Ontology: Mol. function=transcription factor activity; Cellular component=nucleus; Biological process=regulation of transcription, DNA-dependent
  Homolog annotation: Hit_ID=Q1SRV3; Match level="QueryCoverage=65%, HitCoverage=58%, E-value=8e-42, Identity=55%"; Hit description =Pathogenesis-related transcriptional factor and ERF
  Pfam annotation: Domain name=AP2; Domain location=51-115; Score =154.1; E_value=3.7e-43; Accession=PF00847.10; Description=AP2 domain
  Subcellular localization annotation: CTP_CleavageSite=70; ConfidenceScore=5.91e-01
MVEPPAAAATSESDTTGNTNTPSPSSSSSSSSSKKRARDNNNNSNSSSNKHSVYRGVRMRTWGKWVSEIREPRKKNRIWLGTFATAEMAARAHDVAALTIKGSSAILNFPELAATLPRPASNSPRDVQAAAAKAASMEAPPRTPPSPASTPAEDDLGEIVELPPLGTSFDSPIDPMSTEFVFLDMDDGWPYSHPWYHGIYDGGYLISDINNMVSMQESESMLLSLWPST

SEQ ID NO: 139317 - protein, 292 aa, Glycine max
  Coding DNA Sequence Number=SeqID_22539
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=7e-43, Identity=35%"; Hit description= UPI00006A17C9 related cluster
  Subcellular localization annotation: CTP_CleavageSite=8; ConfidenceScore=5.17e-01
RATRPLLKRATRPCLQRTTRPLLQRTTHSRFQRTTHPQLQRTTHPRLQRATHPDLQRTTHLAIKGLNILTFRGLHVLSLRGLHALAFRGLHVLSIRGLHIPAFRGLHILNFRGLHIHDFRGLHILNFRGLHIHDFRGLHILNFRGLHIHDFRGLHILTFRGLHALTFKGLHVNTFRGLHVLTFRGLHTSQSEDYTSSPSGGYTSSPSEGYTPLPLEDYTSSPLEDYTFPLSDDYKSSTSKDYTSTTSEGYTSSPSEGCMPSPSNDCTSSPLEDYTSSPLEDYTFPLSEDYTS

SEQ ID NO: 139318 - protein, 66 aa, Glycine max
  Coding DNA Sequence Number=SeqID_22540
MEEGYDASDSGQIEKVICQDSGPQLFAVSRVVAAVAVIALEEECMVYLDQQHFGRKEQVVVVVVED

SEQ ID NO: 139319 - protein, 116 aa, Glycine max
  Coding DNA Sequence Number=SeqID_22541
MVKPYVPVKNEPGTYPSTERSSSVLKGLLLVVPCPSLMFISVQKGEGVQIGIVHAHFPPLLLFLGRDYVGEPSEVVDLPDKMGGRQFGDFLSYCSSPLFPHFSFPLGHWLDNFTYG

SEQ ID NO: 139320 - protein, 87 aa, Glycine max
  Coding DNA Sequence Number=SeqID_22542
  Homolog annotation: Hit_ID=Q9FZ06; Match level="QueryCoverage=44%, HitCoverage=4%, E-value=2e-11, Identity=84%"; Hit description =Kinesin-like protein
MHRGETACTIMFGQRAMKVENMVKLKEEFDYKSLSRRSSIFFINEVICFLKIMAAEWRRKKDDRRRHFKRKMSQEKAHHHRKPWIRA

SEQ ID NO: 139321 - protein, 131 aa, Glycine max
  Coding DNA Sequence Number=SeqID_22543
  Gene Ontology: Mol. function=transition metal ion binding
MAIGYILPNKVRHAITHPWLFFNAICNKVIDPLKLDDLELFERYMKILKWYTKNLHHPKIFAILRYIVEETIEFCLEYIEKENDYTTELPSSRVNTFTVYMAQIIVCQTYGSDHCLLDSWLKSLFVRPVGM

SEQ ID NO: 139322 - protein, 86 aa, Glycine max
  Coding DNA Sequence Number=SeqID_22544
MTLLLSNIPPDDHNADLPPAEVSVGLCHRDIGIAPIRHPVDPEKPNRALGFPGLVMGLCHSYRVPVPPTKSCHRDIGKYARGYTDF

SEQ ID NO: 139323 - protein, 176 aa, Glycine max
  Coding DNA Sequence Number=SeqID_22545
  Subcellular localization annotation: CTP_CleavageSite=45; ConfidenceScore=5.57e-01
MPLSLSLLFPRLLPPSFSATRTSLNKPSSALSPEALPLSVTPLTVCSVEAKLHNESRMIQRYFDDNKGDDRKLKGQSKNEFKMFKIESRKNEFKMFKIESRTLQDSRIKLLRIKIKIQESREDLIKIQESREELIKISMKRFFQKLSSTWIFLKTCLPKNFYSLVIDYLIVVIDYQ

SEQ ID NO: 139324 - protein, 72 aa, Glycine max
  Coding DNA Sequence Number=SeqID_22546
MKVDVEEIRDVNAHVPIPTKEDKHVSKGLMMPIDRLKPNDDLLYQMTLMILQLLLKPMHRCHGKQLCLGSEQ

SEQ ID NO: 139325 - protein, 33 aa, Glycine max
  Coding DNA Sequence Number=SeqID_22547
MHCFLIFRTLFDSSPRGVPPPNSAWAKCNSDGS

SEQ ID NO: 139326 - protein, 81 aa, Glycine max
  Coding DNA Sequence Number=SeqID_22548
MWVQAIGLFAQATCAPEFGLPRPFNQRLLVMHVGGERSELSRIGCWTNGLSYLKKRGVELRYKDYSPIKLSLSLFGLTMHP

SEQ ID NO: 139327 - protein, 50 aa, Glycine max
  Coding DNA Sequence Number=SeqID_22549
MSKPEQVWDQTWHWMVDDIVYNYKKSSTSPALQLDDRTLQNLVLLEIEQL

SEQ ID NO: 139328 - protein, 126 aa, Glycine max
  Coding DNA Sequence Number=SeqID_22550
  Gene Ontology: Mol. function=nucleic acid binding
MLASSQVYTQVLNKETIKSRKVQSAGDFTVRLDERWCDYKKIQKLHMSCSHVVVACKHAHHEYRNYIHLMHKLENVSNVYKGLFGELRNEEYWPPCLEPMICAGPNKKRNSKGRLVSSRIPTEMDI

SEQ ID NO: 139329 - protein, 112 aa, Glycine max
  Coding DNA Sequence Number=SeqID_22551
MDQSHPYLSTPVVKPTSLTQPNEPKFTVELDLPNEELDTFSEDEDKLLHNQIQEEDDEEEVESVSTITIVPPYYIPPNMQNFEESNFQDSEYSHSLDSKKVQHLVGTLFEGM

SEQ ID NO: 139330 - protein, 128 aa, Glycine max
  Coding DNA Sequence Number=SeqID_22552
  Homolog annotation: Hit_ID=Q1SGM6; Match level="QueryCoverage=70%, HitCoverage=8%, E-value=5e-32, Identity=71%"; Hit description =Lissencephaly type-1-like homology motif; CTLH, C-terminal to LisH motif
MCISTIGVQKLWKWAHSEQNPNGKAIASVVPQHWQSNIGLLMTNDVTSVKLDEVVPCIALSKNDSYVMFACGGKVSLFYMMTFKSTGNFSALFLIATTQILLCLKLAEELGVIVPNPNYAYASYFTFY

SEQ ID NO: 139331 - protein, 96 aa, Glycine max
  Coding DNA Sequence Number=SeqID_22553
MRFWKDNWVPNHGKLDEYQSGQTGHKENILVCFYVNAKGDWDLEQIIVNLPVNVVESIKTLKPHCMAIKDAYIELSNAPILQESMLFKNIWHCDGP

SEQ ID NO: 139332 - protein, 132 aa, Glycine max
  Coding DNA Sequence Number=SeqID_22554
  Homolog annotation: Hit_ID=Q2HRG4; Match level="QueryCoverage=75%, HitCoverage=7%, E-value=3e-08, Identity=32%"; Hit description =Ribonuclease H
MAFVAYGVVLQYDKGDFLKAFSRRLGHCTILKAKLWAILFGMNMACDSSYKAIIIETDFVEAIELVEDPRYHEDQFVDLSSKIVKTKEKFTSCSIVHVLRQANTMACCFAKNDLTIDSDITHSIMKGKRGAT

SEQ ID NO: 139333 - protein, 100 aa, Glycine max
  Coding DNA Sequence Number=SeqID_22555
  Homolog annotation: Hit_ID=Q38908; Match level="QueryCoverage=32%, HitCoverage=9%, E-value=1e-08, Identity=78%"; Hit description =Probable xyloglucan endotransglucosylase/hydrolase protein 30 precursor
MTLSGAVSLYNPDLTKGATERGAWIQMAANTRNNDISATNDGPVMRLINKCLSALRKKLNRILAMEETSNSDVFEKSHDELDFEFLGNVAEKPWRFQMNL

SEQ ID NO: 139334 - protein, 431 aa, Glycine max
  Coding DNA Sequence Number=SeqID_22556
  Gene Ontology: Mol. function=alpha-1,6-mannosylglycoprotein 2-beta-N -acetylglucosaminyltransferase activity; Cellular component=integral to membrane; Biological process=oligosaccharide biosynthetic process
  Homolog annotation: Hit_ID=Q599H9; Match level="QueryCoverage=95%, HitCoverage=95%, E-value=0.0, Identity=72%"; Hit description=Beta 1 ,2 N-acetylglucosaminyltransferase
  Pfam annotation: Domain name=MGAT2; Domain location=75-415; Score =601.9; E_value=5.8e-178; Accession=PF05060.5; Description=N -acetylglucosaminyltransferase II (MGAT2)
MAVSKKPRLRLRDVALCRLLSVVFVTLCGVLLMIFLLASNSTPSGTHDIIDNIDAYHHDLKFEKLHDLPHQNDLSLRLERLNGLPPRNLDLYPTLARDHIVVVLYVHNRPQYLKVVVESLSRVVGISETLLIVSHDGYFEEMNKIIDGIKFCQVKQIYATYSPHLFSDSFPGVSANDCKEKDDAGEKLCEGNPDQYGNHRSPKIVSLKHHWWWMMNTIWNGLRETRDHSGHILFIEEDHFIFPNAYHNLQVLTSLKPEKCPDCYAANLAPSDVNSRGEGWATLIAERMGNVGYSFNRTVWKKIHNKAREFCFFDDYNWDITMWATVYPSFGSPVYTLRGPRTSAVHFGRCGLHQGQGENKACIDNGMVNINVEEPDTVSNIELNWEVHTFKNQPGYKAGFKGWGGWGDNRDRHLCLSFAKMYHSIGTASPL

SEQ ID NO: 139335 - protein, 903 aa, Glycine max
  Coding DNA Sequence Number=SeqID_22557
  Gene Ontology: Mol. function=protein binding; Cellular component =integral to membrane; Biological process=defense response to fungus
  Homolog annotation: Hit_ID=Q5VPF0; Match level="QueryCoverage=98%, HitCoverage=96%, E-value=1e-113, Identity=31%"; Hit description =Putative HcrVf3 protein
  Pfam annotation: Domain name=LRRNT_2; Domain location=8-46; Score =54.2; E_value=4.5e-13; Accession=PF08263.3; Description=Leucine rich repeat N-terminal domain
  Pfam annotation: Domain name=LRR_1; Domain location=120-142; Score =16.1; E_value=0.13; Accession=PF00560.23; Description=Leucine Rich Repeat
  Pfam annotation: Domain name=LRR_1; Domain location=144-167; Score =3.5; E_value=64; Accession=PF00560.23; Description=Leucine Rich Repeat
  Pfam annotation: Domain name=LRR_1; Domain location=169-190; Score =4.4; E_value=42; Accession=PF00560.23; Description=Leucine Rich Repeat
  Pfam annotation: Domain name=LRR_1; Domain location=195-214; Score =2.3; E_value=1.1e+02; Accession=PF00560.23; Description=Leucine Rich Repeat
  Pfam annotation: Domain name=LRR_1; Domain location=222-244; Score =5.8; E_value=23; Accession=PF00560.23; Description=Leucine Rich Repeat
  Pfam annotation: Domain name=LRR_1; Domain location=246-267; Score =10.3; E_value=3.4; Accession=PF00560.23; Description=Leucine Rich Repeat
  Pfam annotation: Domain name=LRR_1; Domain location=269-291; Score =7.1; E_value=14; Accession=PF00560.23; Description=Leucine Rich Repeat
  Pfam annotation: Domain name=LRR_1; Domain location=293-314; Score =14.9; E_value=0.28; Accession=PF00560.23; Description=Leucine Rich Repeat
  Pfam annotation: Domain name=LRR_1; Domain location=316-337; Score =12.2; E_value=1.5; Accession=PF00560.23; Description=Leucine Rich Repeat
  Pfam annotation: Domain name=LRR_1; Domain location=343-367; Score =6.1; E_value=21; Accession=PF00560.23; Description=Leucine Rich Repeat
  Pfam annotation: Domain name=LRR_1; Domain location=371-392; Score =12.0; E_value=1.6; Accession=PF00560.23; Description=Leucine Rich Repeat
  Pfam annotation: Domain name=LRR_1; Domain location=394-416; Score =14.6; E_value=0.37; Accession=PF00560.23; Description=Leucine Rich Repeat
  Pfam annotation: Domain name=LRR_1; Domain location=418-440; Score =11.8; E_value=1.8; Accession=PF00560.23; Description=Leucine Rich Repeat
  Pfam annotation: Domain name=LRR_1; Domain location=442-460; Score =5.6; E_value=25; Accession=PF00560.23; Description=Leucine Rich Repeat
  Pfam annotation: Domain name=LRR_1; Domain location=465-488; Score =14.4; E_value=0.42; Accession=PF00560.23; Description=Leucine Rich Repeat
  Pfam annotation: Domain name=LRR_1; Domain location=490-512; Score =11.8; E_value=1.8; Accession=PF00560.23; Description=Leucine Rich Repeat
  Pfam annotation: Domain name=LRR_1; Domain location=513-535; Score =12.9; E_value=1.1; Accession=PF00560.23; Description=Leucine Rich Repeat
  Pfam annotation: Domain name=LRR_1; Domain location=537-559; Score =17.0; E_value=0.07; Accession=PF00560.23; Description=Leucine Rich Repeat
  Pfam annotation: Domain name=LRR_1; Domain location=561-583; Score =11.2; E_value=2.3; Accession=PF00560.23; Description=Leucine Rich Repeat
  Pfam annotation: Domain name=LRR_1; Domain location=585-607; Score =12.1; E_value=1.5; Accession=PF00560.23; Description=Leucine Rich Repeat
  Pfam annotation: Domain name=LRR_1; Domain location=610-632; Score =11.2; E_value=2.2; Accession=PF00560.23; Description=Leucine Rich Repeat
  Pfam annotation: Domain name=LRR_1; Domain location=634-656; Score =13.4; E_value=0.85; Accession=PF00560.23; Description=Leucine Rich Repeat
  Pfam annotation: Domain name=LRR_1; Domain location=700-722; Score =11.3; E_value=2.1; Accession=PF00560.23; Description=Leucine Rich Repeat
  Pfam annotation: Domain name=LRR_1; Domain location=724-746; Score =10.6; E_value=2.9; Accession=PF00560.23; Description=Leucine Rich Repeat
  Pfam annotation: Domain name=LRR_1; Domain location=748-770; Score =15.3; E_value=0.22; Accession=PF00560.23; Description=Leucine Rich Repeat
  Pfam annotation: Domain name=LRR_1; Domain location=772-793; Score =14.8; E_value=0.31; Accession=PF00560.23; Description=Leucine Rich Repeat
  Pfam annotation: Domain name=LRR_1; Domain location=95-118; Score =9.3; E_value=5.2; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1; Domain location=8-46::120-142::144-167::169-190::195-214::222 -244::246-267::269-291::293-314::316-337::343-367::371-392::394 -416::418-440::442-460::465-488:...
  Pfam module annotation: Domain location=:490-512::513-535::537 -559::561-583::585-607::610-632::634-656::700-722::724-746::748 -770::772-793::95-118
CYSSLGCNEEERQALVNIKESFKDPSSRLSSWEGSDCCQWKGVACNNVTGHVVKLDLRNPCYPLRDQGYFQPNCSLYKNELEAQHVHPSILQLKYLTFLDLSGNNFHNSSIPMFIQSLEHLQVLSLSDSQFSGRIPHIFGNLTKLNFLDLSFNYHLYADGSDWISQLSSLQYLYMSYVYLGKAQNLLKVLSMLPSLSNIELVSCSLNELHAHQLVRDTNVSRVQVLNLAENGLEAQILDVFHNMTFITKIDLSHNNLNSTPFWLSSCSKLVSLFLASNAFHGSFPSAFQNISSLTELELAENNFDSVPSWLGGLKGLRYLGLSGNNISHIEGSLASILGNCCHLQSLIMSRNKIQGDALGGNIQPGCIRYDLQQLDLTNNELDRFPAWLVQLVNLELLDLSENSINGLIPQTIGQLKKLNTLYLDKNNLHGNIPNSLGQLLNLQNLDISLNHLESLISDITWPKQLVYLNLTNNHITGSLPQDIGDRLPNVTSLLLGNNLISGSIPNSLCKINLYNLDLSGNMLSGEIPDCWRDSQGLNEINLSSNNLSGVIPSSFGNLSTLEWFHLNNNSIHGGFPSSLRNLKHLLILDLGENHLSGIIPSWIGNISSSMQILRLRQNKFSGKIPSQLCQLSALQILDLSNNDLMGSIPDCIGNLTGMILGKNSVIQPSNGTTYSEWYEQEVRQIMKGTELEYTRNLRLLVNMDLSNNNLSGSIPEEITLLSALQGLNVSYNHLSGHIPKRVGDMKSLESLDLSHDQLSGAIPDSISSLTSLSHLNLSYNNLSGPIPKGTQLSTLDDPFIYIGNPFLCGPPLPNECSANDSKHGNEDEDGKDDKIEKLWFYFVVALGFAIGFWAVIGSLLMKRSWRCAYFQYIDKSRQRMNASWAIHLANFKERFTGNPVAG

SEQ ID NO: 139336 - protein, 422 aa, Glycine max
  Coding DNA Sequence Number=SeqID_22558
  Gene Ontology: Mol. function=sugar porter activity; Cellular component=integral to membrane; Biological process=carbohydrate transport
  Homolog annotation: Hit_ID=Q1T6J4; Match level="QueryCoverage=99%, HitCoverage=88%, E-value=1e-148, Identity=58%"; Hit description =Sugar transporter superfamily; Major facilitator superfamily MFS_1
  Pfam annotation: Domain name=MFS_1; Domain location=18-421; Score =59.8; E_value=9.1e-15; Accession=PF07690.6; Description=Major Facilitator Superfamily
  Pfam annotation: Domain name=Sugar_tr; Domain location=23-422; Score =382.2; E_value=7.9e-112; Accession=PF00083.14; Description=Sugar (and other) transporter
  Pfam module annotation: Pfam domain module=MFS_1::Sugar_tr; Domain location=18-421::23-422
MASGHMEALVGYPGKLTLRVVLTCVMAATGGLIFGYDHGVSGGVTSMDSFLKEFFPSVYEQESTMKASTDSYCKFNSQILTLFTSSLYLTALVAGLVASSITRLMGRRATMIIGGIFFVLGALLNGLATGLWMLIVGRMLLGFGIGCANQSVPIYVSEMAPYKYRGGLNICFQLSITIGIFIANLFNYYFAHILDGQGWRLSLGLGAVPAVIFVVGSICLPDSPNSLVERDRLEEARKELQKLRGTTEVDAELNDIVAASEASKKQFTGLNVITFYAPILFRSIGFGSTASLMSAVIIGSFKPISTLISILVVDKFGRRSLFLEGGAQMLICQITMAIAIAVAFGTSGNPGTLPKWYASVVVGVICVYVSGYAWSWGPLGWLVPSEIFPLEIRPAAQSVTVCVNMISTFIVAQFFTTMLCHM

SEQ ID NO: 139337 - protein, 106 aa, Glycine max
  Coding DNA Sequence Number=SeqID_22559
MEVKSSKGLGKHLSKNSIEMSSKALMLSFGAVESKEGKVYLQKCNTTIGSPPISDHNKLNAKPAGPKLQDLNFPSSSTFNVLLNLFDETSMDLKLVSSTLPSRNNY

SEQ ID NO: 139338 - protein, 100 aa, Glycine max
  Coding DNA Sequence Number=SeqID_22560
  Gene Ontology: Mol. function=heat shock protein binding; Cellular component=integral to membrane; Biological process=protein folding
  Homolog annotation: Hit_ID=Q6K8D7; Match level="QueryCoverage=86%, HitCoverage=63%, E-value=3e-23, Identity=58%"; Hit description=DNAJ heat shock N-terminal domain-containing protein-like
  Pfam annotation: Domain name=DnaJ; Domain location=37-98; Score=67.0; E_value=6e-17; Accession=PF00226.21; Description=DnaJ domain
MMWEWDDYQDTIPKHDLPQPDSHLKFDFFSALSRPKDYYKILEVDYDATDDAIRSNYIRLALKWHPDKHKDQNSATSRFQDINEAYQGVDESNRALEAQA

SEQ ID NO: 139339 - protein, 114 aa, Glycine max
  Coding DNA Sequence Number=SeqID_22561
  Homolog annotation: Hit_ID=Q9ZPW2; Match level="QueryCoverage=46%, HitCoverage=28%, E-value=5e-20, Identity=87%"; Hit description =Anaphase-promoting complex subunit 10
  Pfam annotation: Domain name=APC10; Domain location=1-105; Score= -70.9; E_value=0.0033; Accession=PF03256.7; Description=Anaphase -promoting complex, subunit 10 (APC10)
LIVLYVVFKLDESYTPSKVSIRAGDGFHNLKEIKTVELVKPTGWVYPSLSGVDPSVDETNLRSMLVSSKRFNSTLKVDDDGKFKSWSFGPAGFALSLLWSEIGGEPIVVLHFWR

SEQ ID NO: 139340 - protein, 54 aa, Glycine max
  Coding DNA Sequence Number=SeqID_22562
MQQLLLMAQEALAAGCSSAKDRLWKKPNKGGRGGGRLSGHSNNTPSQLDTTSPS

SEQ ID NO: 139341 - protein, 276 aa, Glycine max
  Coding DNA Sequence Number=SeqID_22563
WIKADIEALKEQMATMMEAMTSMKKIMEVNATVVASTSAIVEVDPTPPSGLNQINHPTSDMVGKELGSMGGPHFVQVQNKHAFPPYGLLPNNTPPNVVHTPNDNVNNSTPTLMESQQPQSDHAHVFQPMGETHEIPHHNLDDFDPRLRYATEGQAVGGRVPPAMAKKEKLDQIEEMLRAVEEGEDYAFADMEDLCLVPDMAIPPACIVVYKAYERSSKGLNILLAHKVKALWYLYLLARFIGLKVLTFTGLKVLALIFHRTQSPHLDLSQDSKSSL

SEQ ID NO: 139342 - protein, 69 aa, Glycine max
  Coding DNA Sequence Number=SeqID_22564
MTMTVDTTVTVVSVARFFFLQCSKRYQATVLGFSPILDIRFFFAMHRDIKLIGFSMLNEDYNGSEELNS

SEQ ID NO: 139343 - protein, 245 aa, Glycine max
  Coding DNA Sequence Number=SeqID_22565
  Homolog annotation: Hit_ID=Q1T1Y0; Match level="QueryCoverage=72%, HitCoverage=58%, E-value=3e-09, Identity=24%"; Hit description =Ankyrin
  Pfam annotation: Domain name=DUF1723; Domain location=88-134; Score =28.7; E_value=2.1e-05; Accession=PF08330.1; Description=Protein of unknown function (DUF1723)
MTASPYRDANLARQQQQQSLEVQVEPKAQLEIPHVDCIIGLLFGGGPMDLSVLQSYTDHMVGHVWIDQLREEMKLKSLFDAWYTFAIKGIINAFIERWFSYTYSFHLLVGEMTITFNDVSCLLHLPISGRCCNKKWKLSVFDLATKAYLLRFLDNTIFADKSLTHLIFMISCRIRACMAASSGQLYDATNAWVFKHLPTIPCHKKVLDFDRKLREKPLATKWLPLRGTGKVVENRELLDLLQMTD

SEQ ID NO: 139344 - protein, 88 aa, Glycine max
  Coding DNA Sequence Number=SeqID_22566
MGKQWRHFKSDLTMKWAPTTGKGSVDDTVCQKYDISKEKWTQFCQSHRDPSWEDMRKKEQTIHKQNTAPHVLSRGGYEYLENKLMEEK

SEQ ID NO: 139345 - protein, 177 aa, Glycine max
  Coding DNA Sequence Number=SeqID_22567
MEEKKRKKKQCGRRKRAVGSRNCRMSHHGSRRPGVADAKNMGPAEGVNHRKSDSTTNVVLQPDELALPPEPEVGPSAARVSTKESCVDLLGNDPDTVVGPGKPADRPDHDVDDPLYLMTLTIPQLFLKPLQIKHEDLFEIAHGGQCLSIFVIQLWILHMNETSIRAGNADVYGFLEP

SEQ ID NO: 139346 - protein, 59 aa, Glycine max
  Coding DNA Sequence Number=SeqID_22568
MEVSEEENVSRLEGCGGIILAPIFLGLYDEHQDRSSLMGSLSSSMDLLVGVVIPQGLDK

SEQ ID NO: 139347 - protein, 113 aa, Glycine max
  Coding DNA Sequence Number=SeqID_22569
  Gene Ontology: Mol. function=nucleic acid binding; Biological process= RNA-dependent DNA replication
MVVEMKPTLLSLIGSHLFAGMDHEDPYAYLSTFMELCSTMGASDKDVEVAYLRAFLFSLTGKAKTWLQSHPNKTCNTWEEVEEKFTTRFLPPSRFISAKLVIATFSQGFDKPL

SEQ ID NO: 139348 - protein, 139 aa, Glycine max
  Coding DNA Sequence Number=SeqID_22570
MLQREVSTKRNHEDMKLTSNPTATMAMRQAVRTARLAVMKGSCDEDDEQQDWCGVAMKIGINEKTHKPEPQGFGLKCGVKFPYVVARATPAVCPAAVQVPYLEHVGSNGYTRGGGACGRDSHLRGRLLEYKCEVKSYIG

SEQ ID NO: 139349 - protein, 209 aa, Glycine max
  Coding DNA Sequence Number=SeqID_22571
  Gene Ontology: Mol. function=pepsin A activity; Biological process =proteolysis
  Homolog annotation: Hit_ID=Q1RVV6; Match level="QueryCoverage=85%, HitCoverage=38%, E-value=2e-17, Identity=34%"; Hit description =Peptidase A1, pepsin
MGVKHTTTTTTTILFTSMLLHLSIIAIANDPCASQHDDDDSDITMIPIYGNCSPFKNYSTSWENIIIDMASKDPERVVYLSSLDASLRRKPISAAPIASGQAFGIGSYVVRVKLGSPNQLFFMVLDTSTDEAWVPCTGCTGCSSSSTYYSPQASTTYGGAVACYAPRCAQARGALPCPYTGSKACTFNQSYAGIKIVKTKRHPQYYCDS

SEQ ID NO: 139350 - protein, 60 aa, Glycine max
  Coding DNA Sequence Number=SeqID_22572
MPALSAEPKELIQLEMQAESSSKEVIKDHMIGQTPNSNPDQSRPHANLLQWQGNITLNIR

SEQ ID NO: 139351 - protein, 103 aa, Glycine max
  Coding DNA Sequence Number=SeqID_22573
MASPIDFGIDTESKDEAMGNSDVGNGGGQMFGVDDAGGLVGGATSSACVRQWYVNSGGGLGAGAGATSGSGTTGGTSRGTSSMVEEKKGVVSKIVTSAETRYR

SEQ ID NO: 139352 - protein, 227 aa, Glycine max
  Coding DNA Sequence Number=SeqID_22574
  Gene Ontology: Mol. function=binding; Cellular component=COPI vesicle coat; Biological process=protein transport
  Homolog annotation: Hit_ID=Q9C6W3; Match level="QueryCoverage=91%, HitCoverage=24%, E-value=7e-96, Identity=80%"; Hit description =Epsilon-adaptin, putative
MTKSSNVEVIVDRMIDYMISISDDHYKTYIASRCVELAEQFAPSNHWFIQTMNKVFEHAGDLVNIKVAHNLMRLIGEGFGEDDDAAYSQLRSSAVICWVLGEYGTADGKYSASYITGKLCDVAEAYSNDETVKAYAVSALTKIYAFEIAAGRKVDMLPECLSFIEELLASHSTDLQQRAYELQALIGLDARAVETIMPQDASCEDIEIIVLFLEVKIGDHTILQVTV

SEQ ID NO: 139353 - protein, 58 aa, Glycine max
  Coding DNA Sequence Number=SeqID_22575
MGFDKIWSRTALRSIVKGIRVEYSSETSGGTAREPLRDLVSISANRSVELMKSVVISP

SEQ ID NO: 139354 - protein, 283 aa, Glycine max
  Coding DNA Sequence Number=SeqID_22576
  Gene Ontology: Mol. function=nucleic acid binding; Cellular component= beta-galactosidase complex; Biological process=DNA integration
  Homolog annotation: Hit_ID=Q0KIN0; Match level="QueryCoverage=96%, HitCoverage=16%, E-value=1e-87, Identity=59%"; Hit description =Integrase core domain containing protein
MTLRGSFASSLTFIVNFRLRTWAPSGNSLALKLPDPHLPAEVALDILTKIGMADCRPSDTPMDPNMKLLPSQGEPSKDPGRYRRLIGSLNYLTTITRPDITFAVSVVSHFMKEPCCKLIYGDKGNAKIVRYFDADWAGSPSDRRSTCVLIRENLISWRSKKQKTVARFNAKAEYRAMAAVAFEITWLRQLLQQLKFGDTQDTRLLCDNQVALHISSNPIFHERTKQIEIDCHFVREKVLSGEIITDFVNSGDQIADMLTKSLKGSRVDNICDKLGSYDIYVPT

SEQ ID NO: 139355 - protein, 378 aa, Glycine max
  Coding DNA Sequence Number=SeqID_22577
  Gene Ontology: Mol. function=binding; Cellular component=COPI vesicle coat; Biological process=protein transport
  Homolog annotation: Hit_ID=Q8RZX0; Match level="QueryCoverage=98%, HitCoverage=39%, E-value=1e-161, Identity=75%"; Hit description =Putative adapter-related protein complex 4 epsilon 1 subunit
  Pfam annotation: Domain name=Adaptin_N; Domain location=41-378; Score= -142.3; E_value=0.0045; Accession=PF01602.10; Description=Adaptin N terminal region
  Pfam annotation: Domain name=HEAT; Domain location=118-150; Score =0.2; E_value=41; Accession=PF02985.12; Description=HEAT repeat
  Pfam annotation: Domain name=HEAT; Domain location=152-188; Score =21.3; E_value=0.0034; Accession=PF02985.12; Description=HEAT repeat
  Pfam module annotation: Pfam domain module=Adaptin_N::HEAT::HEAT; Domain location=41-378::118-150::152-188
MEQLKTIGRELAMGSQGGFGQSKEFLELVKSIGESRSKAEEDRIVLREIETLKRRIAEPDIPKRKMKEYIIRLLYVEMLGHDASFGHIHAVKMTHDDSLLLKRTGYLAVTLLLNDDDDLIILIVNTIQKDLKSDNYLVVCAALSAVCRLINEETIPAVLPSVVDLLAHPKDAVRKKAVMALHRFHHKSPSSVSHLISNFRKKLCDNDPGVMGATLCPLFDLIAVDPSPYKDLVVSFVSILKQVAEHRLPKSYDYHQMPAPFIQIKLLKILALLGSGDKQASEQMYTVIGEIIRKGDSSSNIGNAILYGCICCVSSIYPNAKLLEAAADVNAKFLKSDSHNLKYMGIDALGRLIKISPHVAEQHQLAVIDCLEVRISLS

SEQ ID NO: 139356 - protein, 106 aa, Glycine max
  Coding DNA Sequence Number=SeqID_22578
MSLLNETSSLSESSTIRLTDVNVRDLQATQRGAGKEISIDDGSLLSIYNFDTTVRVREPNYGDFFMRKNTCTWGHVTRFRTSLRLKLITMGEKLLVHDRVISTLAA

SEQ ID NO: 139357 - protein, 109 aa, Glycine max
  Coding DNA Sequence Number=SeqID_22579
  Gene Ontology: Biological process=response to stress
  Homolog annotation: Hit_ID=Q9SWV2; Match level="QueryCoverage=89%, HitCoverage=60%, E-value=2e-32, Identity=70%"; Hit description=ER6 protein
MSSGGNLSCVLVAVDGSEESMNALRWALNNLKLRSPTLDSTGAPSFIIFHVQSPPSIATGLHPGAIPFGGDIEVPAFTAAIEAHQKRITNAVLDHVLGICSEFNLTRCF

SEQ ID NO: 139358 - protein, 72 aa, Glycine max
  Coding DNA Sequence Number=SeqID_22580
  Gene Ontology: Mol. function=exonuclease activity; Biological process= DNA repair
  Homolog annotation: Hit_ID=Q00U66; Match level="QueryCoverage=69%, HitCoverage=11%, E-value=2e-09, Identity=56%"; Hit description =Chromosome 16 contig 1, DNA sequence
MAILLYTTTPKYDKALKSKNIEFVVAPYEADGQLAHMSQLGVKNGGVAAMITEDSDLIAYDYPTVRTPPILS

SEQ ID NO: 139359 - protein, 135 aa, Glycine max
  Coding DNA Sequence Number=SeqID_22581
  Gene Ontology: Mol. function=transcription regulator activity; Cellular component=nucleus; Biological process=regulation of transcription
  Homolog annotation: Hit_ID=Q9FEA1; Match level="QueryCoverage=55%, HitCoverage=14%, E-value=6e-11, Identity=50%"; Hit description =Anthocyanin 1
MAEPIEPMQAESSSKELIEDRMIGQTPTPATSQDVMHVQPLASRFWFWGDGYYNKAIVTLQPMKVSVEKVSHQRSQQHYESLSARETNSPYATLSEEDSTESKWFPFMCAFILLYSWCWVSHAALFLIKLDLFIN

SEQ ID NO: 139360 - protein, 143 aa, Glycine max
  Coding DNA Sequence Number=SeqID_22582
  Homolog annotation: Hit_ID=Q1RZJ4; Match level="QueryCoverage=39%, HitCoverage=1%, E-value=6e-11, Identity=63%"; Hit description =Aldo/keto reductase; Sigma-54 factor, interaction region
MLDDLIVHVNLHVLVTIHVIANILASLFSKGFEISPENQEEDRSLNTSGDTSGTDMGKGVGLKDADQMSLSEDSGEDDDIDGEDEELNSEMGPSRPNNEVVGKKVLMRMKMKLLMIQEKSIMRVESQNYASAWIPFPFPTTLF

SEQ ID NO: 139361 - protein, 78 aa, Glycine max
  Coding DNA Sequence Number=SeqID_22583
MVLNCGHGHIKVLTIMDIKDYVMWTTIIVHSTSNPSSSSDHIPAVMDSPTTNPNQNDDIDEEEKKFNFEDKTGDHITC

SEQ ID NO: 139362 - protein, 156 aa, Glycine max
  Coding DNA Sequence Number=SeqID_22584
  Gene Ontology: Mol. function=RNA-directed DNA polymerase activity; Biological process=RNA-dependent DNA replication
MMMRGQGIYSSQEEATSSPSSSGSEGEAKGDEHIEEVYPYEEGDLLMVRSIRLVSKLSLTIISHPKPYKLQWLNEQGEMIVNQQKAIHNGLTNEKTLTHGSKKFKLVPLTPSQVVGDQVQIKLKWDEEKNRKRKEEQPLIVKEECKEVSVSSKRLA

SEQ ID NO: 139363 - protein, 221 aa, Glycine max
  Coding DNA Sequence Number=SeqID_22585
  Homolog annotation: Hit_ID=Q8LLE5; Match level="QueryCoverage=90%, HitCoverage=26%, E-value=1e-18, Identity=36%"; Hit description =Coiled-coil protein
MEAEKLELEMDLTECEKQLQASLSRIKEVELEVVELQTKLALANKSNEEPYEKLKATHEKKEIDESKLRVAHTEAEELVLKICSLEEEIEKERALSAENLAKCGKLEDELLRIKNEAQLQKDTEIFHGEGVNSELKQTGTINSIVFNVNIVKCMMLKGLKLREGTSIGYNCKFAECQKTIESLGLQLKSLATLEDFLLDSESPMELACEVTPGQLALWSPM

SEQ ID NO: 139364 - protein, 109 aa, Glycine max
  Coding DNA Sequence Number=SeqID_22586
  Subcellular localization annotation: CTP_CleavageSite=59; ConfidenceScore=5.20e-01
MGADTTGSKTGHSSYKQSTTCNLHCNKGQRQDQAAQQQKRSWLWRRMSSKKNLGEIESSGSMSSHSERFSDDQVYPTQTTPSPEGTCEAAPNDEVNDVKTLTERLLLLF

SEQ ID NO: 139365 - protein, 809 aa, Glycine max
  Coding DNA Sequence Number=SeqID_22587
  Gene Ontology: Mol. function=DNA binding; Cellular component =intracellular; Biological process=DNA integration
  Homolog annotation: Hit_ID=Q1T2W1; Match level="QueryCoverage=62%, HitCoverage=78%, E-value=1e-126, Identity=44%"; Hit description =Integrase, catalytic region; Asp/Glu racemase
  Pfam annotation: Domain name=rve; Domain location=205-380; Score =96.6; E_value=7.7e-26; Accession=PF00665.16; Description=Integrase core domain
  Pfam annotation: Domain name=zf-CCHC; Domain location=175-192; Score =25.5; E_value=6e-05; Accession=PF00098.13; Description=Zinc knuckle
  Pfam module annotation: Pfam domain module=RVT_2::rve::zf-CCHC; Domain location=534-673::205-380::175-192
MEEQQLKDLKIKNYLYQAIDREILDTILNDEMSKNIWDSMKQKFQGSTRVKRAQLQALCKDFEMLQMKEGESVNSYFARTLKIAKSMKACGENMQESVIIANIMRSMTTKFNYVVCSIEESNNMDTMTIDELQSSLLVHKQRMMFPAEEERVMQMVADEKSGRGRGRQTFNKAEVECFKCHKLGHFQYECPMWENKANYAEMEDKEEQEDELLLMTFVDYKEGKKDEWFLDSGCSNLMSSNKEETTPKCNAKEKYMESIKEATAETLSFFKSFKALVEKEVGESIMCLRTDRGGEFTSKAFEEFCRSHGIRRQLTAAYTPQQNGVVERKNRTIMNMVSSMLSERQVPKNFWPKVTKWCVHILNRSPTATVQDKTPEEAWSGIKPSVDYFRVFGCLAHVHTPDQQRVKLDDKSKQCVLFGVSDESKAYKLFDPVNRKIIISKGVIFEEQKNWNWEQNEGENQQDIVDLGENEEYDTEEQPEDEANSEEQQHETETPNYEEGEGLSDDDNTNAMLVTEDDPVTFEEAVKSKKWRDAMVKKMEAIERNQTWELTNLPKGVKPIGVKWVFKTKFKENGEIDKFKARLVEKGYAQHYGVNYTELDVKSAFLHGELKEEIYVQQPAGFMKKGKEEKVYKLRKALYGLKQAPRNWKYAQEVLSRFGMKDCNTFKNPIVPGTKLSSNDAGTKVDATLFKQVVGSLMYLTATQLDLMYGVSLISRFMANPTKTHLFAAKRILRYLKGTTEFGIFYKKGENTKIVAYTDNDFAGDIENRKIHDVGYNVQDILPENTGVAAQCTRQDKRSEAAGSTMSDT

SEQ ID NO: 139366 - protein, 42 aa, Glycine max
  Coding DNA Sequence Number=SeqID_22588
TDPIGATPQVTPVPDQPLSQDSSAGTTALDLNEHAMDSAQDY

SEQ ID NO: 139367 - protein, 48 aa, Glycine max
  Coding DNA Sequence Number=SeqID_22589
METLAQRVDDRVVLTDIIGTLHALGNEVEVLVNGKPTKIRRLKLLLKE

SEQ ID NO: 139368 - protein, 49 aa, Glycine max
  Coding DNA Sequence Number=SeqID_22590
MCHNYEENWGMNQDMVHGGREAGILILMKLDHWKQRDSRHFAYSGHSII

SEQ ID NO: 139369 - protein, 936 aa, Glycine max
  Coding DNA Sequence Number=SeqID_22591
  Gene Ontology: Mol. function=ubiquitin thiolesterase activity; Biological process=ubiquitin-dependent protein catabolic process
  Homolog annotation: Hit_ID=Q9FPS8; Match level="QueryCoverage=62%, HitCoverage=56%, E-value=1e-140, Identity=48%"; Hit description =Ubiquitin-specific protease 16
  Pfam annotation: Domain name=UCH; Domain location=403-707; Score =179.9; E_value=6.2e-51; Accession=PF00443.19; Description=Ubiquitin carboxyl-terminal hydrolase
MGSGKCQIVHWRQDHKDKCHPPSPTCQTEDLVSDLGKKVAEPDYRGVHDEKSQIKSREYATSSDKPLLSDMRCSPDISCARDDSVRVESLQEGNVTGSNSELSSNSFSGFSASTGASESSDDSSVCESVTSNEHERCEGHIFVDPTIDIFYTTCNSIGESIPLSPKFASLVDLVDGNPAMHKLNQIRPDFSKQESKLTLNGSSGLCMWKGATIEPITVSSGFWNTTLDSTRIKDDSNSDPLASHYDDSAPKSVKNNMPCARSASSENEGVGCADALSIHNLQTVGLRVSNHVINTGSTLKSAQSRCLPHAFADTKLVSRTEEHSHYSTKCGNNGIIQSGSATSNSKNDLKTSVLKVSDQLRGSKLSKPFPSAVGSDITGKYSDKGLFPYDLFVKLYNWNRVELQPFGLINCGNSCYANAVLQCLAVTPPLTAYLLQGLHSKSCANKKWCFTCEFESLILKSKDTNSPMSPLGILSQLQNIGSQLGNGREEDAHEFLRLVVETMQSVCLMESGDNMSDSLKEETNLMGLTFGGYLQSKIKCMKCGGKSERQERMMDLTVEIEGEIATLEEALRQFTSAETLDGENKYRCVRCKSYEKAKKKMTVLEAPNVLTIALKRFQSGKFGKLNKPIRFPEILDLAPFMSGTSDLPIYRLYGVVVHLDIMNAAFSGHYVCYVKNFQSRWFKVDDSVVTAVELESVLAKGAYMLFYSRCSPRAPRLIRNSIVSSDSKWKLNGKTATMKSRRLSTGAGVNLTSPGGSASLDTLYSKFLHSKRILEEDSSSDNSSLISSNSDEGSCSTDSTADSTSTDDFADYIFGDVGRGAGGMLRNSDSNICPALPSFPHSGYFPSSDIDQHDSVVLPHSTGFQPSPSEEGLLYRNRVVDVKRSGGGVSHFHLDTNIEHRKLDTSSSSISFRETDSVFNDRNSGVSCTKSRYRTD

SEQ ID NO: 139370 - protein, 86 aa, Glycine max
  Coding DNA Sequence Number=SeqID_22592
  Gene Ontology: Mol. function=unfolded protein binding; Cellular component=chaperonin-containing T-complex; Biological process =cellular protein metabolic process
  Homolog annotation: Hit_ID=Q653F6; Match level="QueryCoverage=90%, HitCoverage=14%, E-value=3e-30, Identity=82%"; Hit description =Putative t-complex protein 1 theta chain
MDKLIHDDKGAVTISNDGATIMKLLDIVHLATKILADIAKSQDSEVGDGTTTVVLLAAEFLREAKPFIEDGVHSQNFIKLIFYIIN

SEQ ID NO: 139371 - protein, 178 aa, Glycine max
  Coding DNA Sequence Number=SeqID_22593
GTSFVVQVEGTSTWVVVTENKRGYISCGLVQVECTPTWLFKENKGGYIPCGSLLVKVLTRLKRNLKDRSQGHLIQHPHGDFSYIEFRCRCKLAHYCFIEEEQDGKPWYHDIKRYIECKEYPQGASGNDKRMLQRLETSFFLSGAKWRRRRVERRHHFKEKMSLEEAHHHRKAWIRASR

SEQ ID NO: 139372 - protein, 70 aa, Glycine max
  Coding DNA Sequence Number=SeqID_22594
PNDQRHPDTAEFVPLGRQKTLSSPDGEKVRNDHNLPPHVIGLAASGWKKVQNDHNLSLCAIGHDRLRMAK

SEQ ID NO: 139373 - protein, 91 aa, Glycine max
  Coding DNA Sequence Number=SeqID_22595
MEHTNLGIPGSCGSACPRPLGSCISFLNDHLEETLGPTKIGENHSKCINLTQVKVYDKLGFWLKACRTTGHDICQGLASGSGKKGMIHVQQ

SEQ ID NO: 139374 - protein, 190 aa, Glycine max
  Coding DNA Sequence Number=SeqID_22596
  Gene Ontology: Mol. function=protein binding; Cellular component =integral to membrane; Biological process=defense response to fungus
  Homolog annotation: Hit_ID=Q1SWI6; Match level="QueryCoverage=73%, HitCoverage=63%, E-value=8e-38, Identity=57%"; Hit description =Leucine-rich repeat, plant specific
  Pfam annotation: Domain name=LRRNT_2; Domain location=27-67; Score =49.3; E_value=1.3e-11; Accession=PF08263.3; Description=Leucine rich repeat N-terminal domain
  Pfam annotation: Domain name=LRR_1; Domain location=116-141; Score =8.2; E_value=8.2; Accession=PF00560.23; Description=Leucine Rich Repeat
  Pfam annotation: Domain name=LRR_1; Domain location=143-165; Score =11.2; E_value=2.3; Accession=PF00560.23; Description=Leucine Rich Repeat
  Pfam module annotation: Pfam domain module=LRRNT_2::LRR_1::LRR_1; Domain location=27-67::116-141::143-165
MNSSFFYILVFVQLWLFSLPCRESVCIPSERETLLKIKNNLNDPSNRLWSWNHNHTNCCHWYGVLCHNVTSHVLQLHLNTTFSAAFYDGYYHFDEEAYEKSQFGGEISPCLADLKHLNHLNLSGNYFLGAGMAIPSFLGTMTSLTHLDLSLTGFMGKIPSQIGNLSNLVYLDLGGYSVEPMLAENVEWVS

SEQ ID NO: 139375 - protein, 183 aa, Glycine max
  Coding DNA Sequence Number=SeqID_22597
ALRAELEKAQTVKERFKSAALKIRKENAELRDGRTRLKKFRGALWDNNRELKLWREERDQSRVDSLILKDGLKVCLRSKRSLSQCLCETKTNMLAIISKYQEELNLATAHEHKVADEYARVYAEKEARGRVIDTLHQEATMWLDQFALTLNGSQELPRLLAKAKAMVDTYSAPEEIHGLLSYC

SEQ ID NO: 139376 - protein, 78 aa, Glycine max
  Coding DNA Sequence Number=SeqID_22598
MARSVFTLCPYFRDLHGRKLKGLLVIIPKVVISLLMVSRGLTGASSKKGKCVESPPTFIRGKRWKNRKKRGLRALSVK

SEQ ID NO: 139377 - protein, 72 aa, Glycine max
  Coding DNA Sequence Number=SeqID_22599
MTPLMKKIQGLQAPHGATSGGSISLQDHATHFSEELGQSACLDEVFQQTHLRKNIGQFCWTSGLNNLRRGVN

SEQ ID NO: 139378 - protein, 81 aa, Glycine max
  Coding DNA Sequence Number=SeqID_22600
  Subcellular localization annotation: CTP_CleavageSite=62; ConfidenceScore=5.23e-01
MTSRDQVWSFCTLVSSRGGGPDDTRKYPSEADTVFCTFCSSGNNKSFTCGNFMVTRDSRQPRGAKLVSYTDFRPGDLCLMT

SEQ ID NO: 139379 - protein, 168 aa, Glycine max
  Coding DNA Sequence Number=SeqID_22601
MVIRHLCHPETTSPMACGDTYGHLPPLSSRDGKFDGTQRQHMVIRHLFHPELASPMARRNTSWLSAPLSSRDSKSDDTQRPIWSSSPFVEDTRSIDQDYFSLPSSSRDDKSDDTQRPICLSAPFVEDSMSIDQDYFSLPSSSRDGKFDDTQRPICSSAPFVEDLMSID

SEQ ID NO: 139380 - protein, 142 aa, Glycine max
  Coding DNA Sequence Number=SeqID_22602
MTCGDQSWSFATFVNERQASPLTRRYQHGHLHLFIKDPTSVDREYFSLHPAIQRHASPMFPLVSGDNQVRWHIETNMVVCFPRRKTQRLWIKITDVFPAISRQASPIACGDVTVIYFCHFQGTKALAVAPDVFYAISFDMFR

SEQ ID NO: 139381 - protein, 99 aa, Glycine max
  Coding DNA Sequence Number=SeqID_22603
MIGLYVSSDLPSLDDEGETKVVSINGLACLWLTKVADDHDWSLWWMTMIGLRVSSDLSSLHDEGETKVVTINGLACLWLTKVVDDHDWSPRVIGLAISG

SEQ ID NO: 139382 - protein, 363 aa, Glycine max
  Coding DNA Sequence Number=SeqID_22604
  Gene Ontology: Mol. function=nucleic acid binding; Cellular component= intracellular; Biological process=DNA integration
MELEQLDVKTFFLHGRLENNILMQQLEGFEKEMSQKHENGGVSSIGPIWAHLEDYGHFVASGGSNPGKLHQEATSSASWAGLSTLGIQNSLKISEKKKKEKIKAEELSYRFRDVSVINFVDVLHRSSFILHPSSIFNQLAFDFEALNSFYAPFGHTLGPHERPFRAPTRGQVVTRLKRPLYGLKQSPRQWYNRFDEFIVSHGEFEIKDMGASEKILDMEIKKDRVQNHYSVEMKDMGASEKILDIEIKKDRVQKIEKEYMSRVPYTSVVGSLRYGMGIVDIGLVYHDRFYALVGYSDFDYAADLDAKRFMISTISLAKDQVHHKRTKHIDIIHHFICSEKRVKVQKLDTRENPTDMFTKPVTR

SEQ ID NO: 139383 - protein, 76 aa, Glycine max
  Coding DNA Sequence Number=SeqID_22605
MVSKGFSYWVEGGVMQIIGKGNHVSNVLIDNFLWHLCLGHMSEKSLHILSKQGLLEITRWNLFNFVSTASMESNIE

SEQ ID NO: 139384 - protein, 102 aa, Glycine max
  Coding DNA Sequence Number=SeqID_22606
  Pfam annotation: Domain name=zf-CCHC; Domain location=68-85; Score =28.3; E_value=2.1e-05; Accession=PF00098.13; Description=Zinc knuckle
MVLNIIKIEKFTRKNNFNLWHIKIELRLKAFGNEDEAFVFRVSMTDSTKRQKKKKDKGGKKSKANPKDICNYCKKLGHWKRDCPKKANKDFVVALVQNDSSS

SEQ ID NO: 139385 - protein, 66 aa, Glycine max
  Coding DNA Sequence Number=SeqID_22607
MTITSPKSSLWYILRLHSDLMIGFMVHQLGDHANQWGNTWMQWSPKLQGIDKGMFILRIWCWPSAS

SEQ ID NO: 139386 - protein, 152 aa, Glycine max
  Coding DNA Sequence Number=SeqID_22608
  Gene Ontology: Mol. function=structural constituent of ribosome; Cellular component=ribonucleoprotein complex; Biological process =translation
  Homolog annotation: Hit_ID=Q9M5M7; Match level="QueryCoverage=54%, HitCoverage=45%, E-value=1e-36, Identity=76%"; Hit description=60S ribosomal protein L10
  Pfam annotation: Domain name=Ribosomal_L10e; Domain location=3-125; Score=98.4; E_value=2.1e-26; Accession=PF00826.8; Description =Ribosomal L10
MVFDLGPAKCYRQIKNKSYSKSRFCHSVPDPKTRIYDVGMKKKGVDEFPFCVHLVSWEKENVSSEALEGAFHLRVRVHPFHVLRINKMLGIILLGFTKFGRNDYLKFKSEYKIMSDGVMPSFLGAMDHWLTANQEELVCLVILHSVLVTKKY

SEQ ID NO: 139387 - protein, 171 aa, Glycine max
  Coding DNA Sequence Number=SeqID_22609
  Gene Ontology: Biological process=response to biotic stimulus
  Homolog annotation: Hit_ID=Q5DQ85; Match level="QueryCoverage=86%, HitCoverage=80%, E-value=7e-71, Identity=87%"; Hit description=CAPIP1
MITFLREGTFLIEIALNVYVLLAPSMPVWSLVRRFDQPQKYKPFISRCVVRGNLEIGSLREVDVKSGLPATTSTERLELLDDNEHILSIRIIGGDHRLRNYSSIMSLHPEIIDGRPGTLVIESFVVDVPEGNTKDETCYFVEALIKCNLKSLADVSEGLAVQDCTEPIDRI

SEQ ID NO: 139388 - protein, 121 aa, Glycine max
  Coding DNA Sequence Number=SeqID_22610
MSSRGKKTISFLRVSPLFEQNCNCGQGFSKRFGPHKTDSERHSGPTTEVPRRQGEGYGQSRRLGPVYGCVSFANFWGRPLSKRGWFGAKRVAHGSSVAYPPSVFGWFHTCSNKTQDIHVRS

SEQ ID NO: 139389 - protein, 84 aa, Glycine max
  Coding DNA Sequence Number=SeqID_22611
MEALEEDYGDGNGKNESRQYIEGLKLLCHHGPHVSKANTNGNDADVAPKFSPLKIVQFGNPSQDTVDPRDGDFGGRLWRWKWEK

SEQ ID NO: 139390 - protein, 181 aa, Glycine max
  Coding DNA Sequence Number=SeqID_22612
GGEVFRVRPGVVGSSGISRIGVEGSDCKSQGVPSVVELMILAVVSPMKNQLMKSIIWGTSQDTISMQYGQWRNHPGNPFNKDQGGPSTRMQQQGPSLYDRTTKLEETLAQFMQVSMSNHKSTESAIKNLEIQVEQLAKQLADRPSSSFSTNIEKNPKEECKAVMTRSRMATHVDEGKADKK

SEQ ID NO: 139391 - protein, 109 aa, Glycine max
  Coding DNA Sequence Number=SeqID_22613
MDELKRLSIPSEMLKFFNHSSFPHKGHPTRKISMQQGQADILIARFLDPNYGVKMGSSRCGVSTENNGGPWWPPVVVGGGEEAWDVGNGFGRKKEKGMTFLQGYTKNNV

SEQ ID NO: 139392 - protein, 63 aa, Glycine max
  Coding DNA Sequence Number=SeqID_22614
  Homolog annotation: Hit_ID=Q5DQ85; Match level="QueryCoverage=51%, HitCoverage=17%, E-value=2e-07, Identity=75%"; Hit description=CAPIP1
MNRIGNGGGGGGGLSNVEMEYIRRHHRHEPGENQCGSALVKHIRAPVPQVLEANVCIRSVSWR

SEQ ID NO: 139393 - protein, 129 aa, Glycine max
  Coding DNA Sequence Number=SeqID_22615
  Gene Ontology: Mol. function=sequence-specific DNA binding; Cellular component=nucleus; Biological process=regulation of transcription, DNA-dependent
  Homolog annotation: Hit_ID=Q5D1M2; Match level="QueryCoverage=100%, HitCoverage=19%, E-value=2e-59, Identity=72%"; Hit description=Class III HD-Zip protein 5
MPPVKHFVRAEMLPSGYLIRPCEGGGSIIHIVDHMDLKPWSVPEVLRPLYESSTVLAQKTTMAVWGFNEALNGFTDEGWTTIGNDGVDDVTILVNSSPDKLMGLNLSFANGFPSVSNAVLCAKASMLLQ

SEQ ID NO: 139394 - protein, 203 aa, Glycine max
  Coding DNA Sequence Number=SeqID_22616
  Gene Ontology: Mol. function=protein serine/threonine kinase activity; Cellular component=integral to membrane; Biological process=protein amino acid phosphorylation
  Homolog annotation: Hit_ID=Q5NJB1; Match level="QueryCoverage=85%, HitCoverage=27%, E-value=3e-63, Identity=66%"; Hit description=S -receptor kinase-like protein 1
  Pfam annotation: Domain name=Pkinase; Domain location=48-203; Score= -14.5; E_value=1.1e-07; Accession=PF00069.15; Description=Protein kinase domain
  Pfam annotation: Domain name=Pkinase_Tyr; Domain location=48-203; Score=-22.4; E_value=4.3e-11; Accession=PF07714.7; Description =Protein tyrosine kinase
  Pfam module annotation: Pfam domain module=Pkinase::Pkinase_Tyr; Domain location=48-203::48-203
MTTRTENKMLKLVALDRYAVGKHHFEVKKRRDSKVFSYASIIAMTNRFSVENKLGEGGFGLVYKGKLPTGEDMAIKRLSKGSGQGAIEFKNELNLISELQHMNVIQILGCCIHGEERMLIYEYMANNNLDFFLFDHNRRMLLDWKRHFNIIEGIAQGLLYLHKYSRLKVVHRDLKASNILLDENMNPKISDFGTARIFSPQES

SEQ ID NO: 139395 - protein, 110 aa, Glycine max
  Coding DNA Sequence Number=SeqID_22617
MQDLHPVYWASGLLRNKRFEHIPEEVQLMYEYNIVSNEEEDSFSYTTPNGVSQWVLFHNGQLKDTTRGSEIARADTFYGYNTDGGCQRWEQPTCRKKSYQRGTATTQAKS

SEQ ID NO: 139396 - protein, 66 aa, Glycine max
  Coding DNA Sequence Number=SeqID_22618
MAQESSEIALQGEIISKKLFMIQNHEEAIKTTTTILTDPSMDTMCKLANDGARSKMKKTTQESRMT

SEQ ID NO: 139397 - protein, 85 aa, Glycine max
  Coding DNA Sequence Number=SeqID_22619
MSAIDFLRSQANVFLTEVMRTCQCRPKHNFGSARTKCQRRPTLLKVQLEKDKAPEWRRMKAQVEMDEGPEAETLSRLLIVAEGPN

SEQ ID NO: 139398 - protein, 259 aa, Glycine max
  Coding DNA Sequence Number=SeqID_22620
  Gene Ontology: Mol. function=DNA binding; Biological process=DNA integration
  Pfam annotation: Domain name=zf-CCHC; Domain location=25-42; Score =28.0; E_value=2.4e-05; Accession=PF00098.13; Description=Zinc knuckle
MTDSTKRQKKKKDKGGKKSKANPKDICNYCKELGHWKRDCPKKANKDFVVALVQNDSSSHWVVTYEKKFGSNVLLGKDDPCKSISIGSIQIRMHHGVVRTLIEVRHVPKLKKNLVFMGAMDSKGFSYWVEGGVMQIRGKGKKQHRMKFPKVEHTIKAMLDYVYFDCLGPSRAPSLGGARYFLSIINDPSRMTWTSRPLFAYGHKPFEYSMLKVFGFQAYYHASEDFGKAKDVTKQVEFESSTIKNISDQKQFEALDETN

SEQ ID NO: 139399 - protein, 143 aa, Glycine max
  Coding DNA Sequence Number=SeqID_22621
  Gene Ontology: Mol. function=nucleic acid binding; Cellular component= oxygen evolving complex; Biological process=DNA integration
  Homolog annotation: Hit_ID=Q1S1X7; Match level="QueryCoverage=66%, HitCoverage=9%, E-value=3e-23, Identity=49%"; Hit description =Integrase, catalytic region; Zinc finger, CCHC-type; Peptidase aspartic, catalytic
MAMNEKMESLHKNQTWDLVELPEGKQVVGYSQKEGVDFNEIFSLVVQHTSICVLLDLMATLDTELEQLDVKTSFLHGRLENDILMQQLEGGSNPARLGELGGHHLPHFAIKCHRGAERKGSSTLGKHISLKISEKKEKEEENQ

SEQ ID NO: 139400 - protein, 102 aa, Glycine max
  Coding DNA Sequence Number=SeqID_22622
MPFCAFMSALRYHACVVFWSHHFVTGSRKVRVAFLSAYMGHCAAKYCKKGCTLRHPYRTRARARVMGELDEVQARIKVDLEAMKEKIATMMEAMMSMKKIME

SEQ ID NO: 139401 - protein, 95 aa, Glycine max
  Coding DNA Sequence Number=SeqID_22623
MLCRDDSRGTPSPGPRESHLTDLSSLAHEAPGFVFVARTRRPGARGAVVIPSLPTRTAHVAAIRTLHRTIQSVGATGGVYKGQGRSQRELMTRAY

SEQ ID NO: 139402 - protein, 72 aa, Glycine max
  Coding DNA Sequence Number=SeqID_22624
MQVPDFDDAEKNSLDNDCHHPKGEEESNEVASTNIQRLSIALRLIQGFFDKHSNIKHCFKTNTRLLQQAFKV

SEQ ID NO: 139403 - protein, 275 aa, Glycine max
  Coding DNA Sequence Number=SeqID_22625
  Gene Ontology: Mol. function=signal transducer activity; Cellular component=membrane; Biological process=signal transduction
  Homolog annotation: Hit_ID=UPI00005F72E6; Match level="QueryCoverage =99%, HitCoverage=22%, E-value=3e-50, Identity=41%"; Hit description =COG3523: Uncharacterized protein conserved in bacteria
  Pfam annotation: Domain name=ImcF-related; Domain location=2-208; Score=2.8; E_value=1.3e-06; Accession=PF06761.2; Description=ImcF -related
MLNISRELPQNVTQQEVKQLAWHLQQLLETQIQSSPYAKDDALVKREQALINQMPLSQRVYGRLKRLLQRDGSLQPVTLAALGGPQSELVFSRKSGKSVNDGVAGLFTPDGYWQHVDKQIAPVTQALFQDDVWVLGGVASPENSQQTDLAVRQLYVQDYIRQWEQFLSDIQLNSSADLSQRINTARLLSGNHSPLRQLVVNLSKLLTLNRAQPDEQSAQAQPATGNSATRTLEALFSSSKASAAPGQGAAQQAPEHAVAVHFAPVLELAQPLQHG

SEQ ID NO: 139404 - protein, 52 aa, Glycine max
  Coding DNA Sequence Number=SeqID_22626
MNEDGDWSSRGMAKHNIVQETKDNPTTRSDENVDQNNTNLGHSANQHASRSE

SEQ ID NO: 139405 - protein, 128 aa, Glycine max
  Coding DNA Sequence Number=SeqID_22627
  Gene Ontology: Mol. function=nucleic acid binding
  Homolog annotation: Hit_ID=Q1RVR4; Match level="QueryCoverage=68%, HitCoverage=32%, E-value=3e-10, Identity=31%"; Hit description =Peptidase aspartic, active site; Aldehyde dehydrogenase
MMLEDDDFDDGEIQVINVEVKEEAENEGELSVMSLQGLVAHQVSKFHTMRLQGKEQGVPILLLIDSGATHNFISHKLVAAMGWSVANTTPLQIKLGNGSKTQTQDGIDIVLGMAWLNSIGSMWVDWPK

SEQ ID NO: 139406 - protein, 161 aa, Glycine max
  Coding DNA Sequence Number=SeqID_22628
  Gene Ontology: Mol. function=DNA binding
  Homolog annotation: Hit_ID=Q1SFS3; Match level="QueryCoverage=91%, HitCoverage=28%, E-value=2e-17, Identity=37%"; Hit description =Lambda repressor-like, DNA-binding
MIEVSVEAIASLTQYYDQSLRCFTFGDFQLAPTIEEFEGILGCPLGGRKSCLFARFYPSRARIEKVVKILEQELDQVKQNRNGVVGIPRKRLEEKAKALANQGEWTSFIDILALLVFGTILFPNVDGPVDLAAINAFLAYHHSKESPVIAILADAYDTFDL

SEQ ID NO: 139407 - protein, 89 aa, Glycine max
  Coding DNA Sequence Number=SeqID_22629
MAFGTMAACPGKLMLHPEVTGSLRRAGSFSPKQFGGLGEPEASLGELGSKKLPKKTLLPLPFGIFLILDQNIKRSFILRGNWCRTTQFG

SEQ ID NO: 139408 - protein, 138 aa, Glycine max
  Coding DNA Sequence Number=SeqID_22630
MMQSYPPRVLDRRLQKDWSRATKEDPRVLMNFGRFLSPGAKELLIEDDEDAPPIKFFKARPRRLFKHELEALKQKIELTNLDWYATTSFYGLKEYYSGLESDEKPPVDVVHHKVRQHYETLNHSCFTQETVGQVTLIT

SEQ ID NO: 139409 - protein, 261 aa, Glycine max
  Coding DNA Sequence Number=SeqID_22631
MASRKRKATTSQPREPYDTTRFVSEVASERYSQNVHSRNILPERDVNLFVTVYHEFRRELIRRNWHKALTQHIDGHIDVALVKEFYSNLYDPEDKSPKQVRGMLIKFDATSLNAFLETPPLIQPGEQYPSYSIFCRTRTDPQELASKLCILGRMFVLNAEGAPWKLLRKDLNTLAQTWRASARTSPEATPEATPRTSPITSPVLEVSNEEDGAADADYAADMIVAQSTWDPWPVTTQDISQPVQDAPSSPLDEPTAAQEEP

SEQ ID NO: 139410 - protein, 239 aa, Glycine max
  Coding DNA Sequence Number=SeqID_22632
MDRVSLVYGLVMKMEMDVGSIISGQISQMAQSNSYRLEFPALITALCTSRGVIPNSLTFESLSPAINLDYIRKNCWNPDDSTITFTGTHKARARGPSNTSTSTPASTPTPASAPALALALLATTAPSNPSTSTRDAIVPMLSPVFSYRGGEASIAQEPQPDPEATLDDTPEETSEDTSAATPMEVTKEGDGIADIDYVADMTVAQGTWDPWPTPAQDTPLPAQDAPSSPLDDPTPAQEE

SEQ ID NO: 139411 - protein, 89 aa, Glycine max; identical to SEQ ID NO: 135359
  Coding DNA Sequence Number=SeqID_22633

SEQ ID NO: 139412 - protein, 119 aa, Glycine max
  Coding DNA Sequence Number=SeqID_22634
MVHPLGFFKENKGGYIPCGSLACKGFYKVERNLKNRHLIQQTREALAQALQYRAHAEKEARKWFLIGDYFYNKITGWKPLCPPMPFGTPIHLSFDSYDFGDEFLKKLNEEVPKQKGDKK

SEQ ID NO: 139413 - protein, 131 aa, Glycine max
  Coding DNA Sequence Number=SeqID_22635
VVPSMVRLMKQANVFMLKKTHKKFIIWEINRDKGILKEDFQDSSRVLIISKDSGGRTRAISSTKTRVGQLAKQIADKSSNSFVANTEKNAKEEYKAVMTRSKRFVEDEEEESVGLRKKAIEKKGTDGKKNE

SEQ ID NO: 139414 - protein, 65 aa, Glycine max
  Coding DNA Sequence Number=SeqID_22636
MKTGVKIIHASGISGSIAYNWSWLNMKTGVKIIHASWGYIQMQGINTSTLSFDHEHADVNLFKPF

SEQ ID NO: 139415 - protein, 124 aa, Glycine max
  Coding DNA Sequence Number=SeqID_22637
  Homolog annotation: Hit_ID=Q9LTU4; Match level="QueryCoverage=38%, HitCoverage=3%, E-value=5e-09, Identity=62%"; Hit description =Helicase-like protein
MRIAELLNEASLIIWDEGPMAHKFCFEALDQSLRDIIKAKSSPHKIFGAKHLPSCGFHMTILRRFGPPLQWTVVTLDVGTGDKYVVQPWYQFLAQGDFIHGDKLSFYYRPHDKIWEIVIRRQKN

SEQ ID NO: 139416 - protein, 152 aa, Glycine max
  Coding DNA Sequence Number=SeqID_22638
MDEDVLRQREEIYGGPEARKQMRICSNASLPSHQTISWCDKLATESRKNWDSYSSSKDATIGAEKAQSHQTLEGRESMIKEFPPRQTIALNPNSLIFYQWPTDIKMYPSGASEIQLETPEESLNFQDWELSSYDLELRMKLSAYKEEIRSGQ

SEQ ID NO: 139417 - protein, 58 aa, Glycine max
  Coding DNA Sequence Number=SeqID_22639
MPLTPAPMMAILETEIGGLSRVVAMVAKKLGYDEVRLSQYIKHYKGMKLHADVKSEST

SEQ ID NO: 139418 - protein, 103 aa, Glycine max
  Coding DNA Sequence Number=SeqID_22640
MESDPTSHHKHSAIFNGDDATRVYQNSDGVKPGVCSNRWGINISWENVPIQKTWFIEHNNRCSSLTTLNPTVWMLQIQGLLDISIVPQMNKDHLDAVTLSFGP

SEQ ID NO: 139419 - protein, 94 aa, Glycine max
  Coding DNA Sequence Number=SeqID_22641
  Homolog annotation: Hit_ID=UPI000034F3B5; Match level="QueryCoverage =69%, HitCoverage=5%, E-value=3e-19, Identity=66%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
MIFASNPNPKKVYLIGGLQVEFPYQPYGSQFAFMARVISTLNLAQKEGHCHTLLESPSGTAIVLLLVSEIPDHTQFEINNKKQKKKEAHHILSS

SEQ ID NO: 139420 - protein, 106 aa, Glycine max
  Coding DNA Sequence Number=SeqID_22642
  Gene Ontology: Mol. function=DNA binding; Cellular component=nucleus; Biological process=DNA integration
MRCKWIFKKKSGSSTKEVIHYKARLWKLWTQLEKLDVKTIFLDGRLEEDIMINYQGNGTRDLMSSLFLMCTSEVPKTHVFIIASSEFEMKDMRVAEKILGMEIKKD

SEQ ID NO: 139421 - protein, 174 aa, Glycine max
  Coding DNA Sequence Number=SeqID_22643
  Gene Ontology: Mol. function=nucleic acid binding; Biological process= DNA integration
MVHTIKIEKFIGKNSFNLWRIKMQALLKEYGIWAPLSCQPSKIDKSVLELYEEKAHSLILLSMSHEVIGGKSVQRKQRKILLLLLFRITPHWKAIWLWLLVNNYNNIMNNEYWTQVVLIICVHTYIGFVQIRMQDGVVRTLTIVHHVSKLKENLVSMGVMDSKGFSCWVEGEVM

SEQ ID NO: 139422 - protein, 77 aa, Glycine max
  Coding DNA Sequence Number=SeqID_22644
MDSFHLKDKVFLQEGGNDSTSIPIGPIPNVTSTITDVGPHTNDDDAIKGRLKCISKRPTGWKDFIHKDLDSLNLGAM

SEQ ID NO: 139423 - protein, 212 aa, Glycine max
  Coding DNA Sequence Number=SeqID_22645
MVLEEENGLDDNLFVDQIETKIIKGKPYSCPALRFFKGEEAKGNKPYIFYTSKAEQIFDYLVKDQHIQFPKGQKIPHLEELRNKRYYKGYNAYNHSTTNCLTSAPFPSTDISMVSTSRMPPKFKQNGIKNSWESNTLPKRKHDTWQGKSPSERQVAKVNVKEGVTTLKITIMNQGNDALIPMTDVGILLMEFTSQDQLMATIKCDVLADEGE

SEQ ID NO: 139424 - protein, 323 aa, Glycine max
  Coding DNA Sequence Number=SeqID_22646
  Gene Ontology: Mol. function=DNA binding; Cellular component=oxygen evolving complex; Biological process=DNA integration
  Homolog annotation: Hit_ID=Q1SS72; Match level="QueryCoverage=99%, HitCoverage=21%, E-value=1e-112, Identity=62%"; Hit description =Integrase, catalytic region
MEGLDYLDTFSPVAKLTTVRFLLAIAAMNNWHLRQLDVNNAFLHGELDEEVYMQVPPGLTIQNPNLVCRLQRSLYGLKQASRQWFLKLSSLLTTHGFQKSQSDHSLFLRFTGSITTILLVYVDDIILTGNSSSEIQEIITILDQTFKIKDLGNLKYFLGLEVARSSNGIHLSQRKYTLDILSDSGMLGCRPNTTSMDYSTKLHTTAGTPLSDAESSSYRRLVGRLIYLTNTRPDIMYAVQQLSQYMSSPTNMHLQAAYRVLRYLKSTPGSGVFFSATSIPQLRAFSDSDWAGCQDSRRSITGFVVYFGSSLVSWQSKKQNTVS

SEQ ID NO: 139425 - protein, 205 aa, Glycine max
  Coding DNA Sequence Number=SeqID_22647
  Homolog annotation: Hit_ID=Q6EP30; Match level="QueryCoverage=78%, HitCoverage=73%, E-value=8e-40, Identity=48%"; Hit description =Ferredoxin-like
MVFISTPGIQVGNPASNIVDIINKNLTDQKLPRLNDSPGLGCMALQYVELCKGNCTDNNVVNCKPPEDDFTEVFAPNCGVELPTFGTITGHIVGCQRKYLEPSLAFSEVLIKDEKSLSLLKNKSHTEVGVGLVGLHKGPFFWCVLFSNGKTNSTFVLENHGAGIQQKKGCYSGSTTPCSRGQKSRVAFFNIFFMCYVSILLFKLW

SEQ ID NO: 139426 - protein, 98 aa, Glycine max
  Coding DNA Sequence Number=SeqID_22648
MDVVGENKSWQKETTAKEVQQHTATEVVLLHHMLLYKIGKKGVIGDGFALQRGHKRTQRWSHVAVISSVIQYFFLKCYPISTNVFRWVPWFLEYCDYE

SEQ ID NO: 139427 - protein, 71 aa, Glycine max
  Coding DNA Sequence Number=SeqID_22649
  Subcellular localization annotation: CTP_CleavageSite=24; ConfidenceScore=5.01e-01
MEGVPQFDLLSSQKQKVTISHTVKDSNEMATTTTKQSKALLPTSEFSAVLIFKKSNIIFILKGPRMKEYLD

SEQ ID NO: 139428 - protein, 403 aa, Glycine max
  Coding DNA Sequence Number=SeqID_22650
  Homolog annotation: Hit_ID=Q1SGA1; Match level="QueryCoverage=14%, HitCoverage=11%, E-value=5e-07, Identity=52%"; Hit description=Heat shock protein DnaJ, N-terminal
  Subcellular localization annotation: CTP_CleavageSite=27; ConfidenceScore=5.19e-01
MSKRNKELPIEVAPTVTVLPSPLPPPSPSTRGRRGYIISPRLVGISLEANTTSTATIGGSNAFSIKEHQVKPLIPGSQEQRRRGFPPRTAAGPQRVPVGVKKKVESTILFFYEIEVLARAIDIENKVPIEVVVGDWLLGGEEDVDDGQDLFADCDKDCGGGVGAEVPRGGGQGLQDPTAGCGGGEEREAGGHGGGSEVTFATKTMEGEDQYPKQISTFMRFVLRSLPGFMSTPPSPHVLPFVSPVTARPVVVVLCFSAEEPLGEKPVVMRMKSPSGECPQHLHIGNKKLHLLLRMFNMRIMKMTRPHDTSVLMDYVYHLAVKVWNGDERLELKLSSYGRKVEKFGRPTPEIEGLVVVTGLSPMIACSLETRTFHSFETLRVNDVVFLLVELLEVSSEEARAET

SEQ ID NO: 139429 - protein, 339 aa, Glycine max
  Coding DNA Sequence Number=SeqID_22651
  Gene Ontology: Mol. function=oxidoreductase activity, acting on single donors with incorporation of molecular oxygen, incorporation of two atoms of oxygen; Cellular component=proton-transporting two -sector ATPase ...
  Gene Ontology: Cellular component=complex; Biological process=ATP synthesis coupled proton transport
  Homolog annotation: Hit_ID=Q1S835; Match level="QueryCoverage=96%, HitCoverage=95%, E-value=1e-112, Identity=55%"; Hit description=2OG -Fe(II) oxygenase
  Pfam annotation: Domain name=2OG-FeII_Oxy; Domain location=214-287; Score=79.1; E_value=1.4e-20; Accession=PF03171.10; Description=2OG -Fe(II) oxygenase superfamily
MGTTTDLNFDYVLSQRKAFDETKAGVKGLVDVGVKNVPTFFHHQTEKFEKASNIGNKSHVIPIIDLADIDKDPSKRQGLVDIVKKASETWGFFQVINHDIPLSVLEEMKNGVKRFHEMDTEAKKEFYSRDRSKSFLYNSNFDLYGSQPAINWRDSCRCLLYPDTPKPEELPVVCRDILLEYRKHIMRLGILLLELFSEALSLSPNYLKDMGCADGLLALCHYYPSCPEPDLTMGITMHSDNDFFTVLLQDHIGGLQFITNDRFKSAEHRVLANDVGPRISVACFFSPSAKTSLKLCGPIKELLSEENPPKFRDITFGDYEAYYLAKGLDGTSALTRYRI

SEQ ID NO: 139430 - protein, 101 aa, Glycine max
  Coding DNA Sequence Number=SeqID_22652
MYENLNDASKSTTRQLVRYITLLQTSAHATCDTFVEPDVAQHPVAATTMDEAPKDAYPDEACQEIAKRLERLLNLRIMTKGTEAYTITKERMRIARGVTVQ

SEQ ID NO: 139431 - protein, 217 aa, Glycine max
  Coding DNA Sequence Number=SeqID_22653
MKQDVNKNANNRTRTKTQTWTEYKEKDLDRIKTVSRAEALIPDDVILTRSGSLDTGYEDLDNATSNDEPVVPATEADGASVEADVYANEPRARGDVHDTGVDTPTDTGAQAVEDEPEGFLSGPRDPSVLTEYADHVARSVWTGEMMLTNCVFLYTSIKERPELKLSSHGRKVHSLGRSVPAIEGLVVGTGLSPLTACSIVIEAVPESNKHENAVTRK

SEQ ID NO: 139432 - protein, 72 aa, Glycine max
  Coding DNA Sequence Number=SeqID_22654
MADAASSRFSHQKDRWIGRALGLHHSPTHLHLHVNLDDATSANNDCQSVHATIAADKERGKKTYRLLRVKTN

SEQ ID NO: 139433 - protein, 70 aa, Glycine max
  Coding DNA Sequence Number=SeqID_22655
MVRTRGLGHALGHDTGRGVGRGDRDDSDDAPQRRRPTTSARRQCDVILTRSGSLDTGYGDLDDATSSEGR

SEQ ID NO: 139434 - protein, 89 aa, Glycine max
  Coding DNA Sequence Number=SeqID_22656
  Subcellular localization annotation: CTP_CleavageSite=44; ConfidenceScore=5.34e-01
MGSGAQTLLTLTLLFLIAALQLSFSLYDSHSRSLTVTQLFTARRAHHATTTFSLYDSHSHSHSRPLVLALTHSSTHFSSRSRLRKENAC

SEQ ID NO: 139435 - protein, 705 aa, Glycine max
  Coding DNA Sequence Number=SeqID_22657
  Gene Ontology: Mol. function=zinc ion binding; Cellular component =actin filament; Biological process=protein transport
  Homolog annotation: Hit_ID=Q1RYE4; Match level="QueryCoverage=99%, HitCoverage=73%, E-value=0.0, Identity=87%"; Hit description =Cytochrome cd1-nitrite reductase-like, C-terminal haem d1
  Pfam annotation: Domain name=Clathrin; Domain location=402-553; Score= -15.3; E_value=0.068; Accession=PF00637.10; Description=Region in Clathrin and VPS
MYQWRKFEFFEEKYGAKCAVPEADEDDSGVIAAERKIECCSSGRGKVVTGFDDGVVCFFDRGLKFNYAFQPHSSSVLFLQQLKQRNFLVTIGEDEQLTPQQTALCLKVFDLDKMQSESSSTTSPDCVGILRIFTNQFPEAKITSFLVLEEVPPILLIAIGLDSGSIYCIKGDIARERITRFKLQVENNHSDKTLSAVTGLGFRVDGQSLQLFVVTPSSVSLFSLHDQPPRRQTLDQIGSGVNSVAMSDRSELIIGRPEAVYFYEVDGRGPCWAFEGEKKLLGWFRGYLLCVIADQRTGKHTFNIYDLKNRLIAHSALVKEVSHMLYEWGNIILIMNDKSALCIGEKDMESKLDMLFKKNLYTVAINLVQTQQADAAATAEVLRKYGDHLYSKQDYDEAMAQYIHTIGHLEPSYVIQKFLDAQRIYNLTNYLEKLHEKGLASKDHTTLLLNCYTKLKDVEKLNLFIKSDDSIGELKFDVETAIRVCRAANYHEHAMYVAKKAGRHEWYLKILLEDLGSYEEALEYISSLESSQAGMTIKEYGKILIEHKPVETIQILIRLCTEDGDKRGRSNGVYMSMLPSPVDFLSIFIHHPQSLMDFLEKYTNKVKDSPAQVEIHNTLLELYISNELNFPSMSQVNDGGNYLNGASAKTMILSAQSNGNIGDHKSSEQEKNHLERLEKGLRLLKTAWPPETEHPQYDVDLAIIL

SEQ ID NO: 139436 - protein, 180 aa, Glycine max
  Coding DNA Sequence Number=SeqID_22658
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=95%, HitCoverage=31%, E-value=2e-74, Identity=77%"; Hit description =Glucosyltransferase-13
NHKFLWVVRAPSSLARDAYFSTQKDVDPMQILPSGFLEKTKEQGTVIPSWAPQIQVLSHSSVGGFLTHCGWNSTLEGVLKGVPLITWPLFAEQRMNAVLLCEGLKVGVRPRVSENGLVEREEIVKVIKCLMEGEEGGKMSGRMNELKEAATNALKEDGSSTKTLSQRRWSTMILGTNGCY

SEQ ID NO: 139437 - protein, 466 aa, Glycine max
  Coding DNA Sequence Number=SeqID_22659
  Gene Ontology: Mol. function=transferase activity, transferring glycosyl groups; Cellular component=integral to membrane; Biological process=metabolic process
  Homolog annotation: Hit_ID=Q8S996; Match level="QueryCoverage=96%, HitCoverage=80%, E-value=0.0, Identity=75%"; Hit description =Glucosyltransferase-13
  Pfam annotation: Domain name=UDPGT; Domain location=5-466; Score= -62.2; E_value=1.7e-07; Accession=PF00201.9; Description=UDP -glucoronosyl and UDP-glucosyl transferase
  Subcellular localization annotation: CTP_CleavageSite=44; ConfidenceScore=5.10e-01
MEKTVHIAVVPGPGFSHLVPILQFSKRLVQLHPNFHVTCLIPTLVSPPSASISILQTLPPNINTIFLQPVKPEDLPQGATIETQIQLIVALSMPSIHQALKTLTSRTRFVALVADSSAFDALDFAKEFNMLSYIYLPISATTLSWYFYVPMLDKETSCEYRDFPEPIKIPGCVPIHGRDLNNIVRDRSSEVYKTFLQRAWRFRFVDGVLMNTFLEMETSPIRALKEEGRGYPPVYPVGPIVQSGGDDTKGLECETWLDKQQVGSVLYVSFGSGGTLSQEQINELACGLELSNYKFLWVVRAPSSLASDAYLSAQKDVDPLHFLPCGFLERTKEKGMVVPSWAPQIQVLSHSSVGGFLTHCGWNSILERVLKGVPFITWPLFAEQRMNAVLLCEGLKVGVRPRVSENGLVQREEIVKVIKCLMEGEEGGKMSGRMNELKEAATNALKEDGSSTKTLSLLALKWKSLV

SEQ ID NO: 139438 - protein, 76 aa, Glycine max
  Coding DNA Sequence Number=SeqID_22660
MESPTVATYPLAGGRRETHGCIFQGRKMHRVTTNVYLRKTSEKPERCGLRTLIVKGSRVVFMHGECISTPRVHHKG

SEQ ID NO: 139439 - protein, 42 aa, Glycine max
  Coding DNA Sequence Number=SeqID_22661
MEAISKQFEELDVCGKMTLKSKFWEIAYSDLNSMCTPPEKVW

SEQ ID NO: 139440 - protein, 184 aa, Glycine max
  Coding DNA Sequence Number=SeqID_22662
MEVPLSYHRQWSPNYPNYVLFDYEGDKHFIKLHKYGNRFYFGDGLKELRRIHGIHESVLMRFVGRDKNTTFSVDIVGPLHQRAAPTIRHHVFTIDVSEDMIQQNYQLVLPPEASIYLTASKKYMVVDRGSGRHKKWMITMNNGLSCVTDAWIHYLGDCHLKAEDEVIFFYNIDQHLWEVLYRKQ

SEQ ID NO: 139441 - protein, 217 aa, Glycine max
  Coding DNA Sequence Number=SeqID_22663
MVVMMIHGYNPHLQFAFRLSHFLMVWPLQSFHRPWSPQLQLCIGLVSLQVNDNSTERSLNCFPQGNCHLFWFNLGTWEVHNLAWHFMPRMLDADCWFLFRWMDFPALLTNLVRLLESQRFGNIGGVFKAVFGVLALEKRDVDYTFMAKFVAALMVREGIFHWDGENCLFILSKSLSSLTSPKPGVKGGSQGGSMRIVLGRLMRMVIENQMHKANYVK

SEQ ID NO: 139442 - protein, 127 aa, Glycine max
  Coding DNA Sequence Number=SeqID_22664
  Gene Ontology: Mol. function=transferase activity, transferring glycosyl groups; Cellular component=endoplasmic reticulum; Biological process=dolichol-linked oligosaccharide biosynthetic process
  Homolog annotation: Hit_ID=UPI00004BB525; Match level="QueryCoverage =42%, HitCoverage=13%, E-value=5e-17, Identity=72%"; Hit description =Dolichyl-P-Man:Man(7)GlcNAc(2)-PP-dolichyl-alpha-1,6- mannosyltransfe rase (EC ...
  Homolog annotation: Hit description=2.4.1.-) (Mannosyltransferase ALG12 homolog) (hALG12) (Membrane protein SB87).
MASNSKSETFLQRNGYDFLLGSIAAFYVLTVPYTKVEESFNVQAMHDILYHRLNLDNYDHLEFPGVVPRTFLVKCFACVINCSTVCVNCKFAAFAEVLCSSHRSLTYICQEVSSYYSFVWMPENLYR

SEQ ID NO: 139443 - protein, 96 aa, Glycine max
  Coding DNA Sequence Number=SeqID_22665
  Subcellular localization annotation: CTP_CleavageSite=59; ConfidenceScore=5.13e-01
MGIDDVICKQPSNFPMAVSAIDDNNGGRRSNAKEKRNSRKKLSVHDEAKTRRRTTPTVLCRNAKKMPRSRNAKSSEEDGTAAAHKKKIEETENEED

SEQ ID NO: 139444 - protein, 162 aa, Glycine max
  Coding DNA Sequence Number=SeqID_22666
MYHIDGLCWEKDCAYGYCGFHNDTDERWVHIDTFSAMNGISRFCESDFPWRYLSVRKAGSGGLDNVAEVCNLLSQVQYSKEEQISLQEFQQRNFTFLINTLSDTHKLDNTCYVYDERSYRLLTQSVGIVKFVLEEYVLLARTASACVVCIMVIAVNQLSYKL

SEQ ID NO: 139445 - protein, 415 aa, Glycine max
  Coding DNA Sequence Number=SeqID_22667
  Gene Ontology: Mol. function=binding; Cellular component =mitochondrion; Biological process=transport
  Homolog annotation: Hit_ID=Q2QPI7; Match level="QueryCoverage=99%, HitCoverage=79%, E-value=2e-68, Identity=34%"; Hit description =Pentatricopeptide, putative, expressed
  Pfam annotation: Domain name=PPR; Domain location=123-157; Score =24.1; E_value=0.00051; Accession=PF01535.11; Description=PPR repeat
  Pfam annotation: Domain name=PPR; Domain location=159-193; Score=6.4; E_value=1.3; Accession=PF01535.11; Description=PPR repeat
  Pfam annotation: Domain name=PPR; Domain location=229-263; Score =11.3; E_value=0.34; Accession=PF01535.11; Description=PPR repeat
  Pfam annotation: Domain name=PPR; Domain location=264-298; Score =31.3; E_value=3.3e-06; Accession=PF01535.11; Description=PPR repeat
  Pfam annotation: Domain name=PPR; Domain location=53-87; Score=23.4; E_value=0.00082; Accession=PF01535.11; Description=PPR repeat
  Pfam annotation: Domain name=PPR; Domain location=88-122; Score=11.3; E_value=0.35; Accession=PF01535.11; Description=PPR repeat
  Pfam module annotation: Pfam domain module=PPR::PPR::PPR::PPR::PPR::PP R; Domain location=123-157::159-193::229-263::264-298::53-87::88-122
MLQVYDWMNNRPERFRVSESDAAIQLDLIAKVRGLSSAEAFFLSLEDKLKDKKTYGALLNVYVHSRSKEKAESLFDTMRSKGYVIHALPFNVMMTLYMNLNEYAKVDILASEMMEKNIQLDIYTYNIWLSSCGSQGSVEKMEQVFEQMEKDPSIIPNWSTFSTMASMYIRMDQNEKAEECLRKVEGRIKGRDRIPFHYLLSLYGSVGKKDEVCRVWNTYKSIFPSIPNLGYHAIISSLVKLDDIEVAEKLYEEWISVKSSYDPRIGNLLIGWYVKKGDTDKALSFFEQMLNDGCIPNSNTWEILSEGHIADKRISEAMSCLKEAFMAAGGSKSWRPKPSYLSAFLELCQEQDDMESAEVLIGLLRQSKFNKSKVYASLIGSSDELPKIDTADRTDDAVDSENMDNDLLNQLGSSS

SEQ ID NO: 139446 - protein, 39 aa, Glycine max
  Coding DNA Sequence Number=SeqID_22668
MVDIGMAPLQATYAWEPSKEGVQIAEDVYSCPFCGRAEE

SEQ ID NO: 139447 - protein, 64 aa, Glycine max
  Coding DNA Sequence Number=SeqID_22669
MGDGGAEGEEEEKEERNEGAEKLYEEWISVKSSHDPRIGNLITDQALSFFEQMKEGGGIPNSNT

SEQ ID NO: 139448 - protein, 239 aa, Glycine max
  Coding DNA Sequence Number=SeqID_22670
  Gene Ontology: Mol. function=protein serine/threonine kinase activity; Biological process=protein amino acid phosphorylation
  Homolog annotation: Hit_ID=Q5NJB1; Match level="QueryCoverage=83%, HitCoverage=32%, E-value=7e-20, Identity=30%"; Hit description=S -receptor kinase-like protein 1
  Pfam annotation: Domain name=PAN_2; Domain location=132-202; Score= -6.3; E_value=0.0059; Accession=PF08276.2; Description=PAN-like domain
MTYGNHLMRTQGRTYKIKNSNTQRTSSKKRNLEGQELVIRRRGKVCWRSGKLRNNRFEYIPEEAQRMLKYTIVSNGDEDSFSFNSTNDKLTPRWFFGESGRLSCNGRYVKADLCYGYTNTGGCQRWQDLPKCRNPGDLFVKKTLVPDYESVSYETNPAFGYSDCEASCWSNCSCDGFRAFWRNETGCKFYHWNSSKNYIVDTSVAGVEFYMLENTGNITPHNGKSNVKFPVDFVFGLLP

SEQ ID NO: 139449 - protein, 185 aa, Glycine max
  Coding DNA Sequence Number=SeqID_22671
  Gene Ontology: Mol. function=protein serine/threonine kinase activity; Cellular component=membrane; Biological process=protein amino acid phosphorylation
  Homolog annotation: Hit_ID=Q17U57; Match level="QueryCoverage=82%, HitCoverage=56%, E-value=7e-41, Identity=52%"; Hit description =Receptor protein kinase, putative
MLVTTPRVFLSWNTHPASHASPSRRRVGCDNYGYMSPEYAMEGTFATKSDVYSFGVLLLEIVSGRKNTSFYDDDRPLNLIGHVWELWKDGKYLQLVDPSLNELFDRDEVQRCIHVGLLCVEHYANDRPTMSDIISMLTNKSATVSLPQRPAFYVQREILDENLSSTDLCTTSTVEIATSLEINQG

SEQ ID NO: 139450 - protein, 45 aa, Glycine max
  Coding DNA Sequence Number=SeqID_22672
MWNFNFLLKGEHLELHPSVRGTVVAIHHATKVLVGAEELSHALRD

SEQ ID NO: 139451 - protein, 478 aa, Glycine max
  Coding DNA Sequence Number=SeqID_22673
MLSCLIGESSNDDPSHHHGGFDATDDQGSSVVVGGIIAIADVVATTRPNIRVDEAESPLPIPPTNVINLDSKTTTVHVYNEVRSYSTSFLTYESITNFLEEVKFRLIDGPNVMIIDSCLKSEHIFMCSYSAKTHFISNTVCLILGIMPKIDYQSVKKTQAEKEVVEKAKADKGKMNVMVEEHGKINDSAIITHLAPVSNHPEVRKEYPELTEMSPVLLWVRDPCVAVGETFGVASPPPKGEGWTPGQNVCAMHGGAGTNVGAGMGVGAGGGGAEEGVEEEGAEASDGPRALALRVPGKVIVGSSGDSKVNEYGTTPQAMHKAVISAGNPSLEEIIQVYIKFLDQGRICVPIHLLGQGFMPAPPLELLTELIIFSDIKNNIPLRKDIPGAPGAGRRLAKLDRWNIIGLASKLAKTNSKIEKNLHLARQTRLAHEQKLRKLNCLGLSEADSLSPGLFKLQRHGGLARLTCLATNKRPKAS

SEQ ID NO: 139452 - protein, 517 aa, Glycine max
  Coding DNA Sequence Number=SeqID_22674
  Gene Ontology: Mol. function=nucleic acid binding; Cellular component= intracellular; Biological process=regulation of transcription
  Homolog annotation: Hit_ID=P93718; Match level="QueryCoverage=95%, HitCoverage=98%, E-value=8e-54, Identity=32%"; Hit description =PEThy; ZPT4-2
  Pfam annotation: Domain name=zf-C2H2; Domain location=104-126; Score =10.6; E_value=0.73; Accession=PF00096.16; Description=Zinc finger, C2H2 type
  Pfam annotation: Domain name=zf-C2H2; Domain location=436-458; Score =22.4; E_value=0.0016; Accession=PF00096.16; Description=Zinc finger, C2H2 type
  Pfam annotation: Domain name=zf-C2H2; Domain location=7-29; Score =16.6; E_value=0.09; Accession=PF00096.16; Description=Zinc finger, C2H2 type
  Pfam module annotation: Pfam domain module=zf-C2H2::zf-C2H2::zf-C2H2; Domain location=104-126::436-458::7-29
MEETRKFVCKYCSKRFPCGKSLGGHIRTHMMSEYHHHSALANEERNNNNNNAANANAMFKFDGGRKRKRDLGSEENGNNNYGLRENPKKTTRFVHSNATLQLDKFCKECGKGFPSLKALCGHMACHSEKDKRRFATEKQKLVMDSQSDTETSSAPRRSKGMKFKTLSNNNQPQSSSVSEVEQEQEEVARCLMMLSKDSSYKGRFALLTESSDNNSIVITKSPSLETKVTTMINGYGKNSMSSAYVERKLELEQNKDLKFKSAEVGYDSDNSDSGYFRYGPKSDVSNDDGFFRNEVKSSKVGYLNGFDQEYDVESRKVLSRGRSRSSEFNEFVLEDWENYDREDGVAARTFDSKKFKKSNYDDSLGQNLGGVSTRKYECLTNEMYNGCSDDSAYESDENSTDTDSYPAPKAHSNRNNLSVQKGKKKKKLKSKKSKAHECPICNKIFRSGQALGGHKRSHFVGGSEENTLVIRPSAPPAAVPCLIDLNLPAPVAECLWSSENVLSLSPYDESNDNVQTS

SEQ ID NO: 139453 - protein, 315 aa, Glycine max
  Coding DNA Sequence Number=SeqID_22675
  Homolog annotation: Hit_ID=Q10MK5; Match level="QueryCoverage=31%, HitCoverage=18%, E-value=3e-27, Identity=66%"; Hit description =Argininosuccinate lyase, putative, expressed
MTLHSVQMHSSSFFQILPRAQPRSVALSGWLAKPEDWLSERMKISTSQTGLINLKLRGNALTFVSFWPSISGAFSLTPWPTIFRFWGFDEVVSITTTIDLKEGDVEEATFRGVHHKLTEGLMGFGAAKEGALDGGFFDISVRRPHECWRDSLFMAILTCNAHRGHVELHPPVRGVVVADYHATEVLAEWVLWASEEFGFITPSDSVSTISSIMPQKKNPDLMELVCGKSARVIGDLVTLLTLCKGLPHAYDCNLQNRSSPLKYVSSKICLDFLKPFLRIGEETKAQWEDDSSNCNKFEGKINVAMWVNPCTLLVG

SEQ ID NO: 139454 - protein, 155 aa, Glycine max
  Coding DNA Sequence Number=SeqID_22676
  Gene Ontology: Mol. function=oxidoreductase activity, acting on single donors with incorporation of molecular oxygen, incorporation of two atoms of oxygen
  Homolog annotation: Hit_ID=Q1S835; Match level="QueryCoverage=35%, HitCoverage=14%, E-value=3e-14, Identity=61%"; Hit description=2OG -Fe(II) oxygenase
MPMVLLSFLDQVVIEGERRNNCSGQYDQICNAQLPRALDPYSVPSEELSTSLGNMVELINLVHKLAALALHNSGFAEGQVLGNLLFELLSEALGLKPDHLKDMDYAKGHLIFCYYYPSCLELELTMGTKSHTDLDFLTFLLQYHVGGLQVLVHNH

SEQ ID NO: 139455 - protein, 139 aa, Glycine max
  Coding DNA Sequence Number=SeqID_22677
  Gene Ontology: Mol. function=dihydrodipicolinate reductase activity; Cellular component=cytoplasm; Biological process=lysine biosynthetic process via diaminopimelate
  Homolog annotation: Hit_ID=Q1S0J3; Match level="QueryCoverage=57%, HitCoverage=52%, E-value=1e-10, Identity=62%"; Hit description =Dihydrodipicolinate reductase
NMVTKLHHSLIFVVEGFTLMEWDKSHFGACWCSGNAYILMHVVINGATKEIGKVAVVAVTKACRIEVAGTVDTCHIGENIRKGVLVAPNLSIGSILLQQLAILASFHYNNIEIVESRANANGSKWGGYMMRMMRHLVSY

SEQ ID NO: 139456 - protein, 75 aa, Glycine max
  Coding DNA Sequence Number=SeqID_22678
  Gene Ontology: Mol. function=carboxypeptidase activity
MSDNFMKCESKWENGVEDLFANGHDAKNLTWHVDGRKSDGLLRHLTDSSQWKIIDRLYPDFGNEARNLRLGLDFE

SEQ ID NO: 139457 - protein, 121 aa, Glycine max
  Coding DNA Sequence Number=SeqID_22679
MFKSKDKDPLEGLGGPMTRARARKAKEALQQVLSILFEYKPKFQGEKSKVVSGSLLKSAVKLLYKLNHFINKHKLSFIQKIRVYLFYLSESDSPKFLSDSRTPWLYQRTFTTFVCCPRWKE

SEQ ID NO: 139458 - protein, 115 aa, Glycine max
  Coding DNA Sequence Number=SeqID_22680
MDPYGCHALGLTPLSGREGVVNGSLPIHSGTSPLEIVIIILSVYVRDNEANIQLYTCQLLKLHDEINCSQYAPQVEQPPANFESTQTLNAESAPSPTLITAQSAPTPNATSDFYI

SEQ ID NO: 139459 - protein, 78 aa, Glycine max
  Coding DNA Sequence Number=SeqID_22681
MGKWGLRRRLPKDPLGVLPELPEEAVKKPKVFRKNPSSGSLPEHLFRKVSGRSTSSERIPEEGFLRMTFEISGKFVFF

SEQ ID NO: 139460 - protein, 45 aa, Glycine max
  Coding DNA Sequence Number=SeqID_22682
MGSLVAILIESKDQYPPVLNDMIHINIIGPKVKASSIDPERHDTC

SEQ ID NO: 139461 - protein, 107 aa, Glycine max
  Coding DNA Sequence Number=SeqID_22683
MTALQQKQEANMQALRQENEQADNKSLCDFTGQFSQIAIRIQELKPGVSLHAMMVALKPGAFADSLCKKRSTIMDNLRCCAINFTQVKELLEFRDKVRRDQKKPDFH

SEQ ID NO: 139462 - protein, 264 aa, Glycine max
  Coding DNA Sequence Number=SeqID_22684
  Gene Ontology: Mol. function=DNA binding; Cellular component=nucleus; Biological process=regulation of transcription, DNA-dependent
  Homolog annotation: Hit_ID=Q2HUH8; Match level="QueryCoverage=47%, HitCoverage=32%, E-value=2e-20, Identity=39%"; Hit description =Histidine triad (HIT) protein; Homeodomain-like
MQRGREAGEGPKEEEGGRGRGREEGRGGTKGRRRGKGREEEGRREGAKERRRRVRRERGEKIEKKKKNRENGRWGKEKVEVGKGEKNNESGHLTITVYTITLEKLDEGNANSRKKAFSTIERPEENMQYEIAIEEIGGSSTKRKHRVAFAIEEDTHLISSWLNISTDPIVGQGKEVFWLRVMENYNKFRGELCERAVNQLKSQWQKINQGMQKFKGRYKQAVPLKESGCTDNDVMLNTYAIWKEDKETNFGLEHAWKLLKDQLK

SEQ ID NO: 139463 - protein, 136 aa, Glycine max
  Coding DNA Sequence Number=SeqID_22685
MNKHISFEKEKENEKEVPEKEIPRIINVEKPTTKSRDVDVIQPHNIDELTTNSDAANKNMEKPTTSSFSPTPPIQDQGEESVPQNTLSKSEVELVKAIESLNMKFNISIKDLLKTNNNVNALNNQLTTEEKKKKNS

SEQ ID NO: 139464 - protein, 56 aa, Glycine max
  Coding DNA Sequence Number=SeqID_22686
MDVDNGDYPEQDNAVSMRKGVCAGLLRGLMISIQFSSYKSMKLAKRETKRGRIVVI

SEQ ID NO: 139465 - protein, 151 aa, Glycine max
  Coding DNA Sequence Number=SeqID_22687
  Gene Ontology: Mol. function=RNA-directed DNA polymerase activity; Biological process=RNA-dependent DNA replication
  Homolog annotation: Hit_ID=Q1SKJ4; Match level="QueryCoverage=93%, HitCoverage=28%, E-value=2e-27, Identity=34%"; Hit description=RNA -directed DNA polymerase
MAIKIDHEKAYDHLLWEFVKDSLEDVGFPNHLTQVIWSCISSTSMKALWNGEALESFSPTRRLLQDVFCASSGQRVSDSKSHVFFSKNVHSQQRKDISDTPGFQRMDNLGRYLGVNIFHSRVKKASFFEVMDRVANRLNAWKAKISHWSVE

SEQ ID NO: 139466 - protein, 77 aa, Glycine max
  Coding DNA Sequence Number=SeqID_22688
MVEGMTMFDGCLACLENINYASRCLVMLRGYVTLAKGSFGHGSWVAPIIKGCSVRPMIVDVQHSQRGPISMGKCINN

SEQ ID NO: 139467 - protein, 197 aa, Glycine max
  Coding DNA Sequence Number=SeqID_22689
  Gene Ontology: Mol. function=sequence-specific DNA binding; Cellular component=nucleus; Biological process=regulation of transcription, DNA-dependent
  Homolog annotation: Hit_ID=Q9C983; Match level="QueryCoverage=89%, HitCoverage=57%, E-value=1e-49, Identity=59%"; Hit description =Probable WRKY transcription factor 57
  Pfam annotation: Domain name=FLYWCH; Domain location=33-101; Score= -1.1; E_value=0.094; Accession=PF04500.7; Description=FLYWCH zinc finger domain
  Pfam annotation: Domain name=WRKY; Domain location=44-103; Score =143.0; E_value=8.1e-40; Accession=PF03106.6; Description=WRKY DNA -binding domain
  Pfam module annotation: Pfam domain module=FLYWCH::WRKY; Domain location=33-101::44-103
MGSDIKSASDLGEIFCRSKGKNKGQKRIRQPRFAFMTKSEVDHLEDGYRWRKYGQKAVKNSPFPRSYYRCTNSKCTVKKRVERSSEDPTIVITTYEGQHCHHTVGFPRGGIISHEAAFASQLAPTMSQFYYPIQLPRDNNNNNNSFSSISQPCQAYDDAEGGLSAMMPLPADVSSQSQPSTDEGLLGDIVPPGMRIR

SEQ ID NO: 139468 - protein, 92 aa, Glycine max
  Coding DNA Sequence Number=SeqID_22690
  Subcellular localization annotation: CTP_CleavageSite=40; ConfidenceScore=5.04e-01
MWDYLMVTRTFRQPGANVPIDAQRLTSSSAPFVVLTREVRCHAGLPYVKSSDMRGYHMVTRTFCQPGANEPDDATRVTSSSAPFVVLTHDVR

SEQ ID NO: 139469 - protein, 111 aa, Glycine max
  Coding DNA Sequence Number=SeqID_22691
  Gene Ontology: Mol. function=oxidoreductase activity; Biological process=response to red or far red light
  Homolog annotation: Hit_ID=Q1SA90; Match level="QueryCoverage=94%, HitCoverage=31%, E-value=2e-44, Identity=81%"; Hit description=2OG -Fe(II) oxygenase
  Pfam annotation: Domain name=2OG-FeII_Oxy; Domain location=30-110; Score=27.1; E_value=6.4e-05; Accession=PF03171.10; Description=2OG -Fe(II) oxygenase superfamily
MCCEVLELMADGLEIEPRNVFSRMIRDERSDSCFRMNRYPACPELRVEALSGRNLIGFGEHTDPQIISVLRSNNTSGLQMCLRDGTWASIQPDHTSFFVNVGDLLQESQKV

SEQ ID NO: 139470 - protein, 147 aa, Glycine max
  Coding DNA Sequence Number=SeqID_22692
  Gene Ontology: Mol. function=oxidoreductase activity; Biological process=response to red or far red light
  Homolog annotation: Hit_ID=Q1ET28; Match level="QueryCoverage=97%, HitCoverage=43%, E-value=2e-51, Identity=67%"; Hit description =Putative gibberellin 2-oxidase
MVVHSHQSALNELFLVKASCKSRFMWVPEVDLTHPEAKTVIVKACQEFGLFKVVNYGVPLELMTHLENEALKFFMQSQCQKDKAGPPDPYGYGSKRIGTNGDLGWVEYLLLNTNPDVISPKTLQLFEQNPEVFRCAVEEYIGAVGIL

SEQ ID NO: 139471 - protein, 55 aa, Glycine max
  Coding DNA Sequence Number=SeqID_22693
MKKIQGLQAPHGATSQWVPNLKPYTFLLTPRTLCYDLTPQVPNLEPYAFLLTPRT

SEQ ID NO: 139472 - protein, 106 aa, Glycine max
  Coding DNA Sequence Number=SeqID_22694
MDEHQQNWKEMANTMLKINKKAENMFNIFHVIDQVTLTHYGQSVFLLTIFKSTFEPKAYPKWHSLYHQVPNSVTFKVLLTEYKVTCNNLDVPSTMHSFELGRDYRV

SEQ ID NO: 139473 - protein, 96 aa, Glycine max
  Coding DNA Sequence Number=SeqID_22695
  Homolog annotation: Hit_ID=Q9FWG4; Match level="QueryCoverage=54%, HitCoverage=15%, E-value=2e-13, Identity=66%"; Hit description =Putative glucose-6-phosphate/phosphate-translocator
  Subcellular localization annotation: CTP_CleavageSite=52; ConfidenceScore=5.18e-01
MTNTIQKKFKVSSTQLLYQSSPYQAATLLISGPYLDKLMTNQNVFGFKCTTQVNLVRGYISSNNVINEDISFRITYIPRNRLLTKALLAVTLQMNG

SEQ ID NO: 139474 - protein, 171 aa, Glycine max
  Coding DNA Sequence Number=SeqID_22696
  Gene Ontology: Mol. function=hydrolase activity
  Homolog annotation: Hit_ID=Q9FNB6; Match level="QueryCoverage=49%, HitCoverage=23%, E-value=1e-35, Identity=81%"; Hit description =Arabidopsis thaliana genomic DNA, chromosome 5, P1 clone:MSH12
  Pfam annotation: Domain name=NUDIX; Domain location=2-109; Score =20.0; E_value=0.0018; Accession=PF00293.18; Description=NUDIX domain
MHAVDTGQCLLVKGWKGSSWSFPHGKKSKDEEDHACAIREVMEETGFDVSKLLNKDEYLEVIFGQQRVRFYIIAGVKDDTTFAPLTKKEISDGAENGYGAKATKILDQVRGSAALAQIILRERLHIFRILGCILCVVGCTTIVLHAPQEREIESLSEVWDLAMEPCSHVPT

SEQ ID NO: 139475 - protein, 141 aa, Glycine max
  Coding DNA Sequence Number=SeqID_22697
  Homolog annotation: Hit_ID=Q1SXD5; Match level="QueryCoverage=64%, HitCoverage=83%, E-value=3e-24, Identity=55%"; Hit description=Cupin, RmlC-type
  Pfam annotation: Domain name=Cupin_3; Domain location=64-138; Score =99.1; E_value=1.3e-26; Accession=PF05899.3; Description=Protein of unknown function (DUF861)
  Subcellular localization annotation: CTP_CleavageSite=16; ConfidenceScore=5.25e-01
MVLPNHFTQTKHSVVPASRSGAPTRRRVHLATTKAETMTTVIEKLGICPIKIERNPPESKLTQLGKDVVKKFKRWGCPPSKFPWTYEAKETCYLLEGKVKVFPSRSNESVEIAAGDLVVFPKGMSCTWDVSVGVDKHYNFE

SEQ ID NO: 139476 - protein, 111 aa, Glycine max
  Coding DNA Sequence Number=SeqID_22698
MVEHVVVTDVWCYSCGLCWLVAVMMGGYERGSIGNGWCARVDDGCPGWCLERLWPKMIGLDTSVMGDIVMCRSSYGAWWWSKMVGLDTLAIEVIGSLRRLEGEGGKRRSNH

SEQ ID NO: 139477 - protein, 252 aa, Glycine max
  Coding DNA Sequence Number=SeqID_22699
  Gene Ontology: Mol. function=DNA binding; Cellular component =mitochondrion; Biological process=DNA integration
MSESGFTVSEGWLQRRKSKSDTVSETLSATVVSMPDNDWARDKDDRKSTNGFVFFIGNTTFTWMSKKFPIVTLSTCEAEYIAAASCVFHVVWLRNLLKELGMSQEETTKIFVDNKSTIALAKNPVFHDRSKHIDTCYHYIRKCIARKDVHIEYVKSQDQVANIFTKLLKQEDFINDDGRSKKRTAKVSRGLTVEEKDLVDRSKKNIEGEIHGFSDFVGEPKDAKASLEEETYMEDKINKDEGYESDDTTIMV

SEQ ID NO: 139478 - protein, 49 aa, Glycine max
  Coding DNA Sequence Number=SeqID_22700
MESISKAINPEFKKHACDNKDGVWNRDYAFAYMEGDDYDDYDYAPAAFA

SEQ ID NO: 139479 - protein, 52 aa, Glycine max
  Coding DNA Sequence Number=SeqID_22701
MELTNPNQPFQARVEVAIAVNGGRSAATHLEQGLSRTEFSLIELSDGSQSYG

SEQ ID NO: 139480 - protein, 319 aa, Glycine max
  Coding DNA Sequence Number=SeqID_22702
  Homolog annotation: Hit_ID=Q1SZM6; Match level="QueryCoverage=33%, HitCoverage=34%, E-value=4e-11, Identity=40%"; Hit description =Ribonuclease H
MAGWKHKLLNRASRVTLVKRFIWGSNTNHWVIWPTITQSKKLGGLGIKRTREANVAMLGKHSVNDIHINDDNNWICCWSNMVTDSPLWLKLEVESIFINAETHDVVAWGYALNDIYTISFAYGWLTKARSSTVVNDRRGSWCGNNEESILHLPNDFPKAIISIRELLNLDMHDIPMNPIVKLGSKSTQLVAMAHSLLQQFGGFGRLGTKKFFHQTTIPCLFFVAEFSLSMTPFNMFFLSRQLLALKDWSVSLHRINVYMFKFNIDDSAIGNLGKVGFGGLVHDSNGTWCWDWALPLKHTLKEGNQVADSLAKDGAQGIH

SEQ ID NO: 139481 - protein, 184 aa, Glycine max
  Coding DNA Sequence Number=SeqID_22703
  Gene Ontology: Mol. function=DNA binding; Cellular component=nucleus
  Homolog annotation: Hit_ID=Q2HUH8; Match level="QueryCoverage=99%, HitCoverage=56%, E-value=3e-16, Identity=31%"; Hit description =Histidine triad (HIT) protein; Homeodomain-like
MQKFKSYYKQAVSLKKSGCTDNNVKLNAYAIWKEDEGTNFGLEHAWRLLKNQLEWLYQFTENCSKRMKISASRAYSSSSNPETPIENVEVDTLSPIFRLMGQKATKRKSKGKRVGTSTNPVDLIGVEEGMREINILNAKLATLREKELEKEYYDILMKDTSTMFETQLKDHQAFCKTIRHKLRI

SEQ ID NO: 139482 - protein, 389 aa, Glycine max
  Coding DNA Sequence Number=SeqID_22704
  Gene Ontology: Mol. function=DNA binding; Biological process =regulation of transcription
  Homolog annotation: Hit_ID=Q9SEZ2; Match level="QueryCoverage=77%, HitCoverage=77%, E-value=6e-37, Identity=37%"; Hit description =Transfactor, putative; 28697-27224
MDPQSMHFVLSTDSKPRLKWTPELHRRFIEATNQLGGADTYIICHSVASCGRSNSKESYEGDGNSGTYFVPPEEPFTGIHSPFKYRLGKSQELETCSDNKQEDYIETKSSSDGHCSREISIGAQNQLTETMSHREMVFPRAFIDQVLCLFTRNMQIAQALQMQMEVQRKLHEQIEVAHIVQKHLQLRIEAQGKYLQSVLKKAQEALAGYNSSPVGIELTKAELSQLVTIINNACPSSPISELTETRGLSLSCGERKRDRGTMCSLESSLTSSESSGRKEEKQPMEEIVEFKSSINVSLQLPLMEILTEDKASNGGSSNEASGRKRSATAAESDDGSCVVEQPCGKRCGNKLRKAKLSEMLDLNSQCQSDMDSTSSKTLDLNCSLNFWEP

SEQ ID NO: 139483 - protein, 131 aa, Glycine max
  Coding DNA Sequence Number=SeqID_22705
  Subcellular localization annotation: CTP_CleavageSite=93; ConfidenceScore=5.46e-01
MSFDQDYHSLLCLKTIKSVGMQRQSRSSASFQRLQCLSTKTITIFFASETIKFVGMQRQSRSSASFRRLQCLSTKTITVFFASRLSSFIAWAPASGRSDALGPTRKLRDEVTSSPGRVAVQPPPLISYKKA

SEQ ID NO: 139484 - protein, 151 aa, Glycine max
  Coding DNA Sequence Number=SeqID_22706
GESLRFRTCTFEKKTHSAKSSWKMLKDDCDSKDQPMSSSFSRIDRPLASLYDFKSGHIAKGDNPLPSFNGEHGRKTRGVATLRESPKRFAKDRGEVCMPMHSKTHCRNLPFGGRAARDSRDKRFGSVAQGTTAFNQVYKSVALAPTYPQLR

SEQ ID NO: 139485 - protein, 184 aa, Glycine max
  Coding DNA Sequence Number=SeqID_22707
  Homolog annotation: Hit_ID=Q9LT41; Match level="QueryCoverage=47%, HitCoverage=30%, E-value=5e-09, Identity=60%"; Hit description=RCD1
MASMSKAMTPEIKKHACDKKDGVLYHYDPTACAEGDDYNGNINYVFAYMEGDDDDDGVANKGEKDPIDKRHIVWSSFYYQQGSRQDAWRLWNTTFSNSATPISEKMLSMNSQGSTYLPSFSHSRHFKAHTEIVSIFPVISPPNLTPAQSTRVCNALALFQSMVLNCCSNTVLLWLGGSRCVAKF

SEQ ID NO: 139486 - protein, 118 aa, Glycine max
  Coding DNA Sequence Number=SeqID_22708
MCKKEHESFKECAQRWRDLAAQVAPPMMEREMITMIMMGYMPSSFVDLVFAGEKIQVGLRRGKFDCPALMNRKPEANGENKEGGTHVVTVISTWPNFPLAQQYQYSASIIPSHYPPPY

SEQ ID NO: 139487 - protein, 162 aa, Glycine max
  Coding DNA Sequence Number=SeqID_22709
MILSDTSGSLKKTTIKHSVPQKKKFDGSCTVIRSIITASSSDCHYNSHVGAQFHSQDGPQKRKQNQEKRRHGCSAVTHIFTQTSTLPPKLRSLLKILMISYIREPFTEQAMCIHFKKLESISKNTYTAFAVRAPLLQGDRDLGAAGYSVWGLTALRGTVFGV

SEQ ID NO: 139488 - protein, 149 aa, Glycine max
  Coding DNA Sequence Number=SeqID_22710
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=Q8W4M7; Match level="QueryCoverage=61%, HitCoverage=14%, E-value=2e-16, Identity=43%"; Hit description=DNA repair helicase UVH6
MYKPQEAELRMTRPSHIAQRTHTSTCWDSPWPPLEPTTRSASSIGVHRATILSGENPRRGRGGRAGNHGDDGAQRASSPSRGHCECIEEVEWGRTKNWDLSIAWSPDGKYLVSGTKTGKYLVIGTFLVALSIDLTNNHQNPERPVFLAL

SEQ ID NO: 139489 - protein, 285 aa, Glycine max
  Coding DNA Sequence Number=SeqID_22711
MEELVTKHNSPKITPTSSRWLGGSSPESYSLHPATVILLPRTRPPGCARNSPPPIGDQPGSPKVFPTSMQQGQADILIARFPDPNYGVKTIPFRPCSSIPCKPLLYQNEGDLVWISENKASNSALGQTPTSLHERAESISGFTKEHHLEIPTMPMVPLGVENNDGLWWLMVAERKLLAPSIHLLKDPNGQIMEKCLVKLQTKFQEDPTVNEGWEAFLPRQLHTKFREDPTVNKGWEAFLPRQLHVAFSRSFIKRLPPEASLRGFFQKLPRGFFEKLDPYLSTPLY

SEQ ID NO: 139490 - protein, 200 aa, Glycine max
  Coding DNA Sequence Number=SeqID_22712
  Gene Ontology: Mol. function=transferase activity; Cellular component= peroxisome; Biological process=electron transport
  Homolog annotation: Hit_ID=Q5YZE3; Match level="QueryCoverage=67%, HitCoverage=38%, E-value=1e-49, Identity=68%"; Hit description =Putative phosphotransferase
METGHHARGLSPGQHDVPQRRTAAGGDRGLGDVHHRGSAAGFGLDAGHVAVRDRRRVLGWRAGSGRGPAHTAGACRALRGTHGPRSRCDGLVHGVGVLQARHHSGGHTCPRVRRESTCGGGGLPARTDVTAVQARGSDHRVVRSPGSGVRRRVNRSIAKSSRITPQDSRLVHSWVRVASWNPMATRMATIPIAVRMVRAG

SEQ ID NO: 139491 - protein, 197 aa, Glycine max
  Coding DNA Sequence Number=SeqID_22713
MGEVEEVQEQMKADMEAMKEQMATMMEAMVSMKKIMEANAVAIAATSTIAEVDLTPPYGLNQINHLIPNMNEHAFPPYGLPPNYTPPNMAYTPNEDVNNSTPILIESRQPRHVHVSQPVGETHEIPHHNLANFEPCLGYATEGQAVGDIPLQNTLEGPQYHPQPHLLHSTVGKNPHAMAEMGKLDHLEERLRAIKGG

SEQ ID NO: 139492 - protein, 162 aa, Glycine max
  Coding DNA Sequence Number=SeqID_22714
  Gene Ontology: Cellular component=integral to membrane; Biological process=cell wall organization and biogenesis
  Homolog annotation: Hit_ID=P41809; Match level="QueryCoverage=83%, HitCoverage=19%, E-value=2e-13, Identity=39%"; Hit description =Hansenula MRAKII killer toxin-resistant protein 1 precursor
NYQTYQGNPCGVYPDLSSFTGSGVYPDLSSFTGSGVYPDLSSFTGSGVYPDLSSFTGSGVIQKLYSLYQAIRPTYQGNPCGVYPDLSSFTGSGVYPDLSSFTGSGVYPDLSSFTGSGVYPDLSSFTGSGVIQKLYSLYQAIRPVRFTSSGIRALALDTDFVS

SEQ ID NO: 139493 - protein, 105 aa, Glycine max
  Coding DNA Sequence Number=SeqID_22715
MVIDYMLKIQIQNLFQQLFLNPVFCAYRTRARARVMGEAEEVQEKMKAEMEAMKEQMATMMEAMMSMKKIMEANAIIVAATSAVAKVNPMLPSGLKQMNHPTSNM

SEQ ID NO: 139494 - protein, 122 aa, Glycine max
  Coding DNA Sequence Number=SeqID_22716
  Homolog annotation: Hit_ID=Q35322; Match level="QueryCoverage=35%, HitCoverage=22%, E-value=1e-18, Identity=100%"; Hit description=NADH- ubiquinone oxidoreductase 27 kDa subunit
SWTYSDSELSVATLFPRTSKIEIAKFLGHLNGFRNHTFLWIIIAYFYISTQRKVAHLDSIAESGLQKPSNGIADTYLYLFLSAGVLPADTLIREMELGICFETSSLRATNCHYSEAYGDPVP

SEQ ID NO: 139495 - protein, 180 aa, Glycine max
  Coding DNA Sequence Number=SeqID_22717
  Homolog annotation: Hit_ID=Q2WXV6; Match level="QueryCoverage=49%, HitCoverage=42%, E-value=4e-14, Identity=41%"; Hit description=Helix- turn-helix motif
  Pfam annotation: Domain name=HTH_3; Domain location=6-61; Score=47.5; E_value=4.6e-11; Accession=PF01381.12; Description=Helix-turn-helix
MKWNEVAKVRMKDLGMTQEKLSEHLGITPGAVSHWLNARRSPELEVIARILHILDIDEFKVDKNGSIFTSADFKNSSCTTKTINCYPLLSKELIINYVDDLGSNEADNFANEWIESGAVILGKGFCILSGGGSAGARDPEVAKPTILSANEMALNSAISFVDGGSNEKAQCNVSGLRSEI

SEQ ID NO: 139496 - protein, 137 aa, Glycine max
  Coding DNA Sequence Number=SeqID_22718
MPISPCRCISWDRAHKTPNGPEEVQQGPGVSSTGYGPLSVLQGARSPSEESHPQRHPVDPKKSNRALGGHARKTLSGPKEVRQVLELPALITGLCQFYGVPVAPSKVIRPSTNQAFIKMYCVPRQAQGEIPQQPGDG

SEQ ID NO: 139497 - protein, 94 aa, Glycine max
  Coding DNA Sequence Number=SeqID_22719
MTKEWAVKVQDDCRNTGVRIDDVGFTLLDLKKFAYQNDTLIMAEQAKQVFYVQDPCDESPLSTQMSPNIVKEEEADDVHANCNDHDEEELINIV

SEQ ID NO: 139498 - protein, 86 aa, Glycine max
  Coding DNA Sequence Number=SeqID_22720
MRVHESFTHGEVIKRDCGINDWSKLALNKVSQRALCGRARARLTGALSKGGKGRGVATNVYLWKTSGKPKETGQNKNSKFGSCIYV

SEQ ID NO: 139499 - protein, 194 aa, Glycine max
  Coding DNA Sequence Number=SeqID_22721
MADQEEIQEQMKADMSTLKEQMASMMDAMLGMRQLMENNVATAATVSLAAKADLTLPATAHHPLPNMVGRERSTLGHISNPHLGHNRVAYPYGLPLNYTPLVMRDDTGHVSSPILKGSFLDSWTRFTRIVESMPKETSISTPRSPSRGRHLTHYLGLTSRENLETSQHSQYSFSPKDHPLQQKKKGNSISSKRD

SEQ ID NO: 139500 - protein, 68 aa, Glycine max
  Coding DNA Sequence Number=SeqID_22722
MATIALSSRYGSKLAYDTGIWGGLRHWNNDIVGFGGKLGRIGMAVTAWVSPSFSPSSFAPVFSVLLVG

SEQ ID NO: 139501 - protein, 498 aa, Glycine max
  Coding DNA Sequence Number=SeqID_22723
  Homolog annotation: Hit_ID=Q10Q83; Match level="QueryCoverage=43%, HitCoverage=47%, E-value=7e-20, Identity=30%"; Hit description =Expressed protein
  Pfam annotation: Domain name=DUF566; Domain location=94-498; Score= -4.8; E_value=1.9e-07; Accession=PF04484.3; Description=Family of unknown function (DUF566)
  Subcellular localization annotation: CTP_CleavageSite=47; ConfidenceScore=5.61e-01
MMSDSNDSVFPYSPKPRTRQVGSRFMSPKSTGSPEPRSASPLPRFHRSAKRNSATLADHISIERLKEREENHQNQNQTPTNRTASVFSALTKQRSYREFRSNTNGSEENDQDQDVIGRSTRNGFSTKFSASPVLKKPGSHVAPGRLSLDENALKRNFHCSKNSIDSESDNTILDSVSLQRTFCSRKLGREVSSKYKATSGRKGEASDSDPLSSDDSWMMKKFMTQKTVKRANSLIGYMSSKSQWALSPGRSGSPSLSLESKDKPLSFSSLRPQHKRVEKILSMGFDLFRTKKPSTSEVVQQLRLLHNRLIQWQFTNARANAVNHTMSLQAESNLTYALDGLAKLRHSVMQKKIELEKEKLEMKLSFVLHSQMKLLETWGSMERQHITAITIMKECLQSVVSKVPLFEGAKVDMQLVSIAQRHASDLAGSIKSVLCTFSPLLKFLHNQAGKTAELLSELARVVAQEKLLLQELTDIFHSMSALELKERSLMCSLIQLKC

SEQ ID NO: 139502 - protein, 89 aa, Glycine max
  Coding DNA Sequence Number=SeqID_22724
MVSRMSSGPPPLDDKRCRMTIICLCVPSDTTVSEWRKGPLPLDDKRRRMTIICLCLSHDPRVSMTEIVGRPTKARLLLLRILNEELRPT

SEQ ID NO: 139503 - protein, 155 aa, Glycine max
  Coding DNA Sequence Number=SeqID_22725
MKNLHEIAYENVSKVRKEGGGCRPACPSELGCFHQKASPSFGTLKKAKVGLVSICTPIFPKYTPFVFFSIDFFLKRCGTFRITQRQLFSFRNVAKFYGLCNNAHFSFRNVAKLYGLCNDACFEGSEGSKQGSRTDRKYSWTKLRYDTYDEVELWC

SEQ ID NO: 139504 - protein, 69 aa, Glycine max
  Coding DNA Sequence Number=SeqID_22726
MGIRHSPTQEPPSEACRAFKPEYPAMSQQQVKQYQRNQDEADRQKMLEKTKDYTFISLMLKAIGMGERK

SEQ ID NO: 139505 - protein, 87 aa, Glycine max
  Coding DNA Sequence Number=SeqID_22727
MASYGESNDVEYENFYISGDVGTDVVRCTFYIILQKATMLNMKTSTSVVTNFYISGDVGTDVVSCAFYIVLQKATILNMGTSTSMVT

SEQ ID NO: 139506 - protein, 284 aa, Glycine max
  Coding DNA Sequence Number=SeqID_22728
  Gene Ontology: Mol. function=transition metal ion binding
  Homolog annotation: Hit_ID=Q8LAU8; Match level="QueryCoverage=84%, HitCoverage=81%, E-value=1e-82, Identity=62%"; Hit description =Dessication-related protein, putative
MGTYISRARASIVIFLASLVLPLLLPNCYSPSVLIASAQIPELSDADLLEFPLNLEYLEAEFFLFRAFGYGLDVAAPNLTGGGPPPIGAKKVELDSLAKDVILQFAFQEVGHLRAIKSKVTGFPRPLLDLSSASFAKLMDSAVEKPLVPPFDPYANSLNFIIASYVIPYVGLTGLLGVESGQDAVLRELLYECKVQLVAQYKVTVAEFTNRISIHRSKLGNMGMKDEGIIVPKELGAESRVRGNILAGDDDSLAYSRTPEEILRIVYGSDHEDVCGGFYPNGAS

SEQ ID NO: 139507 - protein, 385 aa, Glycine max
  Coding DNA Sequence Number=SeqID_22729
  Gene Ontology: Mol. function=sequence-specific DNA binding; Cellular component=nucleus; Biological process=regulation of transcription, DNA-dependent
  Homolog annotation: Hit_ID=Q9FGZ4; Match level="QueryCoverage=98%, HitCoverage=88%, E-value=6e-37, Identity=31%"; Hit description =Probable WRKY transcription factor 48
  Pfam annotation: Domain name=WRKY; Domain location=186-275; Score =113.1; E_value=8.2e-31; Accession=PF03106.6; Description=WRKY DNA -binding domain
MAEEKREEEVAHPNNSSSTTMPFSDEIPNNNNLMMTFPFQVPPTIFDVMMMPSSSSSFIDLLGVQDYNAPLFDCLPGGGYRPAPSPASSNVPDSSEVLNTPAASPNLSSISSSSNEATVNNNAEQSLKPGNDQEEAEAEEEGGNGGRGDDQDQDKTKKQLKPKKKNQKKQREPRFAFMTKSEVDHLDDGYKWRKYGQKAVKNSPYPSNRVFPLILHFLNYYFFLAGHANGRATPPCRSYYRCTSAGCGVKKRVERSSDDPSIVVTTYEGQHRHPCPASARASFGFVSEPSSFGYAGSFGPSHFMLPHQHHQQAQSSALMYNNSTTPPLNVVSSSSTSNYMNTTSFGGFVQDHANRHGFGHEALLRDNGLLQDIIVPTQVRKEEKD

SEQ ID NO: 139508 - protein, 151 aa, Glycine max
  Coding DNA Sequence Number=SeqID_22730
MLWTGRNKLEHDPNSVSFRKPWEELLISDCMRVSTPRIVAGTSHRDNISNKCINIMRTEDEDVCRIKNAILGSGSMVVGVLAEISELFKQATTQHLSEQQEQPINGPFDLSARKEWLHAILETLDASNSMHASCLLSPQDTIGCCQYVIDL

SEQ ID NO: 139509 - protein, 418 aa, Glycine max
  Coding DNA Sequence Number=SeqID_22731
  Gene Ontology: Mol. function=ATP binding; Cellular component=cytosol; Biological process=apoptosis
  Homolog annotation: Hit_ID=Q9FKS9; Match level="QueryCoverage=96%, HitCoverage=89%, E-value=1e-101, Identity=46%"; Hit description=WD -repeat protein-like
  Pfam annotation: Domain name=WD40; Domain location=279-317; Score =39.3; E_value=1.4e-08; Accession=PF00400.22; Description=WD domain, G-beta repeat
  Pfam annotation: Domain name=WD40; Domain location=322-360; Score =10.6; E_value=2.1; Accession=PF00400.22; Description=WD domain, G -beta repeat
  Pfam module annotation: Pfam domain module=WD40::WD40; Domain location=279-317::322-360
MDNDYETISFLIEDSENTTAKETRSGKDIQGITWETETSNYRSRETFRQHRSESLLNGPEEHLSIKQAKQECQSTVKGGEFYNFYQYNNCLMPTIQDWALADYAGRLWSTSKHDLYLSAGTQICHWNALTSTNTEILDLEGHVAPSEEHPGAFMEGLTETRRIDAMAVGHKLLIVGGNEGQLICKHLDRPGISFCFRSDDPRMINAIEIYKCPTLTSEVIHFMVSYEEGSVRIFDVETFQFSHFEFPWPVRHASSSPDGRQLVVVGDKPEGTLVDSQTGLIIQYFGGHFGYSCSSAWHPDGHRFATGNRDRTCRIWDARNLSKSVFALGGNVSTISSISFTSDGRFMAMSEKQDFVHVYDVGADFKREQEINFFGYVSGLCFSPDTEYLFISVSMFTFPTLLLYNRRRHEYYYLDSMP

SEQ ID NO: 139510 - protein, 182 aa, Glycine max
  Coding DNA Sequence Number=SeqID_22732
  Gene Ontology: Mol. function=phospholipid binding; Cellular component= coated pit; Biological process=endocytosis
  Homolog annotation: Hit_ID=Q10NB4; Match level="QueryCoverage=68%, HitCoverage=25%, E-value=3e-22, Identity=41%"; Hit description =Clathrin assembly protein, putative, expressed
  Pfam annotation: Domain name=ANTH; Domain location=3-175; Score= -101.7; E_value=0.058; Accession=PF07651.6; Description=ANTH domain
EVMKQRDVAQMAATEAIQEATAAAESLLQCLRILNMSDFRDDAHSNSSDQVGFVRVYSLYLDAKVDFVAYRRKLSGRVVESVEFRDEFGSAEREGNEVTPVREMGAERVLKRLNHLLWMLDRVLGCRPNGAAKNNSLVLVALYQVVDVRDSFKLYVESKDLSHGFAYMDKDLPHRHMTNSGN

SEQ ID NO: 139511 - protein, 84 aa, Glycine max
  Coding DNA Sequence Number=SeqID_22733
MERGKIKTIVVHIVKKYLILKIFEEVTKSNPPRGNAVMKALPGGTPNNPYVIKGNYYGDNSQESHNSLLLPPNYYSTEPRMHLW

SEQ ID NO: 139512 - protein, 75 aa, Glycine max
  Coding DNA Sequence Number=SeqID_22734
DLKILHKVNSRLLLGGLLLKQKGSIECGYYVMHWMSTIILGSFKNNWETYFNDGRPLEPKRLKVLRMEWATYYLK

SEQ ID NO: 139513 - protein, 107 aa, Glycine max
  Coding DNA Sequence Number=SeqID_22735
MAYIYVRLISKSKREIFQENFIVKFSLNKSWANTCKSIESSSGTSNCIIHSKGEKFFCSSQKFNCNQETGCLLNCEFPEHKGKGFLGCSEVAKGFFTKILENLKWVA

SEQ ID NO: 139514 - protein, 188 aa, Glycine max
  Coding DNA Sequence Number=SeqID_22736
  Gene Ontology: Mol. function=DNA binding; Cellular component=oxygen evolving complex; Biological process=DNA integration
  Homolog annotation: Hit_ID=Q1SAK3; Match level="QueryCoverage=56%, HitCoverage=7%, E-value=7e-33, Identity=64%"; Hit description =Integrase, catalytic region; Zinc finger, CCHC-type
  Pfam annotation: Domain name=rve; Domain location=1-143; Score=71.3; E_value=3.1e-18; Accession=PF00665.16; Description=Integrase core domain
MSSEVVHIGKRIVIVDDYSRFTWTLFLKTKNEAFDDFHKLAKIIQNEKGLIIFSLRSDHGGEFKNESFEKFCQENGIHHNFSAPITPQHNGVVERKNRFLEEVARTLLNETKLPKGQVRLHETFYQCTRHRQGQDSSPYTWPTMEQFEAAVAWPGDWPEDQTEPAGALGGEDKVEDDQNIEDPIDFLL

SEQ ID NO: 139515 - protein, 75 aa, Glycine max
  Coding DNA Sequence Number=SeqID_22737
MRCLHMSSDLPSLNDEVNGSSFLGDPSIPSSEGKDGNSYPRSRFMANELRFWLKRLVERPNMMYVGALVWPVVQG

SEQ ID NO: 139516 - protein, 810 aa, Glycine max
  Coding DNA Sequence Number=SeqID_22738
  Gene Ontology: Mol. function=protein serine/threonine kinase activity; Cellular component=membrane; Biological process=protein amino acid phosphorylation
  Homolog annotation: Hit_ID=Q70I29; Match level="QueryCoverage=92%, HitCoverage=89%, E-value=0.0, Identity=54%"; Hit description=S -receptor kinase-like protein 2
  Pfam annotation: Domain name=B_lectin; Domain location=84-195; Score =149.7; E_value=7.9e-42; Accession=PF01453.15; Description=D-mannose binding lectin
  Pfam annotation: Domain name=PAN_2; Domain location=351-389; Score= -8.5; E_value=0.01; Accession=PF08276.2; Description=PAN-like domain
  Pfam annotation: Domain name=Pkinase; Domain location=463-763; Score =124.3; E_value=3.5e-34; Accession=PF00069.15; Description=Protein kinase domain
  Pfam annotation: Domain name=Pkinase_Tyr; Domain location=463-763; Score=94.3; E_value=3.6e-25; Accession=PF07714.7; Description =Protein tyrosine kinase
  Pfam annotation: Domain name=S_locus_glycop; Domain location=209-334; Score=129.6; E_value=8.5e-36; Accession=PF00954.11; Description=S -locus glycoprotein family
  Pfam module annotation: Pfam domain module=B_lectin::PAN _2::Pkinase::Pkinase_Tyr::S_locus_glycop; Domain location=84-195::351- 389::463-763::463-763::209-334
MEIMLVTRANTMESQKVLMLMMYTTLFCFMATFSSQDTVTITLNQSLQFSDTLVSLDGTFEAGFFNFENSRHQYFGIWYKRISARTVVWVANRDVPVQNSTAVLKLTDQGNIVILDGSRGRVWSSNSSRIAVKPVMQLLKTGNLVVKDGEGTKNILWQSFDYPGNTFLPGMKLKSNLVTGPYNYLTSWRDTEDPAQGEFSYRIDIRGLPQLVTAKGATIWYRAGSWNGYLFTGVSWQRMHRFLNFSFESTDKEVSYEYETWNSSILTRTVLYPTGSSERSLWSDEKQRWLTIATRPVDECEYYAVCGVNSNCNINDFPICKCLQGFIPKFQAKWDSSDWSGGCVRRIKLSCHGGDGFVKYSGMKLPDTSSSWFNKSLSLEEYQRRNKNMNRKKLAGILAGLIAFVIGLTILVWATSSFIKRMNLGKPEIIKKLIHWKHMKETEENDIQTIFDFSTIDIATNHFSDRNKLGEGGFGPGILEDGQEIAVKRLSKTSRQGTEEFKNEVKLMATLQHRNLVKLLGCSIQQDEKLLIYEFMPNRSLDYFIFGLRFHAIKFIALSLLLPSCSFHANVQTDFSDTMRGKLLDWTRCFQIIEGIARGLLYLHQDSTLRIIHRDLKTSNILLDINMIPKISDFGLARTFGGDQAEANTNRVMGTYGYMPPEYVVHGSFSTKSDVFSYGVIVLEIISGRKNRGFRDPHHNHLNLLGHVWRLWTEERPLELIDEMLDDDTTISSEILRRIHVGLLCVQENPENRPNMSSVVLMLNGGTLLPKPRQPGFYTGKDNTIDTGSCSKHHERCSVNEISISLLEAR

SEQ ID NO: 139517 - protein, 102 aa, Glycine max
  Coding DNA Sequence Number=SeqID_22739
MVLLFLRGERAGRELEIAHTGTFGCTLSMLELEAGYGDNMGVVLSDKVVKGAFRCMSPTTLFELWYNGINGSNNGLMSETCVCIITWGRETRKSSLSSPFPS

SEQ ID NO: 139518 - protein, 147 aa, Glycine max
  Coding DNA Sequence Number=SeqID_22740
  Gene Ontology: Mol. function=phosphotransferase activity, alcohol group as acceptor; Cellular component=cytoplasm; Biological process =carbohydrate phosphorylation
  Homolog annotation: Hit_ID=Q1SWC0; Match level="QueryCoverage=71%, HitCoverage=18%, E-value=8e-28, Identity=71%"; Hit description =Mevalonate and galactokinase
MLCFVMLCLVGGTKIRHKIEESFFLLFFPFLHIYHRKNLHKLHVNVNGILVHSLVEWIRLYTSFVMDMFYSDINAISVMGKAEFAELIDFNPIHATDVDLPVGGTYVIAHSLAETEKAVTSATNYNNRVLDCNLASVTTFQNKTQFA

SEQ ID NO: 139519 - protein, 255 aa, Glycine max
  Coding DNA Sequence Number=SeqID_22741
  Gene Ontology: Mol. function=nucleotidyltransferase activity; Cellular component=intracellular
MDTVTTHKISFQHELHEIHTVGTELSVTVTAKASVVREWLSSRLYFRQQYVRRKRLVVGLGVQWTGGSDSPADTLQLCVGRRCLIFQLAHAKSVPKKLRTFLLDASHTFVGFWNHLDRRKLESSEHGLEMVRDPLDLRRYAKTEDGDDLTQASVEEIVEQCLGFDVEQRSEISMSDWNDEYLSDDQIAYATIDARCAFLIGRKSRAWERTVSGVLGLIVPTLEFHRFTRIDERLILVFVSGILHVRFTSQPISQL

SEQ ID NO: 139520 - protein, 188 aa, Glycine max
  Coding DNA Sequence Number=SeqID_22742
  Gene Ontology: Mol. function=enzyme inhibitor activity
  Homolog annotation: Hit_ID=Q9LSN4; Match level="QueryCoverage=99%, HitCoverage=99%, E-value=1e-29, Identity=39%"; Hit description =Arabidopsis thaliana genomic DNA, chromosome 3, TAC clone:K14A17
  Pfam annotation: Domain name=PMEI; Domain location=36-181; Score =110.2; E_value=5.8e-30; Accession=PF04043.6; Description=Plant invertasepectin methylesterase inhibitor
MRRIPTSVSALAIHIFLLASISIPLTQSQPSFPWKDGNGDLVDQICKKTPFYDLCSSILHSNPPSPKPDLKGVALLMVNNILANATDTLSYIEGLIKQTSDRELEQALAFCAELYIPIVKYILPQAADAISQGRFGFASYCISDALKEVSSCDKKFSGAAQAPLGDRNDIVQKLVNVAAAIVKLLLKG

SEQ ID NO: 139521 - protein, 279 aa, Glycine max
  Coding DNA Sequence Number=SeqID_22743
VSGGFAGGSVKGDDGPSLCCNEPSLSEVSADVMIVTNKPMMGRDSANRAQQTPVREKRKKASNKKAPKPPRPPQAPSLDAADNKLIREISELAMLKRARIERMKALKKMKVVKSSSPSSSNTSSLLAMVFTVVFFVVIIFQGMSSGKTSVASFQGSPVSAGESEGGLISVQYQLNPSAVDSNAPALLGKWLWKLLSERVGLWRDVLVRKYGLYNMDALVGSECKVKGSQWWCDILVNCDIFENGLGCFQEKVSKVVSEGRLIHKTMDLSGRVGGDKGCA

SEQ ID NO: 139522 - protein, 37 aa, Glycine max
  Coding DNA Sequence Number=SeqID_22744
MNVHVGMGSMKKPIRLGRSLWLYIPNQLHQRRNQAME

SEQ ID NO: 139523 - protein, 56 aa, Glycine max
  Coding DNA Sequence Number=SeqID_22745
  Homolog annotation: Hit_ID=Q8LAU8; Match level="QueryCoverage=82%, HitCoverage=16%, E-value=5e-08, Identity=58%"; Hit description =Dessication-related protein, putative
MLLLARKCISTLRNKLGNKGLKDEGLIVPRVKGADILAGDKDSLAYPRTPEEILRR

SEQ ID NO: 139524 - protein, 66 aa, Glycine max
  Coding DNA Sequence Number=SeqID_22746
MTKNRVLKEHSKTFLNWFKDTIFGDNNASETLRKNMATPPSFLPPPPLPDSTSPSLSTSKKTRKTT

SEQ ID NO: 139525 - protein, 132 aa, Glycine max
  Coding DNA Sequence Number=SeqID_22747
MYAFLEPQSLVCSKDRRSECEQYLERWLKEYDQEVYIGPYFHHVMTKLKKTLPPETKAVAPKWIEVKSHVQTGCYECGYYIMHWIWNIITNDIKSDWSMWFANDTPLDIDIITTIRKKWATFFLKTAISQNG

SEQ ID NO: 139526 - protein, 115 aa, Glycine max
  Coding DNA Sequence Number=SeqID_22748
MKSKRVCYFTTKRLPEERVLPERDTWRDWTGRWDRGGRACLPDTTSSGHACLPGTTSSGRAPGATSSGGPQARPLVVACQARPLVVGPWHVPLPYKTPCPSFHFDTKTLKLIWKR

SEQ ID NO: 139527 - protein, 67 aa, Glycine max
  Coding DNA Sequence Number=SeqID_22749
MARSVSAPCPYSRDLYGRELTRLLVIIPKVVISLLKVSRGIIPFEEHIAAVGTTSNDIFSKRKTLDE

SEQ ID NO: 139528 - protein, 139 aa, Glycine max
  Coding DNA Sequence Number=SeqID_22750
  Subcellular localization annotation: CTP_CleavageSite=27; ConfidenceScore=5.17e-01
MTFIYISKATMSSPGNNSFIYILKTTMSSIIARFQKATMTFIYILKTTMSLVITCLQKPLGPLDDLREKQPAHLGEQVASRVSQQLPWARRVASSSPYFAVNRRGRLRRKGSAPLESIFHLKLVKRRRKKKKIKAKALP

SEQ ID NO: 139529 - protein, 111 aa, Glycine max
  Coding DNA Sequence Number=SeqID_22751
  Subcellular localization annotation: CTP_CleavageSite=44; ConfidenceScore=5.40e-01
MLCAIGPCSIVGGSMLRVTWISPRSRFLLSNPNSVRHKAQRSLRVLMVVEAKLHDESTMIQRSRFKNQEFKTQEESLQTSIKIQDSRSQESKIKIQESRIKTQDLKNQDQD

SEQ ID NO: 139530 - protein, 141 aa, Glycine max
  Coding DNA Sequence Number=SeqID_22752
MVESDDSDNSFGDSTDDEVALMSRGFKSSLGLEKRASSSKSQSGSDKCDFCGKSKHSKFKCIHKKQMSKGTNAQGIKNIWLPKSCGSNAFQDYFDDAKESRVKQVPKNQVSSKFQESRSRFKIQDSSKESRFKNQEKTQSR

SEQ ID NO: 139531 - protein, 182 aa, Glycine max
  Coding DNA Sequence Number=SeqID_22753
MDHVENLNSFNPMSCIKIHNTSIVRHSHTFVLFIGCIAHCILSLKKMNLIIVIKRKEHVVWHPYQTHARARVMGEVEEVQKQMKADMEAMKEQMATMMEAMMSMKKIMEANAVTVSATRVVAKVNPMPPSGLNQMNHPTSDMVGKDLGSTDGPYYVQIQNKNAFPPYGLPPNYTPPNVGYTP

SEQ ID NO: 139532 - protein, 105 aa, Glycine max
  Coding DNA Sequence Number=SeqID_22754
MASPMTCGEASEPVDTQRLTSSSAPLSSKDGESDDMRGYLMVIRTICQPEASEPIDTQRLTSDGESDDMWGYLMVIRTFSHPETASSMICGGTLWLSAPFVNQRQ

SEQ ID NO: 139533 - protein, 166 aa, Glycine max
  Coding DNA Sequence Number=SeqID_22755
  Gene Ontology: Mol. function=binding; Cellular component=clathrin coat of coated pit; Biological process=intracellular protein transport
  Homolog annotation: Hit_ID=Q9C6U0; Match level="QueryCoverage=73%, HitCoverage=38%, E-value=2e-27, Identity=70%"; Hit description =Clathrin heavy chain, putative
MEEERRVQRKNSVPRETSKENKSRVGSSMVLEINLMTFPNVVDAILANGMFSHYDHPHIEQLCENDGLFIWSLQVVNVLLDNLETIDRAMEFAFQVEEDVVWSQVAKAQLRKGLVSDAIESFIHANDSTHFLEVIKVAKDANIYHDLVKYLFHREETEAYAYIPVI

SEQ ID NO: 139534 - protein, 553 aa, Glycine max
  Coding DNA Sequence Number=SeqID_22756
  Gene Ontology: Mol. function=RNA-directed DNA polymerase activity; Cellular component=intracellular; Biological process=RNA-dependent DNA replication
MKFSTLMGEIVTVKPGKPYSSTGGSSSQVISIIEEFPITTLTVYYTTRGSQDDTFDMDLGVTPSTKAKHQSKSSSTDMPGIYPSIICHKLVVFPQPKPVSQKKRKIGEELHKVVREKLDKLLKAQFIRDVRHSTWLANVVMVKKANGKWRKCTDYTNLNKVCPWDGYLLPSIDKLVDGVSGFQLLSFLDAYSGYKQIKMHPPDDEKTSFITKDAHFYYWVMPFGLKNVGATYQMLIDRVFKWNIGQNFELYMDDMVVNSHSIAQHVADLEEMLGEIRKYDMYLNPEKCTFGGIKANLNKCMAILEMHSPTNIEEVQKLNDRLASLSRFLSKLTGKAKPFYRMLRKIESFLWDEACEQAFLDFKKTIATPPVLIQPMSGAPLVLYLLLAKEAIGSVVVQEDEKHQIPIYFASRVIHDAEKRYQMIEKTHHTDHPIRQVLRKLDLAGIMVVWSVELLEFDLQYEPYDPMKTYFMADFLAEFVDNVQANSDYFFMARMKWTSYNFCDPLFEEMGDVVEPIEQFRARCTATSTHQVEDIARLVTLHEQQQYEHDEDV

SEQ ID NO: 139535 - protein, 60 aa, Glycine max
  Coding DNA Sequence Number=SeqID_22757
MSPPPLEPHNHSQTHLKFSRRLLLQAQFSIGLHIAKSLKLSGTWTFLSLENPRHAEASRK

SEQ ID NO: 139536 - protein, 157 aa, Glycine max
  Coding DNA Sequence Number=SeqID_22758
  Homolog annotation: Hit_ID=Q10P54; Match level="QueryCoverage=80%, HitCoverage=12%, E-value=3e-18, Identity=38%"; Hit description =Expressed protein
MDVQVPLTDKEKLGRDLKRLNDKLAFTLSKCNAKDEQIKKQTKIVQEAVANSFEGWEKAEAKILSMKQHLDESIQLQLVYKERVAQLDGAIKECMQQLHFVREEQEQRIHDFVMKASKEFEEAHIVLEEQLSETNKWLAKSGLKILILISLLLLKKI

SEQ ID NO: 139537 - protein, 294 aa, Glycine max
  Coding DNA Sequence Number=SeqID_22759
MLKLDEDAKLVSLAGNVSAEIPDDDILESLKTLSVEEQRKSPEKATMMEIDGKPMPKVVVLEFLLPHSTIEIWSLRIFQVMKRLCFNLTLKHLSMFTGMIWLRQILVEISEETDADRLRRLEEVCGAMEYVSMEDMVIESWCGKLAIEFGKRNMILGLTLFIQRCNKWSLTSLILQSSLKEGFLGIDSFKYPSWDTFLEEEEYAIGVYGERELVLKQFPIRLIIAPNPNSLIFKYRPTAMKVYPLGPTIFVFVGYPNGTKGYYFYNTYEEKVSITRIGVFLEKQYISHGANGGM

SEQ ID NO: 139538 - protein, 167 aa, Glycine max
  Coding DNA Sequence Number=SeqID_22760
MAPNRIKTATILGINNKEEAKNTFLADSFILGRWELRNIMKQASEAPSIEKKVIISLATIVVASRCVEEGLAFDKDLEKRITYKALDIMLYGGPCPVTNNKKVMTSFVMVGEKVNLPKVIFYYWMQAFKDKFNPKKHIEKKVKKEPNEEPQSVVGQTMGTQDQTIDL

SEQ ID NO: 139539 - protein, 104 aa, Glycine max
  Coding DNA Sequence Number=SeqID_22761
MDQSWKKTSRISDEYHNGIILTYTKWIWHGELLDMPTVPQTESVDEEVGHRIEDMIRDLGQDGFQQAHGPLYDKIENDSKKPLYLGCTNFTKLSVVLALVNLKA

SEQ ID NO: 139540 - protein, 42 aa, Glycine max
  Coding DNA Sequence Number=SeqID_22762
MCGTNKYILGNMVTNNNNYYNEGSGIFQKHYGLKYTEPIVKN

SEQ ID NO: 139541 - protein, 66 aa, Glycine max
  Coding DNA Sequence Number=SeqID_22763
MKTILLLTTRWSEAAGINRGNALVVEIAGHGGVKEVMTELAADFGGHQKMHICSREAVVVSLESEK

SEQ ID NO: 139542 - protein, 94 aa, Glycine max
  Coding DNA Sequence Number=SeqID_22764
  Gene Ontology: Mol. function=isocitrate lyase activity; Cellular component=glyoxysome; Biological process=carboxylic acid metabolic process
  Homolog annotation: Hit_ID=P45456; Match level="QueryCoverage=95%, HitCoverage=16%, E-value=5e-44, Identity=92%"; Hit description =Isocitrate lyase 1
  Pfam annotation: Domain name=ICL; Domain location=1-94; Score=-299.4; E_value=0.0018; Accession=PF00463.11; Description=Isocitrate lyase family
MAKKLWHLLKNHQANGIASRTFGALDPVQVTQMAKHLDTIYVSGWQYSATHTTSNKPGPDLADYPYDTVPNKVGHLFFAQQCHDRKQKEDRSMK

SEQ ID NO: 139543 - protein, 56 aa, Glycine max
  Coding DNA Sequence Number=SeqID_22765
MENRETWHPKAAFAGMYGGGTLLTFLFVIFHFKVGMLNWMVLVVECFFIYRLDRMI

SEQ ID NO: 139544 - protein, 298 aa, Glycine max
  Coding DNA Sequence Number=SeqID_22766
  Gene Ontology: Mol. function=Rab GTPase activator activity; Cellular component=soluble fraction; Biological process=regulation of GTPase activity
  Homolog annotation: Hit_ID=Q9FGH0; Match level="QueryCoverage=82%, HitCoverage=41%, E-value=9e-88, Identity=62%"; Hit description =Arabidopsis thaliana genomic DNA, chromosome 5, P1 clone:MQJ2
MDGIVGFCSRKNIHADATDDEQEQEEEELEHFDDFTLASSWERFISEIEAVLRVWMSDGPNNLLEKGAVLLEDAGNLYKVKSEMKYAMKSYCMEFYFKTDPDGKLADWNFDLHDLQLCFGVKEFLVIAPQSASGVVLDAPESSKLLSAIAIALSNCSSLWPAFVPVHDPSRKAYIGIQSMGTVFTRRFEADRIGSQVPVKLMHLEGLYELFVSKFAYSTLDLSVHNFKVRCAMKLTFRTLPYDDDNIKDAKISKSGENLTGEMSIGTQWDDDCSWSEWYSAEDPVKGKFWDVGTCMLK

SEQ ID NO: 139545 - protein, 118 aa, Glycine max
  Coding DNA Sequence Number=SeqID_22767
  Homolog annotation: Hit_ID=Q10MT9; Match level="QueryCoverage=81%, HitCoverage=9%, E-value=2e-31, Identity=65%"; Hit description =Expressed protein
MALLLDMSAFKAANPGAIFEDFIRWHSPGDWEEDDGPEGSKSSSSSSHDIKKSKDSWPPQGRLSKRMSEHGNLWRKLWNSAPALPASEQKPLLDPNREGEKLKDCPRSPTGLTGGRCA

SEQ ID NO: 139546 - protein, 161 aa, Glycine max
  Coding DNA Sequence Number=SeqID_22768
  Homolog annotation: Hit_ID=Q10MT9; Match level="QueryCoverage=37%, HitCoverage=6%, E-value=5e-14, Identity=62%"; Hit description =Expressed protein
MEVAEIRMLRWMCGRTTAQDRIGYEIIVYEEILLAICIERKCQLSEDYQDCIGSLDQIDSMSEEESVVGDDSFSLQTPSEEFSGKVDRKPEDVDLFNEKKSSDLTRRGSAGIVDSMMLLKSHQSMHAPYTQEAPLMTEDMHEERLKAVEAFGDSFVVDKVK

SEQ ID NO: 139547 - protein, 527 aa, Glycine max
  Coding DNA Sequence Number=SeqID_22769
  Gene Ontology: Mol. function=tetracycline:hydrogen antiporter activity; Cellular component=integral to membrane; Biological process=tetracycline transport
  Homolog annotation: Hit_ID=UPI00005F7317; Match level="QueryCoverage =41%, HitCoverage=53%, E-value=5e-75, Identity=56%"; Hit description =COG0642: Signal transduction histidine kinase
  Pfam annotation: Domain name=TolA; Domain location=205-525; Score= -152.9; E_value=0.071; Accession=PF06519.2; Description=TolA protein
MGNIGHKGAPVALVFLQRARQLVEVARQLANFVAAANLHPGGKFARRQLMGAVYQPFHRRQQAARQQPGDQRGQQRGEADNQPAGLTLLMVKVDVGAARQPLGGRGNHPANNLAVAGELGAPAVRRQLRAAARILFQRAQNGENQPVVVTQKIPATVLFVLIGQRIAQQRQALLVALFDVVDKAMLKAEAHAPVHGDDHQHAGGKNRHKQFGADAEFYRLLHPFLLPLRSTFLLTSAGLMGRGAVAHRAMAESAEQQTGHGDADTHRQLHDHRQQAVAARGQLVRQLFQRQGIHGRKADGIDHALQQQHHGQQPDPAEQRHHGKQQHHQRQRQRAAHQRVTIAKQIYDAHHHAFDAHVAQHHRDHHQPGVERAKAETHLQKNRRHKRQHAAADAAGEAAEQADGVNAVIKQLQAKQRVIVVAAVHQVEQQGKHPQQNQQAQQQRSSVAMAPMMPTGMLIRKIQCQLAYSTRMPPSAGPSSGPIWPGRVTKVMADMYCSRGTIFITVSRPTGTIIAPPMPWTTRAITS

SEQ ID NO: 139548 - protein, 50 aa, Glycine max
  Coding DNA Sequence Number=SeqID_22770
  Gene Ontology: Mol. function=transferase activity, transferring phosphorus-containing groups; Cellular component=integral to membrane; Biological process=two-component signal transduction system (phosphorelay)
  Homolog annotation: Hit_ID=P30847; Match level="QueryCoverage=95%, HitCoverage=10%, E-value=5e-12, Identity=68%"; Hit description =Signal transduction histidine-protein kinase baeS
MQDGVRKLTPDAISSLQSEVALLTQLVEDLHQLSLSDAGALAYRKQPVGS

SEQ ID NO: 139549 - protein, 115 aa, Glycine max
  Coding DNA Sequence Number=SeqID_22771
METIRLVIIVASSKGWSVCQLDVKFSFLNGPLEEEVYVLQPPDFEEGAAAISSLSEAHALSEYHPLSETSARLASKRNLKGDLPCKHALSVSSARPASHLSHPEITYSRLARKWR

SEQ ID NO: 139550 - protein, 83 aa, Glycine max
  Coding DNA Sequence Number=SeqID_22772
MDPVKYIFEKPTLTERIAQRQNSLTRILWPCLRRRLKIKTEISGLCGLTILFRLHKQYGRVRGMRSRDSSGVTTRLIATISTL

SEQ ID NO: 139551 - protein, 78 aa, Glycine max
  Coding DNA Sequence Number=SeqID_22773
MVASFGYRKERDGSWVKKGSMDSKPMLLKGLMLWNNKWTCDSMQWTQGSQRIVIIKKGEIVEAMPSKVILMMPKNQES

SEQ ID NO: 139552 - protein, 50 aa, Glycine max
  Coding DNA Sequence Number=SeqID_22774
MGGQRGELPCLLSGIPPAQLHRRQRQAAGAVRQIAQPLASLAASDFTASA

SEQ ID NO: 139553 - protein, 298 aa, Glycine max
  Coding DNA Sequence Number=SeqID_22775
  Gene Ontology: Mol. function=hydrolase activity; Biological process =metabolic process
  Homolog annotation: Hit_ID=Q93TK1; Match level="QueryCoverage=81%, HitCoverage=73%, E-value=2e-61, Identity=47%"; Hit description =Nonspecific acid phosphatase precursor
  Pfam annotation: Domain name=Hydrolase; Domain location=106-298; Score=1.3; E_value=0.037; Accession=PF00702.16; Description=haloacid dehalogenase-like hydrolase
MTFCLRARPAANRCCVPGLNAPGADVCRPCVEPPVAYSCAARSRSTSQESPMKTVSILAGLTLCLASVSQADDLSAWREGAAKRAITQWVDDTTRAGSADFIPLNQRYVVFDNDGTLWPEAPLTFQLQFALDEVKRLAPQHPRWQQDALVQAVVSNNTAAIAASGKKGLMHLLTLTHSGITTDEFAQRVQNWVATQRDTRFGCRYDRMGYLPMRQLLDYLRAHGFRTWIISGGGIDFMRVLAEQMYGIPPEQVVGSFSLAEFSLSDNGTQLRKTMNGAFYDDEAAKPVAIHLFMGHRP

SEQ ID NO: 139554 - protein, 163 aa, Glycine max
  Coding DNA Sequence Number=SeqID_22776
  Gene Ontology: Mol. function=protein-tyrosine kinase activity; Biological process=protein amino acid phosphorylation
  Homolog annotation: Hit_ID=Q0WN89; Match level="QueryCoverage=73%, HitCoverage=25%, E-value=2e-19, Identity=41%"; Hit description =Protein kinase like protein
SANPGIACISVFGSVRRNTWPLSEQLQNLNHHSSSESSSLIAMAAALECWSRRATTTVHEDHALLMQRPEQDTTPRDSSSSSSSSLVHKKLQKLTRNVSEAIASLKNSLNSTINVESSKLDGPRSLVWTTVLRNLTHLYPGSQLPEKLVCNIRKHYDSLPLRF

SEQ ID NO: 139555 - protein, 347 aa, Glycine max
  Coding DNA Sequence Number=SeqID_22777
  Gene Ontology: Mol. function=protein-tyrosine kinase activity; Cellular component=membrane; Biological process=protein amino acid phosphorylation
  Homolog annotation: Hit_ID=Q0WN89; Match level="QueryCoverage=97%, HitCoverage=56%, E-value=1e-147, Identity=72%"; Hit description =Protein kinase like protein
  Pfam annotation: Domain name=Pkinase; Domain location=89-339; Score =41.7; E_value=4.8e-11; Accession=PF00069.15; Description=Protein kinase domain
  Pfam annotation: Domain name=Pkinase_Tyr; Domain location=89-339; Score=43.9; E_value=3.7e-15; Accession=PF07714.7; Description =Protein tyrosine kinase
  Pfam module annotation: Pfam domain module=Pkinase::Pkinase_Tyr; Domain location=89-339::89-339
MKRLKTGGVKLPFGLCGCQEENSKGRGLGEIEEDGGDAYCGNGFENLSQNIQLRVPLPSSSFLVVIDEWQTIQSGGDEIEKWLLNSDSLEFVEQIAPNSYKGTYMGKRVGIEKLRGCEKGNSYEFELRKDLLALMTCGHRNIMQFCGVCVDDNHGLCAVTKFVEGGSVHDLMLKNKKLSSKDVVRIAADVAEGIKFMNDHGVAYGDLNTQRILLDKHGNACLGDMGIVTACKSVREAIDYETDGYRWLAPEIIAGDPESVTETWMSNVYSFGMVIWEMVTGEAAYSAFSPVQAAVGIAACGLRPEIPKDCPQTLKSLMTKCWNNTPSKRPHFSEILAILLRPSNYNR

SEQ ID NO: 139556 - protein, 115 aa, Glycine max
  Coding DNA Sequence Number=SeqID_22778
  Subcellular localization annotation: CTP_CleavageSite=15; ConfidenceScore=5.05e-01
MSCTGSLSAPLHLTKCTALVHPLSEKGALRQKSLTCAKWSIKLCMSRVSRERKVHVPESFERFCCVKICKDQSLKQEPMHALLRSFNNGNWSDSKVLDSAGLSCSAFTRNQGAIS

SEQ ID NO: 139557 - protein, 159 aa, Glycine max
  Coding DNA Sequence Number=SeqID_22779
  Gene Ontology: Mol. function=transition metal ion binding
MCMIVSSTCFLTFKDGLNTHQDLAEMVSNCHRDTLQLKDPCAAERSKWMYPVKRYMNILKWYTKNLHHPKASIVERYITEEAIEFCLEYVEKAKPIRLSESQHDEKVGGKGSRGLHVITPSLEELQQPHLYILNNNIDSEFYIIKLSDFFNDSKVWHGS

SEQ ID NO: 139558 - protein, 134 aa, Glycine max
  Coding DNA Sequence Number=SeqID_22780
MTLTHLGTKFVLHPQTPSQIAKDQVQIKLKWDEEKNRKRKEEQPLMVKEVSVSSKRLAKKESHFAIKTTIKETFLLRQPPHLLLCKRTLVSTAIPFELDVILQVKEVFHEGVINKKIQKNVLREEAQSFKNLWI

SEQ ID NO: 139559 - protein, 139 aa, Glycine max
  Coding DNA Sequence Number=SeqID_22781
  Gene Ontology: Mol. function=RNA-directed DNA polymerase activity; Biological process=RNA-dependent DNA replication
MAEEGGFPLRDRLRLWIAMRLEKTSNFQLGQRDENVTYLGNQLSDDNMSSLQWIVQANADFFAWSMDDMSGIGLEFHCNKLPIYQDARPIAQRKRKMGEERCQPVWQEISKLLAMRFIREVDYKTWLANMFMIKKSNEK

SEQ ID NO: 139560 - protein, 109 aa, Glycine max
  Coding DNA Sequence Number=SeqID_22782
MIEISHIWGKGKTLERSDENHFRTKQYDVSSIGACRPRIFFINGFLCFLEDEWQRNGERKRERRRHFKEKMGLEETHHHRRSCIRAWRKKEMNEGRGRKENEILCSKEL

SEQ ID NO: 139561 - protein, 135 aa, Glycine max
  Coding DNA Sequence Number=SeqID_22783
  Gene Ontology: Mol. function=ribonuclease H activity
  Homolog annotation: Hit_ID=Q1SZM6; Match level="QueryCoverage=99%, HitCoverage=48%, E-value=8e-16, Identity=43%"; Hit description =Ribonuclease H
MWTTTHSATPTILALVKFCGTILGSGFMRFSGSCGYTTNMNVELHAILHGLNITWEAGHKDVICKIDSLMALQLISGDDIQLHPYAAIVRKIQWEVNECANWRVGQESSFFNLPYADLSALFDPIEAFFVIGCFW

SEQ ID NO: 139562 - protein, 280 aa, Glycine max
  Coding DNA Sequence Number=SeqID_22784
  Gene Ontology: Mol. function=catalytic activity; Biological process =cellular metabolic process
  Homolog annotation: Hit_ID=Q6W2F4; Match level="QueryCoverage=88%, HitCoverage=98%, E-value=5e-69, Identity=54%"; Hit description =Possible nucleoside-diphosphate-sugar epimerases
  Pfam annotation: Domain name=DapB_N; Domain location=31-163; Score= -30.9; E_value=0.016; Accession=PF01113.11; Description =Dihydrodipicolinate reductase, N-terminus
  Pfam annotation: Domain name=Epimerase; Domain location=33-215; Score= -33.3; E_value=0.00054; Accession=PF01370.11; Description=NAD dependent epimerasedehydratase family
  Pfam annotation: Domain name=NmrA; Domain location=33-244; Score= -64.9; E_value=0.00021; Accession=PF05368.3; Description=NmrA-like family
  Pfam module annotation: Pfam domain module=DapB_N::Epimerase::NmrA; Domain location=31-163::33-215::33-244
MHQELQAVVATACRELGDLRGRKIDIEEFKMKALVVGGSGLIGSKVCDILKKAGHEVIPASRRNGIDTVTGEGLAEGLKGVDVVVDVPNSPSFEENDVLEFFTKSSSNITREAKIAGVKSLVALSVVGIDRLPSNSYFRAKLVQEEIIKNSGIPFTIVRATQFLEFLDAIAYTSTHGDVVKVSTAFLQPIASDDVARFVSEAALAEPKNQTVDVAGPEAFRTSDILGSYLQKKGDPRKVVADSEALYFGSKLEADSLVPVGTQPKLGSISFEAWLGSTVN

SEQ ID NO: 139563 - protein, 83 aa, Glycine max
  Coding DNA Sequence Number=SeqID_22785
  Homolog annotation: Hit_ID=Q3SNK8; Match level="QueryCoverage=39%, HitCoverage=19%, E-value=1e-07, Identity=75%"; Hit description=Fec I like protein
  Subcellular localization annotation: CTP_CleavageSite=49; ConfidenceScore=5.19e-01
MSPGLHQQRPRGFEGVSGRNAATYPLGSAAVFRSSRRSWADYRTGKRPSANAKRPEPRQIGPLRAAAPLRKRGDAGFHRATAI

SEQ ID NO: 139564 - protein, 184 aa, Glycine max
  Coding DNA Sequence Number=SeqID_22786
  Gene Ontology: Mol. function=iron-sulfur cluster binding; Biological process=electron transport
  Homolog annotation: Hit_ID=Q0HER1; Match level="QueryCoverage=94%, HitCoverage=46%, E-value=1e-66, Identity=57%"; Hit description =Radical SAM domain protein
VEPVDFTQTAPQFWRDDSIPVSGSRRARPGDLDSVVTDWSVDPDDWGRFLIAVFEEWICVTSEFCGKGLAIEKNGDIYACDHYVYPEYQLGNIANTKLAHLAFSERQKAFGLGKRDTLPAVCKRCPYLKLCWGECPKNRIVRSAEGEPGLNYLCPGIKAFFSYAQPILVGIATLLEREKQGVTQ

SEQ ID NO: 139565 - protein, 70 aa, Glycine max
  Coding DNA Sequence Number=SeqID_22787
MGEVDEVQEWTKVDIEALKEKMAIMMEAVMSMKKMMEVNATVVAVTSAVAEVDPTPPSGTQPNKSSNLGY

SEQ ID NO: 139566 - protein, 336 aa, Glycine max
  Coding DNA Sequence Number=SeqID_22788
  Gene Ontology: Mol. function=metal ion binding; Cellular component =integral to membrane; Biological process=ubiquitin cycle
  Homolog annotation: Hit_ID=Q84KA9; Match level="QueryCoverage=75%, HitCoverage=66%, E-value=6e-44, Identity=41%"; Hit description =RING/C3HC4/PHD zinc finger-like protein
  Pfam annotation: Domain name=zf-C3HC4; Domain location=138-179; Score= 34.9; E_value=2.8e-07; Accession=PF00097.15; Description=Zinc finger, C3HC4 type (RING finger)
  Subcellular localization annotation: CTP_CleavageSite=59; ConfidenceScore=5.05e-01
MGIHTDCPAPAPLSMNLDHARACVLLLIFLMPSATAQLQNSPPPPPLDPFTRLRFDKTMAAVLVILVVVFFAFGFVSIYTRQCAERRIRGRLDLAVAIAGGMERRQHRGLDAAVVETFPTFVYFEVKALKIGRATLECAVCLNEFRDDETLRLIPKCCHVFHSDCIDAWLANHSTCPVCRANLAPKPEDAPSSVEIQLSDPARPIGPNEPGHDPNYINPVEEREGEQNRIVTEPPRVLDDPNRARPVRSKSTGFGIARLFPRSHSTGHSLVRPGAGPARAIRDAEPDEELRDDMAAGEQREKGLPDGECGESPKATRVKDEVDAGERSSDRLFSKD

SEQ ID NO: 139567 - protein, 91 aa, Glycine max
  Coding DNA Sequence Number=SeqID_22789
MAKFGMSSSGSMLATAKDGDGVDIGIEDDSRASIRNGDGVDVVGSGDGVGATSEDLTGIDIADGDGVDDVKLSLGAKAILHGKHASAYTLN

SEQ ID NO: 139568 - protein, 39 aa, Glycine max
  Coding DNA Sequence Number=SeqID_22790
MERFIHLRLQQRITRNNLVTLGLHREQFQKIIRKFFPAF

SEQ ID NO: 139569 - protein, 147 aa, Glycine max
  Coding DNA Sequence Number=SeqID_22791
  Gene Ontology: Mol. function=nucleic acid binding
  Homolog annotation: Hit_ID=Q1S8Q7; Match level="QueryCoverage=80%, HitCoverage=50%, E-value=3e-24, Identity=45%"; Hit description=Zinc finger, CCHC-type
  Pfam annotation: Domain name=Swi3; Domain location=78-136; Score =15.5; E_value=0.00022; Accession=PF07962.3; Description=Replication Fork Protection Component Swi3
  Pfam annotation: Domain name=zf-CCHC; Domain location=10-27; Score =18.2; E_value=0.00098; Accession=PF00098.13; Description=Zinc knuckle
  Pfam module annotation: Pfam domain module=Swi3::zf-CCHC; Domain location=78-136::10-27
  Subcellular localization annotation: CTP_CleavageSite=63; ConfidenceScore=5.40e-01
MEGTRAGTATGSYKCGKPGHWLRDCPFSAPNSNFNLNPNPNSITATTPNPNTPNRSSSSFKPKSATKKPNMLPRTKPKLTPELLLSDDDLGYALRYFPRKFKYCGRGHEFVHKVEKVAATRRGKGHTVRLGVCILPMLSYYSLLLEN

SEQ ID NO: 139570 - protein, 98 aa, Glycine max
  Coding DNA Sequence Number=SeqID_22792
MHSSLAFQTLAASYVALGLVMNRNQSRRKHWRDPYVEHLAVSTGEMVDDGVCRFYCWRHQCPVSKYRQEEWQHQCLRGDLASTAGGTLVSLFLLVASP

SEQ ID NO: 139571 - protein, 75 aa, Glycine max
  Coding DNA Sequence Number=SeqID_22793
MLKLQCIIKAKGRLGTPTSNGNGVQPKEAAPGLAVKEKARGRAFRKCLAPSRLSLASRWTHPSLPPKLLAEIMAC

SEQ ID NO: 139572 - protein, 237 aa, Glycine max
  Coding DNA Sequence Number=SeqID_22794
MKQLKRNGGGRPTTRFAKRSNSVRKPFHDVINPLLNIPWYQLRVTLSRYRDATLCDLKDPPQGITAIESWYVKFDRVTWMAWRIHWRGSVVIAEIEETQVFEDRVNLVGKVIISVIDGNLTVGQADDGFFKVIGGRLSSSVVSHDDGMNVDEGREDAPLFQEGKNSSDLAELFIDSFITMYGGVFLVRTGLEVVTGIDGEDGACEVPVVLSVVLTVWNFNSVAGTNSAALLADGSIC

SEQ ID NO: 139573 - protein, 546 aa, Glycine max
  Coding DNA Sequence Number=SeqID_22795
  Gene Ontology: Mol. function=monooxygenase activity; Cellular component=endoplasmic reticulum; Biological process=electron transport
  Homolog annotation: Hit_ID=Q6J540; Match level="QueryCoverage=96%, HitCoverage=96%, E-value=1e-168, Identity=57%"; Hit description =Cytochrome P450
  Pfam annotation: Domain name=p450; Domain location=51-534; Score =235.8; E_value=9.5e-68; Accession=PF00067.12; Description=Cytochrome P450
MDHSSIHLLSHLHLQALWTSLIIIVVFCITFLKGFGPHLFKRTKKQKLPLPPGPKPWPIIGNLPEMVANRPTFRWIQKLMNEMNTEIACIQLGNVHVIPVTCPTIACEFLRKQDANFASRPTSMTTTLISRGYLTTTLVPFGEQWKKMRRIVGNDLLSTTSHQRLEYKRVEEANNLVFHIYNNCKNNIANGNNNVGLVNVRDVAQHYCCNVMKKLNFSRRYFGEGKKDGGPGSEEVEHLDAIFTMLKYIYDFRVSDYVPCLRGLDLDGHEGKVKKAIETVGKYHDPIIEQRIKEWDEGSKIHGEDFLDILISLKDANNNPMLTTQEIKAQIIELMMAGVDNPSNAVEWGLAEMINQPKLLQRATEELDKVVGKERLVQESDISKLNYIKACAREAFRLHPIVPFNVPHVSIKDTIVGNYLIPKGSHILLSRQEIGRNQKVWGNEAHKFKPERHLIMNKSEVVVLTEPDLKFISFSTGRRGCPAIMLGTTMTVMLFARLLQAFTWTAPPNVSRINLAENNHDILLGHPLVALAKPRLTPELYAMHDK

SEQ ID NO: 139574 - protein, 581 aa, Glycine max
  Coding DNA Sequence Number=SeqID_22796
  Gene Ontology: Mol. function=RNA-directed DNA polymerase activity; Cellular component=chromatin; Biological process=chromatin assembly or disassembly
  Pfam annotation: Domain name=RVP_2; Domain location=106-233; Score= -31.0; E_value=0.00026; Accession=PF08284.2; Description=Retroviral aspartyl protease
  Pfam module annotation: Pfam domain module=RVP_2::RVT_1; Domain location=106-233::331-536
  Subcellular localization annotation: CTP_CleavageSite=73; ConfidenceScore=5.18e-01
MALQPISLLQATALAKLQEEKLRDRPTPTPRSFPQPKPSPNHNPNTSVKPKSSFVQRTPTEMAFRREKGLCYNCDEKWNANHRCKGRGAVVTDNHEFPSNADCSHISLHALVGLPSSETFRIYGTVKNARPTILVDSGSTHNFLQPRIAQFLRLPIQDTHPLRVMVGNGAMLTCDQVSPKTQVTIQGHPFVVSFHLFPISGADAVLGIDWIKRLGPVTTDYAEFLMHFNHSGQDISLKADVLHVMTAMQPDSPTSQHPIQYVEHLLLRYDHLFQTPSQLPPPRQVVHRITLKPSTAPVNVRPYRYPHFQKNEIERQVSDLLSAGLIRPSTSPYSSPVLLVKKKDDTWQLCVDYRALNSVTVRDHFPIPTIDELLDELGCASWFSRLDLRQGFHQILMDEHDVEKTTFRTHNGHFEYLYTTARCHLTYTTWRLSFVPFNKESIEYMGHIVSGKGVTPEPSKIQVMVRWPSPTTAKELHAFLRLTGFYRKFIKSYAFFAAPLTKLLCKDAFGWMHESQMAFDQLKSAMTNAPVLALPNFSEPFVIETNASGTAIGAVLMQRGHLLAYFSKSLGPRLLHASTYI

SEQ ID NO: 139575 - protein, 140 aa, Glycine max
  Coding DNA Sequence Number=SeqID_22797
MASPPLHGLAALLLYPPSPSTTVYGHLQIHTRPDLELKILTQDLTLKLLLGSFLMLLETKEPKKESLIEEYEIRIIKESLEDCSNCLLCKGKSTAMVSNSDASKDNLHLDGFEKDDLGAVWGGRTPSFEYSNFLANGKRG

SEQ ID NO: 139576 - protein, 102 aa, Glycine max
  Coding DNA Sequence Number=SeqID_22798
MLNMLIDYENQVTYDLLKLLDTVYTNLMSIKCLLQEDLFLERVFLAGGSHGKKIELDETQLTNETTQDYEMETEIPFFNVLKLPQRSSPPTIVVQEPAIVQD

SEQ ID NO: 139577 - protein, 270 aa, Glycine max
  Coding DNA Sequence Number=SeqID_22799
  Gene Ontology: Mol. function=RNA-directed DNA polymerase activity; Biological process=RNA-dependent DNA replication
MDGLVEPFMNEEIKSSWKVVEGKVSAAIHEFHSNTSLPKSITSFFITLIPKTQHPQNLLEYHLISLIRSLHKIISKVLAVRLKKVLPSIISRCQIVFLPGRQILDGVLVLNVEAMTSKIILMMPKNQELSKFQRIRSQKASRIKFQRIKIQEQSSFKNQDSRLKIQESREDSIKISTKKRIQGTNRLRILCPNTLEGTSFVVQVEGTSTWIVILRTRGYISYGSVQVEGTSTWLFKENKGGYIPCGSFACKGFYKVERNLKNRWLLGDWM

SEQ ID NO: 139578 - protein, 150 aa, Glycine max
  Coding DNA Sequence Number=SeqID_22800
  Gene Ontology: Mol. function=RNA-directed DNA polymerase activity; Cellular component=chromatin; Biological process=RNA-dependent DNA replication
  Homolog annotation: Hit_ID=Q2HU95; Match level="QueryCoverage=63%, HitCoverage=20%, E-value=2e-12, Identity=42%"; Hit description=RNA -directed DNA polymerase
MGCYEEHKVIYATYKLSGEIEDWWKEFLRELLPEKAREFLELKQGNMTMGEYASKFNKLMNKARKVENDKTFMVLFSSMTEEFLDVGGVPVVYEFIKVFLEDVIELPPKRELEFAIDLVSGSSLVLRAPYLISLKELAKEKEQVEDLLKK

SEQ ID NO: 139579 - protein, 249 aa, Glycine max
  Coding DNA Sequence Number=SeqID_22801
  Homolog annotation: Hit_ID=Q6T7C7; Match level="QueryCoverage=15%, HitCoverage=22%, E-value=4e-12, Identity=89%"; Hit description=Fiber protein Fb38
MALTILGLQHQTLVKGTRLCGPPHHKRRIWYVGKLVGRYYDSQGNPTKYLKGVEVKAARGAQLLEKQKIEEAKLPSCNSRWSQDEGGEVWCDVGYPRLVQRPLEIALTGKMSKRCACFEDSQLDQPGLEGTSFVVQVEGTSTWVVVTENKRGYISCGSVQVEGTSTWLFKENKGGYIPCGSLLVKVFTRLKRNLKERMLLRDWMPLDPTLVNGDYSTFGALIWRGELTGFTLLFLTGSETMLFELGAED

SEQ ID NO: 139580 - protein, 47 aa, Glycine max
  Coding DNA Sequence Number=SeqID_22802
MDKTFKGDSKLMVNLPKFSREEWPKVRFAEGQRMVYNNKKAEGFGNG

SEQ ID NO: 139581 - protein, 128 aa, Glycine max
  Coding DNA Sequence Number=SeqID_22803
  Gene Ontology: Mol. function=transition metal ion binding
  Homolog annotation: Hit_ID=Q6T7C7; Match level="QueryCoverage=74%, HitCoverage=58%, E-value=8e-13, Identity=54%"; Hit description=Fiber protein Fb38
MSLKTLATSPLSGITLLVLLIALLLRFYIKFETAERLFSAEELSLFNGTDEGLPILLGILGENLIMVLEGDTIILLEGMLLVHLSLEISQNWGQLTTIDENCIFTINYREMREYVVFYMWGRESVDFT

SEQ ID NO: 139582 - protein, 139 aa, Glycine max
  Coding DNA Sequence Number=SeqID_22804
  Gene Ontology: Mol. function=DNA binding; Cellular component =chromatin; Biological process=DNA integration
  Homolog annotation: Hit_ID=Q1S858; Match level="QueryCoverage=98%, HitCoverage=21%, E-value=2e-36, Identity=48%"; Hit description =Integrase, catalytic region
MRQRRWMEFLKDYDFELSYHPSKANIVANALSKKSLHMFVMMVKELQLIEDFKDLNLAMEEAQQGDQFWQDMTRLKEEDMELKFRHDANKLIRFMERVCVPQVKEIKHVILEQAHKSRLSFHLGSTKMYQDLKRNFLWN

SEQ ID NO: 139583 - protein, 39 aa, Glycine max
  Coding DNA Sequence Number=SeqID_22805
MVKNEWFETSRLKNSSKKVKVELGQKWMSHFNHKWKSFG

SEQ ID NO: 139584 - protein, 108 aa, Glycine max
  Coding DNA Sequence Number=SeqID_22806
MMKINRKLEEMFNTVHIKDQSYGEVNRSFAIRWKDQLEHTWHLLDSTRSMHSITFNQDLVNPTILARWTKLKDFYGLTGNHQVTMTHFGQCFFLTIFKSRFKPKADPK

SEQ ID NO: 139585 - protein, 223 aa, Glycine max
  Coding DNA Sequence Number=SeqID_22807
MAFLSPMKKTHGSCHQRLFKENVRKTKRGPRILKRWVRELFTHREGKGHLVQGKLAQASWFLIAEGISSPRRVGCLRMNAFHGPGKPNVGLGELRPRNIQKMAILTPFLVKCIQVFVEKKEYPLITLPEFTWVDKEQQVSRRYDEYIVEYLTDEDLGNLAFLKSLPRHLPTKLIVNLFKSLNPIRDLKGIMAQASSNMTAFLLAHKNRTPAGVDISIPTQSSI

SEQ ID NO: 139586 - protein, 61 aa, Glycine max
  Coding DNA Sequence Number=SeqID_22808
MGVADFSPLLIFLALDRRAYFSLLHVKEFKEAGSRVKDPTNEVFKVSSNVDLLGSNSVMPM

SEQ ID NO: 139587 - protein, 472 aa, Glycine max
  Coding DNA Sequence Number=SeqID_22809
  Homolog annotation: Hit_ID=Q1RWU1; Match level="QueryCoverage=41%, HitCoverage=44%, E-value=4e-13, Identity=28%"; Hit description =Resistance-like protein HAAS-2-related
  Pfam annotation: Domain name=DUF1723; Domain location=163-213; Score =41.8; E_value=2.4e-09; Accession=PF08330.1; Description=Protein of unknown function (DUF1723)
MVKTRGLGRALGQVTGRGVGRGDHADFDDAPQRRRPTASARRQRVTVTATHDEPVVPAPDVQDDPMEPPATAEDIVVDIPADTGAEAAEDEHQGFPGGPSDPSVLTQYADHVACSVWMEEKRPELKLSSHGRKVHSLGRLVPAIEGLIASTGLSPLIACSVDTGDRGLLSAFVERLHRETSSFHLPVGELTITLDDVSSLLHLPSLPGLRQPSVVDRTYACNGYMIYMSADARQALRDLSMTERYAWGVTALVHMYDQLNDASMSHSRQLGDYITLLQCWIYEHFSSVAESTADQDYDEASPIPYGEHREVRDFHVRSCYSGLLRWGPVVVYYRPERVVWQFGYTQTILAPPVDSWVSYDDIHDRWMHYEDHIVPAGEVCVVSGQCSNDYMDWFFGISHPLMTPGHASNSLLHGHALQPRVVPQAPQTDIPHVPEPGASSTSAEEPRHAVEVCDDIAERLERHLSLGVVTPG

SEQ ID NO: 139588 - protein, 117 aa, Glycine max
  Coding DNA Sequence Number=SeqID_22810
MVETKTKTKRNLPQQCRREDTATPLSTPTKKKTNKGHEEDEEHAIGRSRRRRAKVTKKTKKKIVLKIFREEEEGRVEGMNKQEWRGRSRNGEEEAEEAKMAKNAEEAEMAEMNNFFF

SEQ ID NO: 139589 - protein, 100 aa, Glycine max
  Coding DNA Sequence Number=SeqID_22811
MISQLHFRCPISVNNQCIKYNAMHLLDDDDVEIMFFRLARNPYIHCAKWYIIEEADSQSRADPSTYEPTQEDTNFTNAKLMLKMLELKKYNDSIRPYYHL

SEQ ID NO: 139590 - protein, 79 aa, Glycine max
  Coding DNA Sequence Number=SeqID_22812
MQTYVLETSSKIFESIQRLTNSNEGNVTGAMIIGCGITWMLWKLGRIDGDPALRGTRIRATWEYVSLVGGGQQGMVGYT

SEQ ID NO: 139591 - protein, 104 aa, Glycine max
  Coding DNA Sequence Number=SeqID_22813
MANKNISSNETYLPTLIPKTIPKLQNSLRVGKGNIGSKGLSKELIQGRLIWLEAYKNKMPKSSPNMHVKQEVSTRVKPRLLCKQSMGQNTLNKIDDDGSNSHQG

SEQ ID NO: 139592 - protein, 120 aa, Glycine max
  Coding DNA Sequence Number=SeqID_22814
MAPPPLVVLEAREFAMSYNASASYSSHLPFNFRIRYIGGSLLVLMLQLYECVKNRYHIKFQSFLNFLRRGFYALVPTLYIEGYIQAMRDSLYRQEYLRVRVIDNQEIVELSAHKLVSFPK

SEQ ID NO: 139593 - protein, 124 aa, Glycine max
  Coding DNA Sequence Number=SeqID_22815
  Subcellular localization annotation: CTP_CleavageSite=54; ConfidenceScore=5.33e-01
MELKLHASMASIPHAIFTHSFSFVPFCTYAAPNISRRRNGNTNSRSTHKIPSLRKEKYPNEQKLMLNHQNQNPLNVDLVALCEEGKWRMTGRCRRGVEVGETAVTEEATEFWMTPLPVKKDKSG

SEQ ID NO: 139594 - protein, 124 aa, Glycine max
  Coding DNA Sequence Number=SeqID_22816
MGENSKATIEKSQWKMESVKQWKPWRANPKGREIKSHNGKWKNAKRETMETVETQLEVEKHKQYILCGTSRGYISCGSVLVEGTSTRLFKENKEGYIPCGSLLVKEFTRLKINLKDRRSFRDWM

SEQ ID NO: 139595 - protein, 106 aa, Glycine max
  Coding DNA Sequence Number=SeqID_22817
  Gene Ontology: Mol. function=transcription regulator activity; Cellular component=integral to membrane
  Homolog annotation: Hit_ID=Q9LK26; Match level="QueryCoverage=100%, HitCoverage=42%, E-value=7e-22, Identity=49%"; Hit description =Arabidopsis thaliana genomic DNA, chromosome 3, TAC clone:K17E12
MDRCVAAREEHDECGELVEDEGEVPGAIEEGDEVEKVNDEVGGVEVQHDVLEFHVGSGETAIRGGEDGGGGEEHHQSAMEDGNEVAGGFGSGLGTPFAKYDEVAEE

SEQ ID NO: 139596 - protein, 204 aa, Glycine max
  Coding DNA Sequence Number=SeqID_22818
MKGYNYKSLRALVIDNQANPVLDLSKQKKRNKVEDSSITNLGGVSKPLGGSDYTTDDVVVVASVDERFKAMYEHLKTMKVEVSKTKQLGVALAKSFEYPSYHIEKDVMDVNTKLDGLSSELAIEQYKMTQLLRMDLPNLVQAFLLRASVLSTALDIILLSEGSPISTGIMALVLYVSMNEEYSDSPKPTPSFEGVQPMMQDVSL

SEQ ID NO: 139597 - protein, 128 aa, Glycine max
  Coding DNA Sequence Number=SeqID_22819
  Subcellular localization annotation: CTP_CleavageSite=41; ConfidenceScore=5.37e-01
MSAELLPSIKTCLTSQFVIRTVITIGSSCSGSTPTKSSSVKAIGGSDFLRQIRDYNNVRGLEVNTLTLEGGPMSLLTLNLNQRACFDNHKVPYCLGVEDKTVVVIKHLSGQLLGYRDPNDACGPEVAT

SEQ ID NO: 139598 - protein, 343 aa, Glycine max
  Coding DNA Sequence Number=SeqID_22820
  Gene Ontology: Mol. function=DNA binding; Biological process =regulation of transcription
  Homolog annotation: Hit_ID=Q1SC80; Match level="QueryCoverage=77%, HitCoverage=79%, E-value=3e-60, Identity=50%"; Hit description=Myb -like DNA-binding domain, SHAQKYF class, putative
  Pfam annotation: Domain name=Myb_DNA-binding; Domain location=63-114; Score=43.1; E_value=9.2e-10; Accession=PF00249.21; Description=Myb -like DNA-binding domain
MEERHGSQCSKTNPSNIDEDEECESEANEEQSTQKNNGGSSSNSTVEENEKKIRPYVRSKMPRLRWTPDLHLRFVHAVQRLGGQERATPKLVLQLMNVKGLSIAHVKSHLQMFRSKKVDDRNQVFADYNNLVEIGDKNIYNISQLSMLQGYNPSQSSSFSYTNNYPCYGLGDASFGVYEKLLQRPFDWSNAISREGSSIFGEQSKIREPKDEFLSFGAHDSLSARARLSHVDHIPPINILQQRAQKNTMPINPTTNPPELKTLKRKASDTTLDLDLSLKLNSKIDDAEEGTLKNHEVDSTNLSLSLCSQSSSSNNPISRLIKEAQQDRCDEQGKMASTLDLAI

SEQ ID NO: 139599 - protein, 111 aa, Glycine max
  Coding DNA Sequence Number=SeqID_22821
MGAKYLEVVERGSHPNNGWSPDEIRERENEKFWEWGIVLERGGGRGGSGPKHQARMLSGGTRQSWGRWMKPVLILKHYEIECESCDTQRAKSLLEEFLKEKRERSENKGKK

SEQ ID NO: 139600 - protein, 191 aa, Glycine max
  Coding DNA Sequence Number=SeqID_22822
FFRKYASSGILPDEPLLPESSRKRFSGSLPEEVFFRKTFGYFRKNTSSGNFPEKVLPELPEEPLTGLPEVSAVSLFSPFFPASSPLVFYPKVTILRGVRETNLVRGEEEDEVRACLAGEEEAVRGEGRTSFAEGMSNSIKQYCWVHLASPEVEEGEGFNDELTHDKGGVIAAVAGVMEVGKIGWCRWCWEG

SEQ ID NO: 139601 - protein, 93 aa, Glycine max
  Coding DNA Sequence Number=SeqID_22823
MYVRQANWLYSARYRLRKQARLQNLKNLAESHEAEVSMNQSQLHFWKTARDELVEENAMMKAQYDIASKLVAEKEALNWALMEEIQRLRNNLI

SEQ ID NO: 139602 - protein, 374 aa, Glycine max
  Coding DNA Sequence Number=SeqID_22824
  Gene Ontology: Mol. function=RNA-directed DNA polymerase activity; Biological process=RNA-dependent DNA replication
DEEVVEKFLKKYFPESKTVEGKVEISSFQQHPNKSLSDALDHFHGLLRKTPTHRFSELVQLNIFIDGLRPQSKQLLDASVGGKIKQKTLEEVMELIENMASGDHAIIRDRAYMLTKKILFELLSQDAMLAQNKLLTKTLETVTATLSNLSQQLHAVQAPPTMHTRGCNICGCAHESGSCMVQDDTTNEVNYTGIQNCQGFHQGGTPRFYQRVQFIQRIESHQKSIDATIRNLEKPEADKVLQDASKEEEEDNEGKKKIDEKRDATDLTKEGTVPSGAIKEGQGALLQAFLKHLLTKKGKYINSETIVVGGNYSAVIQKLPSKFKDLRSVTIPCSIRDVFVGKALVDLGASINLMSLSMCKRIGNLKVDPIRMTF

SEQ ID NO: 139603 - protein, 66 aa, Glycine max
  Coding DNA Sequence Number=SeqID_22825
MSSTWVSSATNTDLAMREENFREASSQKEVSSEGWSVLEGEVVPLDDNEGFSLKKVYNWSLQPNPA

SEQ ID NO: 139604 - protein, 72 aa, Glycine max
  Coding DNA Sequence Number=SeqID_22826
MPSFTKTIGVCLNIRLPHMLGTRFHCIATPNTQYKLAVNRKAIGYTFPKKTTTIDVDSDIDLDLSMEILVGF

SEQ ID NO: 139605 - protein, 54 aa, Glycine max
  Coding DNA Sequence Number=SeqID_22827
MRNIVRYGMSESNMWCHQVRLFHMGLHEPILWTTCLGLIPDYANAEIVGHESCT

SEQ ID NO: 139606 - protein, 192 aa, Glycine max
  Coding DNA Sequence Number=SeqID_22828
  Homolog annotation: Hit_ID=Q2QV44; Match level="QueryCoverage=42%, HitCoverage=63%, E-value=3e-29, Identity=75%"; Hit description =Expressed protein
  Pfam annotation: Domain name=Ribosomal_L37; Domain location=83-191; Score=116.6; E_value=7e-32; Accession=PF08561.1; Description =Mitochondrial ribosomal protein L37
MADGGVWQKAKILPYKNAIAAYDAAIEGLPSKIAYDGWQNIGHTIPPWQPLQCHFTTLKKVMAMNHARSIRHILTTKEVVGVACQRTFATGKAKKGSKGGAAADAPKASTLSKEVKSSTVVGASILKEGTDPKIQPDSEYPDWLWHLLDKCPALSELRRRNIDTLSYEDLKRFVKLDTRARIKENNSVKAKN

SEQ ID NO: 139607 - protein, 224 aa, Glycine max
  Coding DNA Sequence Number=SeqID_22829
  Homolog annotation: Hit_ID=Q6K5G3; Match level="QueryCoverage=98%, HitCoverage=32%, E-value=1e-72, Identity=62%"; Hit description =Ankyrin repeat-like protein
MPPTYFPLRWESTGDQWWYASPIDWAAANGHYDLVRELLRMDSNHLFKLTSLRRIRRLEVVWDDEEQFNDIAKFRSEVAQKLLLESESKRGKNSLIRAGYGGWLMYTAASAGDLGFVQVLLERNPLLVFGEGEYGVTDILYAAARSKNCEVFRLLFDFAVSPRFLSGKGGIMEENVGDIPSVYRWELTNRAVHAAARGGNLKILEELLANCSDVLAYRDADGST

SEQ ID NO: 139608 - protein, 132 aa, Glycine max
  Coding DNA Sequence Number=SeqID_22830
MEEVVIVVYYDGDMRPHFKGLLFECPNGLKFSKISEEMPLASLGKAVTNAIRGDGCVEYDYMELNDNHDVGKMFLIFLQFSSKGSIELYAMIGQSREETLALLCKPKSVKEIITLMRGSMTTTSSSEVDNFV

SEQ ID NO: 139609 - protein, 430 aa, Glycine max
  Coding DNA Sequence Number=SeqID_22831
MLPERKVELYHTELDDFKTELERCNFHKRLTNLVDGSIDLALVKEFYANLYRSEGPSPKQSRVRGHLMKIDADNLNTFLETHVVLTEGETLPTYSRYCMLPTDYREIEVALCIPGRGFILNTNGHPGKILKKDLTTLAQVWSVLSYSNLAPTSHTSDLTVDRARLIFGLVSCMDMNIGALISGQMTSIAQSNTSRLGFPTLITALCRAIGVVSDSLTFERLSPDLIISIRGATTELPSTFAAPTPTSTSAAPSVPAQTYSQHFKAMLQSIHQGQIILLQSLQVVATPGSNPLVEQFREMIAWPRTQPSLHREDKGPTAQVPKHMEDESSEATILEPFVLGEEEGETQVRQVVAVTPERSLEATSEPPAPLVDLPSPQRTTNPSTPILEMPEDQTTLVLTMDTSPPATPVLHLTNEEDVQTQDTQDQSQEF

SEQ ID NO: 139610 - protein, 69 aa, Glycine max
  Coding DNA Sequence Number=SeqID_22832
MEFCNKGKSGCKCWVPLICLPLKVEHVVKEGEVVQINVTGERQRPNDLDSGGVVEAETMEHDDLVVDIV

SEQ ID NO: 139611 - protein, 278 aa, Glycine max
  Coding DNA Sequence Number=SeqID_22833
  Gene Ontology: Cellular component=nucleus; Biological process =transcription
  Homolog annotation: Hit_ID=Q10KZ5; Match level="QueryCoverage=74%, HitCoverage=81%, E-value=3e-27, Identity=38%"; Hit description =Expressed protein
MVDEWVKATTTTAITGSEEGTPDSVNPSVVDDDEEEGLPSPPLDEGAFFVTQAGSMELSQFFDGMDDDGNPRPTGPFSKNRENGRKPVFDSHVVEKRKSQASHDTAIIDRDVKSQQQAKKNEAVVPERPNKPVTADSGPGRPPKSNMQRKSNMEPKMQQKMENNSITRRPPTGQLDKSKRSDDSAVQVKLEATKRKLQESYQQAENAKRQRTIQVMEINDLPKQEENRIAYKNKRVKMTLDGWHWTNCSGKVQVTNPIQYSLIHACAISVYHKTQHRS

SEQ ID NO: 139612 - protein, 185 aa, Glycine max
  Coding DNA Sequence Number=SeqID_22834
MMEGSKGFFMRGVPDLAKFDWINVRQNGSGFDKQQQQQQKHEPTHTHTHKKTRMLINDKKQHRRVFALLGCCFKILELQTKTSGKKRKERPFSSVVVKRKIGNPGNNQKNLNVSFFLAIAVWVRNVAPRRQTNTACLRNWFLFEQAKNHLCCVERERRGCEWWSFWVCFDFDQTEAMVEGKEKLG

SEQ ID NO: 139613 - protein, 70 aa, Glycine max
  Coding DNA Sequence Number=SeqID_22835
MQHRCYNINDTGVFGVVAAFEITKVRSFIIVTTKWFYGSPTPQEGKAMIFLTSINWSLSMHRHAKHYIRA

SEQ ID NO: 139614 - protein, 104 aa, Glycine max
  Coding DNA Sequence Number=SeqID_22836
  Gene Ontology: Mol. function=calcium ion binding
  Homolog annotation: Hit_ID=Q69V45; Match level="QueryCoverage=47%, HitCoverage=22%, E-value=8e-16, Identity=80%"; Hit description =Calcium-binding EF hand-like protein
MANNYVFMTFLIDGDSNGAIDQEELKKCFNKLEISFSEEGINDLFEACDIKEDMRMKFNEFIVLLCVVYLQLCVFEACDIKDDPATLQCFILMILKANDGWNLA

SEQ ID NO: 139615 - protein, 126 aa, Glycine max
  Coding DNA Sequence Number=SeqID_22837
  Gene Ontology: Mol. function=chlorophyll binding; Cellular component =integral to membrane; Biological process=photosynthetic electron transport
  Homolog annotation: Hit_ID=P56777; Match level="QueryCoverage=90%, HitCoverage=22%, E-value=2e-49, Identity=81%"; Hit description =Photosystem II P680 chlorophyll A apoprotein
  Pfam annotation: Domain name=PSII; Domain location=1-126; Score= -160.7; E_value=0.0017; Accession=PF00421.9; Description=Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGVAGAHIVFSGLCFLAAIWHWGWLVLVLAHFM

SEQ ID NO: 139616 - protein, 97 aa, Glycine max
  Coding DNA Sequence Number=SeqID_22838
MGSYLAHGPEIYPKAPENPRAFSYISGLIFLESSIQCPWGVGLHHLACDRPLTPNLSKYPITYDGAGPKSTPSAIKKESSQGENTPSLRALSLLPKA

SEQ ID NO: 139617 - protein, 91 aa, Glycine max
  Coding DNA Sequence Number=SeqID_22839
  Gene Ontology: Mol. function=amino acid transporter activity; Cellular component=membrane; Biological process=amino acid transport
  Homolog annotation: Hit_ID=Q10HT5; Match level="QueryCoverage=94%, HitCoverage=15%, E-value=5e-23, Identity=56%"; Hit description=Amino acid permease family protein, putative, expressed
MFVAFVKLRRKFPYAERPYKVPVGKTGAILMCVLPTLLIFVALALASFKVLIVSFSTMIIGLVLRPCLKYMEWRRWLRFSINPDLPDIYAT

SEQ ID NO: 139618 - protein, 143 aa, Glycine max
  Coding DNA Sequence Number=SeqID_22840
  Homolog annotation: Hit_ID=Q1S1S9; Match level="QueryCoverage=19%, HitCoverage=6%, E-value=3e-08, Identity=89%"; Hit description =Alcohol dehydrogenase superfamily, zinc-containing
MELHCISCLFTTLEVEWLEASKGKDNRHSMHIFTRAEAKTGVLESFLVENNNARKVNVWSDILKETQSAISLGVDSTPQVYALQTAPTIQRAMMIYVKLSFPITGQKESSMMIARAFGASNIIDVDVRDEKLQKAKTLGITTL

SEQ ID NO: 139619 - protein, 124 aa, Glycine max
  Coding DNA Sequence Number=SeqID_22841
  Gene Ontology: Mol. function=transferase activity
MKGEEEKRKEQCEGGEGKREKRKERGEEETKFYIHIEAFSTKKCIAAIRILTYGSLVGTVNEYVRIIKCTAIEYLEDFVKGVNEIFRDEYLRSPNNNDINRLLQIGEAHGFQDMLGSIDCMHWE

SEQ ID NO: 139620 - protein, 582 aa, Glycine max
  Coding DNA Sequence Number=SeqID_22842
  Homolog annotation: Hit_ID=Q8L720; Match level="QueryCoverage=65%, HitCoverage=87%, E-value=1e-72, Identity=41%"; Hit description =Expressed protein
MDSCGKSSFLVPQEKGSCPSIGSVFDGYLIKNCSRLGNSFSLCGFNENLDEETCFEMINALLGDLDDSEEVVIDDDVLDRLPMDPFGMNITAFSDWIGDFEWGFRPEDVEFGVDETHEKIGDHDHLHFLGLSWAWNGPENLQPHKVNAKGNDMSVSGDVLNGYQNFDVVFDEGIVVDGSTRGFLSVSHGDYRVQSREVEELRNCTEIECDAEGGVPHDALFFVLGYLGVRDLLSVEGVCRSLCDAVRGDPLLWRTMHIDQPLNERITDDTLVKLTNRAQGTLQHLALVNCLWITDSGLRRVLQSNPRLTKLSVPDCIRLTIEGILFHLRALKSSGKLGIKHLRIGGLAGVCHVTDQQFDELKELLDASKYLQQGDQKPQFFGEYSHIICEDDRAIDIEVCPRCKKLRPVYDCPAESCQQKHQASQLCRGCTICIARCIHCGRCIKDFDYEETFCLDLLCLNCWNQFLHCPEKGGKEATKSAPDLHDDLLTYIGSESAHLAVWFLMCKTELSVHGITFGCGGIEFTQLLSLSWIIGDAEEGLLVLAVDLFSAVRCIEENVAIENNLRFFCSCKMAKAISTILR

SEQ ID NO: 139621 - protein, 146 aa, Glycine max
  Coding DNA Sequence Number=SeqID_22843
VASLEVEVAKWRVAARTLWQVDRPKVANATVAFTNIVRANRQLSPKVKKINLGGKVESMAAENDRLAKRITELETPLRESKSRLEESEQCASKEREANKELEEELIMYKKEDVKEGVLLDEEEIDAKEEVVGEGQGVAEQGDDACV

SEQ ID NO: 139622 - protein, 312 aa, Glycine max
  Coding DNA Sequence Number=SeqID_22844
  Gene Ontology: Mol. function=hydrolase activity, acting on glycosyl bonds; Biological process=carbohydrate metabolic process
  Homolog annotation: Hit_ID=Q9LRY8; Match level="QueryCoverage=53%, HitCoverage=45%, E-value=1e-44, Identity=50%"; Hit description =Polygalacturonase-like protein
MGDTSTRSSAINSATYDFLNDLEPLGWMHTQLNELPQLMPQDLTSHAKILENNNQWDEEKCIIFTCSFTPVAFLLVLALSNEVRVNGDGGGRQCEINPALKPRPHNVSILKFGAVGDVLNFKNSGAQLYVPPGTWLTQSFNLTSHLTLLLEKGVEVPGGRYQSLINGYMLHDVVITGNDGNIDGMVLAWWELFSSHSLNYSRPLLIELVASDHVVVSNLTFFNAPAYSIHPVYCRGIVHVVSAYGYLMLDLTCCQFISHATMSIIADCCPNLVCLKLECCDMVTENFLYQLGLNCSLLEELDLTDCSSVDGI

SEQ ID NO: 139623 - protein, 58 aa, Glycine max
  Coding DNA Sequence Number=SeqID_22845
MVHMGEAQIIYNVACASGCDSSWMHSGKSVCVCHNCRMRMGVCEGGLTFDARSSANHG

SEQ ID NO: 139624 - protein, 168 aa, Glycine max
  Coding DNA Sequence Number=SeqID_22846
  Pfam annotation: Domain name=DUF1262; Domain location=23-168; Score= -143.6; E_value=0.035; Accession=PF06880.2; Description=Protein of unknown function (DUF1262)
MYVTRPLSLYKKSANGLPLPPPEGPNSGILVIQDQDLEPTSCFGLGEEYHEVKELPFPQNLNLELFYRSGISLNRTTHHHHVAFIPVLNQPLPSNKYYVINLSGKKRGEPSKVDTLQGLSRRWKVSASTSSDYSLRQASGVSEALRAIKPEFKFSLAKKSSESVVVGK

SEQ ID NO: 139625 - protein, 66 aa, Glycine max
  Coding DNA Sequence Number=SeqID_22847
MKFLLLLNSIRSEGVCGVMSQQPPGGRSIQEKDRELRQEEREDGGGRVATFGELISTTAYGVVQEI

SEQ ID NO: 139626 - protein, 471 aa, Glycine max
  Coding DNA Sequence Number=SeqID_22848
  Homolog annotation: Hit_ID=Q9LI86; Match level="QueryCoverage=42%, HitCoverage=44%, E-value=2e-20, Identity=35%"; Hit description =Arabidopsis thaliana genomic DNA, chromosome 3, BAC clone:T5M7
MGWIAKLIDGSKATEALGEDDETFEQWKLEKMKWAREMKIRDYDKLLHLKKAMRERNKGVEDQSYTNDMDCYYYSTSEFTPCKKHPSSSSSSVGICAYCLKDRLVKLVCSDCGEQRLSSCPCSDEMASSHRNSCTVEVGSVGRVSFLIENENNNESTPVVLQRLNHNNKAEEDNNNDEDEVVVLRRSSSSCVEIKRHHHGGDGFWRIGKLFRKKKDQKGCRRSVVGFDERNSEMWVVDHQGGVSRSRSLCSFRGGGLFGSEDGGDSVLSGARSSISAARSSGVNMLESGRRSGYSEAEPRRSGFDGVERRDFLFDSYESGNDLKGGVKKGGLMDGGGDGGGFYGGVNRRVFSLRESDFKGMDESSFIDLKLDYSSESKHEFSAAKMSNNMGGDTFSSFRNGNFMPHDVGGGSYGGLVGDGVLTNGGSCRLTVNDRGIKRGRKSMKGWRWIFRYHSNWGSSRKRDEDFMFKA

SEQ ID NO: 139627 - protein, 118 aa, Glycine max
  Coding DNA Sequence Number=SeqID_22849
MRMIHISLVHGSTCHTIQLWVTIKPQKSKGHYKQAIELKKNSCSKNDAMACLMHMQFGKTPIEVSKTGTPSQIPRPIGQKATKRKSKGKGATTSSQIVDLTGMENAIKEKALVNTKIA

SEQ ID NO: 139628 - protein, 69 aa, Glycine max
  Coding DNA Sequence Number=SeqID_22850
MKWEQERVGWNGEEKQIRVKKVEEFKCTNGWKKFGCRVFVETFVLKTLEGSIVLTYAFRHHDQLWSKWE

SEQ ID NO: 139629 - protein, 97 aa, Glycine max
  Coding DNA Sequence Number=SeqID_22851
MSLSGIFVNNGFAHILHDAAKLKTSKDLEANIPRAISTLSQYRLAVGCPAVVVSCVVVGCLVLTSIVVSCAPRCALLWKVGVLFISVFVHESGVMGS

SEQ ID NO: 139630 - protein, 120 aa, Glycine max
  Coding DNA Sequence Number=SeqID_22852
NKNPFSESRNEGEKEPPKLDSYDLMELKFGRLLGEDPKLTLAKSKTRVSEDARIEGKGVEFRVERSQKSSPRGAHDTTIDVNTKQPTTTQLTTTAGQPTARRYCDNVDMARGMFASRSFE

SEQ ID NO: 139631 - protein, 46 aa, Glycine max
  Coding DNA Sequence Number=SeqID_22853
MIVTTTTTNKAFCTGILKVHLPQAWPHHQQYCRHKVISSRSRNLNA

SEQ ID NO: 139632 - protein, 66 aa, Glycine max
  Coding DNA Sequence Number=SeqID_22854
MDYKAKIHNMRATRATNNRTINKEYPTYVAWPAGSGTMSMLARLEEKKLWRRTSCMMAMEMRAIEP

SEQ ID NO: 139633 - protein, 134 aa, Glycine max
  Coding DNA Sequence Number=SeqID_22855
  Homolog annotation: Hit_ID=Q9FM25; Match level="QueryCoverage=91%, HitCoverage=16%, E-value=3e-60, Identity=92%"; Hit description =Arabidopsis thaliana genomic DNA, chromosome 5, P1 clone:MNF13
MTMDREKEREIELESAMYTNCLLLGLDPAIIGVGASNATPRVGHFRHSNPKLGEQLLYFILSSLRGPIQSAKDFDKVWPIFDSAQSRDFRKVVQGIISELESQGALPRSNSRVSSLATCCGPREIMDNCNLLKL

SEQ ID NO: 139634 - protein, 181 aa, Glycine max
  Coding DNA Sequence Number=SeqID_22856
  Gene Ontology: Mol. function=RNA-directed DNA polymerase activity; Biological process=RNA-dependent DNA replication
MDMLIFLDHDDPLLVKSFINNKEVHWLLVDIGSSIDIMLYDFFKNLRIPQSELLPYNKDLIGFSWKLYVNFGKAPITKTIIVKFIVVKLQSSCNAILGRPTLNTLRFVISIVYLTMKFFKDEMQVITLNEDQKKACECYKESLKQKDTNKIEEMDYEPRAKIQSKVMLTELDGVEDIKKGT

SEQ ID NO: 139635 - protein, 265 aa, Glycine max
  Coding DNA Sequence Number=SeqID_22857
  Subcellular localization annotation: CTP_CleavageSite=88; ConfidenceScore=5.35e-01
MDGADAWRVAACANTNVNRIMLRFRPIAPKPVAGSSAVSRATGAGDGSQSSHVSVLGKRPKRKYVRIRRNGGYVRKNNGNSNRKSNCNCNDESSDVAVVTLQLMPEKDAPEGDVTLAGDSWCKNVDLDLTVEKIQIVENRSVPPPRLVVEEGEGAKGSDLVPAAKAAESWVTVESVTGTCMGEGEGGRGLLSCTDEERVKSLETDTCPGFVCDGSLRVRWVNDAYKRMVLEGRKGEGEDIMVWLKVKDSACAAWWCYSHPAFTCG

SEQ ID NO: 139636 - protein, 49 aa, Glycine max
  Coding DNA Sequence Number=SeqID_22858
MENCNDRGWWCMWCKSKYELLTMKTTFVSCNNNIHYWPLLGCFYVWVSL

SEQ ID NO: 139637 - protein, 64 aa, Glycine max
  Coding DNA Sequence Number=SeqID_22859
  Homolog annotation: Hit_ID=Q1SEE1; Match level="QueryCoverage=66%, HitCoverage=3%, E-value=4e-14, Identity=83%"; Hit description =Integrase, catalytic region; Zinc finger, CCHC-type; Peptidase aspartic, catalytic
MVENKTGLKIKKLRSNNGGEYVDTRFKKFCYEHGIRMERTVLGHWIEDSKKIEPEMQEKALGFS

SEQ ID NO: 139638 - protein, 271 aa, Glycine max
  Coding DNA Sequence Number=SeqID_22860
  Gene Ontology: Mol. function=nucleic acid binding; Cellular component= intracellular; Biological process=DNA integration
  Homolog annotation: Hit_ID=Q1SEE1; Match level="QueryCoverage=99%, HitCoverage=34%, E-value=6e-75, Identity=56%"; Hit description =Integrase, catalytic region; Zinc finger, CCHC-type; Peptidase aspartic, catalytic
MATEDVKVKTEKFDGANFSFWKMQIEDYLYLKKMDQPLSRNKPEESWNAIVTIMSSSSGSNKLKFNDVHDLVLSEEIRRRESVQECTKESRGEGRGNVASTSREVHDALICSLKSKEESWVLDSRASFHTTSQKEFFENYVLGNLGKFYLGNGQSCEIVGKGAMKIKLNRSIWGLKNNRHILNLTKNLISIVQLASDGYTTIFYGNQWKISKGEMAVAHGNKSGTLCMTDEACHLIAAVATKIPNLWHQRLVHMSEKGMKIMHLKNKLLAL

SEQ ID NO: 139639 - protein, 256 aa, Glycine max
  Coding DNA Sequence Number=SeqID_22861
  Gene Ontology: Mol. function=nucleic acid binding; Cellular component= intracellular; Biological process=DNA integration
  Homolog annotation: Hit_ID=Q1SEE1; Match level="QueryCoverage=99%, HitCoverage=29%, E-value=5e-40, Identity=57%"; Hit description =Integrase, catalytic region; Zinc finger, CCHC-type; Peptidase aspartic, catalytic
MIFKKQRTPLMKKIKGLQAPHGPTSLNIMVEAVNTSTYLMNRGPVVPLDHKILDEVYSGKKVDPNSKKCTFISYGEDEFGYCLWDNENKKMIYSRDVIFNERVMYKDTNNTNTSNSEQSSSVYAEVDDVPKTLMIETSQLEESIEYNSQQQVDTPEPQKEGVDYIEIFSLVVKLNTIRSVLSIVANEELYLEQLDVKTVFLHADLDEEIYMHQPEGFSEEGKKNMVCRLKKILYGLKQAPRQWYKKFESFMLKKNF

SEQ ID NO: 139640 - protein, 261 aa, Glycine max
  Coding DNA Sequence Number=SeqID_22862
  Gene Ontology: Mol. function=RNA-directed DNA polymerase activity; Biological process=RNA-dependent DNA replication
MDVTIEARSIMGFDDGADRVAPTFNKSGGLLWIWRKDIIKVSNTFMGSGYLGIQGVWKQGDIPNVVLDVYAPFGDFNLVRCLEEWRNGSNEAIGGNDMDSFNGFIENMELEDIPMGSAEYGLDRSFSDHCPLLLMNSIIDWGPKPFRVLNCWFMENSFKEMVEQSWNSFQVQGRASFVFKEKLKLVKKELKKVEQLKDELDDLNKEEMQTRRVCLGEFWKISRFQASLTQQKARVSWLKEGDEKINYVVLGLNGEEESKIL

SEQ ID NO: 139641 - protein, 125 aa, Glycine max
  Coding DNA Sequence Number=SeqID_22863
MEMPSSSHNLHECHVITWWNTLHETPSDSCVDLHLGYMLDIKLRSQTPQDSSLLQHTTQCHYTTTLFYCYSALMLNPSMIITNGKAMKFVLEKGKNKSEKRKKNEEKMREKEKKEFDPKACTRSN

SEQ ID NO: 139642 - protein, 468 aa, Glycine max
  Coding DNA Sequence Number=SeqID_22864
MGNVQHLANFNSLVQKIEQVVKCITDWKKMITVEYNVKDVPSLTDTLHLIPVLAYWTISTSWSLVPATLISRALTSKGQLQLLGFRGYRYDLSKFDYRLDFILKNFKDHQDNDSQDSRPSVYNGLTGPQAALGEFKNKHVLLFISGLDHIDNEIQLLKSIHVKLKEEPKELEKVFNYKGNPIIMLISPEGKVENSDAKQIISKWDIDGFPFRTSDQTRLTQQWNWFWNEMITLSPIIRELIKRDSYIFIYGGTNTKWIQDFTTAVEKLEKNETLTQEEETTIESYSLGRDNPKIVPRFRIAIDNLLASRKLTKRGGEQVQDSTTREIQKLMFLKQDPLGWAILTKGSHVKLLGHGDAMLKTVSDFYAWKGTLNNEVGFDVAFKDYYEKFKFKSVPHKCEHREFANYPADILAHIPCPNKCGHEMEVSSVKYMCCLGRETSDIAQDKCMKQLLHAQRFHFMHETSLSLV

SEQ ID NO: 139643 - protein, 133 aa, Glycine max
  Coding DNA Sequence Number=SeqID_22865
  Gene Ontology: Mol. function=threonine ammonia-lyase activity; Cellular component=chloroplast; Biological process=branched chain family amino acid biosynthetic process
  Homolog annotation: Hit_ID=Q9ZSS6; Match level="QueryCoverage=79%, HitCoverage=18%, E-value=1e-38, Identity=71%"; Hit description =Threonine dehydratase biosynthetic, chloroplast precursor
MVIVPTPKPLFYNFVPHCPEALRYAKDVFEEKWNILEPAGALALTGAEAYCKHYELQGENIVVITSGANMNFDKLRVVTKLANIGHKQEVALATVMAEELGSFKQFYELVGQMNVTKFKYRCNSNEKAVVLYK

SEQ ID NO: 139644 - protein, 353 aa, Glycine max
  Coding DNA Sequence Number=SeqID_22866
  Gene Ontology: Mol. function=oxidoreductase activity; Cellular component=intracellular; Biological process=electron transport
  Homolog annotation: Hit_ID=Q8LJU3; Match level="QueryCoverage=89%, HitCoverage=74%, E-value=1e-174, Identity=90%"; Hit description =Ascorbate oxidase
  Pfam annotation: Domain name=Cu-oxidase; Domain location=18-104; Score=25.3; E_value=2.3e-06; Accession=PF00394.12; Description =Multicopper oxidase
  Pfam annotation: Domain name=Cu-oxidase_2; Domain location=193-330; Score=150.5; E_value=4.4e-42; Accession=PF07731.4; Description =Multicopper oxidase
  Pfam module annotation: Pfam domain module=Cu-oxidase::Cu-oxidase_2; Domain location=18-104::193-330
MANIKIIGKRKQNYHSLRFHWLGNGRTQHVVKGRKNHKLVVVEADGNYVTPFAVDDIDIYSGESYSVLLRTDQDPNKNYWLSIGVRGRKPNTPQGLTILNYKPISASVFPTFPPPITPLWNDFERSKAFTKKIIAKMGTPQPPKRSDRTIFLLNTQNRVDGFTKWAINNVSLTLPPTPYLGSIKFKIKNAFDKTPPPVTFPQDYDIFNPPVNPNASIGNGVYMFNLNEVVDVILQNANQLSGSGSEIHPWHLHGHDFWILGYGEGKFKSGDEKKFNLTHAPLRNTAVIFPYGWTALRFKADNPGVWAFHCHIEPHLHMGMGVIFAEAVQKVGKIPRDALTCGLTGKMLGNRHY

SEQ ID NO: 139645 - protein, 118 aa, Glycine max
  Coding DNA Sequence Number=SeqID_22867
MGKVRKERMQSMGGLRERGVEVGFVPERDDDGYERKNKIVEMRVQKVQKKIEERDCYLSLNRPTTTTISSRSLPQGSPHSHMTYVRATLGDKSIHHCNASLEAYLRHRRKGPQRQRSR

SEQ ID NO: 139646 - protein, 194 aa, Glycine max
  Coding DNA Sequence Number=SeqID_22868
  Homolog annotation: Hit_ID=Q2PMM5; Match level="QueryCoverage=19%, HitCoverage=1%, E-value=3e-07, Identity=78%"; Hit description =Protein ycf2
MVNESRIVVLPGLIWVYAGKREGFGEEKGKMNLRGRESLDTSHKYKNWPNMSLFIARNFIWEVFHVLGITFPSSLCSLYGLVVTLNGPSNWDQAFPFGDLSSFASKSPHEVTELEGLWLNLGSTRIHQRKNGSRTEEAMSLNPYQTNCNLFLYVRIPSVRLLLLTSLVSLHSLRHDQPLCTFLTSYVSLLLYQH

SEQ ID NO: 139647 - protein, 149 aa, Glycine max
  Coding DNA Sequence Number=SeqID_22869
MGVIELCVEVDVASASTLNVKNSLLSCGNNIADNESKVQRFTINLDDDSYDDDYMISNSYVEDSLDEEEDIDDISDTDEKCESGTAFWKSASNYSNINWSHPDEEDICGFDMGSTFNIGQELFVGMEFESKNSVKKCTTTICYEGAPNF

SEQ ID NO: 139648 - protein, 296 aa, Glycine max
  Coding DNA Sequence Number=SeqID_22870
  Homolog annotation: Hit_ID=Q9FM25; Match level="QueryCoverage=84%, HitCoverage=36%, E-value=5e-99, Identity=71%"; Hit description =Arabidopsis thaliana genomic DNA, chromosome 5, P1 clone:MNF13
MENSPILLVDRDLEKTSAHIHLVEKGFCYCYSSLIWFVELLWQLSLHALREVHRRTFTADISSNPLPAPLTDVAFSHAATLLPVTKARIALERRKFLKNAEMAVQRQAMWSNLAHEMTAEFRGLCAEEAYLQQELEKLHDLRNKVKLEGELWDDLVSSSSQNSHLVSKATRLWESLLARKSQHEVLASGPIEDLIAHREHRYRISGSSLLAAMDQSSQAPYSDVLSAQSGDLPAMDNKEENDGSHFSNETLTRLDDRTGRAHQTVDVAEVIRRWTHALQRIHKQSLHLVCSLQAFL

SEQ ID NO: 139649 - protein, 338 aa, Glycine max
  Coding DNA Sequence Number=SeqID_22871
  Homolog annotation: Hit_ID=Q9FM25; Match level="QueryCoverage=98%, HitCoverage=44%, E-value=3e-83, Identity=53%"; Hit description =Arabidopsis thaliana genomic DNA, chromosome 5, P1 clone:MNF13
MSCTNDGEGPDILRSAQEGDSSGHAESLAATLAEHQQHLASFQVLINQLKDVAPTIQKSISECTEKVNCITSNLPPTNRPNGRSTSPIQTQSSGRMDNSNDDVSDVTSRISNIQLDKVSVSPPTLKLPQLFSLTPSSGKSGNVQRRHNNAPQTSQTENLSDRKSLDPPSNNEVESSAEDSDSCYVHNLKRSVREAALSLRSCNSESSRDSQSDGSSEHFFVPLSETGFSNLDADKRGASLRSKRLFVSQMDDSLLESHASGGHGESKFDEFPDMLNDLERLSVSDYNNVNGFLSYTGSNSTSDAQRSFFDFEDSQDQVFSPPLLMDSSLLTDPFEDLL

SEQ ID NO: 139650 - protein, 604 aa, Glycine max
  Coding DNA Sequence Number=SeqID_22872
  Pfam annotation: Domain name=RRM_1; Domain location=59-129; Score =14.7; E_value=0.0062; Accession=PF00076.12; Description=RNA recognition motif. (a.k.a. RRM, R
MRGERNRGWERVRLRGEAFERERARFRAGFQKTQTRTRDGQQQYYNLTNWRDRNEISSFYFTRFSDDITEKDLWCQFKKWGDVREVFISRQRNKNGRRYGFVRFKGVNDEHMLERQLDSIVIGRMKLYVNLPRFRRHKGGKITSDDKQHEQRNMNENEVSRHIQGGARTNQASYAEVVARKRHAVHSCERRLSSVHLEPSAEILKWLSDAWVGRLTNPATFDEVEDELRLDFGVDISTKYLGDDMVLLFGLNNATAGKLIQEDGHGTVPLFYSLQKWTPSLRPSYRLAWVQCWEISVIAWDVVSIKKIVGVMGELVEVDDDAEERRRMDRARVLVKTPWQPDIQHTVEVHIGAEVYKVCILEECGYNTDTWQRRRSSITLSSEEIDSDGSFMGSSASEKTHVTEFNGGTWVAETQPNTAGSRRTTTSSGGVGVEERSSPLSNGPPESQAPKGKGIDLQTKGAILDNNAEDEVGGCQVSGGIRTQQTNVAATKYNHPTPTAALGQRRGRTGTRGGGNEKQEATMIWELAKQLGATGVEDQGRIAEKFMTMEDRDRKEAKKETKKDTIDKSMCQAMWGDPAVSWEESNIKEFNEWIDELEVEEAPW

SEQ ID NO: 139651 - protein, 240 aa, Glycine max
  Coding DNA Sequence Number=SeqID_22873
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q1M320; Match level="QueryCoverage=99%, HitCoverage=35%, E-value=1e-118, Identity=92%"; Hit description =Putative beta-glycosidase
  Pfam annotation: Domain name=Glyco_hydro_1; Domain location=2-176; Score=-331.6; E_value=0.047; Accession=PF00232.9; Description =Glycosyl hydrolase family 1
MRPYGLLDIASVSLANSLTLFPYIDEIFEKLDYIGINYYGQEVVSGAGLKLVENVEYSESGHGVYPDDLYHMLLQYHERYKHLNISFIITENGVSDETDLIRRPYLLEHLLAIYAAMIMGVRVLGYLFWTISNNWEWVDGYGPKFGLVAVDRENNLARIPRPSYHLFSKIVNTSKVTHEDRERAWDELQRAAKEKKTRPFYRAVDKHRLMYAVSNKSSWLSSRVDLTNLNNDLTLNEIGG

SEQ ID NO: 139652 - protein, 365 aa, Glycine max
  Coding DNA Sequence Number=SeqID_22874
  Gene Ontology: Cellular component=membrane
  Homolog annotation: Hit_ID=Q1SRU7; Match level="QueryCoverage=31%, HitCoverage=19%, E-value=8e-10, Identity=34%"; Hit description =Exostosin-like
MGILSERGSFSYVMFTLELDRDIIGSRFMVYKMQNSKPVNARALKERPTWESVSHLETKRLLWLIGITFAVILTFQYLEFPYGTVLLSLFSAEKIPTPGSSTFKASDAPSISELVNNVTLFNPANSTGDHAFEIANKTKSGENDTIPRIGLVLEPGSTPNNSLGLDGSDQSSKTKSINRSENVAETPQGGDPGPISFNNTIDLSFSANQFQEDNISSTEQKSGSQYASSTNVSTNIVTAVLSNDSSISLFQKDNTTNSIKEESIRSSQNDAKVSVPNEKKDSHTPIPEVTTVSEMNKLLLQSHNSYRSMRPSWFSAVDQELLQARSEIENAPIVKKDPNFYAHIYHNVSMFKRYYLINPPPKSKF

SEQ ID NO: 139653 - protein, 94 aa, Glycine max
  Coding DNA Sequence Number=SeqID_22875
MKIKANKTRNELKVSDSKTYQLKNEERMKNGEERQKSFMKMFTKMSQKRYGSTSAWIFFTETWLWEFYGSPISLGSHFFNKMGEEVASQLAQAS

SEQ ID NO: 139654 - protein, 158 aa, Glycine max
  Coding DNA Sequence Number=SeqID_22876
MQSQGLTLPPKAKVGPFAARVSTKESCVGPSRQDPEIGDLDKCGLVYKGLTTVHNVPLGNDQVKVSIEEVRDADAHVLVPTQEDKQEVEGPTKPIDRPDPNVDPLYLMTLTIPRLFLKPLQVPWDAIVFGVYNDNFPLHMTETSMQAGNVSVHGFLKP

SEQ ID NO: 139655 - protein, 75 aa, Glycine max
  Coding DNA Sequence Number=SeqID_22877
DKQEVEGPTKPIDRPDPNVDPLYLMTLTIPRLFLKPLQVPWDAIVFGVYNDNFPLHMTETSMQAGNVSVHGFLKP

SEQ ID NO: 139656 - protein, 254 aa, Glycine max
  Coding DNA Sequence Number=SeqID_22878
MSLKLPHYPKLVRVFYNNLRIQDSTLYSEVHGIPIVIDQYLFFSLTKLPSQGVPFEGTVFDDWKFDYSSHDAHRMVYNDQADMTGRLLVGSLTFDYCIMHCIIIDWAHLVKYHMHKALRTNAPLPYPQLVTLFLRHFQIPLDDEPFVQVKRSLAIGAGVVTSFGYRKYIDGQWIRKQDLPPSIPDERTPSPPPQRDASSTLMNEVLSELRGLRAFVGDRLDAMDAHFEGMGTRITQLEDDMGFIRRCFDPPAAP

SEQ ID NO: 139657 - protein, 74 aa, Glycine max
  Coding DNA Sequence Number=SeqID_22879
MAREVVDETSSGALPQPNLIDMAACIDLRCHARSKLVAMDVLQPRIERERCHLEGLCTCEDADVAHRSEEDLDF

SEQ ID NO: 139658 - protein, 83 aa, Glycine max
  Coding DNA Sequence Number=SeqID_22880
MFGEGTDRENNKNPYFPATGGSALDNGGHMNSARQSIHGAPNRMVEDTRTTLGNQFVGLRTHGGGCMNDNQFMGIWIRFEGGG

SEQ ID NO: 139659 - protein, 72 aa, Glycine max
  Coding DNA Sequence Number=SeqID_22881
MATHPGELRLSHEATGSPKRASYLTWKSLGSLGELEASMGELGVRKFNEKTLLPSSFGVGPRSLTSKNQKHQ

SEQ ID NO: 139660 - protein, 100 aa, Glycine max
  Coding DNA Sequence Number=SeqID_22882
MKWALVKGVVGPAKPADRLDHDVDDPLYLMTLTIPQLFLKPLQVLQHALRRRARARLTGALTKGGKMRGVATNVYLWETSEKPKETGQNENSKFGSCIYA

SEQ ID NO: 139661 - protein, 86 aa, Glycine max
  Coding DNA Sequence Number=SeqID_22883
MSGFTRDSPQISASPHQLDLAPYASEPYNAQWNTLGLLHDKHTLRSSRILGEMEAFSLHNSFLGWCFWFVPKVVFIIGSAAVGKDK

SEQ ID NO: 139662 - protein, 151 aa, Glycine max
  Coding DNA Sequence Number=SeqID_22884
  Subcellular localization annotation: CTP_CleavageSite=52; ConfidenceScore=5.23e-01
MWSLAAQLGVKCLSYIMSKSNSIGVSSKSGDLHPYCRNLPFGGRATRDSRVRLSRKENARSRHQRLFEENVGKTGKTGKRRGLRTLSVKGLRVVFTHGEGISTPRVRHKGRQPLIKCANAFERSMLTDKSKKDRLRRWTLKRFLVIFADKA

SEQ ID NO: 139663 - protein, 108 aa, Glycine max
  Coding DNA Sequence Number=SeqID_22885
MLEVERKHCCAIRKVPQHSRCQRRDCCAIRKVSRHYGKKTMFFRSRIASGGSNPACLGKLSGNLLPFFPINRQKGVVLRIPEPLGYASQLFWVKKVVFVKKIHAKVLS

SEQ ID NO: 139664 - protein, 140 aa, Glycine max
  Coding DNA Sequence Number=SeqID_22886
  Subcellular localization annotation: CTP_CleavageSite=63; ConfidenceScore=5.31e-01
MKINHNSLFEYARTQKFRARRSEAPPTLATPAPPTSAPSTSPLPPPPTALVLPGPFAHSSKPSLSMLQSLHQGQLLIMQSLQDVVQQRPVMSIEEFLQKASIAQEPQQDQEDDILEASEPTPPEPFIFETDPVIVQEDVA

SEQ ID NO: 139665 - protein, 42 aa, Glycine max
  Coding DNA Sequence Number=SeqID_22887
MEKSFIGATASKVASSVPMPDITKKETSFSEAKAFKHVKVED

SEQ ID NO: 139666 - protein, 50 aa, Glycine max
  Coding DNA Sequence Number=SeqID_22888
MNTINQADSKEMNSEKESGGRVLGESEDGVVIGGLNPISRMDIYKLVPSY

SEQ ID NO: 139667 - protein, 409 aa, Glycine max
  Coding DNA Sequence Number=SeqID_22889
  Gene Ontology: Cellular component=cytoplasm
  Homolog annotation: Hit_ID=Q9LTZ9; Match level="QueryCoverage=68%, HitCoverage=54%, E-value=1e-106, Identity=64%"; Hit description =Arabidopsis thaliana genomic DNA, chromosome 5, TAC clone:K15C23
  Pfam annotation: Domain name=DUF23; Domain location=261-406; Score =22.8; E_value=3.2e-07; Accession=PF01697.17; Description=Domain of unknown function
MYTKKKQHNTKQNKTFPDPEPHLPPLMKRESKFERKHVHNATELKLLLATLLLLCSVATLLQFIPLRFTNISPSNLHLCISSVSQQPPPPFTSHSTLSPSSSSNTPLSTPSSTQLLPNGTIKRAFIPYGSAAYNFITMGAYRGGTNTFAIVGLSSKPLHVYGKPTYECEWIPFSSPKPIITMGYKIIPDIWGYDHVYTAVVVNCTFNHTIINGDNNGGKLVLYASTSGAGDTNFNLTDRIEVLQEAPNTLDVSLFVSEPKYDYFYCGSPLYGDLSPQRVREWITYHVWLFGPRSHFVIYDAGGVHEEVLEVLKPWMELGFVTLQDIRDQERFDGYLHNQFMVVNDCLHRYKFMAKWMFFFDVDEYIYVPPNNTIKTVVDSLSKYDQFIFNMMPMNNKICLYEDYGKTCR

SEQ ID NO: 139668 - protein, 115 aa, Glycine max
  Coding DNA Sequence Number=SeqID_22890
  Gene Ontology: Mol. function=nucleoside-triphosphatase activity; Cellular component=membrane; Biological process=transport
  Homolog annotation: Hit_ID=Q9FF46; Match level="QueryCoverage=81%, HitCoverage=8%, E-value=2e-26, Identity=67%"; Hit description =Putative white-brown complex homolog protein 29
  Pfam annotation: Domain name=ABC_tran; Domain location=1-105; Score= -51.3; E_value=0.006; Accession=PF00005.17; Description=ABC transporter
MPKPDKVMIVERVIESLGLQAVRDSLVGTVEKRGISRGQRKRVNVGMEMVMEPSLLILDEPITSLDSASSTLLLKALRREALEGVNICMVLRQPEVAPSEFVGLGSSSSMESFAS

SEQ ID NO: 139669 - protein, 97 aa, Glycine max
  Coding DNA Sequence Number=SeqID_22891
MTVLSSRSVTSSTPSIRPLPLTSPITAEETKFGYKIGYTGHVMTFEVGAVLEDANWQAPVYCFDENDKEKNIPILGSAVRGGSLGSLMREIPTGETM

SEQ ID NO: 139670 - protein, 69 aa, Glycine max
  Coding DNA Sequence Number=SeqID_22892
  Gene Ontology: Mol. function=glutamine-tRNA ligase activity; Biological process=tRNA aminoacylation for protein translation
  Homolog annotation: Hit_ID=P52780; Match level="QueryCoverage=85%, HitCoverage=7%, E-value=1e-25, Identity=86%"; Hit description =Glutaminyl-tRNA synthetase
MACGASRYADTNPEAEKKEYIDHIEIIVQWMGWKPFKITYTSDYFQELYELAVELIKKGHAYVDHQVGI

SEQ ID NO: 139671 - protein, 148 aa, Glycine max
  Coding DNA Sequence Number=SeqID_22893
MSNSTDSVMCSLSSTKATSEEYFVNTFYSLLLCDFLKFSNISLCHHDHVLEREQEKRIAGEDCDLLPENLVVRLHVIEKVASSFASTSLSFLPPPPSDNIGGNITHNTIVEINSPNLGTVPQQLYCTSSALSCPHKPTAPPWHHHTES

SEQ ID NO: 139672 - protein, 122 aa, Glycine max
  Coding DNA Sequence Number=SeqID_22894
MDMNFSHQISLIAQHDTSRLGFPALITTLCKARGVQSDSRSLENLSPTINLEYIKKNCWNLDDPTVTFRGPRKARDAALHALEHPQGAVHHHAEPLGLGLAIHYDWPGAQPSPSGGGGASVA

SEQ ID NO: 139673 - protein, 96 aa, Glycine max
  Coding DNA Sequence Number=SeqID_22895
MNEFYANLYDPEDKSPKQVRVRGHLVKFDEDTLNTFLKTPIILEEGENLCTYSRFALLRPDPQELAAKLCIPGRGFKLNADRQPLKILRKNMTTLA

SEQ ID NO: 139674 - protein, 380 aa, Glycine max
  Coding DNA Sequence Number=SeqID_22896
  Homolog annotation: Hit_ID=Q1STZ2; Match level="QueryCoverage=51%, HitCoverage=41%, E-value=7e-09, Identity=25%"; Hit description=IMP dehydrogenase/GMP reductase
VDWDQHLAGIGGRTTNWFTRWKEGNEGVLFSCGDYPNIPLIGTRGCFNYNPALAIRQLGYLMRGAPTKESLFPFLVRDFDAQSFKVIQRVHKAWESPLGKDKEFRGIRNGIIGGYHEWLKDEEVRALKTELGKARLAKEKFKARKEEHGRDKFRGALWGSNSELKLRREERDQSRAHSMVLKEELSACSRSKRSLSQRLCETETNMLAIVSKYQEELNLATAHHPLPNAVGRERSTLGHTSNPHLGYNRVAYPYGLTPNYTPPVMRDDAGHVPSTVLEGEPPRQSDEVHEDHREYAQGDVNFYHPVPVEGPTPNILPQTKLPAQPIFLSTEGPPLAVEERRKIDLIEERLRAVEGFGDYLFADMVDLCLVPNVVIPPKFK

SEQ ID NO: 139675 - protein, 107 aa, Glycine max
  Coding DNA Sequence Number=SeqID_22897
  Subcellular localization annotation: CTP_CleavageSite=46; ConfidenceScore=5.60e-01
MDMGPTLSTKSMENFISLSSGKSDISLRNTSGNSLTTGRSPMETFVSTSRAYFTKHLLSLFLFLMPKNPNKATGGGTLESTRNVTIANGEHLSDYIEVRDELLTLED

SEQ ID NO: 139676 - protein, 85 aa, Glycine max
  Coding DNA Sequence Number=SeqID_22898
MEYFGNQVKLKQQLLTIIKQNIELKYTFNQALASKSMLQQHHKEGLKLGEEHELPSRFICVAMSLLERAGDTLVSASLKPSNFPL

SEQ ID NO: 139677 - protein, 241 aa, Glycine max
  Coding DNA Sequence Number=SeqID_22899
  Gene Ontology: Mol. function=ceramidase activity; Cellular component =endoplasmic reticulum membrane; Biological process=sphingolipid metabolic process
  Homolog annotation: Hit_ID=Q1S9K8; Match level="QueryCoverage=97%, HitCoverage=31%, E-value=1e-118, Identity=86%"; Hit description =Neutral/alkaline nonlysosomal ceramidase
  Pfam annotation: Domain name=Ceramidase_alk; Domain location=2-241; Score=-227.9; E_value=6.1e-11; Accession=PF04734.4; Description =Neutralalkaline non-lysosomal ceramidase
  Subcellular localization annotation: CTP_CleavageSite=30; ConfidenceScore=5.07e-01
MDNADIGQLMKKAQSIKATRGKDCKKLASQASKVRKNDGSLFVGAFCQSNVGDVSPNVLGAFCIDSGKPCDFNRSSCHGNDQLCVGRGPGYPDEILSTKIIGERQFKTAVKLFESTSEELSGKIDYRHVYLNFTDIEVELDSNKVVKTCPAALGPGFAAGTTDGPGLFGFQQGDTKINPFWKNVRDFLTKPSQYQVDCQNPKPVLLSTGEMFYPYPWAPAILPIQILRLGKLIILSVPGGL

SEQ ID NO: 139678 - protein, 70 aa, Glycine max
  Coding DNA Sequence Number=SeqID_22900
MEAMMSVKKIMEANAVAIAATSIIAKAKIWEVRAAPIMRKVKTSTPSSFGKTPVSLAFARQQKGTLRHRP

SEQ ID NO: 139679 - protein, 112 aa, Glycine max
  Coding DNA Sequence Number=SeqID_22901
  Gene Ontology: Mol. function=ceramidase activity; Cellular component =extracellular region; Biological process=sphingolipid metabolic process
  Homolog annotation: Hit_ID=Q1S9K8; Match level="QueryCoverage=73%, HitCoverage=11%, E-value=4e-35, Identity=83%"; Hit description =Neutral/alkaline nonlysosomal ceramidase
DVKDAGINRSPSAYLQNPADERARYPTNVDTQMTLMRFVDGASGKNIGAFSWFPTHGTSMSNQNKLISGDNKGVAARLFEDWFASQNNSTNTNSTVPGILKFWAHFINLSQG

SEQ ID NO: 139680 - protein, 237 aa, Glycine max
  Coding DNA Sequence Number=SeqID_22902
  Gene Ontology: Mol. function=ceramidase activity; Cellular component =endoplasmic reticulum membrane; Biological process=sphingolipid metabolic process
  Homolog annotation: Hit_ID=Q1S9K8; Match level="QueryCoverage=99%, HitCoverage=31%, E-value=1e-113, Identity=83%"; Hit description =Neutral/alkaline nonlysosomal ceramidase
  Pfam annotation: Domain name=Ceramidase_alk; Domain location=1-237; Score=-273.5; E_value=3.1e-09; Accession=PF04734.4; Description =Neutralalkaline non-lysosomal ceramidase
MAGRRLREAVKETLISSSNGEFDDETHVVIAGLTNTYSQYIATFEEYQQQRYEAASTLYGPHTLSAYIQEFKKLAQAMAEGENITIKGPSPPDLSSVQISFLLDPLGESPPKGVKFGDIKEDVAFPKRGYFTKGDTPSATFWSANPRYDLLTEGTFAAVERLQGERWISVYDDDDLSLFFKWKVDNSSLHGLATIEWEIPNDAVSGVYRLKHFGATRTTIISPINYFTGASSAFAVQ

SEQ ID NO: 139681 - protein, 150 aa, Glycine max
  Coding DNA Sequence Number=SeqID_22903
SPTEALGFPALITGLCQSFGVPVTPSKRQVQGDAPQAADAPPPHQAGPARLFDTEQYLRHLVRQQAANHRAHVQTHDCLYQMSLSLQSQGFTSFPCPTPDQFRAEVAWPGDWPEAQAGEAPAEAPEEADEAREDEEMTELLDFLGGSGAA

SEQ ID NO: 139682 - protein, 105 aa, Glycine max
  Coding DNA Sequence Number=SeqID_22904
MRDQYGHLLPLSKTRCLLTPTTLVSTPPSRDDMSDDTWRHLMVIRTFVNQRDDKSDDKQKHLMVIYTFVNQRQASPLTCGDKSWSFAPLSSIDNNQTSESKVMAI

SEQ ID NO: 139683 - protein, 478 aa, Glycine max
  Coding DNA Sequence Number=SeqID_22905
  Gene Ontology: Mol. function=nucleic acid binding; Cellular component= spliceosome; Biological process=mRNA processing
  Homolog annotation: Hit_ID=Q1S9K9; Match level="QueryCoverage=81%, HitCoverage=79%, E-value=0.0, Identity=92%"; Hit description=U2 auxiliary factor small subunit
  Pfam annotation: Domain name=RRM_1; Domain location=230-296; Score =64.2; E_value=4.2e-16; Accession=PF00076.12; Description=RNA recognition motif. (a.k.a. RRM, R
  Pfam annotation: Domain name=zf-CCCH; Domain location=158-183; Score =17.3; E_value=0.0068; Accession=PF00642.15; Description=Zinc finger C-x8-C-x5-C-x3-H type (and similar)
  Pfam module annotation: Pfam domain module=RRM_1::zf-CCCH; Domain location=230-296::158-183
MAHRLLRDHEADGWERSDFPIICESCLGDSPYVRMTKAEYDKECKICTRPFTVFRWRPGRDARYKKTEICQTCSKLKNVCQVCLLDLEYGLPVQVRDSALSIDSNDAIPKSDVNREYFAEEHDRKARAGIDYESSYGKVRPNDTILKLQRTTPYYKRNRAHICSFYIRGECTRGAECPYRHEMPVTGELSQQNIKDRYYGVNDPVALKLLGKAGEMSTLEAPEDESIKTLYVGGLDARVTEQDLRDHFYAHGEIESIKMVLQRACAFVTYTTREGAEKAAEELSNKLVIKGLRLKLMWGRPQTTKPESDGSDQARQQASVAHSGLLPRAVISQKQSQDQTQGMLYYNNLPPPQQERSYYPSMDPRRMGALVSSQDAPGGPSGSEENNPGLEKQQMQHYAHPMMPPPPGQYHQYYPPYGYMPPPPPYHQYPQPPYNAAAAPSQPPAAAPSQPPAANHPYPHSMQPAFGKDVQLILYTIK

SEQ ID NO: 139684 - protein, 39 aa, Glycine max
  Coding DNA Sequence Number=SeqID_22906
MGASKKELIFWSAKVVVALSELSGLSAYPSLSTASARLA

SEQ ID NO: 139685 - protein, 199 aa, Glycine max
  Coding DNA Sequence Number=SeqID_22907
  Gene Ontology: Mol. function=ceramidase activity; Cellular component =endoplasmic reticulum membrane; Biological process=sphingolipid metabolic process
  Homolog annotation: Hit_ID=Q1S9K8; Match level="QueryCoverage=94%, HitCoverage=25%, E-value=2e-82, Identity=81%"; Hit description =Neutral/alkaline nonlysosomal ceramidase
  Pfam annotation: Domain name=Ceramidase_alk; Domain location=26-199; Score=-371.9; E_value=1.4e-05; Accession=PF04734.4; Description =Neutralalkaline non-lysosomal ceramidase
MAQNYVIVALGLVVYAWTWMQGAHGEYLIGVGSYDMTGPAADVNMMGYANPLQNTAGIHFRLRARTFIVAESLQGPRFVFVNLDAGMASQLLTIKVLERLNSRFGNLYTEENVAISGTHTHAGPGGYLQYVVYSVTSLGFVKQSFDAIANAIEQSIIQAHNNLKPGSIFMNTGNMSVSPCYMNSTSYLGRLWYLLFCHG

SEQ ID NO: 139686 - protein, 252 aa, Glycine max
  Coding DNA Sequence Number=SeqID_22908
  Homolog annotation: Hit_ID=Q8M9L7; Match level="QueryCoverage=29%, HitCoverage=55%, E-value=1e-06, Identity=44%"; Hit description=ATP synthase epsilon subunit
MVLMANFATINNNGITVLVDDAEKGSDIDPQQALETLHFLTIVDHKCLSSFKIIHLPPTFQSSHATMNAPHSLSHSTSRQLQRFGKASHHVFINCYLNPIAHAKIKLFGDTPFPVFNTILLLIENTSSPRHYQHELTIINCFQHYKSFIRHTLIRSPIIYKFVVAFHNDKDVIEILSFYHRQWTPHYPQFVHFKYNGGTHQIKVRQHHDKFFFANGLKDFRMDLNIYESTTINCYACDQNWIFNLHFTPTLE

SEQ ID NO: 139687 - protein, 910 aa, Glycine max
  Coding DNA Sequence Number=SeqID_22909
  Gene Ontology: Mol. function=transmembrane receptor activity; Cellular component=membrane; Biological process=defense response
  Homolog annotation: Hit_ID=Q2HUN2; Match level="QueryCoverage=96%, HitCoverage=83%, E-value=0.0, Identity=48%"; Hit description=TIR; Disease resistance protein
  Pfam annotation: Domain name=LRR_1; Domain location=613-634; Score =1.8; E_value=1.3e+02; Accession=PF00560.23; Description=Leucine Rich Repeat
  Pfam annotation: Domain name=LRR_1; Domain location=636-657; Score =6.6; E_value=17; Accession=PF00560.23; Description=Leucine Rich Repeat
  Pfam annotation: Domain name=LRR_1; Domain location=659-681; Score =3.4; E_value=67; Accession=PF00560.23; Description=Leucine Rich Repeat
  Pfam annotation: Domain name=LRR_1; Domain location=701-723; Score =3.9; E_value=54; Accession=PF00560.23; Description=Leucine Rich Repeat
  Pfam annotation: Domain name=LRR_1; Domain location=724-746; Score =9.8; E_value=4.1; Accession=PF00560.23; Description=Leucine Rich Repeat
  Pfam annotation: Domain name=LRR_1; Domain location=772-793; Score =2.9; E_value=81; Accession=PF00560.23; Description=Leucine Rich Repeat
  Pfam annotation: Domain name=LRR_3; Domain location=613-632; Score =36.0; E_value=1.3e-07; Accession=PF07725.3; Description=Leucine Rich Repeat
  Pfam annotation: Domain name=NACHT; Domain location=217-369; Score= -20.2; E_value=0.0022; Accession=PF05729.3; Description=NACHT domain
  Pfam annotation: Domain name=NB-ARC; Domain location=183-471; Score =129.3; E_value=1.1e-35; Accession=PF00931.13; Description=NB-ARC domain
  Pfam annotation: Domain name=TIR; Domain location=27-154; Score =176.2; E_value=8.4e-50; Accession=PF01582.10; Description=TIR domain
  Pfam module annotation: Pfam domain module=LRR_1::LRR_1::LRR_1::LRR _1::LRR_1::LRR_1::LRR_3::NACHT::NB-ARC::TIR; Domain location=613 -634::636-657::659-681::701-723::724-746::772-793::613-632::217 -369::183-471::27-154
MDEQNMIRAVASSSNSSSMVSSKKYDVFLSFRGEDTRKNFTSHLYEALKQKKIETYIDYRLEKGDEISAALIKAIEDSHVSVVIFSENYASSKWCLGELGKIMECKKERGQIVIPVFYNIDPSHVRKQTGSYEQSFAKHTGEPRCSKWKAALTEAANLAAWDSQIYRTESEFLKDIVKDVLRKLAPRYPNHRKELVGVEENYEKIESLLKIGSSKVRILGIWGMGGIGKTTLASALYDKLSPEFEGCCFLANVREESDKHGFKALRNKLFSELLENENLCFDASSFLVSHFVLSRLGRKKVFIVLDDVDTSEQLENLIEDFDFLGLGSRVIVTTRNKQIFSQVDKIYKVKELSIHHSLKLFCLSVFREKQPKHGYEDLSRSAISYCKGIPLALKVLGASLRSRSKQAWECELRKLQKFPNMEIHNVLKLSYDGLDYSQKEIFLDIACFLRGKQRDHVTSILEAFDFPAASGIEVLLDKALITISGGIQIEMHDLIQEMGWKIVHQEHIKDPGRRSRLWKHEEVHDVLKYNKGTEVVEGVILDLSKLTEDLYLSFDFLAKMTNVRFLKIHSWSKFTIFNVYLPNGLDSLSYKLRYLHWDGFCLESLPSRFCAEQLVELCMHCSKLKKLWDGVQNLVNLKTIDLWGSRDLVEIPDLSKAEKLESVSLCYCESLCQLQVHSKSLGVLNLYGCSSLREFLVTSEELTELNLAFTAICALPSSIWQKRKLRSLYLRGCHNLNKLSDEPRFCGSYKHSITTLASNVKRLPVNIENLSMMTMIWLDDCRKLVSLPELPLFLEKLSACNCTSLDTKITQQQVLQHMLRSRIPYLRKHYLKCYDEEYFFPGDHVIDECRFHTTQNSITIPYLQKPELCGFIYCIILSMGPLLECDVSCSVYQDGIRVGWLEKVVGITKI

SEQ ID NO: 139688 - protein, 68 aa, Glycine max
  Coding DNA Sequence Number=SeqID_22910
MVGWNDRAIVDALQDLAQAMGNQNRGDATGAAEYQRGRRLLLVHILWWKKLSIGGRALANAWRLKVKL

SEQ ID NO: 139689 - protein, 72 aa, Glycine max
  Coding DNA Sequence Number=SeqID_22911
MANLITHDKALKLMVKKRRSYEVLKVTVELSSSILQHTIVPISGKELWRQQEEQLLQRYLGFVISLSLGFLL

SEQ ID NO: 139690 - protein, 84 aa, Glycine max
  Coding DNA Sequence Number=SeqID_22912
RGGRCKTQGASPGGAVVGADLGGTGEARLIALCARTPKGNRPAHPGNGSAGGRVQRLEEHRTSRGVRSAPGGPRTSGGPSASHA

SEQ ID NO: 139691 - protein, 117 aa, Glycine max
  Coding DNA Sequence Number=SeqID_22913
  Gene Ontology: Mol. function=RNA-directed DNA polymerase activity; Biological process=RNA-dependent DNA replication
MSFGLKNVRATYRRLMDKVFWAQISINFEAYVDDMVVKSENIVLHVKDLMEIFSHLQKTQHTPKPGEMCIHSHPYNQHFLDRTNDVVRLSKMEWKGYDIAKDKDGHDEQEKLWCIIH

SEQ ID NO: 139692 - protein, 329 aa, Glycine max
  Coding DNA Sequence Number=SeqID_22914
  Gene Ontology: Mol. function=lipoxygenase activity; Cellular component=chloroplast; Biological process=electron transport
  Homolog annotation: Hit_ID=Q1S9M9; Match level="QueryCoverage=99%, HitCoverage=51%, E-value=1e-71, Identity=69%"; Hit description=Plant lipoxygenase; Lipase/lipooxygenase, PLAT/LH2
  Pfam annotation: Domain name=Lipoxygenase; Domain location=99-329; Score=-135.2; E_value=5.4e-10; Accession=PF00305.9; Description =Lipoxygenase
  Pfam annotation: Domain name=PLAT; Domain location=1-87; Score=60.2; E_value=7e-15; Accession=PF01477.13; Description=PLATLH2 domain
  Pfam module annotation: Pfam domain module=Lipoxygenase::PLAT; Domain location=99-329::1-87
EETNLEKKTIKGHAQGVEKKERGVQYECTFELPSDFGNVGAVLVQHEHHKEMFLRSIVLHDVPYGPVHFTCNSWVQPKHDCPVKRVFFSDKSYLPSQTPCGLRRLREVELMLLRGNGEGERKSYERIYDYDVYNDLGDPDFSIDLKRPILGCSEHPYPRRCRTGREHSIADEEFARETLSGVNPYSIQLVKEWPLRSKLDPEIYGPPESAITREIIESQIIGYRTVEEAIVEKKLFMLDYHDLFLPYVSKVREIKGTTLYGSRTLFFLTKQGTLKPLAIELTRPIMDGKPQWKQVFTPASHSTDLWLWRLAKAHVLAHDSGYHELVNHW

SEQ ID NO: 139693 - protein, 337 aa, Glycine max
  Coding DNA Sequence Number=SeqID_22915
  Gene Ontology: Mol. function=electron carrier activity; Cellular component=endoplasmic reticulum; Biological process=electron transport
  Homolog annotation: Hit_ID=Q1GXP1; Match level="QueryCoverage=99%, HitCoverage=57%, E-value=1e-94, Identity=54%"; Hit description =Flavodoxin/nitric oxide synthase
  Pfam annotation: Domain name=FAD_binding_1; Domain location=189-337; Score=-21.3; E_value=1.3e-06; Accession=PF00667.10; Description=FAD binding domain
  Pfam annotation: Domain name=Flavodoxin_1; Domain location=29-160; Score=146.0; E_value=1e-40; Accession=PF00258.15; Description =Flavodoxin
  Pfam module annotation: Pfam domain module=FAD_binding_1::Flavodoxin _1; Domain location=189-337::29-160
AGLHSRLLVLEDKQTAPAAGASATTQLHILFGSQTGNAEALAQTAAKAARAKGLVPVVQALGEVDLDVFATMRHVLIVTSTYGEGEMPDNAQLFWQAISASTAPRLEQMHFAVLAIGDTGYDGFCQAGKFIDMRLEQLGAKRVVDRIDCDIDYEEPSSEWIGSAMPQFAASAGSSGTVLESAPEAPVIPGSNKQNPYAAALVTNKRLSGEQSAKDIRHFEFDLSDSGLKYEAGDALGVIPVNDAGLVSLLLSELKADYETPVPGFDRNLGDLLTYQFEISEPSRKLIEWVGQHTTNQELLHVLQHDDKDTLANWLWGKDTLDLLQLELKRNLSVPEL

SEQ ID NO: 139694 - protein, 191 aa, Glycine max
  Coding DNA Sequence Number=SeqID_22916
  Gene Ontology: Mol. function=lipid binding; Cellular component =anchored to membrane; Biological process=lipid transport
  Homolog annotation: Hit_ID=Q1S9L0; Match level="QueryCoverage=40%, HitCoverage=38%, E-value=2e-32, Identity=82%"; Hit description=Plant lipid transfer protein/Par allergen
MVTYGMVIFGYYQMIVLTIFSNTKGPSKERRQVWRGGLYGLRWCEGFGYTEMRSDSMLSVSIQTEHGHGGVVTPQTEGSLRALFKSILMPIESGFPSNSHKQMGLLSINPANSGQHPLSGFANLLPSSTYVRQSDMFVSAIKHPLLSGAGAAAGDCADVTQHTSARTKVITTSILVATTVLLVAIEVILLL

SEQ ID NO: 139695 - protein, 392 aa, Glycine max
  Coding DNA Sequence Number=SeqID_22917
  Gene Ontology: Mol. function=structural constituent of ribosome; Cellular component=intracellular; Biological process=translation
  Homolog annotation: Hit_ID=Q012X7; Match level="QueryCoverage=75%, HitCoverage=65%, E-value=5e-43, Identity=36%"; Hit description=[I] KOG4411 Phytoene/squalene synthetase
MGHELDGFYWNYRGRDGPLVHNSVGVVWVLFEEVDAAVEGYLPKDQNKLSILSISAGLNYRLYFQGAKSQTPILNSNVTFICRHPGEALMNGGSASSNLRAALSHCVQQVRSYDYHHYLCLLELPPSMRKAAFALRALNVETARAMDVASDPRIGLMRLVWWQEAIDKMFANKLIEHPTAQALSSVIAETKLSKIWLKRSVDARINDARREVTDMPKTIGELEKYAEDTVSTMLYLTLQAGGIKSTAADHAASHIGKASGILLLLKSLPYHASHNRHFSYIPTAIASKHGLIVKQGGGEERWVDSREGLCEAVYEMASVANAHLEKARKLTESVPPEALPVLLPAVPAQVLLDSLRKVQFDVFDSKLTRGVLGIPPLWYQLKLKWTSWRRKY

SEQ ID NO: 139696 - protein, 237 aa, Glycine max
  Coding DNA Sequence Number=SeqID_22918
  Subcellular localization annotation: CTP_CleavageSite=59; ConfidenceScore=5.68e-01
ARVRPTDVPSSSTPPAPSTSTTHIPTPPGLSAQDSQRFKSMLQSLHQGQILLMQSLQVVAPLGSILTVEQFIEKVSWPGTLPSLEREGGGPSAQVPRQVQDASSEATIPEPFIFEADETQPADPPTPVHEMPADLSTPLLDVPEDPFKPVLGLTTTPLPTLVLHLTNKEDTQDEDTQSWDLSQVSQPTLRREGDAGLTGASSKEGRRAESLPTEGISTPRVCHKGRQPSIKVCIYDF

SEQ ID NO: 139697 - protein, 159 aa, Glycine max
  Coding DNA Sequence Number=SeqID_22919
MAVCLLPATDHPQAAVVFRPAPVWGAILLDESSISRGPDALAGGYRMLLSSNVIYICVRVVMLVRMIRTGLFAAAQMKSRPSMHSSCVIASLSGCARTVGPPPISGGGPGTVWIWSPLKVRTRSPLKARACSPLKFRTCRLSKARECSPMTGRTCNPLK

SEQ ID NO: 139698 - protein, 110 aa, Glycine max
  Coding DNA Sequence Number=SeqID_22920
AEPHLAVGRSSLLGRVQTGLKGGGMKDSDLTGDSSLARANQSMGICKFLIPVVKRKKREKEWAQPHARVFDPKGIENETRICVHYLWSGVTILNLLFPISPLPFFLFLAG

SEQ ID NO: 139699 - protein, 121 aa, Glycine max
  Coding DNA Sequence Number=SeqID_22921
MASGNRLPMVYMCKSCVTRVWALEPARTLQQPVEWILPTPTPYRLVEPVQLIEVSSSEEDLEEDPEKLPPEPAVDDLDLPEDDEDPLPDVDSLEDIMSASQADSTEDSGPGGTANSKDSSS

SEQ ID NO: 139700 - protein, 151 aa, Glycine max
  Coding DNA Sequence Number=SeqID_22922
MSISPCESIGWSVPSRHRGRAHKTPNGPGGAQQGPGVSSSGYGPLDHPRKTPSGPKEVQQGLGVASSNYGPLLVLRSVCRPQQVLRPPRQAQGETPHQPGNGRQPVIDAPPPPPEPLSSSTKAGVLPMTCGRPTGAPPPPLEFASAHPQKV

SEQ ID NO: 139701 - protein, 149 aa, Glycine max
  Coding DNA Sequence Number=SeqID_22923
  Gene Ontology: Mol. function=protein transporter activity; Cellular component=fimbrium; Biological process=cell adhesion
  Homolog annotation: Hit_ID=Q7CR79; Match level="QueryCoverage=94%, HitCoverage=97%, E-value=6e-45, Identity=61%"; Hit description =Prelipin peptidase dependent protein
  Pfam annotation: Domain name=N_methyl; Domain location=5-28; Score =35.4; E_value=1.9e-07; Accession=PF07963.3; Description=Prokaryotic N-terminal methylation motif
MDKQRGFTMIELMIVIGIVAILSAIGLPAYQNYLQRAALTDMLQTMVPYKTAVELCAIERGGPAQCQAGERGIPAAKGSRYVANLSVVNGAITLTGQESLTGLTVAMLPIWNAAEGALSWQRICTSDNTSLRDSCLEQFRFADKEENNG

SEQ ID NO: 139702 - protein, 71 aa, Glycine max
  Coding DNA Sequence Number=SeqID_22924
MEELTSEKKTTEENLASAKDEIANLKKNLKNMESELQKKEKIGSDLMVELDEAKRLIVLNHRKALKRPNIK

SEQ ID NO: 139703 - protein, 148 aa, Glycine max
  Coding DNA Sequence Number=SeqID_22925
MTLTITYQRLRGTLKLLAFFSPFVKFITLKLGFWKHKPQTHIMKVSPWVKVHEEGQLKRQMKKRKSNEDKELTKNLDKERNGEKKVEKEKEIEKEKAEIAQKSTSIVLGYSSSIGMPHVDYKKVVLHNHKGKLSWLGHAFVAPNIVSL

SEQ ID NO: 139704 - protein, 156 aa, Glycine max
  Coding DNA Sequence Number=SeqID_22926
  Gene Ontology: Mol. function=oxidoreductase activity, acting on the aldehyde or oxo group of donors, NAD or NADP as acceptor; Cellular component=cytoplasm; Biological process=amino acid biosynthetic process
  Homolog annotation: Hit_ID=Q1SD50; Match level="QueryCoverage=64%, HitCoverage=23%, E-value=5e-24, Identity=59%"; Hit description =Semialdehyde dehydrogenase, NAD-binding
MTRSYIWILTEVLREELKNARLVSNPGCYPTSVQLPHPIHKGQHAYFSLNNAYSFLSIELKNIIIDAKPVVSGAGCSAKENLLFTEVTEGLNSYGATQHRHVVSRIFPLDLMVKSMQFQVKKRLSHEVIKVTVELSSSVGLSTHPPLSVASACLAR

SEQ ID NO: 139705 - protein, 132 aa, Glycine max
  Coding DNA Sequence Number=SeqID_22927
MKFFLHQHGSVIILRYPSLHPFWPRTEIFTRFHQGPTEKSYPFGIHIKPTTTIKFVSDQIAPRFPPLDPRKKKGKVPSHTKHMPHPDPKDNISLHPIPYDWSRYFTKDAVKKIVALKLDAEFDQNDFILFYF

SEQ ID NO: 139706 - protein, 166 aa, Glycine max
  Coding DNA Sequence Number=SeqID_22928
MHHTKAQWEDDSSNCNKFEGKSIHFAKLWSLVVRTISFFFILSRLCSRRRNKEKEVANPYGSKESSSKAIVVNETSKEESDNDESDEEDDELSLITGKIKRIWKNKNPSRFNNSSKRPFYKKEKILVIFYECKKLRHFKSKCPDLEKSQDKKKKLFKSKEKILTST

SEQ ID NO: 139707 - protein, 66 aa, Glycine max
  Coding DNA Sequence Number=SeqID_22929
MSKLDEFFVEMKIENIAKFIATSNEDQLASNSPMDNQPKEVKVPIGHLLRKHHPESQIIGDPKDKV

SEQ ID NO: 139708 - protein, 308 aa, Glycine max
  Coding DNA Sequence Number=SeqID_22930
MSVETITQAIGCERYGTKFMNSWGDELEDHIWHSLWGPNWAKTLRRYGTLFNKAKIFQQIVNKAIIHKQGSKDFLSNTHKFILYHLMEGTPFDLPQILFNFFVSKVMMDKCIEKDIYHSVVLTKVFEAHGVIRKFLYETPMDMMAHSNKLPRWMIPYFLNFIKSLDSTLGETTSWMQYGKNLQKNNKWILVAPKEIGAMTNVTKKLASKKQKPLSTTERLRALSETESDDNQALMFTKPKYPKGEQSSTTANATNKPPPVEIPLRIESTRDMDDEVQYEAPPSPFHLDRFQHQGPLAIDPNLIADDIA

SEQ ID NO: 139709 - protein, 91 aa, Glycine max
  Coding DNA Sequence Number=SeqID_22931
  Subcellular localization annotation: CTP_CleavageSite=51; ConfidenceScore=5.13e-01
MLNREDVHKNHHTSMTTNPPPQTKKTHARRPTMSPRSREWRMENMKETQTKKMHKQHDHHDDTCGQMKSIRVAETQTLIVSLSTIRVQLWT

SEQ ID NO: 139710 - protein, 34 aa, Glycine max
  Coding DNA Sequence Number=SeqID_22932
MTADSLEDMNSESTQGYSDLGDQAMQCRHCNAKM

SEQ ID NO: 139711 - protein, 130 aa, Glycine max
  Coding DNA Sequence Number=SeqID_22933
  Homolog annotation: Hit_ID=Q9SJT1; Match level="QueryCoverage=25%, HitCoverage=4%, E-value=2e-07, Identity=76%"; Hit description =Putative ubiquitin activating enzyme
  Pfam annotation: Domain name=UBACT; Domain location=58-123; Score =6.5; E_value=0.0014; Accession=PF02134.11; Description=Repeat in ubiquitin-activating (UBA) protein
MIEHERNSIKVNKIWESLEKYKKKLARAEAVDTIEYCNEKINELEARLEYEEKIGNLSFDKDDQLAIEFVTIAANIRAASFGIPRGTSKTLHRGHNKSKHSKETHATPIVNNFKILGAFLGIQLAKKVYH

SEQ ID NO: 139712 - protein, 137 aa, Glycine max
  Coding DNA Sequence Number=SeqID_22934
MGSETCFREVSTKRNPEDMKHTSNPTTTMAARMESRETRVMAETFNLASEPGSSGHCSRRRPPPRRRRPSPFSLATTGFGAPREAQPNPTTRMNNRSPTCRHVPLPSITNLDAWRPRVVFPAPESGQTNASRLIGVS

SEQ ID NO: 139713 - protein, 253 aa, Glycine max
  Coding DNA Sequence Number=SeqID_22935
  Homolog annotation: Hit_ID=UPI000034F3BF; Match level="QueryCoverage =42%, HitCoverage=9%, E-value=9e-19, Identity=43%"; Hit description =calcium ion binding
  Pfam annotation: Domain name=efhand; Domain location=144-172; Score =19.0; E_value=0.017; Accession=PF00036.22; Description=EF hand
MYGFLEPQCIHNAKDKRQECKQYIQTWVKESQRQVYLGAYQNQAHWQLIVLCPQDNIVVWLCSLRKKPNVNIKGAISSAMKTLTNSLEGKGDQVVPRWIERKSHVQTGGYECGYYVMHWMWCIVSGRLNNEWNRQDLCGLCVDVLKKVWDLSDQDNDSMLSLKEFCFALYLMEPYKEGRPLPQSLPSNVLFDETPMSMTGQPKIAYGNAAWGIGQGFQQQQGIPVHGSSAQADGTQQSNQQKSGKPVLEEIPF

SEQ ID NO: 139714 - protein, 93 aa, Glycine max
  Coding DNA Sequence Number=SeqID_22936
MSRPIGPKAAKRKSKGKECPNTLDLSGIECVIKDKNMNTSKLIQLKEAQEKRLQEQERRMEYEILMKDTSNMSEQQRKDHEKFCDHIRKKLGY

SEQ ID NO: 139715 - protein, 274 aa, Glycine max
  Coding DNA Sequence Number=SeqID_22937
  Gene Ontology: Mol. function=transferase activity; Cellular component= intracellular; Biological process=translation
  Homolog annotation: Hit_ID=Q1SYJ0; Match level="QueryCoverage=76%, HitCoverage=60%, E-value=2e-59, Identity=49%"; Hit description =Terpenoid cylases/protein prenyltransferase alpha-alpha toroid
MDPTIDLDEVLDQMIDEELEDNNDEEIIRFILESQQQLHGNTTSRSQRRRVVHRNREEGHHRLFNEYFSENPVYTEIQFRRRFCMLRHVLIRIVNALSNHDEYFQMRVDALRQKGLSPLQKCTTVIRILAYGSPADSVDEYVRIGETTTVECLERFVLGICTIFGNEYLRRPNNEDIKRLLQMGAARGFPVLSGHAPAMQFMVNRTQYNMGYYLADDIYPDFVTFVKTISMPQGEKRKLFAQRQESVRKDVERAFGVLQSRFAIIRGPSRFWDA

SEQ ID NO: 139716 - protein, 90 aa, Glycine max
  Coding DNA Sequence Number=SeqID_22938
MEKRPWPETRHATVMETTDATMAGDETVFGDPTMCFIVDANEVKVRPHEGVTVVAGGVDECGHGGEEEDTEKERKKIERRRGGSFWRCCW

SEQ ID NO: 139717 - protein, 87 aa, Glycine max
  Coding DNA Sequence Number=SeqID_22939
MDERITRESTLCFFFFLLVLLRLLLLSTYWGSTWLLVEGRGFRIRLTMRMPWESYMLEEGEACSNSCNLLLADMFTKSFKGLCLLHL

SEQ ID NO: 139718 - protein, 133 aa, Glycine max
  Coding DNA Sequence Number=SeqID_22940
MTTVLNTTQKPHNGNANDIEGEECITRQCRHAEGEEEEEQSNGPRSGGEDDAAERSWVEEENQEALDCWVHRPQGRRRRKKVVEQEEEAQKKKSLCWVHLATPITTRSGIVRITKSIARSLTIRSNRMTLGDS

SEQ ID NO: 139719 - protein, 172 aa, Glycine max
  Coding DNA Sequence Number=SeqID_22941
  Homolog annotation: Hit_ID=Q9FFU3; Match level="QueryCoverage=56%, HitCoverage=24%, E-value=7e-23, Identity=45%"; Hit description =Genomic DNA, chromosome 5, P1 clone:MBG8
MNLTVLEAITLYPAYAPAFLKYKGGTKLIFYLFIKIVDVDFECNGSLVLNGMFSVQGLYLHDILVETEKRGISFDELLTIQEQDEWVYSDGKSTTCVAFILSNTKRLKFLVPLLIPFQVTELTILGEYKMELPGYNTLEPYANMNEMIGLLDVRSVFHRFYHLELYCLLNLT

SEQ ID NO: 139720 - protein, 347 aa, Glycine max
  Coding DNA Sequence Number=SeqID_22942
  Gene Ontology: Mol. function=transcription factor activity; Cellular component=transcription factor complex; Biological process =regulation of progression through cell cycle
  Homolog annotation: Hit_ID=Q1SSF0; Match level="QueryCoverage=79%, HitCoverage=86%, E-value=5e-82, Identity=53%"; Hit description =Transcription factor E2F/dimerisation partner
  Pfam annotation: Domain name=E2F_TDP; Domain location=55-112; Score =2.8; E_value=0.0037; Accession=PF02319.11; Description=Transcription factor E2Fdimerisation partner (TDP)
  Subcellular localization annotation: CTP_CleavageSite=36; ConfidenceScore=5.39e-01
APGMTQTVHLPPPLQTDPTIRGKQNGKPKGSRNAKSAAHRPYADSTNSTAVNNCRYDSSLGLLTKKFVSLIQDAKDGTLDLNRTAEILELGSIQAEVDSLYAEECKLDDCIRKKQELLRNLEESESSQKYLFITKEDILGLPCFQNQEIIAIKAPKASSIEVPDPDEELGFRQRQYKMIVRSAIGPIYLYLLSKDDHKFEDDSAKPMKLTNPSWNSDLYRKRGVGLLESQNDENNPSERFSLQGSQAFGIQEITPTDFEMEDDYWFQSDPGVSQTELWVEMVIITTIIAVTTTTIIVSITIIIATNMNIIVATACDPDDSDSHVDGDDSGHDNDHDDDDSGNRNERS

SEQ ID NO: 139721 - protein, 125 aa, Glycine max
  Coding DNA Sequence Number=SeqID_22943
MYKKHNNPHKSGTEGFVVIKIRGGTEEEAYFEQIPQPRPKLNLSAMKLFQRFRKIFMRLMFSVPNSRRSKDSKHKVNDRFEPPKTSCSSYYSSQSHYSEAIADCIEFFNKSAQDGVLDGRKSDVV

SEQ ID NO: 139722 - protein, 51 aa, Glycine max
  Coding DNA Sequence Number=SeqID_22944
MWLLVRFVNKTFIVAHGRCWWRRKRRHDNNLFGSTVRGKAMVEERVLTHDD

SEQ ID NO: 139723 - protein, 115 aa, Glycine max
  Coding DNA Sequence Number=SeqID_22945
  Homolog annotation: Hit_ID=Q1RTL5; Match level="QueryCoverage=49%, HitCoverage=39%, E-value=2e-07, Identity=45%"; Hit description =Polynucleotidyl transferase, Ribonuclease H fold
MELCIPCLSSSPCLSLHIRGGDFSSTFIFAYAMALVSYDILKSPFQIFAHSIDQTSHVQWMAPPKGFFKCNNEAAFQKQCATTSWGACCRDDTRAFVLTLTKWGNPVWRVKAWGC

SEQ ID NO: 139724 - protein, 53 aa, Glycine max
  Coding DNA Sequence Number=SeqID_22946
MPLDVVRKIIMDVIEGNGFVKYECMKVKCDNDLNNNNNNYNYKNNNNNNNNTC

SEQ ID NO: 139725 - protein, 152 aa, Glycine max
  Coding DNA Sequence Number=SeqID_22947
MLITEIKMFMNYTSSYKKGMVSKAKRVGDDSWKPGRIICQVENVIAAQTKSVFEGGEIVPGKRMLKRVFWSFGSCINEFAGCKPNLQVTHTRRRCTSDILRTSVRISLSAQLRLTAKHFFCSHIMAACKSVNVDHMNYVSAAIRLITHFARL

SEQ ID NO: 139726 - protein, 411 aa, Glycine max
  Coding DNA Sequence Number=SeqID_22948
  Homolog annotation: Hit_ID=Q5XM22; Match level="QueryCoverage=15%, HitCoverage=36%, E-value=2e-14, Identity=62%"; Hit description =Resistance-like protein HAAS-2
MKHSSGRGSKWILILDTLYPPNDRYFYARMGMERVVEDLPTAVEELNKEQQEAPVEEVVTDVEGFSGEPHDTSVMRDFEHHIALRVWNGEERPELKLSSHGRKMTKFGRPAPEIEGLMAASRRSPLIALTITLDDIAPLLHLPIVGAFHNFEQLHVDDAVDMLVELLEMKIEACHWIVAARAYLLHLLGCILFANKSSTHVQVIFLDALRDLMQSGTYALDAAALVHMIYEHFLFVGSALAAKDYDERRLPACQWTSSKALSMSTYCRYLDRLTPEFGYIQTISPHPTASSVSVEEMDDRWMQFNDYIALVEQICVVPDQCSSDYMDWFYMILHSFMSSAQPGDSPRVPSVQQYDTFVQPDVHPQLVATTTPDEADVDVHHLRHLERLLNLRILTEGIETYNVAEECLGIT

SEQ ID NO: 139727 - protein, 725 aa, Glycine max
  Coding DNA Sequence Number=SeqID_22949
  Subcellular localization annotation: CTP_CleavageSite=50; ConfidenceScore=5.36e-01
MTKRHTNKQQQSQSSSSSSGGRNLIPPACGLNASRGDLEFSEKSKKEKVRSLSAVDEALSMGCRVSHSHKPTKKFKLPRKFLKDCNGVDHASVPRKIRSGGDFVSVEITAVKKRGRESIFGDSEKVNHRMNGMESPQKDGIKKSKKQRTPGWSTRLVSPGPITKDEEEVVETLYALAGMFPADNASNAIKSELGSESLPENSTVLQDQEESQSANVTVEASGATQDGGERSPRGCKKISFLNETNCQEQTDFPESAKFLVATHSTAPKTNLQAVPMMVKSESGGNVALHDSELLSLEMGLNVPAQPQISYIERQSDGGFQTVRSVDYKQEQQHLIKYQKETEGSALSPDLSRIASAGITSASYLQSSSAKAQDWLNTAIGISKQNLMESCSSGGKISEIITHKKSWKRCAAHVHISHLIRSLEVSKRQVGKEHELCPQTRVHQGSKCGVLTQAHNLNWMRSGNSHATRTVYSATTSNSRETKNGILQHGLYHEKSQAPPTPGVYDPQKQCSNFLSLSTRGSELKVNESFNKGESKLEPYSKQQLPYFQSLHQQQQQHGLMPIQSSTYASTFLDQLPVAGPQVRLQQPHYYGTPLRGTHYSSTVSYKQQQQSFWAVQLAAQGGSSSMNCSIVRAQYPNWQSGRHDSSVAQVILPHSPASASASLETLGSKITSISEQNLFSFASSRSRANGQGIYLASSVCDESKGRFRSSNSGTPSLQLLCDERI

SEQ ID NO: 139728 - protein, 218 aa, Glycine max
  Coding DNA Sequence Number=SeqID_22950
  Gene Ontology: Mol. function=oxidoreductase activity, acting on the aldehyde or oxo group of donors, disulfide as acceptor; Cellular component=mitochondrion; Biological process=metabolic process
  Homolog annotation: Hit_ID=Q4JIY3; Match level="QueryCoverage=82%, HitCoverage=30%, E-value=7e-48, Identity=60%"; Hit description =Pyruvate dehydrogenase
MDALAVKQACKFAKEFALKNGPIILEMDTYRYHGHSMSDPGSTYRTRDEISGVRQERDPIERVRKLLLTHEIATEKELKGSVACKTCNTAQRLEAGGHYSLSFHYLFNPLSLTLSKGLGPLGSGEKPLEQPDIEKEIRKEVDEAIAKAKSSVFISDFQESQMPEPSDLFTNVYVKGFGVESASRVKAHLKCKSKGGRGEVVLKIDITKAYDGMDWERS

SEQ ID NO: 139729 - protein, 790 aa, Glycine max
  Coding DNA Sequence Number=SeqID_22951
  Gene Ontology: Mol. function=actin filament binding; Cellular component=intercellular junction; Biological process=actin cytoskeleton organization and biogenesis
  Homolog annotation: Hit_ID=UPI0000162EB3; Match level="QueryCoverage =98%, HitCoverage=94%, E-value=1e-97, Identity=40%"; Hit description =actin binding
  Pfam annotation: Domain name=Extensin_2; Domain location=203-510; Score=-143.0; E_value=0.1; Accession=PF04554.4; Description=Extensin- like region
  Pfam annotation: Domain name=FH2; Domain location=348-769; Score =436.5; E_value=3.5e-128; Accession=PF02181.13; Description=Formin Homology 2 Domain
  Pfam module annotation: Pfam domain module=Extensin_2::FH2; Domain location=203-510::348-769
  Subcellular localization annotation: CTP_CleavageSite=53; ConfidenceScore=5.19e-01
MALNTMILQSWPFMSLVFVLLLHSLSITPTCHCQTSTNSPTQNIETFYPNGTSATAPATQQPPPPVPTGNIAPSRGSSNRNIATAVAATAASTIVVCGLIFFVVQRCLRKRRRRREEIRSNTAGGGGGGGDTRVVPQGNLFERIDGNVRGLIVDEDGLDVIYWRKLEGKNSNKDLLHKEVVRSSRNNEKEDEKHGHDENQVKKSKYIQEVPLLRGKSSTSHLNVSPEEDEPYRFSPLPSPPPSASVSAPNSSSVPASVGIVIKGAQKPDSPTQPSTPPPPVSPSTPSSSTSFAAVPKTNIPAPSPPPPPIPARRNPTPPPPPPSSKPPPAPIEMQAIKQRNSSGKGMLETSNDQVKLKPLHWDKVNTNNADHSMVWDKVDRGSFRVDQDLMEALFGYVATNRRSPKGKSHSAIPSKDASAQSAKTNFLLDPRKSQNIAIVLKSLAVSQGEILDALTDGKGLNADTLEKLARVSPTEEEQSLILQYKGDPARLAAAESFLFSILKAVPSAFKHLNAMLFRLNYNSEIQEIKESLQTIELGCNELKSKGLFLKLLEAVLKAGNRMNAGTARGNAQAFNLASLRKLSDVKSTNGRTTLLHFVVEEVVRLEGKRVALNRNGSLSSSSSRSSSNSNGNYENNIASNELVEREYVTLGLPIVGGISSELSNVKKAAQIDHNNLVGSISALSTQLVEIQQLVSSCGNGEGGNFVKEMDHFLGNAEEELKLVREKQTSVFQLIKKTAQYYQGGSSKETAENNLQLFVIVKDFLGMVDQTCIEIARDMQKRKPPKALFR

SEQ ID NO: 139730 - protein, 64 aa, Glycine max
  Coding DNA Sequence Number=SeqID_22952
MSKSCVSQCVKGIRIPLVTKCMMDVCMFFVLEYMRSHEPSCLASDERLAYGRLIGEAWSMELHA

SEQ ID NO: 139731 - protein, 235 aa, Glycine max
  Coding DNA Sequence Number=SeqID_22953
  Gene Ontology: Mol. function=carboxypeptidase activity; Cellular component=membrane; Biological process=auxin mediated signaling pathway
  Homolog annotation: Hit_ID=Q9FL08; Match level="QueryCoverage=86%, HitCoverage=57%, E-value=1e-31, Identity=35%"; Hit description =Nodulin-like protein
  Pfam annotation: Domain name=DUF6; Domain location=66-195; Score =20.8; E_value=0.0043; Accession=PF00892.11; Description=Integral membrane protein DUF6
  Pfam annotation: Domain name=TPT; Domain location=58-195; Score= -26.2; E_value=0.019; Accession=PF03151.7; Description=Triose -phosphate Transporter family
  Pfam module annotation: Pfam domain module=DUF6::TPT; Domain location= 66-195::58-195
MEKLDLKLQSCQAKSIGTVISIAGALIMTLYKGLPMTSDVMPNNVFLSSQQSKWLLGGFLLAVGCFFCSISLVIQTWTIKDYPEELMLITISTSLSVILSFIVAFIAEENPKAWTLKLDMELVCILYSAIFVMSTRNVVNVWACRKKGPVYVAMFSPLGIVIALAMGIVFLGDALYLGSLIGAAIIAIGFYAVTWGQAQEETMGYEKHGTCSIISSPSSETPLLLNKSKDSSYFV

SEQ ID NO: 139732 - protein, 67 aa, Glycine max
  Coding DNA Sequence Number=SeqID_22954
  Subcellular localization annotation: CTP_CleavageSite=37; ConfidenceScore=5.06e-01
MATWVNGWGKLLPFLGMLMAMLTQSGSMVVIKFAMTDGMNKSELPLLTVPALGSFFLLALFALVLLF

SEQ ID NO: 139733 - protein, 66 aa, Glycine max
  Coding DNA Sequence Number=SeqID_22955
MSLDLEILKPRGWFHEHPECRCGSLFDVTTSVATGDVAQGSLSNVVAFVATISIAQGSFSLMSPLL

SEQ ID NO: 139734 - protein, 231 aa, Glycine max
  Coding DNA Sequence Number=SeqID_22956
  Gene Ontology: Cellular component=chloroplast thylakoid membrane
  Pfam annotation: Domain name=Methyltransf_11; Domain location=90-186; Score=7.2; E_value=0.011; Accession=PF08241.2; Description =Methyltransferase domain
MTRKQASSTRRGGLSGVLHSKSKSSPLLSISLVLFVAILLILYACIGSGILGGRKDVISMAEDDFSCTFEVPSAIPVLKNAYGGSMKNVLHVGPESCSVVSKFLREGETEAWGVEPYDLDDADRNCKALVQKGIIRVADIKFPLPYRVKSFSHVIVSDALDYLSPKYINKTLPELARVSSDGIIIFTGYPGQPRAKIAPLSKFGRPPSQREDYGVCWMLGSNCKGKYGVSV

SEQ ID NO: 139735 - protein, 109 aa, Glycine max
  Coding DNA Sequence Number=SeqID_22957
  Gene Ontology: Cellular component=nucleus; Biological process =regulation of transcription, DNA-dependent
  Homolog annotation: Hit_ID=Q1SAU7; Match level="QueryCoverage=95%, HitCoverage=11%, E-value=2e-36, Identity=74%"; Hit description =Paired amphipathic helix
  Pfam annotation: Domain name=PAH; Domain location=29-75; Score=59.5; E_value=1.1e-14; Accession=PF02671.11; Description=Paired amphipathic helix repeat
MTTGDGQIPTTKDALAFLKAVEDAFQDKREKYDYFMVIMKDFKAQRIDTIGVMERVEELFKGHKDLILGFNTFLPKGYKIILPLEDEQPPQKKLIELKEEAINFVGKIK

SEQ ID NO: 139736 - protein, 568 aa, Glycine max
  Coding DNA Sequence Number=SeqID_22958
  Gene Ontology: Mol. function=transcription factor activity; Cellular component=nucleus; Biological process=regulation of transcription, DNA-dependent
  Homolog annotation: Hit_ID=Q6SA75; Match level="QueryCoverage=97%, HitCoverage=93%, E-value=6e-51, Identity=35%"; Hit description=ANT -like protein
  Pfam annotation: Domain name=AP2; Domain location=325-392; Score =113.5; E_value=6.3e-31; Accession=PF00847.10; Description=AP2 domain
  Subcellular localization annotation: CTP_CleavageSite=43; ConfidenceScore=5.14e-01
MKSMENDDTVDLNNQNNNWLGFSLSPQMNNNNIGVSTHTQPSSAAAEVVPTSFYHTTPLSSYGFYYGLEAENVGLYSALPIMPLKSDGSLYGMEAVSRSQAQAMATTSTPKLENFLGGEAMGTPHHHYECSATETMPLSLDSVFYNQPSRRDQNNNQTYQNHVQHISTQQQQQQELQAYYSTLRNHDMMLEGSKQSQTSENNNNNLQVQNMGDDAVSVPVAGLKSWGVRNFQASHAHESKMIVPHHVEENGGESGSIGSMAYGDLQSLSLSMSPSSQSSCVTSSHRASSAVIDSAAMDTKKRGSEKVDQKQIVHRKSIDTFGQRTSQYRGVTRHRWTGRYEAHLWDNSCKKEGQSRKGRQGTQEEAAEAYDIAAIKFRGANAVTNFDITRYDVEKIMASSNLLSSELARRNQETTDNGTQYIDQNHNKPSAYEDTQEAAILMHQKSCETQNDQWKMVLYQQSSQQLEQNIPPRIESDRTNQSFSVALENMFHQEVEESSKVRTHVSNPSSLATSLSSSRECSPDRTSLPMLSGVPSTSSKLLATNPNNVNSWDPSPHLRPALTLPQMP

SEQ ID NO: 139737 - protein, 46 aa, Glycine max
  Coding DNA Sequence Number=SeqID_22959
MTNSINLALWTILAELTDSNNLVELELGNANLIGILPDVFDEFVSG

SEQ ID NO: 139738 - protein, 227 aa, Glycine max
  Coding DNA Sequence Number=SeqID_22960
  Gene Ontology: Mol. function=oxidoreductase activity; Biological process=metabolic process
  Homolog annotation: Hit_ID=Q9FJP5; Match level="QueryCoverage=52%, HitCoverage=35%, E-value=2e-17, Identity=38%"; Hit description =Similarity to dehydrogenase
  Subcellular localization annotation: CTP_CleavageSite=60; ConfidenceScore=5.51e-01
MCGVAGITSGSIVNVGNLVGYVSTPWARSYCAGKASMQAMSNSLRLKLRPFGVNVVLVLPSSMRSNLGRANLERLGNYEWKLYKDFKEVIEERARASQDDKAMDGRVFARHVVRKVLGPKPPKKIVFLSHDWFVCLALVVSPVDEKVMEIKKTKELNLSNDDEEITSQVVNKNNEKKGEGNAKDELGKLAHKYEEALKFELIWKYFKICLQTFLILHPEISLRRTHN

SEQ ID NO: 139739 - protein, 40 aa, Glycine max
  Coding DNA Sequence Number=SeqID_22961
YFIVKSKELIPRGIGIYMNSEEVHSKRWWMYLDSWRIPLS

SEQ ID NO: 139740 - protein, 125 aa, Glycine max
  Coding DNA Sequence Number=SeqID_22962
MSDRKIVLVIGCAKGGIGYEYCKAFAEKNCHTYLPLTSRRGCKTCSTGTLNEMPLDAILAWEINTLGQLRMVQHAVPHMAMRRSCNPNRTIGGAQENTENSTITNGRERFNDYIKVRDELLTLED

SEQ ID NO: 139741 - protein, 601 aa, Glycine max
  Coding DNA Sequence Number=SeqID_22963
  Gene Ontology: Mol. function=transcription corepressor activity; Cellular component=nucleus; Biological process=regulation of transcription, DNA-dependent
  Homolog annotation: Hit_ID=Q1SAU7; Match level="QueryCoverage=97%, HitCoverage=67%, E-value=1e-146, Identity=48%"; Hit description =Paired amphipathic helix
  Pfam annotation: Domain name=HDAC_interact; Domain location=413-513; Score=117.2; E_value=4.7e-32; Accession=PF08295.2; Description =Histone deacetylase (HDAC) interacting
  Pfam annotation: Domain name=PAH; Domain location=106-151; Score =20.7; E_value=0.0053; Accession=PF02671.11; Description=Paired amphipathic helix repeat
  Pfam annotation: Domain name=PAH; Domain location=20-66; Score=53.6; E_value=6.7e-13; Accession=PF02671.11; Description=Paired amphipathic helix repeat
  Pfam module annotation: Pfam domain module=HDAC_interact::PAH::PAH; Domain location=413-513::106-151::20-66
MTDSALAYLTTVKDAFKDDREKYDKFLELVKNFTAERFNLVRGIEEVKELLKGYRDLILGFNVFLPKGYEIKLPLEDEQPPEKKLDVFVKAKKLLHKIKARFHGQDNVYKTFLAILKMHKDGTKSPTAAYGEITALLQHHADLLNELPFLSLNTSRTISIHFTSAQNSLFREKSSAVPIVQQMCVLKVYLSAYYVPFFDDIVGHLADFFTHSDWSEREKDNRDYYQDGIQKLLSLKRTHFCMAEDLMARSFCNVDKHFGSERFSFCAKIKDKLQNPKNYFSKHVDIYSKEKTTRQELPSSTTDFPRKFPDLMKGFNECVTQCKKMNEEFSVGIVKKKSSRDEEHVQKQIKLEDWNRDRHHDGDDRVKETVSDCRKRDKSTVVANKNVSGRKLSLYASKKKNSAKSVRELDLSICEKCTPSYYLLPKEFQIPSSSRRTKLDAEVLNDHWKCVAPSIKDYSSKHMSKNLNEMTLFECEDDRIELDMCLETAKSTTKQVEELIEKINTNMIERDNPINIEKHLIAQNLRCIEQLYGDHGIDVLDVLRKNASQVLPVILTRLKQKHEEWARCRADLNKLWAEVYAKNYHKSLNHDRVPSTRNQEL

SEQ ID NO: 139742 - protein, 60 aa, Glycine max
  Coding DNA Sequence Number=SeqID_22964
MEKNDENADEVFDENKMAYLQSTSAKTMPTRTSSLRHLLRQLTKGLIIIGSEVVESEKEN

SEQ ID NO: 139743 - protein, 267 aa, Glycine max
  Coding DNA Sequence Number=SeqID_22965
  Gene Ontology: Mol. function=protein kinase activity; Cellular component=membrane; Biological process=protein amino acid phosphorylation
  Homolog annotation: Hit_ID=Q1T053; Match level="QueryCoverage=81%, HitCoverage=60%, E-value=1e-117, Identity=94%"; Hit description =Protein kinase
  Pfam annotation: Domain name=Pkinase; Domain location=66-263; Score =46.1; E_value=2.6e-11; Accession=PF00069.15; Description=Protein kinase domain
  Pfam annotation: Domain name=Pkinase_Tyr; Domain location=66-256; Score=36.5; E_value=1e-14; Accession=PF07714.7; Description=Protein tyrosine kinase
  Pfam module annotation: Pfam domain module=Pkinase::Pkinase_Tyr; Domain location=66-263::66-256
MVNGVAVSISLSKQARPHLYYHIPTIGVYKPAQLWQLEDQMPRPTKRLHGSSVYTLKEMEEATCSFSDENLLGKGGFGKVYRGTLRSGEVVAIKKMELPAIKAAEGEREFRVEVDILSRLDHPNLVSLIGYCADGKHRFLVYEYMRRGNLQDHLNGIGERNMDWPRRLQVALGAAKGLAYLHSSSDVGIPIVHRDFKSTNILLDDNFEAKISDFGLAKLMPEGQETHVTARVLGTFGYFDPEYTSELTDRYCGQELNPYHPWTWSSN

SEQ ID NO: 139744 - protein, 97 aa, Glycine max
  Coding DNA Sequence Number=SeqID_22966
MDGITGQSVWKLSFAIDMERGPTTAKSGYLHQWYWSILTSPQGDWSDISFFGYFLHSSSISNADFTVSTAATSKKREEVKRGSCENGLKIKHKKIDF

SEQ ID NO: 139745 - protein, 146 aa, Glycine max
  Coding DNA Sequence Number=SeqID_22967
  Gene Ontology: Mol. function=protein kinase activity; Biological process=protein amino acid phosphorylation
  Homolog annotation: Hit_ID=Q1T053; Match level="QueryCoverage=57%, HitCoverage=23%, E-value=6e-34, Identity=84%"; Hit description =Protein kinase
MAPFDLDMSMGRDGYGYCLPNLLSRLPTISLYPYPIPHGFKFIVPFPYPSGILNPVSYTIQIRKIFFYVRHILNDRKKLRKVIDPEMARNSYTIQSIVMFANLASRCVRTESNERPSMAECIKELLMIIYTNSKGLGMVMHSLRMI

SEQ ID NO: 139746 - protein, 203 aa, Glycine max
  Coding DNA Sequence Number=SeqID_22968
  Gene Ontology: Mol. function=N-acetyltransferase activity; Biological process=metabolic process
  Homolog annotation: Hit_ID=Q1T050; Match level="QueryCoverage=49%, HitCoverage=49%, E-value=2e-25, Identity=59%"; Hit description=GCN5 -related N-acetyltransferase
MYAPPGDNPEGPLYAAKLNRLIPGRGGRGDGSIGASFVETELHHPSQARFFFFLISAGGCCLGVECDEGGGVGHEGPAVEEVLFDKEGEEFDVGLGEEHGLGEGLGEEEDGGVGLVGPHDADGEGAGGEVRAVEECLEEAEAAELVVGEEAARVEGVVGNSEGGVGRGEFESGEEFGGEGGFGGGEGEGEGLDLRVEGEGEGK

SEQ ID NO: 139747 - protein, 496 aa, Glycine max
  Coding DNA Sequence Number=SeqID_22969
  Gene Ontology: Mol. function=RNA-directed DNA polymerase activity; Cellular component=nucleus; Biological process=RNA-dependent DNA replication
  Homolog annotation: Hit_ID=Q1S408; Match level="QueryCoverage=71%, HitCoverage=62%, E-value=1e-44, Identity=29%"; Hit description=RNA -directed DNA polymerase
MYLDKDDGDYVMSNSFVGETSNEQDVIDDDFSDTNDEVTSIEASKLDNCAVDLRAWGKNLKLSFRAEIDRCKKDVEAFRASKEEDIRDEEGIRRYEEAREAMGLWLNKEDAFWKQNKIDKLLDDNGGSHGISRGDLVIKCVEARVFDSDNQELTKPFLKEELKHALLNMNSDKPSRPDGFNPVFYKRFWNLCGENLESMKGLRPISICNVVYKVLIKILANRLKPLLPNCIFVEQSAFVENRSITDNTIVAFEAIHHMKCKVKGKQEEVALKVDMSKAYDRIKHYNLIKKEELRGDLHGIKVCRGASSQAINLAKSNVYFSRNPSPLIKDEVSSIMGDRICKKINHWLWKHLSISGKEHLPHARLLSRLDLAYNELILVGWQQWKGQGINWLNWDKMAVRKEFEGMGFRHLFGFNLAILAKQGWKLISNPNTTIVRVFKTKYYPQGVFLEAALGHNSSFDWRSIQAFHVLVSRGLKWRIGDGKRINIGKDLWLRAP

SEQ ID NO: 139748 - protein, 97 aa, Glycine max
  Coding DNA Sequence Number=SeqID_22970
  Gene Ontology: Mol. function=protein serine/threonine kinase activity; Cellular component=cytoplasm; Biological process=protein amino acid phosphorylation
  Homolog annotation: Hit_ID=UPI000034F1DC; Match level="QueryCoverage =98%, HitCoverage=13%, E-value=1e-34, Identity=71%"; Hit description =ATP binding / kinase/ protein kinase/ protein serine/threonine kinase/ protein-tyrosine kinase
MVRAYCSFVVKRSLWVVMAFMAQGSFLHLVKAAYLEGFEEAAIGSILRETLKGLEYLHRPGHIHRDVKAGNILLDDNDKVKLIDFGVSACMFDTGNR

SEQ ID NO: 139749 - protein, 95 aa, Glycine max
  Coding DNA Sequence Number=SeqID_22971
MKKDKLIGMLDEVLCKVSSREAQDKNSKIDRVGLKIDISFNVYKYLPTIELLLNHLPAIKGRIVMKVWDIVEPKGVEEILKGGVVSDNVNQTQHH

SEQ ID NO: 139750 - protein, 52 aa, Glycine max
  Coding DNA Sequence Number=SeqID_22972
MKKKESKRRKQVGEEMTETEEAVNRYKCWRDGIMEHVYVVSSALSHEISETY

SEQ ID NO: 139751 - protein, 213 aa, Glycine max
  Coding DNA Sequence Number=SeqID_22973
MVPKRKRLKACKLTDKLPPLDLGVLVSMVLSIVWSAGSSWLGYSGGLVVFHDWLSYGDWEMVERKSDERKKDNVIKIWFWSLCGVNCEGRKEGLSSLGPALVQSATDYLILSHALHFKINPVFLIGWMVTDFLLTPTFNMAIKWSFMLVTLTLSIALGFTLSFLIIFSPKNQNLDLHSSPSCIRSSRRKRPPFSSSSKIHSSVLRLFSISKLG

SEQ ID NO: 139752 - protein, 1071 aa, Glycine max
  Coding DNA Sequence Number=SeqID_22974
  Gene Ontology: Mol. function=nucleotidyltransferase activity
  Homolog annotation: Hit_ID=UPI000051AB64; Match level="QueryCoverage =23%, HitCoverage=32%, E-value=6e-16, Identity=27%"; Hit description =PREDICTED: similar to CG11265-PA, isoform A
  Pfam annotation: Domain name=NTP_transf_2; Domain location=815-908; Score=12.5; E_value=0.0075; Accession=PF01909.13; Description =Nucleotidyltransferase domain
MRGFLMVISLDCTKLELLGEEHDKSSSGKPKEKPSVSNRKKKGRNRNNKRQNPVSKTCVDDISHENPLKDIDCKVDNKKKTDLVASSELPAVHMGKEISMEFPSSTDHTQGLDIGKIKVRTTSRSRKEKNKSKNILISAGGDSQKSSIHAASTTVISEGEVAICDRFLNSSTIQNVKNDNAIGNDILASNSSLCSSLSGLSRENSSTRKVEGKTEDLAESGNSLGPQCCLLSDERKTLCSGLDTLTCDIDCTAATTPPVPAVKQGSFFSKEDTCPLNSSCAAKADLKTTVPDKPIREVNAKEFGLLKERDRCLFESRNSAFSKCSPYEWPGLPSIYFPSFNSHLPPATDRLHLDVGHNWHNHFCHPFVPTLQQARNPPIEGGCNPILSRPIPMSFDWPPVFRGGMTPSPNYNYDSGFISRKQCTFSKGLAVHNMQVDATAPDDERKYSGDVWDLPDLTNTLELADEFDNHCVSEEEYEVHTVSGIDYNQYFGGGVMYWNPSDYPGKGFSRPPSLSSDDSLWALRDADMNRTVDDMVAFSSSYSTNGLTSPTAATFCSPFDPVGTATQTIGYVMSGNEVPGKMLHSSSVTDAAVDEDTSGSLGNNLPGEVEGKAGDSHPYPILRPIIIPNLSRERFDHKSPCVPPSRREQPRIKRPPSPVVLCVPRAPRPPPPSPVSDSRKHRGFPTVRSGSSSPRHWGMRGWYHDGSNFEEACLRMDGAEVVWPWRSNNLAVRPLIQPLPAALLQDRLIALSQIARDQEHPDVTFPLQPPDLQSCSAQSASLTLMHGILHDEIDSFCKQVAAENMARRPYINWAVKRVTRFLQVLWPRSRTNIFGSNATGMSLPTSDVDLVVGLPPVRNLEPIKEAGILEGRNGIKETCLQHAARYLANQDWVKNDSLKTVENTAIPIIMLVVEVPQDVITSLAPMIQSLNEEPHCTPGEHGNDNQSDSIRLEDSALPKGSQMKFDALKSKSVRLDISFKSPSHTGLQTTEMVKELTAQFPAATPLALVLKQFLADRSLDQSYSGGLSSYCLVLLIIRFLQHEHHLGRPINQVNFDRSSYSSLYLLMAIVD

SEQ ID NO: 139753 - protein, 42 aa, Glycine max
  Coding DNA Sequence Number=SeqID_22975
MWEGIASEYINVLSSHTWPLLCHDDRKKKPVVDIIHKLLNYL

SEQ ID NO: 139754 - protein, 282 aa, Glycine max
  Coding DNA Sequence Number=SeqID_22976
  Gene Ontology: Mol. function=nucleotidyltransferase activity
  Subcellular localization annotation: CTP_CleavageSite=63; ConfidenceScore=5.09e-01
MAHHQLIDTLTSHISLYHSQSPNPNPNPNPNPRSSILKWFSSLSIHHRQAHLTIVDANFVQILLQMLAKLRSHGHGSFILLPDLPSRDNLPTLCFKKSRGLLARVADSDAAGRAVFESSRLFDSREGEEAAIATLPSARRLDALALAEGFVGDVDRFVEAMDRISGGGFLRGEEAELGEDWVELHWLKSKGYYGIEAFIANRIEVSMRLAWLNCCGGRKRGVKLKEKMGAAGVGVNVFWRKKGCVDWWGNLDAGTRRKVISTFLMKAAKPLVLFWELIELLV

SEQ ID NO: 139755 - protein, 84 aa, Glycine max
  Coding DNA Sequence Number=SeqID_22977
MVGVVATALSQNGASLLPKLVAEHLTIAELHVDHGLSFSVVLFSQDEYATHWLAGDMTSTVELELAAVAEVVGFQKPWDMINML

SEQ ID NO: 139756 - protein, 48 aa, Glycine max
  Coding DNA Sequence Number=SeqID_22978
MAAYLIWSLEHIDHIPWLLKTNHLRYRRQFKLHRGSHILCTIERKGKG

SEQ ID NO: 139757 - protein, 570 aa, Glycine max
  Coding DNA Sequence Number=SeqID_22979
  Homolog annotation: Hit_ID=Q6YRM6; Match level="QueryCoverage=86%, HitCoverage=82%, E-value=1e-108, Identity=42%"; Hit description=Zinc finger (C3HC4-type RING finger) protein family-like
  Pfam annotation: Domain name=DUF23; Domain location=293-540; Score =151.2; E_value=2.7e-42; Accession=PF01697.17; Description=Domain of unknown function
  Subcellular localization annotation: CTP_CleavageSite=6; ConfidenceScore=5.68e-01
MDSSPDQTRKRNQNQNHTLAQKSLFLCFSFFLFLFFFSSSHHSFYSHTSLQPSTLSTFPTPTPFPTTKLPVSSLHVLDRILFPDHVLLTLSNPHVFSPKHFHCVYYNLVKGSTPSNSNPVFDVLVLPVLSTDRYDEFRSIARCPLPGKKFSAVDLRWRSGDDDRQPFRFPVQPTVPHSFDKLAYEVALDGDTAVVFVKGLNLRPHQISDEGLLRCHFGPQNGKHWQTTKAVAAAQEVVRCALPQSIQNSPHEARGIISVSVSHVRHEAIFDSVAKIGGYRKQINRVNMNMNKNKLELCACTMVWNQARAMKEWVIYHAWLGVEKWYIYDNNSDDEIDDVVRELEVKGYNINRVVWPWIKSQEAGFSHCSLRAKEECKWVGFFDVDEFFYLREMKQNALISTVGNLSNSIAEIRTGCLNFGPSELRTHPRNGVSVGYTCRLRTPERHKSIVRPDLLHASLLNVVHHFELKEGFGSLNMPQSVAVINHYKYQVWEIFKAKFFRRVATYVVDWKEDANIGSKDRAPGLGTEAIEPSDWRLRFCEVWDTRLKDFLLSNFADQETGLLPWERSSK

SEQ ID NO: 139758 - protein, 138 aa, Glycine max
  Coding DNA Sequence Number=SeqID_22980
  Gene Ontology: Mol. function=nucleic acid binding; Biological process= DNA integration
MAIFLLSRLSQHMQCPTNLQMQAAKLVLRYLKGTIDHGLQFKRDSFIHIRLQVHKGLATSFTFDPIPYHGHVRQPTVAKSSTEVEYRTIGSTTTLATLDPRTVKCASSSTLQKASGGWCTWTILEQLIYVQILFSILG

SEQ ID NO: 139759 - protein, 63 aa, Glycine max
  Coding DNA Sequence Number=SeqID_22981
MASSGPQKPEPPGGLKDILGSIWWHGKLLTYNAPTTRHVYTNRLHSINLMCNMTQWIPRNKST

SEQ ID NO: 139760 - protein, 131 aa, Glycine max
  Coding DNA Sequence Number=SeqID_22982
  Gene Ontology: Cellular component=nucleus; Biological process =regulation of transcription, DNA-dependent
  Homolog annotation: Hit_ID=Q1SAU7; Match level="QueryCoverage=90%, HitCoverage=12%, E-value=4e-22, Identity=45%"; Hit description =Paired amphipathic helix
  Pfam annotation: Domain name=PAH; Domain location=28-74; Score=59.3; E_value=1.3e-14; Accession=PF02671.11; Description=Paired amphipathic helix repeat
MSTTEQKSWMREASLYLNKVKVTFQDEKEKYNIFVDVLRDYKAQRIDEESVKDRVKVLFKGHRDLLEGFNFFLPKAYEITIPSKNEHPSQLRYCHNNVGHFNFLSLIGFFSSRLEGDNGVYKVISRHVRCI

SEQ ID NO: 139761 - protein, 248 aa, Glycine max
  Coding DNA Sequence Number=SeqID_22983
  Gene Ontology: Mol. function=transition metal ion binding
MNIIKEYDVNKYSFYAKSQDDESSVHNNGVNLEADFEHFCGASDNNSIRALMPYFGWVNGNIGVHQDQLGLTLVDLHKVAYKDELFIMVEQSKQVFCIQDPCDSRLPVVLQGRKSGISHQDDDSTLDICEMSAFSTRMTSIIEEHEDQPRPMINVNPAIGKGSGPEKEKFHSYLGVIAQEKIPIVHIWDDIFGKFDILEASNAKKVMSLVATRWRQFKSSLTTKYIYADNEGQDKQDPSIKYGLDPQT

SEQ ID NO: 139762 - protein, 115 aa, Glycine max
  Coding DNA Sequence Number=SeqID_22984
  Homolog annotation: Hit_ID=Q1T013; Match level="QueryCoverage=25%, HitCoverage=3%, E-value=2e-07, Identity=86%"; Hit description =Ionotropic glutamate receptor; Extracellular ligand-binding receptor
MDKNINHVEITIGCFPSSIPLGSCWNGNLLSMILKVQWRLTRFFTENGTTLHVSQHITSSMLEMERLGLCQGNALIDVISRHVAFPRDSPLAVDMSTAILQLSETGDLKQIHEPF

SEQ ID NO: 139763 - protein, 247 aa, Glycine max
  Coding DNA Sequence Number=SeqID_22985
  Gene Ontology: Mol. function=protein kinase activity; Cellular component=cell surface; Biological process=protein amino acid phosphorylation
  Homolog annotation: Hit_ID=Q1S8T9; Match level="QueryCoverage=86%, HitCoverage=45%, E-value=1e-52, Identity=63%"; Hit description =Protein kinase
  Pfam annotation: Domain name=Pkinase; Domain location=3-194; Score= -8.0; E_value=4.4e-08; Accession=PF00069.15; Description=Protein kinase domain
  Pfam annotation: Domain name=Pkinase_Tyr; Domain location=5-194; Score=-38.1; E_value=3.9e-10; Accession=PF07714.7; Description =Protein tyrosine kinase
  Pfam module annotation: Pfam domain module=Pkinase::Pkinase_Tyr; Domain location=3-194::5-194
MTGGFKVKLGQGGFGSVYKGKLRSGPDVAIKMLSNSKSNGQDFISEVATVGRIHHVNVNFVPKVSDFGLAKLYPVNDSIVTLTAARGTLGYMAPELFYKNIGGVSYKADVYSFGMLLMEMTSRRRNSNPCAEHSSQHYFPLWIYDQFKEEKDVDMEDVSEEDKILTKRMFIVALWCIQLKPGDRPSMNEVVEMLEGKIESLEMPPRPSFYPHEMSEPNAIISSDQTTWSDSSSMDTYHGEPINIGCA

SEQ ID NO: 139764 - protein, 153 aa, Glycine max
  Coding DNA Sequence Number=SeqID_22986
  Gene Ontology: Mol. function=phosphoprotein phosphatase activity; Cellular component=cytoplasm; Biological process=protein amino acid dephosphorylation
  Homolog annotation: Hit_ID=O04951; Match level="QueryCoverage=89%, HitCoverage=44%, E-value=3e-69, Identity=87%"; Hit description =Serine/threonine-protein phosphatase PP2A-5 catalytic subunit
MLDNLSKFRAIHMLLIDTIRNSLAVNFNDHIMVPHEGPMCDLLWSDPDDRCGWGISPRGAGYTFGQDIAAQFNHTNGLSLISRAHQLVMEGFNWCQDKNVVTVFSAPNYCYRCGNMAAILEIGENMDQNFLQFDPAPRQIEPDTTRKTPDYFL

SEQ ID NO: 139765 - protein, 125 aa, Glycine max
  Coding DNA Sequence Number=SeqID_22987
MANKDYRDNKRSVCETSILLVANIIRLSSLRFSGQSFTKDLEPPQEEGTYVGKGNESSSVSKFYKSERTKKLERIKRPRSYLMKLPKEDPTNYLSQALDDVDVNAENYISHIRGKIIRDSGNIEY

SEQ ID NO: 139766 - protein, 96 aa, Glycine max
  Coding DNA Sequence Number=SeqID_22988
  Homolog annotation: Hit_ID=Q2PEP6; Match level="QueryCoverage=65%, HitCoverage=10%, E-value=4e-09, Identity=56%"; Hit description =Putative myosin heavy chain-like protein
MSLSLRCFVALSKIVQADYQPRSSQDKTAQITINKLLADIGTLHAQKNELEEQIISKSDEASTQVKSITNELNACMISWSTYVHIQNLLLSTLPCL

SEQ ID NO: 139767 - protein, 104 aa, Glycine max
  Coding DNA Sequence Number=SeqID_22989
MSGMARLTNWYKLQNAAFHSPVLALLRNPNPIHGIPPLAVDAVTVAPTAANRINRIDLREEEEEDAISEVGAKRNDAVSRGSGTTDRAADGVQASVGVGGEGAV

SEQ ID NO: 139768 - protein, 1447 aa, Glycine max
  Coding DNA Sequence Number=SeqID_22990
  Gene Ontology: Mol. function=transmembrane receptor activity; Cellular component=membrane; Biological process=defense response
  Homolog annotation: Hit_ID=Q19PM0; Match level="QueryCoverage=82%, HitCoverage=69%, E-value=1e-138, Identity=30%"; Hit description=TIR -NBS-LRR-TIR type disease resistance protein
  Pfam annotation: Domain name=AAA; Domain location=215-394; Score= -31.9; E_value=0.054; Accession=PF00004.19; Description=ATPase family associated with various cellular activities (AAA)
  Pfam annotation: Domain name=Arch_ATPase; Domain location=200-387; Score=-93.0; E_value=0.036; Accession=PF01637.9; Description =Archaeal ATPase
  Pfam annotation: Domain name=LRR_1; Domain location=1000-1021; Score =1.2; E_value=1.7e+02; Accession=PF00560.23; Description=Leucine Rich Repeat
  Pfam annotation: Domain name=LRR_1; Domain location=1064-1086; Score =0.7; E_value=2.1e+02; Accession=PF00560.23; Description=Leucine Rich Repeat
  Pfam annotation: Domain name=LRR_1; Domain location=1088-1109; Score =8.6; E_value=7.1; Accession=PF00560.23; Description=Leucine Rich Repeat
  Pfam annotation: Domain name=LRR_1; Domain location=1132-1153; Score =9.1; E_value=5.8; Accession=PF00560.23; Description=Leucine Rich Repeat
  Pfam annotation: Domain name=LRR_1; Domain location=1155-1176; Score =11.7; E_value=1.8; Accession=PF00560.23; Description=Leucine Rich Repeat
  Pfam annotation: Domain name=LRR_1; Domain location=1178-1206; Score =4.4; E_value=44; Accession=PF00560.23; Description=Leucine Rich Repeat
  Pfam annotation: Domain name=LRR_1; Domain location=603-623; Score =3.0; E_value=78; Accession=PF00560.23; Description=Leucine Rich Repeat
  Pfam annotation: Domain name=LRR_1; Domain location=670-691; Score =12.1; E_value=1.6; Accession=PF00560.23; Description=Leucine Rich Repeat
  Pfam annotation: Domain name=LRR_1; Domain location=693-715; Score =13.9; E_value=0.6; Accession=PF00560.23; Description=Leucine Rich Repeat
  Pfam annotation: Domain name=LRR_1; Domain location=717-739; Score =8.4; E_value=7.5; Accession=PF00560.23; Description=Leucine Rich Repeat
  Pfam annotation: Domain name=LRR_1; Domain location=741-763; Score =11.7; E_value=1.8; Accession=PF00560.23; Description=Leucine Rich Repeat
  Pfam annotation: Domain name=LRR_1; Domain location=765-786; Score =6.1; E_value=21; Accession=PF00560.23; Description=Leucine Rich Repeat
  Pfam annotation: Domain name=LRR_1; Domain location=788-810; Score =12.7; E_value=1.2; Accession=PF00560.23; Description=Leucine Rich Repeat
  Pfam annotation: Domain name=LRR_1; Domain location=812-833; Score =11.9; E_value=1.7; Accession=PF00560.23; Description=Leucine Rich Repeat
  Pfam annotation: Domain name=LRR_1; Domain location=835-857; Score =12.1; E_value=1.6; Accession=PF00560.23; Description=Leucine Rich Repeat
  Pfam annotation: Domain name=LRR_1; Domain location=859-880; Score =6.1; E_value=20; Accession=PF00560.23; Description=Leucine Rich Repeat
  Pfam annotation: Domain name=LRR_1; Domain location=882-904; Score =11.2; E_value=2.3; Accession=PF00560.23; Description=Leucine Rich Repeat
  Pfam annotation: Domain name=LRR_1; Domain location=906-927; Score =8.8; E_value=6.5; Accession=PF00560.23; Description=Leucine Rich Repeat
  Pfam annotation: Domain name=LRR_1; Domain location=929-951; Score =7.0; E_value=14; Accession=PF00560.23; Description=Leucine Rich Repeat
  Pfam annotation: Domain name=LRR_1; Domain location=953-971; Score =0.2; E_value=2.6e+02; Accession=PF00560.23; Description=Leucine Rich Repeat
  Pfam annotation: Domain name=LRR_1; Domain location=976-998; Score =12.2; E_value=1.5; Accession=PF00560.23; Description=Leucine Rich Repeat
  Pfam annotation: Domain name=NACHT; Domain location=214-361; Score =13.6; E_value=4.9e-06; Accession=PF05729.3; Description=NACHT domain
  Pfam annotation: Domain name=NB-ARC; Domain location=176-467; Score =146.4; E_value=7.5e-41; Accession=PF00931.13; Description=NB-ARC domain
  Pfam annotation: Domain name=TIR; Domain location=25-152; Score =105.2; E_value=1.9e-28; Accession=PF01582.10; Description=TIR domain
  Pfam module annotation: Pfam domain module=AAA::Arch_ATPase::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::NACHT::...
  Pfam module annotation: Pfam domain module=NB-ARC::TIR; Domain location=215-394::200-387::1000-1021::1064-1086::1088-1109::1132 -1153::1155-1176::1178-1206::603-623::670-691::693-715::717-739::741 -763::765-786::788-810::...
  Pfam module annotation: Domain location=812-833::835-857::859 -880::882-904::906-927::929-951::953-971::976-998::214-361::176 -467::25-152
MPYKSPPESDVTAPTPGAFRLRWDVFLSFRGIDTRDTITKGLYSSLEARGVRVFLDDVGLERGEEIKQGLMEAIDDSAAFIVIISESYATSHWCLEELTKICDTGRLVLPVFYRVDPSHVRDQKGPFEAGFVEHERRFGKNEVSMWREAFNKLGGVSGWPFNDSEEDTLIRLLVQRIMKELSNTPLGAPKFAVGLDERVEKLMKVLQVQSNGVKVLGLYGMGGVGKTTLAKALFNNLLNHFEHRCFISNVREVSSKQDGLVSLRTKIIEDLFPEPGSPTIISDHVKARENRVLLVLDDVDDVKQLDALIGKREWFYDGSRVIITTRDTVLIKNHVNELYEVEELNFDEALELFSNHALRRNKPPENFLNLSKKIVSLTGRMPLALEVFGSFLFDKRRVEEWEDAVEKLRQIRPKHLQDVLKISYDALDEEEKCIFLDMACLFVQMGMKRDDVIDVLRGCGFRGEIAITVLVQKCLIKITDEDNTLWMHDQIRDMGRQIVVDESIVDPGKRSRLWDRAEIMSVLKGHMGTRCIQGIVLDFEEDRFYRSKAESGFSTNLQWRSSLRNVLGGIIEQCLCLKNYLHPQAEENKEVILHTKSFEPMVNLRQLQINNRRLEGKFLPAELKWLQWQGCPLKHMPLKSWPRELAVLDLKNSKKIETLWGWNDYKVPRNLMVLNLSYCIELTAIPDLSGCRRLEKIDLENCINLTNIHDSIGSLSTLRSLKLTRCSSLINLPIDVSGLKQLESLFLSGCTKLKSLPENIGILKSLKALHADGTAITELPRSIFRLTKLERLVLEGCKHLRRLPSSIGHLCSLKELSLYQSGLEELPDSIGSLNNLERLNLMWCESLTVIPDSIGSLISLTQLFFNSTKIKELPSTIGSLYYLRELSVGNCKFLSKLPNSIKTLASVVELQLDGTTITDLPDEIGEMKLLRKLEMMNCKNLEYLPESIGHLAFLTTLNMFNGNIRELPESIGWLENLVTLRLNKCKMLSKLPASIGNLKSLYHFFMEETCVASLPESFGRLSSLRTLRIAKRPNLNTNENSFLAEPEENHNSFVLTPSFCNLTLLTELDARSWRISGKIPDEFEKLSQLETLKLGMNDFQKLPSSLKGLSILKVLSLPNCTQLISLPSLPSSLIELNVENCYALETIHDMSNLESLKELKLTNCVKVRDIPGLEGLKSLRRLYLSGCVACSSQIRKRLSKVVLKNLQNLSMPGGKLPEWFSGQTVCFSKPKNLELKGVIVGVVLSINHNINIGIPNMQREHMPGVLDVQANVLKQGKTLFSTVLNICGVPRTDEEHIHLCRFHDYHQLIAILKDGDTFCVSKRNPPFDKGLELKQCGVHLIFEGDDDYDGGEESLDKDLQSVSEKLANFFKTYEDESVRNQNELEMMGQEPRSFLVTLRSNFIFLFLIGEFAISSVLHVPIKVGITAVFPVMLWSFFDSGEFSKENI

SEQ ID NO: 139769 - protein, 850 aa, Glycine max
  Coding DNA Sequence Number=SeqID_22991
  Homolog annotation: Hit_ID=Q1RU78; Match level="QueryCoverage=8%, HitCoverage=39%, E-value=9e-14, Identity=60%"; Hit description =Repetitive proline-rich cell wall protein 1.-related
  Pfam annotation: Domain name=SWIM; Domain location=293-325; Score =29.0; E_value=1.7e-05; Accession=PF04434.8; Description=SWIM zinc finger
MDLFQKHVEVYIDHTSHMTKGVLLTVDEGGKPMVEGDLGNDAIDGKDSDREVVMIDLDDRDKETDEDKGDDDNYEENDSDNGDGLDAKYDTDKLEFDITSEEDDDCYALPMAPINGEDISIEPVSKRFQPHEMGRDFNFEVGMKFDSISQFKAAIKEYDGCEVAYVSMVGGSTTYSLNTYNEKHTCASKNKDSWKWFLQNLLNDIGHEQKWVFISDQQKEAYDWVMQLDPRFWSEAHMSEYSRKLGEKQKAKGQKVCPRPMKRLDQEVLACSKWIVVWGGNPKFEVQKYPLAFKIDLNEKSCSYKFWQLIGIPCRHAVAAMFDCRLLPSNFFHPYYHVHVLGEVVARAFIVGVSVYLDLSHHDSRVAPLGTLWVLLLLDGCPPNGYLQVESFLQDCSAIGCQGASFLLVVLLSGLSDFVPKSRHFFHLDISDLEDNAPKSVHEFSKRLVVCLSQIGQGDNGHTIRPTSCVLHIEALDEDLPKSGRHPDVHLDRWSYHTAPGVIPLRCTQEMCEQSAHCPGDLLLMVSLHFHNAVLELSKSICEGLKPSKGISCLSSDQVLIMGEKERDDKRPWSMFYCDSTVGTKCTYQNSELAHVMVDLAKVCLLCSRCAAESMYVESSKKPSIYKRGMELQCGLAVFSMRKAFTLQRALLRFSVALLLVASFTCATSVMAITEVSGNEVNTDGKLVNEELAKTSQQGYDKEAKFKGFFSKPIPKPISVVKPIPIPLYKSIPKSIPIVKPIPKSIPNEEEKFKGLFPKPIPIVKPIPKSIPIVKPILKPIPVVKPIPIPVYKSIPKSVPIVKPVPKLIPVVKPITKPIPTFEPESFLKPKPFFEKPVPKLPLEPKFKKP

SEQ ID NO: 139770 - protein, 231 aa, Glycine max
  Coding DNA Sequence Number=SeqID_22992
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9XIE6; Match level="QueryCoverage=96%, HitCoverage=19%, E-value=4e-93, Identity=68%"; Hit description =Putative phospholipid-transporting ATPase 3
  Subcellular localization annotation: CTP_CleavageSite=53; ConfidenceScore=5.22e-01
MEGIRNVFFKWKVVAIWAFFSVYQSLIFFYFVSSTNLSAKNSAGKIFGLWDVSTMAFTCVVITVNLRLLMICNSITRWHYISVGGRISTPYDRQENIYFVIYVLMSTFYFYVMLFLVPVAALFCDFVYQGVQRWFFPYDYQIIQEMHRDEVDSTGRAQLLEIGNQLTPDEARSYAISQLPRELSKHTGFAFDSPGYESFFAAQLGVYAPPKAWDVARRASMRSRSKTGQQK

SEQ ID NO: 139771 - protein, 334 aa, Glycine max
  Coding DNA Sequence Number=SeqID_22993
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9XIE6; Match level="QueryCoverage=99%, HitCoverage=27%, E-value=1e-164, Identity=86%"; Hit description =Putative phospholipid-transporting ATPase 3
  Pfam annotation: Domain name=EutC; Domain location=67-221; Score= -135.7; E_value=0.084; Accession=PF05985.2; Description=Ethanolamine ammonia-lyase light chain (EutC)
MVYVRESHVEKMGKVQDVSYEILNVLEFNRKRQSVVCRYPDGRLVLYCKGADNVVYERLADGNNNIKKVTREHLEQFGSAGLRTLCLAYKELHPDVYESWNEKFIQAKSSLNDREKKLDEVAELIENDLILIGSTAIEDKLQEGVPACIETLQRAGIKIWVLTGDKIETAINIAYACNLINNEMKQFVISSETDEIREVEDRGDQVEIARFIKEVVKRELKKCLEEAQSSFQSLRGPKLALVIDGKCLMYALDPSLRVMLLNLSLNCHAVVCCRVSPLQKAQVTSMVKKGAQKITLSIGDGANDVSMIQAAHVGVGISGMEGMQAVMASDFAIA

SEQ ID NO: 139772 - protein, 159 aa, Glycine max
  Coding DNA Sequence Number=SeqID_22994
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9XIE6; Match level="QueryCoverage=77%, HitCoverage=10%, E-value=4e-50, Identity=70%"; Hit description =Putative phospholipid-transporting ATPase 3
MVKIGALKVHWVIRGLGPVSPITNVLPLSLVLLVSLIKEAFEDWKRFQNDMSINNNTIDVLHDQKWESVPWKKLQVGDIVKVKQDAFFPADLLFLASTNADGVCYIETANLDGETNLKIRKALEKTWDYVTPEKASEFKDGSVKFGITTGFKQENLGRY

SEQ ID NO: 139773 - protein, 78 aa, Glycine max
  Coding DNA Sequence Number=SeqID_22995
MAYFKIGYCLASWGWEEEGESDQILAIPLGYSQRDNKLAWGLSSDENCSVKNGYRVAQRNNGKEIGSSSSYNVLFGDH

SEQ ID NO: 139774 - protein, 412 aa, Glycine max
  Coding DNA Sequence Number=SeqID_22996
  Gene Ontology: Mol. function=iron ion transporter activity; Cellular component=outer membrane-bounded periplasmic space; Biological process=iron ion transport
  Homolog annotation: Hit_ID=Q3BNH5; Match level="QueryCoverage=62%, HitCoverage=88%, E-value=3e-44, Identity=36%"; Hit description =Putative secreted protein precursor
MSTPSRHCGWPTRRCTWPRSRAATGWWSTRTPTDAEPGCPAPQRVSALLQRGQQAQPALGAVHHVDAAFRQQIAAGLLDRVGLVPRHALPRPRNESAPATIAFRLCIGIMVQGEVHRDANRPAVPGAVLAGGRRLEGPRAGGADAGSGQDVAHLGQGPLGCDHGHVHLLGGHVGHCSVARHLDQQQHLTLATVSVGRLRVARRCHVQRGHRTSGLRIVLAEVDTGHADFITAVGRSLAAQANAQRGPRGHRLAIAQRGLEAPATDGAFHEGGNARGDHGFLVQHQRTDRALRRDLDVTGQHHAHFRSRTYSACGLRSGVTCKQGGAGTDGQREGEKQWRTHHCRILGDEQRAYLSPNTHDSRLRPAGVRPHRVAYPDSHHGQNVPADPATRPGRTGAGSARAPPPVRRPAGP

SEQ ID NO: 139775 - protein, 53 aa, Glycine max
  Coding DNA Sequence Number=SeqID_22997
  Homolog annotation: Hit_ID=Q04524; Match level="QueryCoverage=75%, HitCoverage=7%, E-value=3e-10, Identity=75%"; Hit description =Acetolactate synthase, catabolic
AFGAAGFSVNSAAELEPTLRRAIEVEGPAVVAIPVDYSDNPLLMGQLHLSQLL

SEQ ID NO: 139776 - protein, 425 aa, Glycine max
  Coding DNA Sequence Number=SeqID_22998
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=96%, HitCoverage=86%, E-value=0.0, Identity=85%"; Hit description=ATP synthase subunit alpha
  Pfam annotation: Domain name=ATP-synt_ab; Domain location=95-284; Score=287.2; E_value=3.2e-83; Accession=PF00006.15; Description=ATP synthase alphabeta family, nucleotide-binding domain
  Pfam annotation: Domain name=ATP-synt_ab_C; Domain location=296-396; Score=127.9; E_value=2.8e-35; Accession=PF00306.17; Description=ATP synthase alphabeta chain, C terminal domain
  Pfam module annotation: Pfam domain module=ATP-synt_ab::ATP-synt_ab _C; Domain location=95-284::296-396
GFEEGTIGIALNLESKNVGVVLMGDGLMIQEGSSVKATGRIAQIPVSEAYLGRVINALAKPIDGRGEISASESRLIESPAPGIISRRSVYEPLQTGLIAIDSMIPIGRGQRELIIGDRQTGKTAVATDTILNQQGQNVICVYVAIGQKASSVAQVVNTLQERGAMEYTIVVAETADSPATLQYLAPYTGAALAEYFMYRERHTLIIYDDLSKQAQAYRQIAAKLSSQLGEGSMTALPIVETQSGDVSAYIPTNVISITDGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQ

SEQ ID NO: 139777 - protein, 118 aa, Glycine max
  Coding DNA Sequence Number=SeqID_22999
MKLFGVPGEPEAGLGEPEASLGDPRFRKSLKMTLLPSPLGIFTFLIKTLNDHLFRTVTGVQHPMPSKIILMMPKNQESNKFQESRSRFKNNQDHYSRFKIQVKNQDLRFKNQEKTQSR

SEQ ID NO: 139778 - protein, 90 aa, Glycine max
  Coding DNA Sequence Number=SeqID_23000
  Gene Ontology: Mol. function=nucleic acid binding; Biological process= DNA integration
MIHNEPIVEEPQEVTLRRSQRERRSAISNDYMVYLHEPETDLSINDNDQILFSQVVSYDNLDAMKEELNSMEHNSVRDLVHFPKGCKKVG

SEQ ID NO: 139779 - protein, 106 aa, Glycine max
  Coding DNA Sequence Number=SeqID_23001
MVFSYSTLFAHISQVMSRPKNKIVDEDITKGKDHEALEGPMTRGRLKQVQHIIETRLTYQGNPCGVYPDLSSFTGSGIYPNLSSFTRSDVYPDLSSFTGSCVNQPP

SEQ ID NO: 139780 - protein, 125 aa, Glycine max
  Coding DNA Sequence Number=SeqID_23002
MQQKRHPHAQSSSQPTMNCTSEYDSSGSNFLSAYEDCQSPTNHLVINTEGYSDLGDQLMQCRYCNAQMWYDERISKDKNCQSPRFSLCCGDGKVELPLLQNPPQYLQRLLFDDNTIDSKNYQHNL

SEQ ID NO: 139781 - protein, 67 aa, Glycine max
  Coding DNA Sequence Number=SeqID_23003
  Homolog annotation: Hit_ID=O49543; Match level="QueryCoverage=51%, HitCoverage=7%, E-value=6e-10, Identity=85%"; Hit description =Cysteine desulfurase 1, mitochondrial precursor
MDVASNGRNFKTIVKKTENVVIVEEQRMICSMVELTVQQVEKLREMSPLYEFVKEGINIKDIQWAQH

SEQ ID NO: 139782 - protein, 73 aa, Glycine max
  Coding DNA Sequence Number=SeqID_23004
MEEANWWGNDTNEGSRCQPKKVGEEATCIHQQKLNTQAEMPKKLANWTGVKLSAMSILGISLGFSFIIYLGCC

SEQ ID NO: 139783 - protein, 301 aa, Glycine max
  Coding DNA Sequence Number=SeqID_23005
  Gene Ontology: Mol. function=DNA binding
  Homolog annotation: Hit_ID=Q1S0F5; Match level="QueryCoverage=93%, HitCoverage=63%, E-value=7e-30, Identity=31%"; Hit description=IMP dehydrogenase/GMP reductase
MGSSQTPSLKKRFYQVKVKSLGITSLRELGQLMGQLQRQAFRKAYGKIWDLAMAEVSTEAIASLAQYYDQPLRCFTFGDFQLSPMVEEFEEILGCPLGGRKPYLFSGFYPSLARISKIVQISAQELDHRKGVLFPNVDGLVDLAAIDAFLAYHDRKESPVVAILDDLYDTFDRRCEKSSTRIVCCTPTLYVWLVSHLFRHEVRHACLLDSHRSCTEKRGANWDRLLACKEGVSVNWFPRWKEGRTRILISCGRFPNVPLMGTRGCISYNPVLAIRQLGYPMRGAPLEESSHLLLHEASIRP

SEQ ID NO: 139784 - protein, 74 aa, Glycine max
  Coding DNA Sequence Number=SeqID_23006
MRFRMLAFIPKRPFRGNTGPDRIEEYHSKVCGKLGFWLKACRTAGHDICQDVGLASGSGKKEKSHIISMIHMQH

SEQ ID NO: 139785 - protein, 173 aa, Glycine max
  Coding DNA Sequence Number=SeqID_23007
MEESSGFPVLLVGENSNPPDDDGKDKILGLQLSARLQNNGLKDKIFLGLELIARLQHRTRGLRHLTRIHGVDLTNETQDTCPKRSIKKEIYEEVLGISYSTVSQSEKVVAHDLKEPHSGAIKTMSASRKLNTGEKTVLSWMIETGTILQHEKVLCSLLTRCTCKEDYEDGDEL

SEQ ID NO: 139786 - protein, 63 aa, Glycine max
  Coding DNA Sequence Number=SeqID_23008
MASYGSAFAYSNTLRQRFPFVQTWARDDDLSVVTLASTRVRPYVPESRKRHRAANCGRVTVLP

SEQ ID NO: 139787 - protein, 76 aa, Glycine max
  Coding DNA Sequence Number=SeqID_23009
MEKSDKMNFKEKKEKKGYITWEDNVINYSSDSEKKIISLGIMMKDYENGEEQSRYIDSNFSKHMACIKVYSYVSPR

SEQ ID NO: 139788 - protein, 122 aa, Glycine max
  Coding DNA Sequence Number=SeqID_23010
MVKGTTSDSECSAESESSPEVSCTLGDNDSTTNDDSSHSCGSKSSPQLDDNKAPTPWVNLFKDNKSPSKGFGMKFSPPPSDDEVLLEETDLQPLEEAWGHSLIRYVEGRFPGKKALLDCCKK

SEQ ID NO: 139789 - protein, 100 aa, Glycine max
  Coding DNA Sequence Number=SeqID_23011
MRSDFLVQFSILHFYSEPHELIVVHASSTREFGAMCSDCLVQFSILHFYSEPHELIVVHASSTHESGATRSDCLALFMCPPPSSAEPPKTEEIETRVVID

SEQ ID NO: 139790 - protein, 83 aa, Glycine max
  Coding DNA Sequence Number=SeqID_23012
MTKARQKGSLPVEDRRTNDERRRTVENLREITHGNGRSLPPSSPKRAQLAQASQVASSRSNSLLEEHPGRPKWVWFLFAPFFY

SEQ ID NO: 139791 - protein, 390 aa, Glycine max
  Coding DNA Sequence Number=SeqID_23013
  Gene Ontology: Mol. function=transcription factor activity; Cellular component=nucleus; Biological process=regulation of transcription, DNA-dependent
  Homolog annotation: Hit_ID=Q5NE24; Match level="QueryCoverage=95%, HitCoverage=72%, E-value=1e-145, Identity=72%"; Hit description =Nodulation signaling pathway 2 protein
  Pfam annotation: Domain name=GRAS; Domain location=1-298; Score =283.8; E_value=3.3e-82; Accession=PF03514.5; Description=GRAS family transcription factor
MAAAEALSGAPKSRDLARVILVRLKELVSSHAAPHGSTMERLAAYFTDALQGLLEGAGGAHNNNNKHHHHYITSCGPHHHHRDDHHHQNDTLAAFQLLQDMSPYVKFGHFTANQAILEAVAHDRRVHIVDYDIMEGVQWASLIQALASNKTGPPGPHLRITALSRTGSGRRSIATVQETGRRLAAFAASLGQPFSFHHCRLEPDETFKPSSLKLVRGEALVFNCMLNLPHLSYRAPESVASFLSGAKALKPRLVTLVEEEVASIVGGFVARFMDSLHHYSAVFDSLEAGFPMQGRARALVERVFLGPRIVGSLARMGEEEERGSWGEWLGAAGFRGVPMSFANHCQAKLLIGLFNDGYRVEELGSNKLVLDWKSRRLLSASLWTSSSHSD

SEQ ID NO: 139792 - protein, 110 aa, Glycine max
  Coding DNA Sequence Number=SeqID_23014
  Gene Ontology: Cellular component=nucleus; Biological process =regulation of transcription, DNA-dependent
  Homolog annotation: Hit_ID=Q2PEG7; Match level="QueryCoverage=94%, HitCoverage=23%, E-value=2e-26, Identity=48%"; Hit description =Transcription initiator for nodulation
MDESQALGIVAGVVVLLRDGDGGGVAGDVVVGAEVVLLGGGAVAHDGVDDLVEVVVGAGEGVPVDDGGPVVPVATIVIIRRGGCVGDGAVSGEVEVVDSIYVHVYFDGYW

SEQ ID NO: 139793 - protein, 299 aa, Glycine max
  Coding DNA Sequence Number=SeqID_23015
  Gene Ontology: Mol. function=oxidoreductase activity; Cellular component=cytoplasm; Biological process=flavonoid biosynthetic process
  Homolog annotation: Hit_ID=Q0EDG6; Match level="QueryCoverage=99%, HitCoverage=100%, E-value=1e-126, Identity=67%"; Hit description =Flavonol synthase
  Pfam annotation: Domain name=2OG-FeII_Oxy; Domain location=137-260; Score=53.9; E_value=5.4e-13; Accession=PF03171.10; Description=2OG -Fe(II) oxygenase superfamily
MDTLRVQSLASQSKETIPAEFVRSETEQPGITTVHGTQLGVPIIDFSNPDEDKVLHEIMEASRDWGMFQIVNHEIPSQVIEKLQAVGKEFFELPQEEKEQYAKPADSTSIEGYGTKLQKEVDNKKGWVDHLFHRIWPPSDINYRFWPKNPPSYREANEEYDKYLHGVVDKLFESMSIGLGLEKHELKEFAGGDNLVHLLKGLQASRDGHWYDVKYIPNALVIHIGDQMEIMSNGKYKAVLHRTTVSKDETRISWPVFVEPQPEHEVGPHPKLVNQDNPPKYKSKKYKDYAYCKLNKIPQ

SEQ ID NO: 139794 - protein, 834 aa, Glycine max
  Coding DNA Sequence Number=SeqID_23016
  Gene Ontology: Mol. function=protein serine/threonine kinase activity; Cellular component=ubiquinol-cytochrome-c reductase complex; Biological process=protein amino acid phosphorylation
  Homolog annotation: Hit_ID=Q9FZP3; Match level="QueryCoverage=98%, HitCoverage=98%, E-value=0.0, Identity=49%"; Hit description=S -receptor kinase
  Pfam annotation: Domain name=B_lectin; Domain location=75-175; Score =52.4; E_value=1.5e-12; Accession=PF01453.15; Description=D-mannose binding lectin
  Pfam annotation: Domain name=Pkinase; Domain location=475-762; Score =168.1; E_value=2.2e-47; Accession=PF00069.15; Description=Protein kinase domain
  Pfam annotation: Domain name=Pkinase_Tyr; Domain location=476-762; Score=118.3; E_value=2.1e-32; Accession=PF07714.7; Description =Protein tyrosine kinase
  Pfam module annotation: Pfam domain module=B_lectin::Pkinase::Pkinase_ Tyr; Domain location=75-175::475-762::476-762
MKPIITFSCILLFFTTISARSFSDYITPNFTASYLEFIDNFGTFLFSHNRTFKAAIFNPGGQQTSFYLCVIHAASNTIIWSGNRDAPISDSGKMLLSFKGITILDEHGNTKWSTPSLKSQVNRLQLTEMGNLVLLDKSNGSLWESFQNPTDTIVIGQRLPVGASLSSAASNSDLSKGNYKLTITSSDAVLQWYGQTYWKLSTDTRVYKNSNDMLEYMAINNTGFYLFGDGGTVFQLGLPLANFRIAKLGTSGQFIVNSFSGTNNLKQEFVGPEDGCQTPLACGRAGLCTENTVSSSPVCSCPPNFHVGSGYVEYFGNFYSDPVLYKVNLSACQSLCSSNCSCLGIFYKSTSGSCYMIENELGSIQSSNGGDERDILGFIKAITVASTTSSNDGNDDKENSQNGEFPVAVAVLLPIIGFIILMALIFLVWRRLTLMSKMQEVKLGKNSPSSGDLDAFYIPGLPARFDYEELEEATENFKTLIGSGGFGTVYKGVLPDKSVVAVKKIGNIGIQGKKDFCTEIAVIGNIHHVNLVKLKGFCAQGRHRLLVYEYMNRGSLDRNLFGGEPVLEWQERFDVALGTARGLAYLHSGCVQKIIHCDIKPENILLQDQFQAKISDFGLSKLLSAEQSGLFTTMRGTRGYLAPEWLTNSAITEKTDVYSFGMVLLELVSGRKNCYYRSRSHSMDDSNSGGGNSSTSSTTGLVYFPLFALEMHEQRSYLELADSRLEGRVTCEEVEKLVRIALCCAHEEPALRPNMVTVVGMLEGGTPLPHPRIESLNFLRFYGRRYTEASTIAEENEYGSVMLQQARSSTTSMPSDSSTRGFSYMSSQNISGPR

SEQ ID NO: 139795 - protein, 101 aa, Glycine max
  Coding DNA Sequence Number=SeqID_23017
MPSLASITSSFAGGLTPEWDRNLSIEAGESIQSGEASPQVRGSNLWIAGMIGCEEVKHDRLAVVVVEQKRDRAIICGPMMAIRLIHDLERSPSILISPISP

SEQ ID NO: 139796 - protein, 725 aa, Glycine max
  Coding DNA Sequence Number=SeqID_23018
  Gene Ontology: Mol. function=protein serine/threonine kinase activity; Cellular component=cytoplasm; Biological process=protein amino acid phosphorylation
  Homolog annotation: Hit_ID=Q019E0; Match level="QueryCoverage=70%, HitCoverage=48%, E-value=5e-77, Identity=39%"; Hit description=[T] KOG0578 p21-activated serine/threonine protein kinase
  Pfam annotation: Domain name=GCV_T; Domain location=397-559; Score= -70.3; E_value=0.08; Accession=PF01571.11; Description=Glycine cleavage T-protein (aminomethyl transferase)
  Pfam annotation: Domain name=Pkinase; Domain location=348-641; Score =215.4; E_value=1.3e-61; Accession=PF00069.15; Description=Protein kinase domain
  Pfam annotation: Domain name=Pkinase_Tyr; Domain location=348-641; Score=-57.7; E_value=6.3e-09; Accession=PF07714.7; Description =Protein tyrosine kinase
  Pfam module annotation: Pfam domain module=GCV_T::Pkinase::Pkinase _Tyr; Domain location=397-559::348-641::348-641
  Subcellular localization annotation: CTP_CleavageSite=61; ConfidenceScore=5.25e-01
MQSNCIRPRRTLLPQRRASSTSSSSSDVTNSQEEASSKDSLNAVVPSQNLDSQKKVQFSVPSNAASQDGKATELENLSSHMSSLGFAEMEWVEGSQIEAWSSSSSLGCNQQESVQQAGIDASLKCESGVSSVLPKRSVVTPDHLQQFRSFLSQPATQSSVVGPTCATTTSVHSTSAPMLNSTTRYSHFRQYCGSSVAAEPLGEVNVNPCPITEGVVKSIDVSIQETNRMPVDPGAEAEVRASGSCIDDAGSLSKESNQSKEQQGGELKESGNSKYTSCDDGKGKEAVDVATVQMQAPLPTTITSSSDVKLGSSKVEKREKAASSKGTLGARKRTYDPDLFFKVNGKLYQRLGKIGSGGSSEVHKVISSDCRIYALKKIKLKGRDYATAYGFCQEIEYLNRLKGKDNIIQLIDYEVTDKALLEEVMKGSFSNKDGRVKDDGCIYMVLEYGEIDLAHMLSQKWKELDGSYQTIDENWLRFYWQQILLAVNTIHEDRIVHSDLKPANFLLVKGSLKLIDFGIAKAIMSDTTNIQRDSQVGTLSYMSPEAFLCNETDANGNIIKCGRPSDIWSLGCILYQMVYGRTPFSDYKTFWAKFKVITDPNHKITYEPVSNPWLLDLMERCLAWDRNQRWRIPQLLQHPFLVPPVPSHPCLPQDHSCKLLQLISETCTYDPEASQLCSRLQRLLSDPLEKTTRSLNSGDQQLKLLSQMSELCIQLHERLTNTEYK

SEQ ID NO: 139797 - protein, 120 aa, Glycine max
  Coding DNA Sequence Number=SeqID_23019
  Gene Ontology: Mol. function=protein binding; Cellular component =nucleus; Biological process=ubiquitin cycle
  Homolog annotation: Hit_ID=Q94DM8; Match level="QueryCoverage=97%, HitCoverage=84%, E-value=5e-31, Identity=64%"; Hit description =Probable ubiquitin-fold modifier 1 precursor
  Pfam annotation: Domain name=UPF0185; Domain location=5-112; Score =133.9; E_value=4.5e-37; Accession=PF03671.5; Description =Uncharacterised protein family (UPF0185)
MAGGGKVSFKVTLTSDPKFSVPEAAPFTAVLKFAAEEFKVPPQTSAIITNVIRTDLVSPSYVVTFGIYCCTTKSIVLFIKKEKKHGKDGVGINPQQSAGNVFLKHGSELRLIPRDRVGAF

SEQ ID NO: 139798 - protein, 83 aa, Glycine max
  Coding DNA Sequence Number=SeqID_23020
  Gene Ontology: Mol. function=histone-lysine N-methyltransferase activity; Cellular component=nucleus; Biological process=chromatin modification
  Homolog annotation: Hit_ID=Q7XJS0; Match level="QueryCoverage=80%, HitCoverage=14%, E-value=3e-23, Identity=76%"; Hit description =Histone-lysine N-methyltransferase ASHR1
MTISCYFIAGVYPAVHPLLGLQYYTCGKLEWYLGDTDEAVKSLIKAVDILRITHGTNTPFMKDLLMKLEEARAEASYRLSPKE

SEQ ID NO: 139799 - protein, 462 aa, Glycine max
  Coding DNA Sequence Number=SeqID_23021
  Gene Ontology: Mol. function=amino acid transporter activity; Cellular component=integral to membrane; Biological process=auxin mediated signaling pathway
  Homolog annotation: Hit_ID=Q9FEL6; Match level="QueryCoverage=99%, HitCoverage=100%, E-value=0.0, Identity=85%"; Hit description=Auxin transporter-like protein 3
  Pfam annotation: Domain name=Aa_trans; Domain location=37-428; Score =263.2; E_value=5.2e-76; Accession=PF01490.8; Description =Transmembrane amino acid transporter protein
MASEKVETVVAGNYLEMEREEEGSKSTTSKLSRLFWHGGSVYDAWFSCASNQALAIPALIILLLTLPYSFSQLGMLSGIIFQLFYGLMGSWTAYLISVLYVEYRTRKEREKVDFRNHVIQWFEVLDGLLGKHWRNLGLFFNCTFLLFGSVIQLIACASNIYYINDNLDKRTWTYIFGACCATTVFIPSFHNYRIWSFLGLVMTTYTAWYMTIASLTHGQVEGVTHTGPAKLVLYFTGATNILYTFGGHAVTPQKFKMIYLIATLYVLTLTLPSASAVYWAFGDQLLTHSNALSLLPKTGFRDTAVILMLIHQFITFGFACTPLYFVWEKFIGVHETKSLFKRALARLPVVIPIWFLAIIFPFFGPINSTVGSLLVSFTVYIIPALAHMVTFASAPARENAVERPPSKLGGWVGLYSMNVFVVVWVLVIGFGLGGWASMINFIHQIDTFGLFVKCYQCPPHKA

SEQ ID NO: 139800 - protein, 686 aa, Glycine max
  Coding DNA Sequence Number=SeqID_23022
  Gene Ontology: Mol. function=binding; Cellular component =intracellular; Biological process=metabolic process
  Homolog annotation: Hit_ID=Q2QNV4; Match level="QueryCoverage=99%, HitCoverage=64%, E-value=1e-108, Identity=28%"; Hit description =Pentatricopeptide, putative, expressed
  Pfam annotation: Domain name=PPR; Domain location=106-140; Score =10.1; E_value=0.48; Accession=PF01535.11; Description=PPR repeat
  Pfam annotation: Domain name=PPR; Domain location=172-206; Score =25.2; E_value=0.00024; Accession=PF01535.11; Description=PPR repeat
  Pfam annotation: Domain name=PPR; Domain location=237-271; Score=2.0; E_value=4.3; Accession=PF01535.11; Description=PPR repeat
  Pfam annotation: Domain name=PPR; Domain location=305-339; Score =26.0; E_value=0.00013; Accession=PF01535.11; Description=PPR repeat
  Pfam annotation: Domain name=PPR; Domain location=340-374; Score=5.1; E_value=1.9; Accession=PF01535.11; Description=PPR repeat
  Pfam annotation: Domain name=PPR; Domain location=406-440; Score =25.5; E_value=0.00018; Accession=PF01535.11; Description=PPR repeat
  Pfam annotation: Domain name=PPR; Domain location=507-541; Score =37.6; E_value=4.3e-08; Accession=PF01535.11; Description=PPR repeat
  Pfam annotation: Domain name=PPR; Domain location=578-612; Score =18.3; E_value=0.029; Accession=PF01535.11; Description=PPR repeat
  Pfam annotation: Domain name=PPR; Domain location=70-104; Score=26.7; E_value=8.2e-05; Accession=PF01535.11; Description=PPR repeat
  Pfam module annotation: Pfam domain module=PPR::PPR::PPR::PPR::PPR::PP R::PPR::PPR::PPR; Domain location=106-140::172-206::237-271::305 -339::340-374::406-440::507-541::578-612::70-104
MDLNQIQLALRCCGRFQAIKHAKSLHSLIIKLGLSNHIFLLNSIISVYAKCSRFDDARTLFDEMPHRNIVSFTTMVSAFTNSGRPHEALTLYNHMLESKTVQPNQFLYSAVLKACGLVGDVELGMLVHQHVSEARLEFDTVLMNALLDMYVKCGSLMDAKRVFHEIPCKNSTSWNTLILGHAKQGLMRDAFNLFDQMPEPDLVSWNSIIAGLADNASPHALQFLSMMHGKGLKLDAFTFPCALKACGLLGELTMGRQIHCCIIKSGLECSCYCISSLIDMYSNCKLLDEAMKIFDKNSPLAESLAVWNSMLSGYVANGDWWRALGMIACMHHSGAQFDSYTFSIALKVCIYFDNLRLASQVHGLIITRGYELDHVVGSILIDLYAKQGNINSALRLFERLPNKDVVAWSSLIVGCARLGLGTLVFSLFMDMVHLDLEIDHFVLSIVLKVSSSLASLQSGKQIHSFCLKKGYESERVITTALTDMYAKCGEIEDALALFDCLYEIDTMSWTGIIVGCAQNGRADKAISILHKMIESGTKPNKITILGVLTACRHAGLVEEAWTIFKSIETEHGLTPCPEHYNCMVDIFAKAGRFKEARNLINDMPFKPDKTIWCSLLDACGTYKNRHLANIVAEHLLATSPEDASVYIMLSNVYASLGMWDNLSKVREAVRKVGIKGAGKSWIEIFS

SEQ ID NO: 139801 - protein, 99 aa, Glycine max
  Coding DNA Sequence Number=SeqID_23023
MARKEWAKKHSGVGVSRATSMHGGDVAQQQLVGLMQEAFSDCTQVHMVWTVLLHLLSGFPRTLCSPNLGAPTYSSFVNCNYYQADIQFTSMAWKDQIGA

SEQ ID NO: 139802 - protein, 347 aa, Glycine max
  Coding DNA Sequence Number=SeqID_23024
  Gene Ontology: Mol. function=biotin-[acetyl-CoA-carboxylase] ligase activity; Cellular component=intracellular; Biological process =protein modification process
  Homolog annotation: Hit_ID=Q8S4V8; Match level="QueryCoverage=85%, HitCoverage=74%, E-value=2e-97, Identity=62%"; Hit description =Holocarboxylase synthetase 1
  Pfam annotation: Domain name=BPL_LipA_LipB; Domain location=109-210; Score=85.8; E_value=1.3e-22; Accession=PF03099.9; Description =Biotinlipoate AB protein ligase family
  Subcellular localization annotation: CTP_CleavageSite=32; ConfidenceScore=5.46e-01
MLLRNPALTASLLSATTKKLCNHRCSTPAALMASSGVACSLLVLCGKSLAENETAKAIKTSSTLKLPEDEKLSLVLHSEMDNSVMQGFFQVHSYMDSLSTNQFGRLLIWSPDLNSTHDIVSHNFCELPIGTVSIADVQTKGRGRSKNVWESPLGCLMFSFTMQMEDGRVVPLVQYVVSLAMTEAIKDICDKNGLPSIDVRIKWPNDLYLNGCKVGGILCTSTYKSKKFNVSAGIGLNVNNKNPTTSLNTILKGFYTGAYQFQREDVLAAFFNKFEKFYDLFVNQGPRYSTSPNILISKVILSFTYSVKCRISNPRGALYQDMVAQRIIVTLDTIFRDILVTNLAVSE

SEQ ID NO: 139803 - protein, 412 aa, Glycine max
  Coding DNA Sequence Number=SeqID_23025
  Gene Ontology: Mol. function=nucleic acid binding; Cellular component= intracellular; Biological process=chromatin modification
  Homolog annotation: Hit_ID=Q53JG9; Match level="QueryCoverage=63%, HitCoverage=61%, E-value=1e-66, Identity=52%"; Hit description=Zinc finger, C2H2 type, putative
MTKKVSQNQEQQKTEKQPSWVVRGLLACRNVQIQQNQQQQKEAKPPSEAKENRKKQEQRKLQEERVPEENSKKCKKMKCSGSLCNNTKITAKPDTATPDVHNKRLLLSGCNNNDASSRSMKAPLNELNGTVSATSSLSASSTSSGGGSLRGMPFRRLSGCYECRMVVDPVLGFTRDPSLRSSICSCPDCGEIMKAESLEHHQAVKHAVSELGPEDTSKNIVEIIFHSSWLKKQSPVCKIDRILKVHNTQKTITKFEEYRDSIKAKATKLSKKHPRCIADGNELLRFHCTSFNCSLGLNGSSNLCNSIPQCNVCSIIKHGFKVTGGGAGILTTATSGKAHDKAACVDESEEKRAMLVCRVIAGRVKKNIAEGGGMEEYDSVAAAVGAYSNLDELVVSNPRAILPCFVVIYRGF

SEQ ID NO: 139804 - protein, 175 aa, Glycine max
  Coding DNA Sequence Number=SeqID_23026
  Gene Ontology: Cellular component=membrane
  Homolog annotation: Hit_ID=Q8RYE2; Match level="QueryCoverage=93%, HitCoverage=43%, E-value=5e-29, Identity=44%"; Hit description =Expressed protein
MERMSQKIDGDAESECVSEAGDIGDRTLLGTRHSEGDGLRLSLDSTPKNEDVYISRDHELQNMARKPRSYPSYWTTFCVSDLAVFVIVGVLKGYLLQKLFGPGVADVTSDQNILYLDFPSNMVGSFFMGWLGVVFKADISRVSEHLAIGLTTGYLGSLTTFSGWNQKMVELINCY

SEQ ID NO: 139805 - protein, 91 aa, Glycine max
  Coding DNA Sequence Number=SeqID_23027
  Gene Ontology: Cellular component=membrane
  Homolog annotation: Hit_ID=Q33A72; Match level="QueryCoverage=90%, HitCoverage=23%, E-value=1e-11, Identity=47%"; Hit description =Nodulin MtN21 family protein, putative, expressed
MEETCSRAGFGKKFTKAKPYLLTVGLQFGFAGGYIFSVASLNHGMSRYVFVVYRNAIAALALAPFALIVMKIRPKIILPVFLQIVAVGFVE

SEQ ID NO: 139806 - protein, 68 aa, Glycine max
  Coding DNA Sequence Number=SeqID_23028
MSGFTRDSPQISASPHQLDLAPYASGPYNAQWNAPGILHDKHTLRSSRILGEMEVVFVIGSAVGRLCG

SEQ ID NO: 139807 - protein, 128 aa, Glycine max
  Coding DNA Sequence Number=SeqID_23029
  Gene Ontology: Mol. function=aminoacyl-tRNA ligase activity; Cellular component=cytoplasm; Biological process=tRNA aminoacylation for protein translation
  Homolog annotation: Hit_ID=Q6Z302; Match level="QueryCoverage=93%, HitCoverage=37%, E-value=2e-46, Identity=77%"; Hit description =YbaK/prolyl-tRNA synthetase protein-like
MGFSKEQLLARLKELQVPFSQYEHPVVLTVDAQAQYVGHLGGGLSKNLFLKDKKSRLYIVSALAGTKVDLKVLSQRLGLGKGGLRMAPEEALGEVLQVPLGCVTPFALVNESARYAYVLILFAWLCDI

SEQ ID NO: 139808 - protein, 233 aa, Glycine max
  Coding DNA Sequence Number=SeqID_23030
  Homolog annotation: Hit_ID=Q10X65; Match level="QueryCoverage=31%, HitCoverage=70%, E-value=2e-07, Identity=45%"; Hit description =Glutaredoxin 2
  Pfam annotation: Domain name=DUF836; Domain location=44-133; Score =47.4; E_value=4.7e-11; Accession=PF05768.4; Description=Protein of unknown function (DUF836)
  Subcellular localization annotation: CTP_CleavageSite=55; ConfidenceScore=5.64e-01
MVVGSALGAFAVAGPSSPLLLLRGQKVFKFRPFSSSSSAAPSRKLVLYSKPGCCLCDGLKEKLHAAFLLSGTDSLHDVDLQASLFLSRTLDITTNPEWENAYQYEIPVLAKVLSDGTEFYNLQGKPAISSIGQRVLLVFEIASFDGCFCWQCFFEFDITILHPCFLAIRCGPLIWTQLVVKHYNLITFHLSNHCVQLYLVVQVFPFWSDFSSPVSTNISVCTSFGRNYWVVRG

SEQ ID NO: 139809 - protein, 287 aa, Glycine max
  Coding DNA Sequence Number=SeqID_23031
  Gene Ontology: Mol. function=carboxypeptidase activity; Cellular component=membrane; Biological process=auxin mediated signaling pathway
  Homolog annotation: Hit_ID=Q9SUF1; Match level="QueryCoverage=90%, HitCoverage=68%, E-value=3e-72, Identity=52%"; Hit description =Nodulin-like protein
  Pfam annotation: Domain name=DUF6; Domain location=99-228; Score =20.3; E_value=0.0045; Accession=PF00892.11; Description=Integral membrane protein DUF6
  Subcellular localization annotation: CTP_CleavageSite=38; ConfidenceScore=5.07e-01
MKYTSASFTSTIVNAVPSITFVLAVFVRLERLRLAEIRSQAKVIGTIVTFGGALLMAIYKGPAFDLFHSESTTHRESGSTSPHNSHQTAGAIYILMGCVALSSFYILQSMTVKRYPAELSLATLICLAGTVEASAVAFVAERHSRAWAVGWDYRLYAPFYTGVVSSGIAYYVQGLVMKLRGPVFATAFNPLCMIIVAALGSLILGELLHLGSLIGGIVIAVGLYSVVWGKAKDYSEPKLPSANAEDTKSLPITATDDSKIDIIYGNLEKQPSTNQKLEETNKVGDEN

SEQ ID NO: 139810 - protein, 248 aa, Glycine max
  Coding DNA Sequence Number=SeqID_23032
  Gene Ontology: Mol. function=transporter activity; Cellular component= integral to membrane; Biological process=transport
  Homolog annotation: Hit_ID=Q39FZ4; Match level="QueryCoverage=66%, HitCoverage=38%, E-value=3e-68, Identity=75%"; Hit description=Major facilitator superfamily (MFS_1) transporter
  Pfam annotation: Domain name=MFS_1; Domain location=97-248; Score= -46.2; E_value=0.041; Accession=PF07690.6; Description=Major Facilitator Superfamily
FKTANGEQGAIAAIKVDNVVDTVGAGDGFAVGVISALLEGKTLTQAVNRGNKIGSLAIQRGTAAPVPAGVCHLIDRGKPMNSSTNAAKRWWYIMPIVFITYSLAYLDRANFSFASAAGITEDLGITKGISSLLGALFFLGYFFFQIPGAIYAERRSVRKLIFICLILWGGCASLTGVVHNIPALAAIRFILGVVEAAVMPAMLIYISNWFTKSERSRANTFLILGNPVTVLWMSVVSGYLIQAFGWRE

SEQ ID NO: 139811 - protein, 323 aa, Glycine max
  Coding DNA Sequence Number=SeqID_23033
  Gene Ontology: Mol. function=aminoacyl-tRNA ligase activity
  Homolog annotation: Hit_ID=Q9M3Y5; Match level="QueryCoverage=53%, HitCoverage=72%, E-value=9e-55, Identity=67%"; Hit description=25.7 kDa protein
MSDPLCFDALKTQLIRVLSFTIAALNACDLDKFLKSIGRNPSYVDLETNPTVGKDQPPDLAALVPSGSIVLPDQPQKQSSSQVPKDANHVSVDNGANTVSAKVVKPSSGGKNTKGTPAKNVNSSGSFADAGQFVEEILQKTSQLLLSEVKDENIKLHGEQLGTVLSDKLQKNLNAEFKSLAMIFKNTAYTEGFHAVYEQIYSTATRGLPRNNAIGVIYVLALKLPRFSTHFEFLLTNRTLRILLQMRALDFHRRNRLDRPLRPRRRTLPVVFRYLFDEFVEPWPEEIISRVESARDWAWAVSVWDVNGLEGLMDRSMGWKAIQ

SEQ ID NO: 139812 - protein, 80 aa, Glycine max
  Coding DNA Sequence Number=SeqID_23034
MSAYFGLKTNFLNERESSTDLKYGKNDNATQPKNDHKLKKPPAHSTNNCDTLPGISGQPGQRRFDGGCLGMMYTHITRID

SEQ ID NO: 139813 - protein, 63 aa, Glycine max
  Coding DNA Sequence Number=SeqID_23035
MEKESEGGPAKDNAFSGLWPHFQWKQSTWLKEDQDYAVAPTIFWSTYMYQPRTIMCDARGLIK

SEQ ID NO: 139814 - protein, 254 aa, Glycine max
  Coding DNA Sequence Number=SeqID_23036
  Gene Ontology: Mol. function=transferase activity, transferring nitrogenous groups; Cellular component=cytosol; Biological process =biosynthetic process
  Homolog annotation: Hit_ID=Q8VXZ8; Match level="QueryCoverage=99%, HitCoverage=57%, E-value=1e-104, Identity=71%"; Hit description =Putative aminotransferase
  Pfam annotation: Domain name=Aminotran_1_2; Domain location=1-250; Score=12.4; E_value=5.4e-08; Accession=PF00155.11; Description =Aminotransferase class I and II
MAGAKIKSISLHPPDFAVPIEKLKSIVSSNTRAILINTPHNPTGKMFTLEELNAIASLCIENDVLVFADEVYHKLAFDVEHISIASLPGMFERTVTMNSMAKTFNLTGWKIGWAIAPSHLSWGVRQAHAFVTFSSPNALQCAAAVALRAPDSYYVELKRDYIAKRAILVEGLKAVGFKVFPPNGTFFVLADHTHFGMENDVAFCKYLHKEVGVVAIPCSVFCLNPEEGKNLVRFVFCKDEETLRAAVERMKEKL

SEQ ID NO: 139815 - protein, 109 aa, Glycine max
  Coding DNA Sequence Number=SeqID_23037
  Gene Ontology: Mol. function=transferase activity, transferring nitrogenous groups; Cellular component=membrane; Biological process =biosynthetic process
  Homolog annotation: Hit_ID=Q8VXZ8; Match level="QueryCoverage=96%, HitCoverage=25%, E-value=3e-29, Identity=69%"; Hit description =Putative aminotransferase
MTRLNVAKRLEKFQRDWGGATNQKDGIINLGRGFPNFDGPEFIKEAAIQAIRDGKNQYARGFGVPELNIAIADRFKKDTGIVVDPDKEVTVTTLLRSNCCHCARIDKSR

SEQ ID NO: 139816 - protein, 78 aa, Glycine max
  Coding DNA Sequence Number=SeqID_23038
MVYDFVVVYLSVSDIIAAKYSCLSAKIPGSESRGCARKNACVQQLGSSRLKLMQAEDALSAESDPRHAWQNLRHQKVI

SEQ ID NO: 139817 - protein, 48 aa, Glycine max
  Coding DNA Sequence Number=SeqID_23039
MENWRTALGNDIRGAPDSKVEENGELANMATHNFAGLQTRRWRVHEQR

SEQ ID NO: 139818 - protein, 49 aa, Glycine max
  Coding DNA Sequence Number=SeqID_23040
MTNDNRKYVVGSTKKHARRMSMMKAGVAAHDVQRYVKESDWGCTMHKAR

SEQ ID NO: 139819 - protein, 337 aa, Glycine max
  Coding DNA Sequence Number=SeqID_23041
MDQVQRAYGKIWDLAMIEVFVEAITSLTQYYNQSLRCFTFGDFQLAPTIEEDTKEALGGEGRSSSQLRRMGNIHQLISSASVWDAVIDAFLAYHHNKESPTITVLAYAYDTFDLRCEKSSARIVYCMPALYGKVNWEELLAGVLCSSKGIPNVDLIGMRGGFIEASAKILQRVRKAWNRVERKDKELRGSSNGVIGDYHKWLKSKTQGITWLPKIKGLSGKEVEIPEESEEVQALKAELERTRVVKEKLKVAVTRVRKECDELKDINIAMGSSNELKLRKAEREKSKMESMVLEDKLKSYQRSKRSLIERLNQTKENMLVIIDQYQEKVKLAASHRQ

SEQ ID NO: 139820 - protein, 155 aa, Glycine max
  Coding DNA Sequence Number=SeqID_23042
  Gene Ontology: Mol. function=transcription regulator activity; Cellular component=nucleus; Biological process=regulation of transcription
  Homolog annotation: Hit_ID=Q9ZVX2; Match level="QueryCoverage=48%, HitCoverage=14%, E-value=5e-07, Identity=42%"; Hit description=BHLH transcription factor
  Pfam annotation: Domain name=HLH; Domain location=41-98; Score=31.4; E_value=3.2e-06; Accession=PF00010.16; Description=Helix-loop-helix DNA-binding domain
MGHVCEERLHMSLDEFSFNAENGSNRERMRRKNYDYDTQVFKSKNLEVERRRREKLSTRILLLRSLVPIITMQQPLELHLMNKATIVEDAITYIETQQNIVQSLSYELHEMEATSEEIKPKKEEIDAAEEMNKLGIVQEERSRRQKLMGTNCGSR

SEQ ID NO: 139821 - protein, 196 aa, Glycine max
  Coding DNA Sequence Number=SeqID_23043
  Gene Ontology: Cellular component=mitochondrion
  Homolog annotation: Hit_ID=Q9LK57; Match level="QueryCoverage=88%, HitCoverage=43%, E-value=1e-41, Identity=49%"; Hit description =Arabidopsis thaliana genomic DNA, chromosome 3, P1 clone:MJG19
  Pfam annotation: Domain name=DUF1398; Domain location=6-119; Score= -47.1; E_value=0.073; Accession=PF07166.2; Description=Protein of unknown function (DUF1398)
  Pfam annotation: Domain name=PPR; Domain location=113-147; Score =20.0; E_value=0.0084; Accession=PF01535.11; Description=PPR repeat
  Pfam module annotation: Pfam domain module=DUF1398::PPR; Domain location=6-119::113-147
MAPFRPCVVFNTVAEDTRSHKMYHVLNRAFCTATEPATTIAASIRSISEDLYKEVKLKNVVEKFKKASDNDRFRKKTGIYEDTVRRLAGARRFRWVRDILEHQKQYSDISNEGFSARLISLYGKSGMTKHARKVFDEMPQRNCSRTVLSLNALLAAYLHSHKYDVVQELFRDLPTQLSIKPDLVTYNTIIKAFCEK

SEQ ID NO: 139822 - protein, 175 aa, Glycine max
  Coding DNA Sequence Number=SeqID_23044
  Homolog annotation: Hit_ID=Q10EV2; Match level="QueryCoverage=73%, HitCoverage=78%, E-value=2e-12, Identity=34%"; Hit description =Expressed protein
  Pfam annotation: Domain name=DUF538; Domain location=16-160; Score =106.2; E_value=9.7e-29; Accession=PF04398.3; Description=Protein of unknown function, DUF538
MLSLTPRSSVVPSHLILLLLLILLPLTGSAAAVEEENSYSSDLHRVLHSHGLPAGLFPRSVKSFNLDQTGRLEVHLDRPCLAQYETRVFFDSVVRANLSFGQLKVLEGMSREELFLWLPVKYILVTDPSSGLIVIDIGLAFKHLSLSRFEDPPICKSHSGTTSCPFSLLPLIGCH

SEQ ID NO: 139823 - protein, 1290 aa, Glycine max
  Coding DNA Sequence Number=SeqID_23045
  Gene Ontology: Mol. function=zinc ion binding
  Homolog annotation: Hit_ID=Q5QEU0; Match level="QueryCoverage=5%, HitCoverage=98%, E-value=1e-18, Identity=71%"; Hit description=Auxin- induced putative tetratricopeptide-containing protein
  Pfam annotation: Domain name=FYVE; Domain location=16-79; Score=76.4; E_value=9.2e-20; Accession=PF01363.12; Description=FYVE zinc finger
  Pfam annotation: Domain name=TPR_1; Domain location=1068-1101; Score =8.4; E_value=0.53; Accession=PF00515.18; Description=Tetratricopeptid e repeat
  Pfam annotation: Domain name=TPR_1; Domain location=1145-1178; Score =10.7; E_value=0.28; Accession=PF00515.18; Description=Tetratricopepti de repeat
  Pfam annotation: Domain name=TPR_1; Domain location=303-336; Score =4.5; E_value=1.6; Accession=PF00515.18; Description=Tetratricopeptide repeat
  Pfam annotation: Domain name=TPR_1; Domain location=434-467; Score =1.1; E_value=4; Accession=PF00515.18; Description=Tetratricopeptide repeat
  Pfam annotation: Domain name=TPR_1; Domain location=530-563; Score =0.6; E_value=4.5; Accession=PF00515.18; Description=Tetratricopeptide repeat
  Pfam annotation: Domain name=TPR_1; Domain location=678-711; Score =6.7; E_value=0.85; Accession=PF00515.18; Description=Tetratricopeptid e repeat
  Pfam annotation: Domain name=TPR_1; Domain location=816-849; Score =9.1; E_value=0.44; Accession=PF00515.18; Description=Tetratricopeptid e repeat
  Pfam annotation: Domain name=TPR_2; Domain location=1068-1101; Score =14.8; E_value=0.32; Accession=PF07719.7; Description=Tetratricopeptid e repeat
  Pfam annotation: Domain name=TPR_2; Domain location=1145-1178; Score =18.0; E_value=0.034; Accession=PF07719.7; Description=Tetratricopepti de repeat
  Pfam annotation: Domain name=TPR_2; Domain location=1250-1283; Score =4.1; E_value=11; Accession=PF07719.7; Description=Tetratricopeptide repeat
  Pfam annotation: Domain name=TPR_2; Domain location=303-336; Score =10.9; E_value=1.8; Accession=PF07719.7; Description=Tetratricopeptide repeat
  Pfam annotation: Domain name=TPR_2; Domain location=434-467; Score =8.1; E_value=3.7; Accession=PF07719.7; Description=Tetratricopeptide repeat
  Pfam annotation: Domain name=TPR_2; Domain location=530-563; Score =9.5; E_value=2.6; Accession=PF07719.7; Description=Tetratricopeptide repeat
  Pfam annotation: Domain name=TPR_2; Domain location=678-711; Score =5.0; E_value=8.7; Accession=PF07719.7; Description=Tetratricopeptide repeat
  Pfam annotation: Domain name=TPR_2; Domain location=816-849; Score =11.7; E_value=1.4; Accession=PF07719.7; Description=Tetratricopeptide repeat
  Pfam annotation: Domain name=TPR_4; Domain location=1068-1093; Score =0.8; E_value=30; Accession=PF07721.5; Description=Tetratricopeptide repeat
  Pfam annotation: Domain name=TPR_4; Domain location=1145-1170; Score =6.8; E_value=5.9; Accession=PF07721.5; Description=Tetratricopeptide repeat
  Pfam annotation: Domain name=TPR_4; Domain location=816-841; Score =9.3; E_value=2.9; Accession=PF07721.5; Description=Tetratricopeptide repeat
  Pfam module annotation: Pfam domain module=FYVE::TPR_1::TPR_1::TPR _1::TPR_1::TPR_1::TPR_1::TPR_1::TPR_2::TPR_2::TPR_2::TPR_2::TPR _2::TPR_2::TPR_2::TPR_2::TPR_4::TPR_4::TPR_4; Domain location=16 -79::1068-1101::1145-1178::...
  Pfam module annotation: Domain location=303-336::434-467::530 -563::678-711::816-849::1068-1101::1145-1178::1250-1283::303-336::434- 467::530-563::678-711::816-849::1068-1093::1145-1170::816-841
MLEKIGLPPKPSLRGNTWVVDASHCQGCSSQFTFINRKHHCRRCGGIFCGSCTQQRMVLRGQGDSPVRICEPCKKLEEAARFELRHGRRPGRGSLKSAPRDEEEVLNQILGQASGEVPSRQRSIGIASSSSNSNFDEDIQKIVSNDKPNVLGIDLESTTPDELRKQALEEKKKHKILKGEGKSDEALRAFKRGKELERQADALEIQLRKSRKKSLPSGNLSDMLNKGIPAESDRKTKSLSHVGRVKDDLTSELRELGWSDMDLHNEDKKSSNLSLEGELSSLIGEVFTKTGEQKGSKIDKSQVVALKKNALMLKREGKLAEAKEELKRAKILEKELEEQELLAEAEDSDDELSALIRGMNDDKELSNLHDHGDGFDFERLLAIPDDLHGNFEVTDEDMMDPAIAGALESLGWTEPENTSSQSQTFDKEELLSEIQSLKREALNQKRAGNAEEAMTFLKKAKLLERGLNSSGPEDYNTMSQKSTAVRKGVSSEIAGNGSDSIQLDERNTSATNNVASRVAPKSRLMIQRELLSLKKKALTLRREGKMNEAEEEMQKGAALERQLMEMDKASNVTISRTNTTDNVPHTAHMEADFSRNLPLEEGSEDDVTDQDMSDPTYLSFLRDLGWNDDNNDLSNSPSKPLKKDDDHFVPVNDASLSKHSTNILVQAPRSKAEIQRELLGLKRKALAFRREGKAEDAEEVLKMAKALEAQMAEMDAAKSKAQVEATVMKDRLFNPPVDEERDMVVSEQDMHDPTLNSMLTNLGWKDDESEPMTIKEEPVKEATVRSKHTVDLSALDSSSGIPATALRSKGEIQRELLTLKRKALALRRKGEIEEAEEILRQSKTLEAQIEDFANQNKYLSLNVSMDEQSVLSESSVFQERLGSLGVATEVDNASASSVVWSSKNSSESTFGLERINNETNIAILRKSNNLIPATSHFADGKHSLSADGSTSSENLSKKMKAEKIIGHSSSAGHSMDMVDLLASDDSNMSEIFTQKHKEYKLCSANSSQADPTIHLDTSVNFNQDRGFKNSDTTQKREVIDAIEKPNINKPNAVQDNASQHLLTLRQEILAHKRKAVTLKREGKLTEAKEELRQAKLLEKGLEDGSMQPDTASASVKNVVQKKQELSNVSAKPLSSRDRFKLQQESLGHKRQALKLRREGRIEEAEALFERAKAIETQLEELTAQDSNKSDGVDDVTVEDFLDPQLLSALKAVGLDDVSVVSKAPEREETVKSNAKVENSNQERIQLEERIKEEKVKALNLKRSGKQAEALDALRRAKLYEKKLNSLTSGS

SEQ ID NO: 139824 - protein, 631 aa, Glycine max
  Coding DNA Sequence Number=SeqID_23046
  Subcellular localization annotation: CTP_CleavageSite=36; ConfidenceScore=5.30e-01
MSKKKVSGNTMTLKDFHGGSIPSDLPLPSAPGVTVRTSDRSGFDRPSAWGMPMGRSDHWSRPHTSPATRHYDDKTPFLSNTAPIGRNFDEDERKPLDGGSVPRRTISDESIRGGPPPRVEVRPPEYGLGGSSLGRQVAPVSQTPVGAGNSYSARLTEAVHVGMNPLSLGGSKEQGTAGDGGGYPNVWSMRKEVASAVEPEQPAWSSASAASKLAHASALEKVSSGRWQSKAVHYQTDAEVVRSPELENRPRVNGVGAYSRMDAVGEKEYYDAMLARHTERGLGIDNQMQGGRNELLNYERSRVSRYSDVRPTSAPHHSGGVQLARNDGKIVGSDLQHRMPSEPTERHKLKLLPRAKPVESSEPAVMDYAQGNRHVNDSGHVETVYQAHGHANFVKPVSAGTDSGKDSGQRPKLNLKPRSQPIEQLDGNSERDRNVLFGGARPRELGYPVLKERGIDDVAINNYDVVEHSNRVENNISRVEKLPDHSTQTRYGEKTEDAHLDQKTGRKPERKEQRVDGERAHAQRRNWRGDTRRNGKESNRQPPALERQPSPETWRKPAEQQPKSAPGAAGTRYGRAASAVELAQAFSKSVSDPKVNDKFSGQRGLNTGNSRTQVPFSRLVGPTSRPQINGY

SEQ ID NO: 139825 - protein, 87 aa, Glycine max
  Coding DNA Sequence Number=SeqID_23047
  Subcellular localization annotation: CTP_CleavageSite=28; ConfidenceScore=5.02e-01
MEEPPMAAPRTFQTQSIHLRDQHSGNVSNASGNGQFRMCQGRSLDSKAFYSGNEGADSFAKILYKRHGSLVGASIRASGEGGTQRNI

SEQ ID NO: 139826 - protein, 74 aa, Glycine max
  Coding DNA Sequence Number=SeqID_23048
  Homolog annotation: Hit_ID=Q6Z1V9; Match level="QueryCoverage=36%, HitCoverage=20%, E-value=2e-07, Identity=88%"; Hit description =Chloroplast ORF133; ORF within trnI intron
MGSRNNRNSNTIKIDVGFEVRNRKGGKKVKKMAADHLIGMKFGMGILDDCNFLQTPGKSMKKRLEWYDPTVTPE

SEQ ID NO: 139827 - protein, 219 aa, Glycine max
  Coding DNA Sequence Number=SeqID_23049
  Homolog annotation: Hit_ID=Q1RSQ2; Match level="QueryCoverage=88%, HitCoverage=52%, E-value=4e-30, Identity=40%"; Hit description =Cyclin-like F-box; F-box protein interaction domain
  Pfam annotation: Domain name=FBA_1; Domain location=60-195; Score= -26.4; E_value=0.00042; Accession=PF07734.3; Description=F-box associated
  Pfam annotation: Domain name=FBA_3; Domain location=60-166; Score= -21.0; E_value=0.013; Accession=PF08268.2; Description=F-box associated
  Pfam module annotation: Pfam domain module=FBA_1::FBA_3; Domain location=60-195::60-166
MSHNYLCGIGYDSSTDDYMVVIGRLGKEFHYFSLRTNSWSSSECTVPYLLKHGSGFRNEGLFLNGALHWLVESYDNLRIIIAFDVMERRYSVVPLPDNLAVVLESKTYHLKVSEMWVMKEYKVQLSWTKSYILSTKNFPLSYHFFPICFTKNGEILGSNSSNKLVRLNDKGELHSHGDEKRRFDYIRDSVMYRETLLSLPGGDYEKPSVVPPLLRRKRF

SEQ ID NO: 139828 - protein, 122 aa, Glycine max
  Coding DNA Sequence Number=SeqID_23050
MSPKGKDKNSPAQLELESEMSQTFQFTLGYRSLNMLHMTGIFQRSIQPRAGVIGCKFSRARANKRKRCLFKSVDQLPSSCFANCLLKDGDFEDDKMDSRTMTSTMTYLGLLSQNLYNMSIEH

SEQ ID NO: 139829 - protein, 167 aa, Glycine max
  Coding DNA Sequence Number=SeqID_23051
  Gene Ontology: Mol. function=catalytic activity; Cellular component =nucleus; Biological process=coenzyme M biosynthetic process
  Homolog annotation: Hit_ID=Q4VUC5; Match level="QueryCoverage=85%, HitCoverage=53%, E-value=2e-39, Identity=56%"; Hit description =Phosphosulfolactate synthase-related protein
  Pfam annotation: Domain name=ComA; Domain location=1-165; Score= -37.3; E_value=3.6e-08; Accession=PF02679.6; Description=(2R)-phospho- 3-sulfolactate synthase (ComA)
MEVLRGERGSPRQASLLWRHRDSKTPLHSLLPQPSSELKTEDIFESVGDYVDGLKFSGGSHSMMPKATIKQAIDMAHQHDVYVSTGDWAEHMEYKQLGFDTIELNVSSLEIPEETFLRFIRLVKSGGLKAKPHFQVKFNESDISPLRRNLNIFRPCGRGYILESALY

SEQ ID NO: 139830 - protein, 93 aa, Glycine max
  Coding DNA Sequence Number=SeqID_23052
  Gene Ontology: Mol. function=catalytic activity; Biological process =coenzyme M biosynthetic process
  Homolog annotation: Hit_ID=Q4VUC5; Match level="QueryCoverage=77%, HitCoverage=25%, E-value=4e-25, Identity=71%"; Hit description =Phosphosulfolactate synthase-related protein
MKNVESTQTQNIGSPSLYNMRADIIAKIIGRLGIEKTMFEASNQRISEWFIKQYGPNVNLFIDHWNVVDVECLRGRNLGKNLASVLGSSDFLF

SEQ ID NO: 139831 - protein, 203 aa, Glycine max
  Coding DNA Sequence Number=SeqID_23053
  Gene Ontology: Mol. function=galactosyltransferase activity; Cellular component=membrane; Biological process=protein amino acid glycosylation
  Homolog annotation: Hit_ID=A0EVG3; Match level="QueryCoverage=75%, HitCoverage=53%, E-value=2e-29, Identity=43%"; Hit description =Hypothetical protein hypro1
  Subcellular localization annotation: CTP_CleavageSite=26; ConfidenceScore=5.46e-01
MKPSNTDRELHSLISSNQVQFKDTLRSSLTTTTTTSPQLTNYFSSNSDNNLRILIGILTLPDQHLRRNLLRLVYGTQPAPPGAKINVKFVFCNLTKEDQKVLVALEIMRYGDIIILDCKENMNNGKTLTYFSSLPEMLNDTASSYPPYHYMMKTDDDTYLRLNILVQSLKPLSREDLYYGYVIPCRSIDPFVRYMSGMGYLVS

SEQ ID NO: 139832 - protein, 53 aa, Glycine max
  Coding DNA Sequence Number=SeqID_23054
  Subcellular localization annotation: CTP_CleavageSite=22; ConfidenceScore=5.05e-01
MCSSLCVGTRISQCMKSPRVPLSSKVVKLSDSTANARMWFFLLHFLIFNFTMH

SEQ ID NO: 139833 - protein, 144 aa, Glycine max
  Coding DNA Sequence Number=SeqID_23055
ALITGLCQSFGVPVTRRKVIRPPITRAFIEKYCTLRQAQGDAPQAADAPLPPHQADLTGSLGMERYLQHLVRQQAANHRGQGQGIAPFVCPTPEQFRAEVAWPGDWPEAQAGEAPAGSPGDAEEARMDEEITNLLGFLGGGGAT

SEQ ID NO: 139834 - protein, 83 aa, Glycine max
  Coding DNA Sequence Number=SeqID_23056
MADQQATKSKAKVITRPAQDVKEALLGGNLELATKKLPAKRSRKGTIEKDSTVASQVDTCFDKHRSKRGRSIAFQGHQRMVIP

SEQ ID NO: 139835 - protein, 119 aa, Glycine max
  Coding DNA Sequence Number=SeqID_23057
MKTIQTKEEADATRSKAGCSLTLYNGGNHDTIYDQKAQKEAGLPTYLNRDSEEHELEWELLQTRTRTPTPTRTGTGANSNLNMNKNGNFKRTNNLSDEEEMEKEFWLLNAWRENGFSGF

SEQ ID NO: 139836 - protein, 84 aa, Glycine max
  Coding DNA Sequence Number=SeqID_23058
  Homolog annotation: Hit_ID=Q9C7R3; Match level="QueryCoverage=48%, HitCoverage=17%, E-value=5e-09, Identity=68%"; Hit description=Beta -1,3 glucanase, putative; 26636-27432
MKHDREQCLKYNSLLLFVLLSSLHLNSHKHSQEQPVEQCLKLPVSEDDELGDATNSATMGNDVDSNSGTEDDIHSSTDFEFYLQ

SEQ ID NO: 139837 - protein, 83 aa, Glycine max
  Coding DNA Sequence Number=SeqID_23059
MEEESFFATSAKAVDDNIVREVIINLTNTSVMNEILELSKTAQADEIVHQEKEPASKQSTDNCLKNIILMTILWAIMLIFEYI

SEQ ID NO: 139838 - protein, 215 aa, Glycine max
  Coding DNA Sequence Number=SeqID_23060
MNRKTIVSKALGAKVVLSSDSIDKATGCLDEGSTYHEGWENNYDSNVARALYKENIENTGDQETIVYNLMFERENILNKSILHKVWSKTTLSDLHKMDKDSNHTIIAKGSIVAKQKKFSKTNLKSMKKERIAKLAATTKDVVILSVVPRRVKTRATKANPKIGDKDCYIPIVGDKEYAPLSSLDNESTEDAHVFPLRQASIHCNKKNVYLYLSHT

SEQ ID NO: 139839 - protein, 395 aa, Glycine max
  Coding DNA Sequence Number=SeqID_23061
  Homolog annotation: Hit_ID=Q1T1F7; Match level="QueryCoverage=54%, HitCoverage=46%, E-value=1e-15, Identity=27%"; Hit description=IMP dehydrogenase/GMP reductase
MIIIKTSKPIASTHCVRHVWICQEWPKVKLVSHYGHVLPPLLIHEFGLMWTNQGRPIDHVPSLFDREAMKILVMTHLSIPTETKASVVTNAGARVRLMWLEDLYHRYVESNPYVWVAMTYPLHLINSKILVDKSSTHVHIAYLQYLDNLDTCHEYAWRIGVLAYLYDHLSYTSQYNNKQCGGYMTLLMSWVFVHLPIVGYSKAKDYVVDNLVATKWKPLKSSRHALSIRERLDDLQMNVVMWCSYENHRAVRPFTQQSFFSGFIKCETNVRSYHSEGVLSFVIRREWSNNNISFPLAMLCHLGVLRIAPMTICLGFTRFPIPMSFHWRRDNHHVVISMLDSIRSYAKLVGFQSRAKRHELSSGHTTSFRIVVGGLSNWVPRKSVDKDGGKGSGDG

SEQ ID NO: 139840 - protein, 71 aa, Glycine max
  Coding DNA Sequence Number=SeqID_23062
ILLGIAFSLLILGSSANSRSRESCGISNRRFLSIGGILCFIHGLFTIGYYVSVTATRREEKRQGNSFVGHT

SEQ ID NO: 139841 - protein, 496 aa, Glycine max
  Coding DNA Sequence Number=SeqID_23063
  Gene Ontology: Mol. function=magnesium ion binding; Cellular component=chloroplast; Biological process=metabolic process
  Homolog annotation: Hit_ID=Q5UB06; Match level="QueryCoverage=98%, HitCoverage=84%, E-value=0.0, Identity=69%"; Hit description=Wound -inducible putative chloroplast terpene synthase 3
  Pfam annotation: Domain name=Terpene_synth; Domain location=1-157; Score=24.1; E_value=7.9e-09; Accession=PF01397.11; Description =Terpene synthase, N-terminal domain
  Pfam annotation: Domain name=Terpene_synth_C; Domain location=160 -432; Score=277.0; E_value=3.8e-80; Accession=PF03936.6; Description =Terpene synthase family, metal binding domain
  Pfam module annotation: Pfam domain module=Terpene_synth::Terpene _synth_C; Domain location=1-157::160-432
MVDSIQRLGIEYHFEEEIETILKKKLLMLRVHNHQGRAYQELSEVALQFRLLRQEGYYIHADIFDKFWGNEGKLKLTFCDDINGLIGLFEASQLSIEGEDYLHEAEECCRQYLNTWLSRFHEHPQVKVVADSLRYPIHRSLSRFTPTNSLQIESTEWIRSLQELSKIDTEMVSSLHLKEMFAVSKWWKELGLAKDLKLARDEPIKWYMWAMACLPDPRFSEERIELTKPLSLVYIIDDIFDFCGNIDELTLFTEAVKRWDMAATEQLPDYMKGCFKALYDITNEFAFKIQIKHGWNPISTLIKSWVRLLNAFLEEAKWFASGLVPKADDYLKNGIVSTGAHMILVHSFFFMGDAITQETITLMDEFPSIISATATILRLCDDLEGDQDVNVKGDDNDGSYIKCYMKEHPATSVEQAREHVAELISDAWKRLNQECLMTDANLFPSSFTKLCLNAARMVPLMYGYDTNSPSKLEEYVKSLLCGGAMQSIPEDQTIVS

SEQ ID NO: 139842 - protein, 489 aa, Glycine max
  Coding DNA Sequence Number=SeqID_23064
  Gene Ontology: Mol. function=ATP-dependent peptidase activity; Cellular component=integral to membrane; Biological process=ATP -dependent proteolysis
  Homolog annotation: Hit_ID=Q5ZAL4; Match level="QueryCoverage=87%, HitCoverage=98%, E-value=5e-42, Identity=45%"; Hit description =Membrane protein-like
  Pfam annotation: Domain name=DUF81; Domain location=63-463; Score= -21.1; E_value=0.00017; Accession=PF01925.9; Description=Domain of unknown function DUF81
MRIIHSLACLVLTFISFNPCKAEQAQTILNSLSIDQILQKIYEWGNGAQGFQEGQIQISGPIVVAGVLCFIASSISSAGGIGGGGLFLPILTIVAGLDLKTASSLSAFMVTGGSIANVLCNLCATSPKFGGKSLIDYDIALLSEPCMLLGVSVGVICNLVFPEWLITMLFAVFLTWSTSKTCNSGVLFWKIESEERRKNDGFEGLEKGLLEDGSSEEREERVQVNNEKAGMKSIEEQVMVPEENIRMRIPWLKLVVLLLVWLSFFSLYLLRGNKYGQFSKCKIAQKVGEGWCKSIIPMEPCGVGYWILSSAQVPLALFFTAWIVYRKESHQDQNLMQEDPCLSSNGPSNKLIFPMMALLAGILGGVFGIGGGMLISPLLLHVGIAPEVTAATCSFMVFFSSTMSALQYLLLGMDHIETALILALICFVASLIGLLVVQRAIQSYGRPSLIVFSVSIVMTLSIVLMTSFGVIRTWKDYTSGRYMGFKLPC

SEQ ID NO: 139843 - protein, 187 aa, Glycine max
  Coding DNA Sequence Number=SeqID_23065
MSNEKGAPHAIIVYSTSSGPTPLNYAHPSAMTRDQVQDMIGQAMDSFIERQRQENEQFRLSMQNSITTQFSNFSVVLLQNLQKTQMTILGVVVALASIVAPASPPLNHQPPLIEPTPPSSPRSFKPSEQFYKAFSTFSVSFSLMLENPNRAIGRVALESIENVAIANGECLSDYIEYDSENYSSVGV

SEQ ID NO: 139844 - protein, 44 aa, Glycine max
  Coding DNA Sequence Number=SeqID_23066
MASIIVSICSFMASMSAFIFSCTSSALPITLALARVRGKRKGHA

SEQ ID NO: 139845 - protein, 60 aa, Glycine max
  Coding DNA Sequence Number=SeqID_23067
MTKEVIHGHNSVVPWPHFSSSMFFSQLSEKAIYCKGNSPRQAACLGLKVSARPGEWLAWG

SEQ ID NO: 139846 - protein, 218 aa, Glycine max
  Coding DNA Sequence Number=SeqID_23068
  Gene Ontology: Mol. function=inorganic anion transporter activity; Cellular component=integral to membrane; Biological process =inorganic anion transport
  Homolog annotation: Hit_ID=Q1H4J5; Match level="QueryCoverage=94%, HitCoverage=51%, E-value=6e-68, Identity=65%"; Hit description =Nitrate transporter
MAKDAPDAPAPKSMSQYLSVLKDKDAWWFMFFYSVTFGGFVGMASSLTIYFHDQYGLDPVHAGYFTAACVFAGSLVRPFGGLLADRIGGIRSLSAMYILAALFLFTLSVGIETQLIGLGVVMLAMAALGMGNGAVFQLVPQRFRKEIGVMTGLVGMAGGVGGFYLASSLGYSKQITGSYQVGLTIFAGLAILALIGLSNVKNRWRTTWGAATVTSAKI

SEQ ID NO: 139847 - protein, 85 aa, Glycine max
  Coding DNA Sequence Number=SeqID_23069
MAPILGQWSPLLGLALDSAASCFAIGGTWSLYMELVRERIDAGSIGSEYPVLDLSNGTGTGEAIGLIGRVSPTGMWSSRSYLRKD

SEQ ID NO: 139848 - protein, 573 aa, Glycine max
  Coding DNA Sequence Number=SeqID_23070
  Gene Ontology: Mol. function=magnesium ion binding; Cellular component=chloroplast; Biological process=metabolic process
  Homolog annotation: Hit_ID=Q5UB06; Match level="QueryCoverage=89%, HitCoverage=89%, E-value=1e-137, Identity=48%"; Hit description =Wound-inducible putative chloroplast terpene synthase 3
  Pfam annotation: Domain name=Terpene_synth; Domain location=42-247; Score=124.3; E_value=3.3e-34; Accession=PF01397.11; Description =Terpene synthase, N-terminal domain
  Pfam annotation: Domain name=Terpene_synth_C; Domain location=251 -521; Score=273.6; E_value=3.8e-79; Accession=PF03936.6; Description =Terpene synthase family, metal binding domain
  Pfam module annotation: Pfam domain module=Terpene_synth::Terpene _synth_C; Domain location=42-247::251-521
MALHFKTCIFSFKPHQIMTTKAQLSQSFNPAKLDSLHIANKWNIVQEERSSALFTKTGDLISINHSDKLEVVKNEFMNTVGENSLRGLYMIDAMQRLNIDYHFQEEIEEFLRRQYVNSTTIAGGYYGDDIHEIALRFRLLRQQGFFVPEEVFHKFTNKEGKFNQKLGENIKGMVELYEASPLGIAGEDTLAEAGEFSGPVLKEKLDCIDIHNLEAKFVKRTLEQPFHKSLPMFTARNFFGDFDATNTWLGSLKEVAKMDFSLLQCMYHREITQISNWWTGLGLANELMYARNQPLKWYIWSLACFTDPTLSEERVELTKPISLIYIIDDIFDVYGTLDELTLFTEAVCRWDITAIEQLPDYMKACFGVLYNLTNEISSKVYQKHGWNPIDSLQHAWKSLCKAFLVEAKWFASGNLPSAEEYLKNGIVSSGVHIVMVHAFFLLGHGLTEENIKIIDRNPDIISSPATILRLWDDLGNAEDENQQGNDGSYVNCLMMDHPHYTTRTARKRVMSKISDAWKSLNQECLFGNHFHSTFTKASLNLARMVPLMYSYDDKQSLPGLEEQVKSLLYDDFL

SEQ ID NO: 139849 - protein, 95 aa, Glycine max
  Coding DNA Sequence Number=SeqID_23071
MASYGVASPLSLPFSIPLPFIFQEAKESIDEEDPRPTSSNGACINPDQRNNFTIYNKDTPESSTSILKRATKVKSKQTPNWYNRYKKMKPQIYRA

SEQ ID NO: 139850 - protein, 179 aa, Glycine max
  Coding DNA Sequence Number=SeqID_23072
  Gene Ontology: Mol. function=nucleoside-triphosphatase activity; Cellular component=membrane
  Homolog annotation: Hit_ID=Q4KB62; Match level="QueryCoverage=52%, HitCoverage=17%, E-value=9e-16, Identity=49%"; Hit description=ABC transporter ATP-binding protein
MVNAEDKDVRINRLTLLSKLRELFLQVADISLLQLGPGYPMPRRIPRLTGAHTTNEQTRLMNFTPYLANAAGRGVLISFRSAYGSLCPHPLFCFTSGHLSVRDGTDAFWPAEFIAGTVALRPCRAKWRWQDTPVASAGGPRFSLLRAYRTIGHRCLGGAAADPHGRDNRCLPAGLCASI

SEQ ID NO: 139851 - protein, 81 aa, Glycine max
  Coding DNA Sequence Number=SeqID_23073
MTGDWLGALERRLKMGWNMPRADTSTLPKAPVIATTGHLANVNLVSLSTARGYLIPTARRFTSFYFEGGHVDMKKKLNCSS

SEQ ID NO: 139852 - protein, 109 aa, Glycine max
  Coding DNA Sequence Number=SeqID_23074
MRGYLMVICTFCHLETASSMTCGVTLWLSAPLSFRDVTASPMTCRGTLWLSTPFVIQRQAGPLTRRDKLLVIRTFCHPETASPMTCGGTLWLSAPFVNQRQASPLTHRD

SEQ ID NO: 139853 - protein, 130 aa, Glycine max
  Coding DNA Sequence Number=SeqID_23075
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=9e-12, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=81; ConfidenceScore=5.54e-01
MARTCSALKVRACSPLMARTCSPLKDRMSSPLKVRACSSLIARTCSPLKARISSPHMVRTCCPLMVRTCSPLKARTSSPLKAWMSSPLMAWPCSSLKVRMCSPLIPRTCSPLKVTACSPLMARTCGPLIA

SEQ ID NO: 139854 - protein, 250 aa, Glycine max
  Coding DNA Sequence Number=SeqID_23076
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=1e-31, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MAAHPHLQRTTRPCHHRAARSHLLRTTRPRLHALTFRGLDILAFIGLHVLAIRGLHALTFKGLHVFTIKGLHALTFRGLHVLAIRGLHALTFRGLDILAFRRPHDLAIRGPHVLAIRGLHALTFRGLQVLGIRGLHVLTFRELHVHAITLRGLDILPFRGLHVLAIRGLHALTFRGLHAFAIKGLHALTFRGLHVLAIRGLHALIFRGLHVLAIRGLHALTFRGLDILAFRGLHVLAMRGLHALTFSGIQ

SEQ ID NO: 139855 - protein, 146 aa, Glycine max
  Coding DNA Sequence Number=SeqID_23077
FSSYRQLKVYTDNNTGISARQRDSKVNMTDLVSVEDYRDSKVNMTDLVSAEDDTAKVYTDNHSGISARQRDSIESMTDLVGAEDDVYLRVSTGFSSYRQQKVYTDNHSGISARLRHSKVSMTDLVSAEDDAFRLTDRKMFIRITTQ

SEQ ID NO: 139856 - protein, 348 aa, Glycine max
  Coding DNA Sequence Number=SeqID_23078
  Gene Ontology: Mol. function=helicase activity; Biological process =viral genome replication
  Homolog annotation: Hit_ID=Q1SRJ5; Match level="QueryCoverage=89%, HitCoverage=37%, E-value=8e-97, Identity=52%"; Hit description =Probable helicase [imported]-Arabidopsis thaliana-related
MIESERISYVRNNQKKLRVDKFCSLQQSSEAGNTEDRPEIISRIFKLKYEQMLSDLTKNHLLGKVVAYMYTVKFQKRGLPHVHLLLFLHANNKYPSPNDIDNIISAEIPSQKDDPKLYKLVQNHMIHGPCGILRPASPCMKEGKCSQFYPKKFQPTTLIDGDGYSVYRRRNTSRAITKNDIIIDNRCIVPYNPKLLKKYQAHINIEWCNQSTSIKYLFKYINKGYDRVTAVMVHDDNEIVPHAKTPNDEIKEYLDCRYISPCESAWRIFSFPIHGRKPSVERLQFHLPGQHSVLYQDHDDIDDLLSNPSISESKFIAWMNTNQAFVEGKNLTYSEFVTKFVYNQKQRC

SEQ ID NO: 139857 - protein, 155 aa, Glycine max
  Coding DNA Sequence Number=SeqID_23079
MSSRKRKSIDARPTTQYDIRRFHSFEAWTRYTDNVLGRHILAERKVEIYHTELDEFKAELERRNFHKRLTNLADSSIDLALVKEFYANLYSPKGPSPEQVRIRGHLIKIDADSLNTFLETPVVLAEGESLPAYSRYCRMPTDIGEIEAALCIPSR

SEQ ID NO: 139858 - protein, 70 aa, Glycine max
  Coding DNA Sequence Number=SeqID_23080
MSHTVKDNRGKWAPNYEGPFMVKRAFSGGALILAHMDGEELPKPMNSDVHRDGCKWVWGHDRPIVAPSRR

SEQ ID NO: 139859 - protein, 84 aa, Glycine max
  Coding DNA Sequence Number=SeqID_23081
MVNREVVKGKGTLKEIFRPQLRARMSSVILHKLHKGYKENLFETNCKVLSGKNGGEKYCSYLADIARESAEACWKIGLTFLCFM

SEQ ID NO: 139860 - protein, 135 aa, Glycine max
  Coding DNA Sequence Number=SeqID_23082
  Pfam annotation: Domain name=Transposase_23; Domain location=22-92; Score=-6.0; E_value=0.0051; Accession=PF03017.5; Description =TNP1ENSPM transposase
MGVKHFEVVKRRSHADKQWSPDEIRRKCGLYVEENPPRLVALGRLYEGSTTIHNIPLRHDQVKVGVEEVRDVDATVFVPTEEVQLVEQTLNTFIAWTTHLVKSLLEQGAVGPAKPAHRLDDHVDDPLYLMTLIIP

SEQ ID NO: 139861 - protein, 122 aa, Glycine max
  Coding DNA Sequence Number=SeqID_23083
LGRIDGDPVLRETRIWATWEYVSSDGGGQQGMSGTGDMSRGSGDLGPSASSWKSTDKRNKDHKARRLVWWLASCESCVIYGLWPLVIDYQGLENEVVEASGNRLPVCVIDYTEEWVTGNRLS

SEQ ID NO: 139862 - protein, 66 aa, Glycine max
  Coding DNA Sequence Number=SeqID_23084
  Subcellular localization annotation: CTP_CleavageSite=25; ConfidenceScore=5.15e-01
MWQTTTSFPSTHLDKRNNPMYTGCSSSAGNPIACKKTSERMWQSHDNFKEAWTSSTIERGYPGCRH

SEQ ID NO: 139863 - protein, 132 aa, Glycine max
  Coding DNA Sequence Number=SeqID_23085
MPPSHFVVQLLAVHIGLHVANGVGCISFSIVDYEILIPGDRCRTGCHDITLQNMQIICVRMNRLNKVPSRWLTKDSSPKNSQTNSSIPDLVQNSCSLHDYIAVYDSGLQVLDAGGDLSSSEKSAVKELKDNF

SEQ ID NO: 139864 - protein, 49 aa, Glycine max
  Coding DNA Sequence Number=SeqID_23086
MEELINKTQLSPKSNPNFITSAQRLHNRISLPAPYCCHSAPMNIVRDHH

SEQ ID NO: 139865 - protein, 129 aa, Glycine max
  Coding DNA Sequence Number=SeqID_23087
MKSGCSDAISDYGNNDKNGGGGINGGNGVSDDDYNNYCSINGDNGNDKTTRMESFPIVIIVVAAKEIVVMVATIAVKSWNEEVAHTRSFLVYGWEDVNFLLFHSAFWSILPFSYSFTMQEYIPSGLIHC

SEQ ID NO: 139866 - protein, 142 aa, Glycine max
  Coding DNA Sequence Number=SeqID_23088
  Gene Ontology: Mol. function=nucleic acid binding
  Homolog annotation: Hit_ID=Q1S9L7; Match level="QueryCoverage=51%, HitCoverage=40%, E-value=8e-31, Identity=86%"; Hit description=RNA -binding region RNP-1
  Pfam annotation: Domain name=RRM_1; Domain location=53-118; Score =45.7; E_value=1.6e-10; Accession=PF00076.12; Description=RNA recognition motif. (a.k.a. RRM, R
MKPEVVAHLSGRGGGRDRFRRDYPSRCDDNRGNGVGGRDNRNSSRNNPPSRHLWVGNLSHNIVEEELAHHFLRYGPLENVAFQPGRSYAFINFRMDEDAIDALRALQGFPLAGNPLRIEFAKAVLQNMHLTVKKSMAESYFF

SEQ ID NO: 139867 - protein, 233 aa, Glycine max
  Coding DNA Sequence Number=SeqID_23089
  Gene Ontology: Mol. function=protein serine/threonine kinase activity; Cellular component=membrane; Biological process=protein amino acid phosphorylation
  Homolog annotation: Hit_ID=O81833; Match level="QueryCoverage=76%, HitCoverage=21%, E-value=2e-63, Identity=67%"; Hit description =Putative receptor protein kinase
  Pfam annotation: Domain name=Pkinase; Domain location=61-233; Score= -11.0; E_value=6.6e-08; Accession=PF00069.15; Description=Protein kinase domain
  Pfam annotation: Domain name=Pkinase_Tyr; Domain location=61-233; Score=-6.9; E_value=4.8e-12; Accession=PF07714.7; Description =Protein tyrosine kinase
  Pfam module annotation: Pfam domain module=Pkinase::Pkinase_Tyr; Domain location=61-233::61-233
MGRVYISGCCFRISFAIHNAINHFYSLSEKSKAENNYEGFVDDLDLPLLDLSIILAATDNFSEVNKIGEGGFGPVYWGKLASGLEIAAKRLSQNSGQGISEFVNEVKLIAKLQHRNLVKLLGCCIHKQEKILVYEYMANGSLDYFIFDLLRNTDHTKGKSLDWPKRLSIICGIARGLMYLHQDSRLRIIHRDLKGSNVLLDEDFNPKISDFGMAKTVGREEIEGNTNKIVGTL

SEQ ID NO: 139868 - protein, 371 aa, Glycine max
  Coding DNA Sequence Number=SeqID_23090
MHKPHRTGKWTLRPPPTTEDGQVTFFFTNFLMRLTAKDMWGALGGIVISGVCLCANVSRFDAADRWQLALGRREVAGSGHGGLWRSRGVLGGGGFVATPSSLVAASVVDDSCSMLGRWLGMRGEGGCQETTTLGGVISGVGDPIGCVFGLIGDIGVTTGVGNLVSVDEYMACRGRLDIVRVLVHVKGFHNIDTHVLVDVGGEPFDIWVKQDGYTSLCPSCSNNPKGEGDGDETDDELELLSLIADDLQVDQSRVIGGREGSRARSGVPIMMKVSDYSSHAAKFVEEVHKEVVSSNPQPRRSWVVPRFSQRELRRSASVITTLRVVDHSDDAMAWRVWSMVSAWGLKAKGANYSPMKVFSLNMREIGDWAKH

SEQ ID NO: 139869 - protein, 130 aa, Glycine max
  Coding DNA Sequence Number=SeqID_23091
MTNFARCFQIIIVMRALWKNMEVQDESDTLTPKFVSPQISRLESSFFPPKQRTAESPQGRANRTLKPDFPKKGMGKEKWKERKGRNGKKEKEKDENKEKEQKKGKKDSRSKIERKQKGKRSNSQSMKERG

SEQ ID NO: 139870 - protein, 250 aa, Glycine max
  Coding DNA Sequence Number=SeqID_23092
MQDEDPAAALRLLLNTSQANTSSEKNPGASSSSDADITSTVRQDCLLLKLSMEYARADVLKSIEENPSAAFGHLNFLKKLHNPLTSDEILGKVIQIESIIDQFANTVQKKRDNGARLDAQKQAHILLLEKARAAQREVERLTKEAKEGSSEIKACDDNISSWEATITNLLSQVDDLRQKIVTEQAKRKELQEKAADSIQKLVAEKGREGLKAFSASQAVADEARAMESADQVLSKEMATLKKLYEDLVLH

SEQ ID NO: 139871 - protein, 285 aa, Glycine max
  Coding DNA Sequence Number=SeqID_23093
  Gene Ontology: Mol. function=transporter activity; Cellular component= integral to membrane; Biological process=transport
  Homolog annotation: Hit_ID=Q6DB28; Match level="QueryCoverage=93%, HitCoverage=94%, E-value=1e-60, Identity=47%"; Hit description=ABC transporter permease protein
  Pfam annotation: Domain name=BPD_transp_1; Domain location=88-283; Score=114.1; E_value=4e-31; Accession=PF00528.12; Description =Binding-protein-dependent transport s
MSLVDYSTARQGQPALRRDRARRLQPGLWLAWTVLALAFVAAVAPQLFTHYSPTEGIAGAQRLAPHSAHWLGTDQLGRDLLARIVYGASQSLSAAVAAVAMGLTGGTALGVLAGAVGGRTEQALMRLVDVLLSIPALLLSLSLLILLGFGTVHAALAVGIASIASFARLARGEVVRVRRSEYVEAAFGSGGRFWQVLWRHIVPNTLTAVIAFAALQFGQAILALSTLSFLGYGTPPPTPEWGLLIAEGRNYLATAWWLTTFPGVVVVAVVLAANRVSRQLAGGDA

SEQ ID NO: 139872 - protein, 88 aa, Glycine max
  Coding DNA Sequence Number=SeqID_23094
MDEDQWTYDNTLSEEVDMDYENEEECGVNEPYVISEILTHPNSWLLLLSSSSWTSWDSRLPSKLVRVYELTLEFDNLAHECIKLACFT

SEQ ID NO: 139873 - protein, 57 aa, Glycine max
  Coding DNA Sequence Number=SeqID_23095
MDELDILVSLVLSQTHLCLFNFHQNVSVVKTKMDTSEPYTGTMRGTMHEPQVNLGAD

SEQ ID NO: 139874 - protein, 144 aa, Glycine max
  Coding DNA Sequence Number=SeqID_23096
HGEDECEAVSKHGEDLHKQKNSKRFPFKEMEEDNDYAEEENWTKVVSRRSMKVMQKSSLAGRQSQNLEIGDNNKHYRLNWRNNADITSFYFTHFPDEANEELLWRHFKNWGDVREVYIAKRLNKDGRRYGFMRFKGVSDAKGLE

SEQ ID NO: 139875 - protein, 56 aa, Glycine max
  Coding DNA Sequence Number=SeqID_23097
MVSGASMAFVMLPLNFRKPWRRGAVSKIFMTPKLCISAILGKKHVFVKKNRVEVLP

SEQ ID NO: 139876 - protein, 106 aa, Glycine max
  Coding DNA Sequence Number=SeqID_23098
  Gene Ontology: Mol. function=hydrolase activity, hydrolyzing O -glycosyl compounds; Cellular component=cell wall; Biological process= carbohydrate metabolic process
  Homolog annotation: Hit_ID=Q9SV60; Match level="QueryCoverage=91%, HitCoverage=41%, E-value=2e-25, Identity=48%"; Hit description =Xyloglucan endotransglucosylase/hydrolase protein 2 precursor
  Pfam annotation: Domain name=Glyco_hydro_16; Domain location=1-98; Score=3.4; E_value=1e-07; Accession=PF00722.11; Description=Glycosyl hydrolases family 16
LTSTAYKHLGAKHDEIDFEFLGNNGQPHTLQTNVFTNDEGGREQRHSLWFYVDEIPIRVFKNYSNVGVSFPSQQMHVTASIWNGEPWASNGKRIDWKQAPFTAQFQ

SEQ ID NO: 139877 - protein, 101 aa, Glycine max
  Coding DNA Sequence Number=SeqID_23099
  Subcellular localization annotation: CTP_CleavageSite=42; ConfidenceScore=5.07e-01
MGMRLPPSSSKRAQASLGYRNVTEALRKPQMPFFNKMGEAVAAQLNQASSACPDELGCFHPKQEKNFTDSMAMGVKPSEAINNGPQMKLGWLGGWLWRTSC

SEQ ID NO: 139878 - protein, 142 aa, Glycine max
  Coding DNA Sequence Number=SeqID_23100
MGLRKRGRDGRIALSNHYAWLQTRGWRMNENAIHGAPKQAREWRIALSNHYAWLQKSGWRMHERKRNSWGSEKGKEWRIALSINYAWLILVGGGCKNKNVIHGAPKKGREWRIALSNHYSWLQTPGCKMHKRKHNSWGSENW

SEQ ID NO: 139879 - protein, 183 aa, Glycine max
  Coding DNA Sequence Number=SeqID_23101
  Gene Ontology: Mol. function=chitin binding; Cellular component =extracellular region; Biological process=chitin metabolic process
  Homolog annotation: Hit_ID=UPI0000D66BFF; Match level="QueryCoverage =66%, HitCoverage=83%, E-value=7e-12, Identity=31%"; Hit description =PREDICTED: similar to SPT transcription factor family member (spt-5)
MRGTVDEPQSNLGADQKFPKSNVQTFVFGIRGPLNESISCFLIRLDPLRLHILASRRIHVLAFRGLHVLAFKGLRILDFRGLRVLDCRGLYILASRGLHVLASRGLYVLAFRGLPVLNFRGLHVLAFRGLYVLTSKGLHVLAFRGMHILTFRGLHVLAFRGLYVLTFRGLHILTFKELKVLFH

SEQ ID NO: 139880 - protein, 127 aa, Glycine max
  Coding DNA Sequence Number=SeqID_23102
METTKSTQQALRSVEIQVGELAEAVTQFMVRQEKSFVEVEAQKKSPVKERESREKDEEKDEEQAQKQWEKYLTVENQQENILQAYPWLSGTYCRQPQFLMALIEVHDAKRQSWQLSKLLCDNMSAKR

SEQ ID NO: 139881 - protein, 75 aa, Glycine max
  Coding DNA Sequence Number=SeqID_23103
  Subcellular localization annotation: CTP_CleavageSite=52; ConfidenceScore=5.43e-01
MNNASKDSPNESSTKPTTSKGPQKLTNLKVSRSITIKDVLHSDRYKPPKVSNSSTLKGTKLPTIQQVFSRRPGGN

SEQ ID NO: 139882 - protein, 131 aa, Glycine max
  Coding DNA Sequence Number=SeqID_23104
MPIFDDIDYDTRNPQDLFHENGQSSMADAKKIFYPKNRSNKGTSSSHTETTQKQERKFTMKDVCYYSQPSNIPPKDSDSSSQQQQARTFTMKDFCYYTKPNNPPSVSDASTSRAGTPLPTIKKSFARRTWS

SEQ ID NO: 139883 - protein, 82 aa, Glycine max
  Coding DNA Sequence Number=SeqID_23105
  Subcellular localization annotation: CTP_CleavageSite=72; ConfidenceScore=5.60e-01
MADSKNLIKKALWPNSLSNSSGPKTSNTSQHETPPKIAIKDVFYSSRPSNPPNTSTTTSPSGTPLPKMRDVFARRKGKGSGS

SEQ ID NO: 139884 - protein, 90 aa, Glycine max
  Coding DNA Sequence Number=SeqID_23106
MKLLSFNVKGMGSRVKWKEIRRIISKEEVDIVEWRHVPAANDAGGILCLWGEGNLMYEILGQMLVSFFCKAIGKGSKRSLISLIFIHHAQ

SEQ ID NO: 139885 - protein, 566 aa, Glycine max
  Coding DNA Sequence Number=SeqID_23107
  Gene Ontology: Mol. function=inositol or phosphatidylinositol phosphatase activity; Cellular component=intracellular; Biological process=abscisic acid mediated signaling
  Homolog annotation: Hit_ID=Q1RYG3; Match level="QueryCoverage=93%, HitCoverage=96%, E-value=0.0, Identity=76%"; Hit description =Inositol polyphosphate related phosphatase
  Pfam annotation: Domain name=Exo_endo_phos; Domain location=111-526; Score=95.9; E_value=1.2e-25; Accession=PF03372.13; Description =EndonucleaseExonucleasephosphatase family
MPALLQNSFAFDFLGLALLTLFFLFKLSWSKSLVKKWFNIKNKAEDFHSDEVLSQGVDEECSSNYSEREACTIRKSKSERSSRWYSDRMRRGRGKNDLDEAQVTDVYNYRIFAATWNVAGKSPPCYLSLEDWLHTSPPADIYVLGFQEIVPLNAGNVLGTEDNGPARKWLALIRRTLNSLPGTNGGCHTPSPLPNPIVELDADFEGSMRQKATSFFQRRSFQSLSRSMRIDNDMLMPQACLDRRLSVCDRVMFGHRTSDYDPNYRWGSSDEENGTGDSPITAQYSPMSYGGCFSTEDSDRHTGHSRYCLVASKQMVGVFLTVWVKSDIRDDVHNMKVSCVGRGLMGYLGNKGSISISMSLHQTSFCFICSHLTSGQKDGDELRRNSDVMEILRKTRFPPVLDIGGEYSPQTILEHDRIIWLGDLNYRIAISYRAAKALVEMHDWKTLLENDQLCIEQRQGRVFEGWNEGKIYFPPTYKYSNNSDRYAGDDRHSKQKRRTPAWGLHQLSYVRGESRFSDHRPVYSMFLAEVESVSCNQIKKSSSSRIEVEELFPHSHGYGYTDLNYF

SEQ ID NO: 139886 - protein, 51 aa, Glycine max
  Coding DNA Sequence Number=SeqID_23108
MEYQNGTNIIQVIKQNNAEKQAGNVYCIFWTLLNFEADIDGDVDVKLLTIG

SEQ ID NO: 139887 - protein, 85 aa, Glycine max
  Coding DNA Sequence Number=SeqID_23109
MHENEWHGACLLFAPIREPIGQYLWVSNNYSPTIYNSHGRSLESKRALRRRARARLTGALSKGGKMRGVATNVYFVENVGKTEGN

SEQ ID NO: 139888 - protein, 511 aa, Glycine max
  Coding DNA Sequence Number=SeqID_23110
  Gene Ontology: Mol. function=sulfate porter activity; Cellular component=integral to membrane; Biological process=sulfate transport
  Homolog annotation: Hit_ID=Q1SMI4; Match level="QueryCoverage=100%, HitCoverage=73%, E-value=0.0, Identity=77%"; Hit description =Sulphate transporter
  Pfam annotation: Domain name=Sulfate_transp; Domain location=189-511; Score=433.3; E_value=3.3e-127; Accession=PF00916.10; Description =Sulfate transporter family
MGNADYAYPSGMNVECVHRVAIPPPQPFFKSLKYSMKETFFPDDPFRKFKNQPASKRFLLGLQYFFPIFEWAPKYTLHFLKSDLISGITIASLAIPQGISYAKLANLPPVLGLYSSFIPPLIYAMMGSSRDLAVGTVAVGSLLMASMLGRVVNFNENPNLFLHLAFTATFFAGVLQASLGLFRNHVEECRLGFIVDFLSHATIVGFMGGAATVVCLQQLKSILGLEHFTHEADLVSVMRSVFSQTHEWRWESAVLGCCFIFFLLVTRYFSKRQPKFFWVSAMAPLTSVILGSLLVYLTHAEKHGVQVIGNLKKGLNPPSVTDLVFVSPYMGTAIKTGLVTGIIALAVKYLNLISFGRGHVSKALRTELIDLVQEGIAVGRSFAMFKNYHIDGNKEMIAIGTMNIFGSFTSCYLTTGPFSRSAVNYNAGCKTAASNIIMAIAVMLTLLFLTPLFHFTPLVVLSAIIVSAMLGLIDYQAAIHLWKIDKFDFLVCFTAYVGVVFGSVEIGLVIA

SEQ ID NO: 139889 - protein, 48 aa, Glycine max
  Coding DNA Sequence Number=SeqID_23111
DKPEESSSTPTHAQCICSSLSEAIVSSVLSTRLVLSQISLTRAKRAFE

SEQ ID NO: 139890 - protein, 82 aa, Glycine max
  Coding DNA Sequence Number=SeqID_23112
MDRIDFARILIRTSTLTQVMSFQKFSIEGTLFGIRIVEEIPDTIESEWPRMHEDGGWEKERIPEVISRDPKCYCHEGKGVRR

SEQ ID NO: 139891 - protein, 285 aa, Glycine max
  Coding DNA Sequence Number=SeqID_23113
  Homolog annotation: Hit_ID=Q47522; Match level="QueryCoverage=20%, HitCoverage=77%, E-value=5e-19, Identity=74%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPEFDKLDSQKLVCMGGRCLLPTRTCEWEPSYTLMKKDFGNRCIQLRYTWVQAQRFHMLFSQPFPATNMRTLAAPSTVKQDAGGLCPVLSSHREACLEATCQLAAFLWQGDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 139892 - protein, 140 aa, Glycine max
  Coding DNA Sequence Number=SeqID_23114
MAGTLQVVSVAGEAFVPTCLGSSPSIRKLWMVTGVSGLPGCNYLSLARVRVISGIDVEQEPVVPGDDNIPGGEKLLETLQGSASVDDSAFLATAEAVIARVCCAMQFYFQLFTLLWIPTPYLAWIKINVRSGGTLPYSLE

SEQ ID NO: 139893 - protein, 112 aa, Glycine max
  Coding DNA Sequence Number=SeqID_23115
  Gene Ontology: Mol. function=peptidase activity; Cellular component =anchored to membrane
  Homolog annotation: Hit_ID=Q1RYG6; Match level="QueryCoverage=96%, HitCoverage=58%, E-value=1e-20, Identity=45%"; Hit description=Plant lipid transfer/seed storage/trypsin-alpha amylase inhibitor
  Pfam annotation: Domain name=Tryp_alpha_amyl; Domain location=28-108; Score=29.1; E_value=1.6e-05; Accession=PF00234.12; Description =Protease inhibitorseed storageLTP f
  Subcellular localization annotation: CTP_CleavageSite=72; ConfidenceScore=5.69e-01
MAFQIRVILATLIVASVNLVYGQVSTSCTTSMMSSFTPCANIITGSTNNGLVPPSTCCDLLRSLMSTNMDCACMVISANAPFFQQPLSQALALSLSQACNINGVPLQCKGAN

SEQ ID NO: 139894 - protein, 166 aa, Glycine max
  Coding DNA Sequence Number=SeqID_23116
MVAMGKAQKYENMQLARELSPASSPVEAETPTRTRIPQIRPVLTPRPSASHSSFASPSAFPFFIGILNPGPGSRPSQSYLAAELVLEIGYLFQNNRVDPHKKSNAPLIAMKPNAVEKLLDMMPRIGVKAVANLLIIVARVYERNGPREELKKLQRHIEEAPNLTDL

SEQ ID NO: 139895 - protein, 251 aa, Glycine max
  Coding DNA Sequence Number=SeqID_23117
  Gene Ontology: Mol. function=ammonium transporter activity; Cellular component=membrane; Biological process=transport
  Homolog annotation: Hit_ID=Q93X02; Match level="QueryCoverage=85%, HitCoverage=44%, E-value=1e-107, Identity=84%"; Hit description =Putative ammonium transporter AMT2
  Pfam annotation: Domain name=Ammonium_transp; Domain location=24-251; Score=-174.4; E_value=0.00049; Accession=PF00909.11; Description =Ammonium Transporter Family
MATPLAYQEHLPAAPSWLNKGDNAWQLTAATLVGLQSMPGLVILYASIVKKKWAVNSAFMALYAFAAVLICWVLVCYRMAFGEELLPFWGKGAPALGQKFLTKRAVVNETIHHFHNGTVESPPEEPFYPMASLVYFQFTFAAITLILLAGSVLGRMNIKAWMAFVPLWLIFSYTVGAFSLWGGGFLYQWGVIDYSGGYVIHLSSGIAGLTAAYWMWACDSGFITIFDTVRNCKSNISLKACSYLMGVAMRY

SEQ ID NO: 139896 - protein, 71 aa, Glycine max
  Coding DNA Sequence Number=SeqID_23118
MVICTFRQPGANQPVDAQRLTSSSAPFIIQGQRVRWQAEIPYGRLHLSSTKANQFDGFYSRRLETFKPDDA

SEQ ID NO: 139897 - protein, 195 aa, Glycine max
  Coding DNA Sequence Number=SeqID_23119
  Gene Ontology: Mol. function=translation initiation factor activity; Biological process=translational initiation
  Homolog annotation: Hit_ID=Q1SIP1; Match level="QueryCoverage=86%, HitCoverage=64%, E-value=3e-63, Identity=69%"; Hit description =Translation initiation factor IF5
  Pfam annotation: Domain name=eIF-5_eIF-2B; Domain location=122-189; Score=-11.7; E_value=7.7e-07; Accession=PF01873.8; Description =Domain found in IF2BIF5
MADETPNEMKEEVPEIVPFDPTKKKKKKKITIVDPADEPVEKLAEKTENLSVSEGVETAFTGLKKKKKKPVEMGNLNDESGDAIEDLDDHPEDDEGEMVVPQARYPWEGSDRNYEYEELLGRVFNILRENNPELAGDRRRTVMRPPQVLREGTKKTVFVNFMDLCKTLEKDRLLNPNPSKPSFCGRFTPETTKGL

SEQ ID NO: 139898 - protein, 422 aa, Glycine max
  Coding DNA Sequence Number=SeqID_23120
  Gene Ontology: Mol. function=protein binding; Cellular component =membrane; Biological process=defense response
  Homolog annotation: Hit_ID=Q1SPY2; Match level="QueryCoverage=95%, HitCoverage=21%, E-value=1e-82, Identity=42%"; Hit description =Disease resistance protein; AAA ATPase; Zinc finger, C2H2-type
  Pfam annotation: Domain name=ABC_tran; Domain location=169-299; Score= -52.7; E_value=0.008; Accession=PF00005.17; Description=ABC transporter
  Pfam annotation: Domain name=NACHT; Domain location=169-319; Score= -27.9; E_value=0.0086; Accession=PF05729.3; Description=NACHT domain
  Pfam annotation: Domain name=NB-ARC; Domain location=131-422; Score =178.5; E_value=1.6e-50; Accession=PF00931.13; Description=NB-ARC domain
  Pfam module annotation: Pfam domain module=ABC_tran::NACHT::NB-ARC; Domain location=169-299::169-319::131-422
MGDIVLSIVAKLAEYTVGPILHHARYLCCFNNIAGNLPNAKEELELTRNSVKERVEEAIMRTEKIEPAVEKWLKDVEKVLEEEHMLQERISEVSKSYFRRQFQYFLTKKIARKIEKMAQLNHNSKFEPFSKIAELPGMKYYSSKDFVLFKSRESAYKKLLEALKDKSVSMIGLVGLGGSGKTTLAKEVGKKAEELKLFEKVVMTTVSQTPNIRSIQVQIADKLGLKFVEESEEGRAQRLSERLRTGTTLLILDDLWEKLEFEAIGIPSNENNKGCGVILTTRSREVCISLQCQTIIELNLLAGDEAWDLFKLNANITDDSPYASKGVAPKIVDECRGLPIAIVTVGSTLKGKTVKEWELALSRLKDSEPLDIPKGLRSPYACLGLSYDNLTNELAKSLFLLCSIFPEDHEIDLEDLFRFGRG

SEQ ID NO: 139899 - protein, 40 aa, Glycine max
  Coding DNA Sequence Number=SeqID_23121
MKKGGEIVDGTLTALNYADFEWMVGREDRQNVTVPPYDVL

SEQ ID NO: 139900 - protein, 230 aa, Glycine max
  Coding DNA Sequence Number=SeqID_23122
  Homolog annotation: Hit_ID=Q9AVH2; Match level="QueryCoverage=19%, HitCoverage=15%, E-value=2e-18, Identity=97%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFL

SEQ ID NO: 139901 - protein, 120 aa, Glycine max
  Coding DNA Sequence Number=SeqID_23123
MWDLRLPYEEKGASEVDAGVEAVEVEGSLASLALTLLAPQIETVRSSGFQQFFLIAGNPSLEVLDWAIEVIWPEISAPMFISKIFPGWPSEFKMNPQPGMHKAGSISLKSIGNLQYLEYA

SEQ ID NO: 139902 - protein, 84 aa, Glycine max
  Coding DNA Sequence Number=SeqID_23124
MTTSSSSSVLCRKLEITMPFGEALQQMPLYSKFLKDMCRNLPFGGRATRGLTGASSMRGKCVESPPTFIPGKRQKNRKGVVYEL

SEQ ID NO: 139903 - protein, 50 aa, Glycine max
  Coding DNA Sequence Number=SeqID_23125
MSQPSRLYTMNDKDIGTKKGVQEMEMHLKDDCPLLPIAPQWSTYYTHEAR

SEQ ID NO: 139904 - protein, 511 aa, Glycine max
  Coding DNA Sequence Number=SeqID_23126
  Gene Ontology: Mol. function=transporter activity; Cellular component= membrane; Biological process=transport
  Homolog annotation: Hit_ID=Q9FM07; Match level="QueryCoverage=96%, HitCoverage=96%, E-value=0.0, Identity=80%"; Hit description =Permease 1
  Pfam annotation: Domain name=Xan_ur_permease; Domain location=36-423; Score=155.7; E_value=1.2e-43; Accession=PF00860.11; Description =Permease family
MAGAAPPPKPEELQPHPVKDQLPNVSYCITSPPPWPEAILLGFQHYLVMLGTTVLIPTTLVTQMGGGNEEKAKMIQTLLFVAGINTFFQTLFGTRLPAVIGGSYTFVPTTISIILAGRYSDIVNPQERFERIMRGTQGALIVASTLQIVVGFSGLWRNVVRFLSPLSAVPLVALSGFGLYELGFPVYIPHVMKAEKPIFDRFAVIFSVTIVWIYAHLLTVGGAYKNVPQTTQSTCRTDRAGIISGAPWIRIPYPFQWGAPTFDAGEAFATMAASFVALVESTGAFIAVSRYASATPLPPSVLSRGVGWQGVGILLSGIFGTGNGSSVSVENAGLLALTRVGSRRVVQISAGFMIFFSILGKFGAVFASIPAPIVAALYCLFFAYVGSAGLGFLQFCNLNSFRTKLILGFSIFMGFSVPQYFNEYTAFKNYGPVHTHARWFNDMINVPFSSKAFVAGSLALFLDATLHNKDSQTRKDRGMHWWDRFSSFKTDTRSEEFYSLPFNLNKFFPSV

SEQ ID NO: 139905 - protein, 66 aa, Glycine max
  Coding DNA Sequence Number=SeqID_23127
  Gene Ontology: Mol. function=catalytic activity; Biological process =metabolic process
  Homolog annotation: Hit_ID=Q8VWZ8; Match level="QueryCoverage=56%, HitCoverage=14%, E-value=7e-15, Identity=89%"; Hit description =Sterol 4-alpha-methyl-oxidase
MYTVFIMRKNYVYSGVTISRGVFQTLFHCMGELIYMTIITGCCTPSLQTTPQPLTYMDWYVLDIFC

SEQ ID NO: 139906 - protein, 121 aa, Glycine max
  Coding DNA Sequence Number=SeqID_23128
  Gene Ontology: Cellular component=membrane
  Homolog annotation: Hit_ID=Q8L9I2; Match level="QueryCoverage=90%, HitCoverage=30%, E-value=8e-10, Identity=34%"; Hit description =Nodulin MtN21-like protein
  Pfam annotation: Domain name=DUF6; Domain location=15-117; Score= -2.4; E_value=0.091; Accession=PF00892.11; Description=Integral membrane protein DUF6
  Subcellular localization annotation: CTP_CleavageSite=50; ConfidenceScore=5.46e-01
MQGAVTAAMVVCLFLTVGLNTLIKANMSKGMSNFVFVAYSNLLAFVFLLLATTIRHRNRAPTPITNSIIFRIFLISLLSVSVQTLYYIGLGYSSPTLGSTMEDLVPAYTFIIAIVSRLQQF

SEQ ID NO: 139907 - protein, 162 aa, Glycine max
  Coding DNA Sequence Number=SeqID_23129
  Gene Ontology: Mol. function=carboxypeptidase activity; Cellular component=membrane; Biological process=auxin mediated signaling pathway
  Homolog annotation: Hit_ID=Q9FL08; Match level="QueryCoverage=79%, HitCoverage=35%, E-value=6e-29, Identity=44%"; Hit description =Nodulin-like protein
  Pfam annotation: Domain name=DUF6; Domain location=1-122; Score=10.6; E_value=0.016; Accession=PF00892.11; Description=Integral membrane protein DUF6
MQTWTIKDYPEELILITISTSFSVILSFITAFVAEENPKAWILKPDMKLVCIFYSAIFVMSTRSVVYAWACRKKGAVYVAMFSPLEIVIALAMGVAFLGDALYLGSMIGAAIIAVGFYGVIWGQAQEEKIVCENYEISTIISSSSSEAALLLDQSKGKSSFV

SEQ ID NO: 139908 - protein, 131 aa, Glycine max
  Coding DNA Sequence Number=SeqID_23130
  Gene Ontology: Mol. function=carboxypeptidase activity; Cellular component=membrane
  Homolog annotation: Hit_ID=Q9FL08; Match level="QueryCoverage=92%, HitCoverage=33%, E-value=2e-13, Identity=39%"; Hit description =Nodulin-like protein
  Pfam annotation: Domain name=DUF6; Domain location=22-131; Score= -2.2; E_value=0.088; Accession=PF00892.11; Description=Integral membrane protein DUF6
MGRWVNCRGNIFPFLGMVMAMLAQSGSMVVIKVAMTDGINKYVMVVYSLALSTILLLPFALFLHRSERPPLTFSALCSFFLLAFFGSSGQIMAYVGIDLSSPTLASAMLNLIPAFTFILALIFRILRMLVS

SEQ ID NO: 139909 - protein, 172 aa, Glycine max
  Coding DNA Sequence Number=SeqID_23131
MGETHEIPHHNLADFEPCLGYATEGQAVVDIPLQNTLEGPQYHPQPHPSHSTASKNPHAMAEMGKLDHLEERLRAIEGELFLVPNIITPPKFKVLDFDKYKGTTCPKNHLKMYCRKMGAYAKDEELLIHSFQESLTGVAFTWYTNLEPSRVHSWKDLMVAFVRQCQLILIWL

SEQ ID NO: 139910 - protein, 253 aa, Glycine max
  Coding DNA Sequence Number=SeqID_23132
LSLSALKKFGLVDDEGTKDERRVRVTDLAVQILNHPSSDARETAIKDAALIPPIHREMWEEYGTELPSDANMMWRLTRNRGFTETGAKEFIREWRETMEYAQLSREDASAAHLSNGVGLTDEVATELITGPDPEPERYEPRPEAQLQNAGYGFPAQQAAQIVDSLPRVQDPALQDYKIPIALAGRPPVTITGAFPLSETEWTQFVAILSAMKPVLVGAPMPSADHPSIAAGEQIASTILAQDSEDPESPTEAP

SEQ ID NO: 139911 - protein, 254 aa, Glycine max
  Coding DNA Sequence Number=SeqID_23133
DSSNQSGWWNPLVLDGDETYFAFNVPGSESAKHQVNVAVRAGDGTWTSGCLRLATGACAEYLDDNGHNQPSIAIDGDGYIHAFVSMHHEPWKYFRSTAPYDATSLVDVSAEMPDAGAAVSYPVTAQGADGDIWLMVRIGADPQARRDGVLYHYDPVAGTWSRETTIAAAVNHSFYPDDLEVDANGKVHVLWEWGPWPADPYRHLGSYAVYDPTTGTFRDIADQALPTPIRPDTPGAVVWRGYEPGETIGDAVPA

SEQ ID NO: 139912 - protein, 419 aa, Glycine max
  Coding DNA Sequence Number=SeqID_23134
  Gene Ontology: Mol. function=RNA-directed DNA polymerase activity; Biological process=RNA-dependent DNA replication
MTYSAPLIHTIQQEVEPIFQAENVVAFDKMEELQERFDGMQREVEALRGRDLFGKDACELCLVPNVTIPHKFKVPDFEKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTGESVPAASNAKKFGGHFAKKKDQEVGMVAHGKPQQNFTPYRQVANVASAIPNPSYHQQRPHYPYPYPPQQYPPQQYPPQQYPPQQYPPQQYHQPQYPQKQQNRPQPPQQPYHSQNRQKTTFDPIPMKYADLLPALLAKNLVQVRTPPRTPDVLPPWFRHDLTCAFHQGAPGHDVENCYVLKNE

SEQ ID NO: 139913 - protein, 58 aa, Glycine max
  Coding DNA Sequence Number=SeqID_23135
ATHTPVSPSSIKHERKLGSEGKLPGSHIINETSRRVELHPQKETTPEYLAFHRFKHKT

SEQ ID NO: 139914 - protein, 213 aa, Glycine max
  Coding DNA Sequence Number=SeqID_23136
  Homolog annotation: Hit_ID=Q84VH5; Match level="QueryCoverage=81%, HitCoverage=29%, E-value=1e-75, Identity=74%"; Hit description =Envelope-like protein
PTNGVIDIDVSEHQIAKEITAKRVQHWPKKGKLSAGKLSVKYAILHRIGAANWVPTNHTSTVATESFAVKLPIAFPTVLCGIMLSQHPNMLNYTDSVIKRESPLSLHYKLFEGTHVPDIVSTSGKAAASGAVSKDALIAELKDTCKVLEATIKANTEKKMELERLIKRLSESGIDGEAAEEDGEAAEAEEEAAEEEEEAAEETESDDDSEATP

SEQ ID NO: 139915 - protein, 112 aa, Glycine max
  Coding DNA Sequence Number=SeqID_23137
  Subcellular localization annotation: CTP_CleavageSite=56; ConfidenceScore=5.01e-01
MVGAGLKKDLRVSRVVPGGLLMPSFSSHRSYFTKTCHGKEEGGTSTLGERSTTDSCAMIYFTGEVSAQLVELRSCNWVVAITGWMSNCPGEDRNMPLKDSTETKTGCQERRG

SEQ ID NO: 139916 - protein, 137 aa, Glycine max
  Coding DNA Sequence Number=SeqID_23138
MVTHHVHILVKSPAFVDHPTFFYHGPRSRWHTETPDGNPHTPFAIQRSESLVACRDALRLSAPFQCGHLHPFRRCQHLPVETISVSHFSQELHPEHDSIQRLTSSSAPFVNRGQQAGLHAEIYVLLRAFCHTDPEIR

SEQ ID NO: 139917 - protein, 58 aa, Glycine max
  Coding DNA Sequence Number=SeqID_23139
MVKVVSRTFPLDLMMKSVHFQWAKRACTAKRSFIALSAKENLAKHHHQGCALSARSMS

SEQ ID NO: 139918 - protein, 64 aa, Glycine max
  Coding DNA Sequence Number=SeqID_23140
MEKIQKSTSRDNSQGKFHGLSATMHHQKRKTLDEASLSSSESKTQHDRRSTSTPYGSHRPGYRT

SEQ ID NO: 139919 - protein, 78 aa, Glycine max
  Coding DNA Sequence Number=SeqID_23141
MAGIFFLLKQQNNLENYERFRGVTLSHTLCVFLPSCLEHGRVTDSQDCCVYKIGMAGRGRDQNRDVLDRITAVLETLV

SEQ ID NO: 139920 - protein, 55 aa, Glycine max
  Coding DNA Sequence Number=SeqID_23142
MERCLSSMFSNLAVLLPSLTQLVVLHSAQQPILELAHPWPEWVQLMKCLLDKGYF

SEQ ID NO: 139921 - protein, 130 aa, Glycine max
  Coding DNA Sequence Number=SeqID_23143
MSGRSSTRQFPSRKLGGNGRTKSDPLGESSSHIATTWPSCPRPALIKLLQMWQGGPPLTSHPKRECHTLISSGDHPFVGMRPSFDHFEGVQIATRPTWAESSPEGGAFWRKNPSSPGRAGWQAPPSLSYK

SEQ ID NO: 139922 - protein, 403 aa, Glycine max
  Coding DNA Sequence Number=SeqID_23144
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=97%, HitCoverage=82%, E-value=0.0, Identity=84%"; Hit description=ATP synthase subunit alpha
  Pfam annotation: Domain name=ATP-synt_ab; Domain location=73-262; Score=272.2; E_value=1e-78; Accession=PF00006.15; Description=ATP synthase alphabeta family, nucleotide-binding domain
  Pfam annotation: Domain name=ATP-synt_ab_C; Domain location=274-374; Score=127.9; E_value=2.8e-35; Accession=PF00306.17; Description=ATP synthase alphabeta chain, C terminal domain
  Pfam module annotation: Pfam domain module=ATP-synt_ab::ATP-synt_ab _C; Domain location=73-262::274-374
MGDGLMIQEGSSVKATGRIAQIPVSEAYLGRVINALAKPIDGRGEISASESRLIESPAPGIISRRSVYEPLQTGLIAIDSMIPIGRGQRELIIGDRQTGKTAVSTDTILNQQGQNVICVYVAIGQKASFVAQVVNTLQERGAMEYTIVVAETADSPATLQYLAPYTGAALAEYFMYRERHTLIIYDYLSKQAQAYRQIAAKLSSQLGEGSMTALPIVETQSGDVSAYIPTNVISITDGQIFLSADLFNAGIRPAINVGISVSRVGSAAQIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQ

SEQ ID NO: 139923 - protein, 72 aa, Glycine max
  Coding DNA Sequence Number=SeqID_23145
MEDAPVSPRVALSPKVNIASAANLSAQVNCHPMLNGTNFKVGKEAIEIVLGCMDLDLAPRTEQPTSTLETSN

SEQ ID NO: 139924 - protein, 94 aa, Glycine max
  Coding DNA Sequence Number=SeqID_23146
  Subcellular localization annotation: CTP_CleavageSite=37; ConfidenceScore=5.00e-01
MSASSDRHYEKVSFAIRKTQSTIASSGYGRPLHRSRRSSSDQHYEKVSFAIQKTQSTIASSGYGRPLHLSRRCPLLQAETMKKFYLLSIRLKGR

SEQ ID NO: 139925 - protein, 105 aa, Glycine max
  Coding DNA Sequence Number=SeqID_23147
GIEHHIDLIPAASLPKCLNSYAKVGAINNITIKYRHPIPRKDVRSRHQRLFVENVGKNQRKPVTTKFLSSGVVFTFEEGISTSHVDKSGALAPTYPPSKRKSDLR

SEQ ID NO: 139926 - protein, 101 aa, Glycine max
  Coding DNA Sequence Number=SeqID_23148
MVDLCVICGCGESTCTIARSPPSTTYDGVVHGDMSRGSGDLGDVRRAPGSQPIKEQRPQSKEACVVASQLWILSDIWNMAFGNRLPRVCNRLPGLKMGSGS

SEQ ID NO: 139927 - protein, 110 aa, Glycine max
  Coding DNA Sequence Number=SeqID_23149
MHSTYKEEPTEDLALHIWEASFTTKRREKGRIEEIQVVGMSPPPLEPHNHSQTHLKLSGRLPLQAPFSGMDSSGVLSWTSPRSTNMHNSFFFQILPRAQSKECCAQQMAR

SEQ ID NO: 139928 - protein, 132 aa, Glycine max
  Coding DNA Sequence Number=SeqID_23150
MNLERTVENLRVITHGNITETLRKRLGLNFLHGNNFPKQFRERENKIGEKLAAQLAQASKVASSRSNSLLEESSGGPKWAWLLFAPPFLLNTPPAFFLLSKKLQKPTDCAKTPLFDFRHITEFHGLRKPASF

SEQ ID NO: 139929 - protein, 119 aa, Glycine max
  Coding DNA Sequence Number=SeqID_23151
MTVADNIKITLPKTDNTKMFMGLVGEHSQTTDKSLAGTLMSTRTIMKFDGSHTTHELVIEMANVATRLKTLGMDEETRLKNQGSHSVYYVSHQGNQGAGRKKHDKGLGPLKINDDPVQI

SEQ ID NO: 139930 - protein, 134 aa, Glycine max
  Coding DNA Sequence Number=SeqID_23152
  Gene Ontology: Mol. function=metabotropic glutamate, GABA-B-like receptor activity; Cellular component=membrane; Biological process =amino acid transport
  Homolog annotation: Hit_ID=Q0K9G7; Match level="QueryCoverage=95%, HitCoverage=32%, E-value=5e-42, Identity=67%"; Hit description=ABC -type transporter, periplasmic component precursor
MKRILLATLAGLCLSSAAMAKDFVVAHVYDKTGPLEAYAKQTHNGLMLGLEYATQGTMTVAGRKIRVIEKDNQGKPDVARAQLASAYADDDADIAVGPTSSGVALAMLPIAEEYEKILLVEPAVADSITGDKWN

SEQ ID NO: 139931 - protein, 116 aa, Glycine max
  Coding DNA Sequence Number=SeqID_23153
MEKSEKKNFSEKKMKKAYITWDDNDMESSEDSKNEEINLCVMAKSYERDEEDINLKNNKNFIKTSLLPHKNIILVLSLAFTVEEKGMVSYPNFVRGLLLDDMRLFFGPCKVLGTHH

SEQ ID NO: 139932 - protein, 63 aa, Glycine max
  Coding DNA Sequence Number=SeqID_23154
MHETQCGPLRVHRMNRKAWFEDPRCRIQCPDILPENTGVAVQCKIKVKCRSEAAGSTMSDTMS

SEQ ID NO: 139933 - protein, 84 aa, Glycine max
  Coding DNA Sequence Number=SeqID_23155
MVIDYQWLISRYHPRYIAGQPPHKPPCFVDFVLLLVDCQELACLGTSQDWPSLVLGNSTPPDVPKVSRPPRHISKYHSMVNKQK

SEQ ID NO: 139934 - protein, 58 aa, Glycine max
  Coding DNA Sequence Number=SeqID_23156
MPPSTVAQAAGEGNQPAVEVGPIIGIVEVASGAPSLEATLDAEVDAPTTSTSPIVAPS

SEQ ID NO: 139935 - protein, 86 aa, Glycine max
  Coding DNA Sequence Number=SeqID_23157
MDFEICQIVPKKAVKFCALKLCLCAEKCLCIAGYGKENRKEKLDSRPAPPDKVRVEVLNCIMVFFKSVYYANEKGYVHCTFKIHLC

SEQ ID NO: 139936 - protein, 101 aa, Glycine max
  Coding DNA Sequence Number=SeqID_23158
MSSIFGPDVLDIVSDIVDPAASMLLATPVFSGQMSWTSYEQLCKWDQQLPLSESSSTAEILQVGSRFQDVKTPHVTSAFCSPCLHALTAVKQFTAASSISY

SEQ ID NO: 139937 - protein, 64 aa, Glycine max
  Coding DNA Sequence Number=SeqID_23159
MDNIELSSRYGSKLAYDTRIGAGLVADLGTTFVVDWVVGPLMVVFHHGDAAEDKGEEGRGGAIH

SEQ ID NO: 139938 - protein, 56 aa, Glycine max
  Coding DNA Sequence Number=SeqID_23160
MAHNPIGYAFKLFWVKNYFREENPSRGASITLLRRFRKQIHEGFPPFFIVLHSFFN

SEQ ID NO: 139939 - protein, 93 aa, Glycine max
  Coding DNA Sequence Number=SeqID_23161
  Gene Ontology: Mol. function=RNA-directed DNA polymerase activity; Biological process=RNA-dependent DNA replication
  Pfam annotation: Domain name=AT_hook; Domain location=33-45; Score =14.9; E_value=0.061; Accession=PF02178.9; Description=AT hook motif
MVENRLRWFGHVERRPVDSVVRRVDQMERRQTIRGRGRPKKTIREVIKKDLELNDLDRSMTLVSPFMSHKEAIISHLSWASLFLGFHTLTLCP

SEQ ID NO: 139940 - protein, 80 aa, Glycine max
  Coding DNA Sequence Number=SeqID_23162
MEILILGQGLRWFEVLGQKACRTAEHDVCQGVGMASSSRIKGMSHIYFHDTHTTMMIWKFYAKVMHTPMWTLKHQVFMVM

SEQ ID NO: 139941 - protein, 143 aa, Glycine max
  Coding DNA Sequence Number=SeqID_23163
MGEVEEVQEQMATMMEAMMSMKKIMEANAVTVAATSTVAKVNPMPSSGLNQMNHPTLNMVGKDLGSRDGPHDVQIQNKYTFPPYGSPPKEDANNFAPILIESQQPQTNHAHVSQTVEETHEIAHHNPANSEPCLGYATEGQAV

SEQ ID NO: 139942 - protein, 70 aa, Glycine max
  Coding DNA Sequence Number=SeqID_23164
MSHAVKDNRGKWAPNYEGPFVMGQNQLGVVRCHDEVGGRNPSSQNGNTTTVYHTMLFPTFRYLGMDASRG

SEQ ID NO: 139943 - protein, 56 aa, Glycine max
  Coding DNA Sequence Number=SeqID_23165
MTNLMEMASNLDSPQKLLLTKVIFINDNTFSQASLAADQARFIKTVKLPPDEDIND

SEQ ID NO: 139944 - protein, 158 aa, Glycine max
  Coding DNA Sequence Number=SeqID_23166
  Gene Ontology: Mol. function=ubiquitin thiolesterase activity; Biological process=ubiquitin-dependent protein catabolic process
  Homolog annotation: Hit_ID=Q9FG10; Match level="QueryCoverage=89%, HitCoverage=12%, E-value=1e-37, Identity=54%"; Hit description =Ubiquitin carboxyl-terminal hydrolase
MTLMTPPPMDQQQQQQEHDEMLVPRSDLPEGPQPMEAAQAEIPSTVDAPTVDAPTVDDTPTAKFTWTIDNFSSISQKLFSDIFCVGGYKWRILIFPKGNGAGHLSMYIDVADSATLPYGWSRYAHFNLTVVNQIHSKYSIRKDLWSPNTSYIARIRHP

SEQ ID NO: 139945 - protein, 345 aa, Glycine max
  Coding DNA Sequence Number=SeqID_23167
  Gene Ontology: Mol. function=RNA-directed DNA polymerase activity; Biological process=RNA-dependent DNA replication
  Homolog annotation: Hit_ID=Q1RXD8; Match level="QueryCoverage=50%, HitCoverage=24%, E-value=1e-12, Identity=25%"; Hit description=RNA -directed DNA polymerase
GLTGLMREAQEKNFFEGFKGSKEGGREVGEAAMVVPVRGKFRLVEDRLGELGENLSSKGEWENCGQKYWTPDIEVGGVWMNPEGIVEILFGAEIDIAAKFMEDIEGVVMQTNKQDSWCWGVDPSKRYIVGSAYKLLSRHSSNENNDGVFNELWKLKVPSKASHFARSAFLVKHCGSPCLGWESLSWVNNVGVFPQDPRQHFLQHGSIAADGLRINRWRCWWLAVTWTIWKKRNDIIFSNDSFDNNKLMDETAFLMWTWLRNLEKDFVTHFNHWSSNLREGAQRSLPSTFSQLSQGYQNSEMANMVDFLDLVHMIWLKNLEKGFDIPFHSWASNIGSGFVLGGIAL

SEQ ID NO: 139946 - protein, 411 aa, Glycine max
  Coding DNA Sequence Number=SeqID_23168
  Gene Ontology: Mol. function=ubiquitin thiolesterase activity; Cellular component=nucleus; Biological process=ubiquitin-dependent protein catabolic process
  Homolog annotation: Hit_ID=Q9FG10; Match level="QueryCoverage=65%, HitCoverage=23%, E-value=1e-140, Identity=88%"; Hit description =Ubiquitin carboxyl-terminal hydrolase
  Pfam annotation: Domain name=UCH; Domain location=193-410; Score =36.2; E_value=1e-08; Accession=PF00443.19; Description=Ubiquitin carboxyl-terminal hydrolase
MLHVPLLGVVEAGPITHALSVSLSTSLSHLYPGTEYWVAKNDGWERGEWVQLFREEKNKNAAKKQKALNLPFAMCKLLGCFEAFGATSPGVGCSMCQDLFKPFKTSVNTCASCAGPEFSPHFCPIIIIPIDYSSDSQHQFNARESDWGFINFMPLAELYDPARGYLVNDTCIVEADISVRKDMDWSYDSKKETGYVGLKNQGATCYMNSLLQTLYHISYFRKAVYHMPTTENDMPSVSIPLALQSLFYKLQYSDTSVATKELTTSFGWDTYDSFMQHDVQELNRVLCEKLEGKMKGTVVEGTIQQLFEGHHMNYIECINVDYKSTRKESFYDLQLDVKGCKDVYASFDKYVEVEQLEGDNKYHAEHYGLQDARKGMLFIDFPPVLQLQLKRFEYDCTRDTMVKEHLTSSLV

SEQ ID NO: 139947 - protein, 840 aa, Glycine max
  Coding DNA Sequence Number=SeqID_23169
MGQKCGLNSGPAQLAQVFTEVLKGLKRVQIEKLKCNHTYDVSSKATVQGKAEGLHDSPADTSQIDGAVITTTITPDTCYSPHQGRWPQKLQNNLKVCTLQRAAEPTLPFPSHHFWQPSIQYRGRDERVRFPEDMREKELWIEFKKWGDIREVFIARNQNKSGPTHESPEAWKGIESDKDSQQETPAKGGGSHREVSMWQNGGHRSMRSIKYDLLLIYPTITRSTNKMTWLTKAWIGRLRNLMAFDQCCQMAVMTAPWRGGFLKKRHQIAMALRVSNGSLHRFNNARTNTSTTRTPKLLKSMTAPPPGEFSHDLTRSRCRHHTSTTHQREFSHEELMRDGGEEIKPKYIGDDMVLLMGLNDTRAEELRREGVESGLSMFHTLEKWSPSLRPGFRLMWVMCWGILLHAWDAENITKIVEGIREMVDVDEDVDDLQKRGGEGSEVRMDILSKEAQVDGKLPGTNTATGAEGDEPERNIGLQQLPAGYYTNYVTMINNYARRSYSLNGDPTQFGLGEERTEQKADEIDALGGSQLIIFEENHCDGDRDDNTKQGQTEKVEYVEEADATPSNEGERNNKKGKSGEERDPHLKTKFELKELYREARDLTQEWEKDNPLSGPTVKVADGKTVEKFNDLGLKLNGPSHTWKAASPKQNGGSGLKEVVTWEGKYKVMQGSVSTPKSCEMVKEAASNWEMAKYLGEGKQCQCLMKIVTYNIRGPGWGLKWTPIKKLMRKEHVDMLCLQETKKEVIDKALCQALWGDVEVRWEMQQAINSVGGLFCIWSDKTFKMEKQGGGSLKEFNDWIGDLEVEDMPSCMYKIVAKLLSRRLKKVLPCIIDERQSAYME

SEQ ID NO: 139948 - protein, 168 aa, Glycine max
  Coding DNA Sequence Number=SeqID_23170
  Gene Ontology: Mol. function=ubiquitin thiolesterase activity; Cellular component=nucleus; Biological process=ubiquitin-dependent protein catabolic process
  Homolog annotation: Hit_ID=Q2R2A3; Match level="QueryCoverage=97%, HitCoverage=10%, E-value=3e-54, Identity=64%"; Hit description =Ubiquitin carboxyl-terminal hydrolase family protein, expressed
MGDSKKIPEEEKNLGSHDRLIHVYHFLKDTTQNQQVQNFGHPFLLVIREGETLAEVKLRIQKKLQVPDEEFSKWKFAFLSFGRPEYLQDSDIVSTRFQRRDIYGAWEQYLGLEHIDSASKRSNTANQLHLKRSEGNNESGEATNLLKGSLLKTIIFLAEVVGVVYSLQ

SEQ ID NO: 139949 - protein, 69 aa, Glycine max
  Coding DNA Sequence Number=SeqID_23171
PIAFAHRHRVVTLVAEDVEHMHHAADEVHEQSQEAVTDDACADAQGFPSEPHDTSILTEYVHHVAPTYP

SEQ ID NO: 139950 - protein, 89 aa, Glycine max
  Coding DNA Sequence Number=SeqID_23172
MKLSFYTNEDGTSVIIDAKLRLHQLCRIKRWPKPKYMSSWRCVRAIQIAAEDGIFQMSGHEKFPVTNSENSVASFDASSLTRAKSTDHL

SEQ ID NO: 139951 - protein, 69 aa, Glycine max
  Coding DNA Sequence Number=SeqID_23173
MSMSPMAFHSRNVGLSKGHSYYNHCQQYRHKSALASEGLSTGSPPATWKEDPPTELSFRAMRLLKSTLY

SEQ ID NO: 139952 - protein, 85 aa, Glycine max
  Coding DNA Sequence Number=SeqID_23174
MARAKKTGQMMSQVAKEIADKIASQGSFIAHGCQDVLTTAIGRLEHPGRLRAGLALSPKPEVGPSAAHINTKESCVDPSGNDPDT

SEQ ID NO: 139953 - protein, 188 aa, Glycine max
  Coding DNA Sequence Number=SeqID_23175
  Homolog annotation: Hit_ID=Q47522; Match level="QueryCoverage=30%, HitCoverage=77%, E-value=2e-19, Identity=74%"; Hit description=LacZ protein
VPPVQLLTGWCVTAKAPPDISAGKCSGHAARRVPFAIQAAQLLGRAIGAGLFAITPAGERGMCCKAIKLGNARVFPGRLSILNLHNVVNPVDASRANLKNKEKIEELMLEWGSELQNQQIEIKLIDTVDLEGGPVGKPVVPAALMNRPTRGERRFAYWALAECILAYYVGTDEGVSEVLHVAREKRLH

SEQ ID NO: 139954 - protein, 173 aa, Glycine max
  Coding DNA Sequence Number=SeqID_23176
  Gene Ontology: Mol. function=zinc ion binding; Cellular component =integral to membrane; Biological process=ubiquitin cycle
  Homolog annotation: Hit_ID=Q1T0Q0; Match level="QueryCoverage=99%, HitCoverage=99%, E-value=2e-19, Identity=31%"; Hit description=Zinc finger, RING-type; RINGv
  Pfam annotation: Domain name=zf-C3HC4; Domain location=108-149; Score= 44.0; E_value=5e-10; Accession=PF00097.15; Description=Zinc finger, C3HC4 type (RING finger)
MNNTSNSDHGMNNPSEEHNGSYAYYSVGLSLGILLMIALISLISFYCSHRSLQNSQVSVTANTSMELDSALTIQVHQQNSFVNNYPVLLFSEAKHHRPDSETMTSSCCSICLADYKDTDCVKLLSNCGHLFHRECIDRWLQVNLSCPMCRNSPLPSPLSTPLAEATPLVTRRD

SEQ ID NO: 139955 - protein, 161 aa, Glycine max
  Coding DNA Sequence Number=SeqID_23177
  Gene Ontology: Mol. function=RNA-directed DNA polymerase activity; Cellular component=oxygen evolving complex; Biological process=DNA integration
MDAENVFLNGDLEEEVYMIPPLCVSHNPWEVCKLKKALYGLKQAPRACCLCSSMGIFHMDVKNVFLNGDLEEEVYMIPPLCVSHNPWEVCKLKKDFYGLKQAPQAWFEKFSIVIASLGFRYSDYDAALFLKNTPHGNIIISLYDDDMIITWDNVDGIIELG

SEQ ID NO: 139956 - protein, 233 aa, Glycine max
  Coding DNA Sequence Number=SeqID_23178
  Gene Ontology: Mol. function=protein dimerization activity; Biological process=regulation of transcription, DNA-dependent
  Homolog annotation: Hit_ID=Q1S570; Match level="QueryCoverage=76%, HitCoverage=43%, E-value=2e-40, Identity=46%"; Hit description=Zinc finger, TTF-type
  Subcellular localization annotation: CTP_CleavageSite=46; ConfidenceScore=5.14e-01
MSQCCASLASCRRALHWWRHRGVPSFVVGASLLTPFWASNPSTLPSSSQEQQFKVPRIEEVDISSLEKDPGKRLSIWKYPIDQRDKIRRAYINAGSYQPKNIVFSTSTIGKHRQQFQPSWYNKFRSWLEYSPHKDVVFCLPCYLFNKNHGDRNDGRHTFAEMRFRNWKKVNDGKNCAFLFQEGVGPNLMHKRCLKFCDDLLDQSQHIEKVFDKQSVEIIANNCLQLKISIDAV

SEQ ID NO: 139957 - protein, 100 aa, Glycine max
  Coding DNA Sequence Number=SeqID_23179
MKYQFNIPNLFNVIVILVFLAADDDFPYFITFVIEGDLITMGEITVGKELISWLYNISVANSNVKEHNIPLQWRSKFSKDCHVLAADINMCNGTIWKSLQ

SEQ ID NO: 139958 - protein, 42 aa, Glycine max
  Coding DNA Sequence Number=SeqID_23180
MADTKLSAACVDRLEAAMAKLAAAQTSMASKLDVILRILNTM

SEQ ID NO: 139959 - protein, 474 aa, Glycine max
  Coding DNA Sequence Number=SeqID_23181
  Gene Ontology: Mol. function=helicase activity; Biological process =viral genome replication
  Homolog annotation: Hit_ID=Q9LTU4; Match level="QueryCoverage=97%, HitCoverage=32%, E-value=1e-98, Identity=43%"; Hit description =Helicase-like protein
  Pfam annotation: Domain name=DUF889; Domain location=317-474; Score =118.0; E_value=2.6e-32; Accession=PF05970.5; Description=Eukaryotic protein of unknown function (DUF889)
MRLTACKGATSFEDIRTVTNIQYPTYREACFAMGFLQDDKEFVEAIKEAKDWGTTNYLRKLFVLMLLIGAINKPEEVSNQTWHWLADDIAYHYSKSTINTELHIDDNHLSNLALLEIEQLLHVNQKSLKDYPSIPYPEDVDCTSYLDNSLILAELNYNNDETISEFLQLFSSMIDEQTSIYNQIIEVVNKNQGGMFFLYGFGGTGKTFIWRTLETSLRANNQIVIIVASSGIASLLLLGSRTAHSKFKIPVPIFEDSTCNIHQGSELAELLNQTNLIIWDKAPMAHKFCFEAFDQSLRDIIKTKPSSNQIFGGKVIVFGGDFRQILPVIPRGSRSDIVNATINSSYLWDCCQVLRLTKNMRLQNNEQSPDEQETTTFAKGILDIGDGIIGHENDGYSTIEIPEDLLITEYDDLIHAIVNSTFPDLSQHHNDPQFFNSRAILASTNETVEQVNDYILSLIPGNHRITNVIGITSI

SEQ ID NO: 139960 - protein, 54 aa, Glycine max
  Coding DNA Sequence Number=SeqID_23182
MACAPDNIKSINGSKETLKLVVRITDLWFVGTPNRSEQAEMVIIDSHGDAIHVV

SEQ ID NO: 139961 - protein, 107 aa, Glycine max
  Coding DNA Sequence Number=SeqID_23183
MHMGEPKKGQQGRAYAKRNTHWLRARKNLEEDELYRSPIGNLVPLDLEIEATLRRNRAERRRKLLPDSIVASILEEETLFSDSLSPDSPSTRESTTQLPETASMEDE

SEQ ID NO: 139962 - protein, 378 aa, Glycine max
  Coding DNA Sequence Number=SeqID_23184
  Gene Ontology: Mol. function=arylesterase activity; Cellular component=membrane; Biological process=electron transport
  Homolog annotation: Hit_ID=Q1GYW6; Match level="QueryCoverage=99%, HitCoverage=100%, E-value=2e-52, Identity=34%"; Hit description=40 -residue YVTN beta-propeller repeat
VTTLAVGDHPYCATTDHRGQRLFVTNTGEDSVTVIDLASRRTIGKIRVPGTPEGIAYDAVRQQVLVASWMDNVLAVIDDTAQVLKSAIKVGSQPRAFGQFIGHAHISPCSGQLLQQLADFFEGRSMQTKLSNLILAGALASFCSSVFSQPLAYVPNEKDGAVTVIDTSTDQVINTLPKKGKLGKKVQAAAIHPSNQKLYVVVRDKNAVSVVDTQLGKQTALIKVGDEPEGIDISADGKLLAACLEEENAVALVDLQLNKVKRTIATQGKNPEHCVFSPDQQWLLASNEESNNVDVINLNTFKSEHLIAATKHPRGVGFSPDGKWAYVANEAASLLEIVSTADWKVQANIKVGLRSNGVKVNADGSRIYVSNGGDHNLS

SEQ ID NO: 139963 - protein, 163 aa, Glycine max
  Coding DNA Sequence Number=SeqID_23185
  Homolog annotation: Hit_ID=Q1RXS1; Match level="QueryCoverage=47%, HitCoverage=21%, E-value=6e-07, Identity=34%"; Hit description=Zinc finger, CCHC-type; Peptidase aspartic, catalytic
  Pfam annotation: Domain name=zf-CCHC; Domain location=90-107; Score =22.8; E_value=0.00017; Accession=PF00098.13; Description=Zinc knuckle
  Subcellular localization annotation: CTP_CleavageSite=59; ConfidenceScore=5.06e-01
MKEGIGHILDITPIGGKRNKSLKRLTLTSHTSMGRTMKSTSKSYGTHSYPKKDQGQSILGATTSKPKDDKRKTIEKQPPKASMQEKTSSIKCFKCLGRGHITSQCPTKKTMIMRSQDIHSSQDEATTSPSSSESEEAKWEESSEEIYPQEEGQPLMVKDEFKE

SEQ ID NO: 139964 - protein, 208 aa, Glycine max
  Coding DNA Sequence Number=SeqID_23186
  Gene Ontology: Mol. function=serine-type peptidase activity; Biological process=regulation of transcription
  Homolog annotation: Hit_ID=Q31HB9; Match level="QueryCoverage=86%, HitCoverage=87%, E-value=3e-21, Identity=35%"; Hit description =LexA/MucA/RumA/RuvA family protein
  Pfam annotation: Domain name=Peptidase_S24; Domain location=120-191; Score=59.1; E_value=1.5e-14; Accession=PF00717.13; Description =Peptidase family S24
METEHQKPKGGKRPGAGRKPGSTTCLEKTVVIRIPASQKPLVSQLMEAYVKKSKNLQLAHNLDPVAVFDQPASDMREISLPLFQSKVPAGFPSPADDHIESRLDPNEYLIDQVDSTFFVTIQGESMIEAGLMPGDKAVVDKGKVPVVGDIVLAMIDGEFTVKTLARQKNGNPKLIPANASGKYAPILIEPAMQFEVWGVVIGSFRRFR

SEQ ID NO: 139965 - protein, 70 aa, Glycine max
  Coding DNA Sequence Number=SeqID_23187
MKTQPLTETQNLPRWWNNKTKLQVLNVDNEPPNARQTNLQGKQTVPRGEEARTSSRKQPNDTGKRDVRNA

SEQ ID NO: 139966 - protein, 107 aa, Glycine max
  Coding DNA Sequence Number=SeqID_23188
METAKGTTTEITASNQNQNGRNKAEKKAQYQVNVMWSASRGRLRRVFWVKNDDLEAKKLLELEKFMGVSFIQNEHNALKDLGKMKKRDQEELRLIEEKTKKGEKNGD

SEQ ID NO: 139967 - protein, 326 aa, Glycine max
  Coding DNA Sequence Number=SeqID_23189
  Gene Ontology: Mol. function=RNA-directed DNA polymerase activity; Biological process=RNA-dependent DNA replication
  Pfam annotation: Domain name=zf-C3HC4; Domain location=265-306; Score= 34.1; E_value=4.8e-07; Accession=PF00097.15; Description=Zinc finger, C3HC4 type (RING finger)
MREWNLGEFGCLESRKKALKEISMLDKKEEEKGLSVEEIQGRWVEEPRNIKEEMTSFFEKRFREQEREVKEAIWEYGSQKSFDPDRINFKFVKTVWETWKCNILRFLNEFHSYGILPRGRNASFIVLLLKVDDLQHLGEFGPISLVGCTYKMLTKVLANRLKVVLPRIIDGRQNTFLENKYLLDSVITVIRYTLYYCTHQLQNKRGSAIDNISINTTTSTEQGFALIIRVREEEQAIWNSYPLLLYFEAELHRPDSATTTASLCCSICLADYKNTEWLKLLPDCGHMFHRDCIDMWLQLNLTCPLCRTSPLLTLLTGVAPMATRRA

SEQ ID NO: 139968 - protein, 157 aa, Glycine max
  Coding DNA Sequence Number=SeqID_23190
  Homolog annotation: Hit_ID=Q9MD97; Match level="QueryCoverage=20%, HitCoverage=59%, E-value=2e-11, Identity=87%"; Hit description =Hypothetical protein rps12
MDVDKILPSSSTLGWHSLKVKGEVQTKKGLWWIPRHPETRKGVVSDEMLRGVENKRRSGDSRYRGKESKSDSRSSGERNGSSLNRENGVVGELYKCRAARRSSRECCTLDGESPVAESITSLRSDPSSMGHVESRVNQQGPPCKAKYSWVTDSEVVP

SEQ ID NO: 139969 - protein, 85 aa, Glycine max
  Coding DNA Sequence Number=SeqID_23191
MLFTIQFHTPPPLGFAKKCLWREKYASHEAVQNGGFNPFSFSLTFGNSIRAISGKIEESQKIARDATIAVRRHMSPLRGILRGLN

SEQ ID NO: 139970 - protein, 152 aa, Glycine max
  Coding DNA Sequence Number=SeqID_23192
AQPPRNVSNLHGDNDDDDYLVSNSYVEEYLDEDDSIDGISDTDDEVTDMIQLVRIVHPAEGVQGIQNPFWNDALHYNNINWSHPDEEGICGFEMPSSFNVGQELYVGIDFDSKDAVKQYVMKVHQSFKVIESKSNKYVVCCLNKSADCPCHL

SEQ ID NO: 139971 - protein, 150 aa, Glycine max
  Coding DNA Sequence Number=SeqID_23193
  Homolog annotation: Hit_ID=Q9AVH2; Match level="QueryCoverage=31%, HitCoverage=16%, E-value=3e-20, Identity=97%"; Hit description =Putative senescence-associated protein
MARHKVTRTHTHTHSRRHKGEEGLGREGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 139972 - protein, 144 aa, Glycine max
  Coding DNA Sequence Number=SeqID_23194
MIIETLKIEQRMLSRNLNGHKFSLGCLIQANNVSRRSKVNTKALGNSNDHKCFTQVVVIIKKRENVNHAGFDDVKMNLLDNESHHQKGGECESSLLQDFFKIKPCLKTKGFKVMQGSGNRLPGSVIDYDEDMTDYQKGSLKKSC

SEQ ID NO: 139973 - protein, 59 aa, Glycine max
  Coding DNA Sequence Number=SeqID_23195
MKDIELVEEEHARIGADPSTEAVEHTNKRDTGHQNLALDNKTGDSTMLKMGDSAKVVIK

SEQ ID NO: 139974 - protein, 89 aa, Glycine max
  Coding DNA Sequence Number=SeqID_23196
  Subcellular localization annotation: CTP_CleavageSite=45; ConfidenceScore=5.12e-01
MNSLSALFSCGKCTGSRGLVGACALSTNLDRLACISEFRLSVRLLAQRVDSSGALSRITACSENMHSSSFLQILPCAQPKECCTQRMAR

SEQ ID NO: 139975 - protein, 278 aa, Glycine max
  Coding DNA Sequence Number=SeqID_23197
  Homolog annotation: Hit_ID=Q47522; Match level="QueryCoverage=13%, HitCoverage=45%, E-value=8e-14, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCLHIEDANFSEREFVDLLPICWDSCFKLFEEVQEFDSKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139976 - protein, 133 aa, Glycine max
  Coding DNA Sequence Number=SeqID_23198
  Gene Ontology: Mol. function=nucleic acid binding; Biological process= DNA integration
  Homolog annotation: Hit_ID=Q1T6H5; Match level="QueryCoverage=59%, HitCoverage=13%, E-value=3e-26, Identity=70%"; Hit description =Integrase, catalytic region; Zinc finger, CCHC-type; Peptidase aspartic, catalytic
MWESPEVSLRKAKYFVSIIDDYSKRLWVYPIKKKPYMFIVFKEFKTQVELETSKRIKCLRINDGREYVDSDCLTFWKPKGGRPQQRSNPRLKAQLARGFDMKNLGPTNKILGMQIHQDVKDRKVWLFQKNYLY

SEQ ID NO: 139977 - protein, 213 aa, Glycine max
  Coding DNA Sequence Number=SeqID_23199
MGEAEEVQEKMKADMEAMKEQMATMMEHMMSMKKIMEANAVIVAATSAIAMVNPMLPSGIKQMNHPTSNMVGKDLGSTDDPMMCKFKTSTPSRHMACLPNYTPPNVAYIPNEDVNNSTPILIKSQQPQSDHAHVSRPMEETHEIPHHDLANFEPFLGYAAEGQAIGGIPLQNTLEGPQYHPQPQPSRSTTIKNPHDYGRNGKVGSSRGKPQGH

SEQ ID NO: 139978 - protein, 96 aa, Glycine max
  Coding DNA Sequence Number=SeqID_23200
  Pfam annotation: Domain name=AP2; Domain location=3-47; Score=8.0; E _value=7e-05; Accession=PF00847.10; Description=AP2 domain
MRPPPLKASRDIMEMETLEAAARAYDLAALKYWGQDTILNFPLFGIESRNLPNPLHAIEVLVCFRCERRKKKCISDDDVHRYVEGLRILHSHTRAS

SEQ ID NO: 139979 - protein, 100 aa, Glycine max
  Coding DNA Sequence Number=SeqID_23201
MQSSKRDVYLGAYLHGALKGLNDAPRPKSKAVVRWIVVKCNRKKGSTECGYYVMHRMSTIILGSFRNNCKAYFNYPRPLEPERLKALRIQWGQYYLRVRA

SEQ ID NO: 139980 - protein, 158 aa, Glycine max
  Coding DNA Sequence Number=SeqID_23202
  Pfam annotation: Domain name=zf-CCHC; Domain location=90-107; Score =22.8; E_value=0.00017; Accession=PF00098.13; Description=Zinc knuckle
MKEGIGHILDLTPIGEKGKESLKRQTLASHTSMGRTMKSSSKSYVSHSYPKKDQGQGILGVVPSKPKDDKGKTIEKQPPKASMQDKTISIKCFKCLGRGHITSQCPTKKTMIMRGQDIYSSQDEATTSPSSSESEEAKEEESSEEIYPLRRRSCWCQK

SEQ ID NO: 139981 - protein, 453 aa, Glycine max
  Coding DNA Sequence Number=SeqID_23203
  Homolog annotation: Hit_ID=Q2XK51; Match level="QueryCoverage=52%, HitCoverage=94%, E-value=5e-25, Identity=35%"; Hit description =Epimerase KguE, putative
MAKAVIPHAADPTHVQAETRQAGRDVELSACDAFDKVLHRTQLARFGGDKHGHGLADRDDIQRLVHGLLLAQQLAEQIQPACIGAVRCDGAEVIFMRHGGLHVDIAHGRGQVTRGLFRGVAHPQPVPHIEGQRDGERHFPTGGLEALHGRELSAVGLIVLHDQRHAAGIQQRTQGVERLRVAEMAQGNLQPKCVQSVGFRKIAGQGGGCGVARQQTQQLNGFAQRGQRQQLFAVEQFPADLHAVSPRASNNGEHRPLTARLSHLFRTVRGGDHHNFPAHLRTPSQHINTITLDGTGSKEKLAGEDLLANGIAGAFNTTNDLFNSSIANLPGGLFEGSNADASQLRPLQFIKPQQTDVAAPVQANALERAGNLQRQCPVGGDNRFAHPTMARMELTQGVVKLPGFVKRRFGIFGDHAGITLQRGAKCAQAFTSGVDHPQRFTQKQNGLEALFNQ

SEQ ID NO: 139982 - protein, 550 aa, Glycine max
  Coding DNA Sequence Number=SeqID_23204
  Gene Ontology: Mol. function=kinase activity; Cellular component =proton-transporting two-sector ATPase complex; Biological process =ATP synthesis coupled proton transport
  Homolog annotation: Hit_ID=Q94CG5; Match level="QueryCoverage=98%, HitCoverage=59%, E-value=2e-85, Identity=36%"; Hit description =Kinase interacting protein 1
  Pfam annotation: Domain name=KIP1; Domain location=1-52; Score=71.8; E_value=2.2e-18; Accession=PF07765.3; Description=KIP1-like protein
MEEKVQTVLKLLEEEGDSFAKRAEMCYKRRPELISFVDESFKAYRALAEGYDHISTELQNANNTIASVFPDRVPFMDEEDDDGSPRPSRKKAEGFKTNIPKPPIKDLKNVITTAAATRKFHSKKPAATTASAAPKVPKSSLSRKEALEEVDKLQKQILALQTVKVFVKNSYDNSIARYWETDEQIKEFQERVSTLQDELGEGVDIEDDEARHLMAEDVKAKLGSLMDEFHYERSNSEEPRVQRDLKEIAETKDLEENAGLAPKKQKLQLLKENIKEHFETSSNSSLSVAEMAKKIDELVNKVISLETVVSSQTVMVTRLKTDTDELQEQIRTLENDKESLIKDKNKLNEQLRKMEEKMHGVQYLNQIVEDQNNNLQTQFNEAHNNLDQLSEKVQNVQQPGEEAKTTDLSHTQKDSSSQVELKSKSEGQVPLNEDNILLNDIKSEKDLTNGLVEDDAKDKELKVAGTVEDDVTSDNKLEATSSPFANEPNVTRSLENDAKSVDKVKVTSSLEMEEATPMEKKSPKELEEQDKTVNPGNDENYKLEATGSPF

SEQ ID NO: 139983 - protein, 181 aa, Glycine max
  Coding DNA Sequence Number=SeqID_23205
  Homolog annotation: Hit_ID=Q5YLY5; Match level="QueryCoverage=21%, HitCoverage=8%, E-value=1e-07, Identity=71%"; Hit description=Zinc finger protein-like
MKRFGGPYRVGSSVGVGEKSCLCEIAEIKGFLVLDMKFDSITFAFWSKSSMDVEPRRIRLLSNRYTTNTLLDTAATIQILKPRTFLATFYPKPMMSATSAAAWDRLKKHYASRSHTPIMSLKESLDSITKLIIGLKGLGPAFHEFSASIQECDSPLFAKLFHKLVDRDFSPTRGMLAIVHS

SEQ ID NO: 139984 - protein, 129 aa, Glycine max
  Coding DNA Sequence Number=SeqID_23206
  Homolog annotation: Hit_ID=Q47522; Match level="QueryCoverage=40%, HitCoverage=65%, E-value=2e-19, Identity=83%"; Hit description=LacZ protein
YDGVFEVLQWLLFLSAVPPVQLLTGWCVTAKAPPDISAGKCSGRVPFAIQAAQLLGRAIGAGLFAITPAGERGMCCKAIKLGNARVFPEFGVNLQVETNKAVPRDDQQTMNRQTGSIHGLDAPKRFLLE

SEQ ID NO: 139985 - protein, 117 aa, Glycine max
  Coding DNA Sequence Number=SeqID_23207
  Homolog annotation: Hit_ID=Q6H4R9; Match level="QueryCoverage=90%, HitCoverage=18%, E-value=2e-08, Identity=31%"; Hit description =Putative receptor kinase
MESGTPKTFDWTSRLGIATTIAEALSFLHQELCHHAIVRGNLKSSNILLNKNMEPCISEYGVMGMDDQRGSLFASPIDSGALDIFKEDVYGFGVILLELLTGKLVKGNGIDLTDWVQ

SEQ ID NO: 139986 - protein, 343 aa, Glycine max
  Coding DNA Sequence Number=SeqID_23208
  Gene Ontology: Mol. function=protein serine/threonine kinase activity; Cellular component=membrane; Biological process=protein amino acid phosphorylation
  Homolog annotation: Hit_ID=Q9FIU5; Match level="QueryCoverage=86%, HitCoverage=67%, E-value=1e-136, Identity=81%"; Hit description =Serine/threonine-specific protein kinase-like protein
  Pfam annotation: Domain name=Pkinase; Domain location=113-339; Score =100.2; E_value=6.4e-27; Accession=PF00069.15; Description=Protein kinase domain
  Pfam annotation: Domain name=Pkinase_Tyr; Domain location=113-323; Score=118.8; E_value=1.5e-32; Accession=PF07714.7; Description =Protein tyrosine kinase
  Pfam module annotation: Pfam domain module=Pkinase::Pkinase_Tyr; Domain location=113-339::113-323
MREESLGLIIGVSIGVVIGLVLAIFAFFCHRYHRKRSQIGNSSSRRAATIPIRTNGADSCTILSDSTLGPESPIKSGRNGMPFWLDGFKKSSSMIPASGLPEYAYKDLQKATHNFTTVIGQGAFGPVYKAQMSTGETVAVKVLAMNSKQGEKEFHTEVMLLGRLHHRNLVNLVGYCAEKGQRMLVYVYMSNGSLASHLYSDVNEALCWDLRVHIALDVARGLEYLHNGAVPPVIHRDIKSSNILLDQSMLARVADFGLSREEMANKHAAIRGTFGYLDPEYISSGTFTKKSDVYSFGVLLFEIMAGRNPQQGLMEYVELVRSLSLPSNHSEDNGIGGYFFGDI

SEQ ID NO: 139987 - protein, 236 aa, Glycine max
  Coding DNA Sequence Number=SeqID_23209
MVGYTPSSFVDLVFTDEWNKVGMKRGKFNHLAWTNEKSGANEEGENEGETHAVTAIPIRPSFPPTQQCHYSANNNPSPYPPPSYPQRPSLNQPQSLSTALPMTKTTFSTNIFIHQLKGILQQKACRVHPKFRCHMLNLIPYLLDNSMVAITLAKVHQPPFLREYDSNATCACHGEAPGRSIEHCRALKRKVQGLIDTGWLKFEENRLLNPNINKQHHTWGNSGSCCYEGQFWKLLL

SEQ ID NO: 139988 - protein, 153 aa, Glycine max
  Coding DNA Sequence Number=SeqID_23210
  Gene Ontology: Mol. function=catalytic activity; Biological process =cellular metabolic process
  Homolog annotation: Hit_ID=Q653W0; Match level="QueryCoverage=85%, HitCoverage=40%, E-value=7e-29, Identity=55%"; Hit description =Putative dihydroflavonol-4-reductase DFR1
MFHFLLSKCTSKVIAPSVSLWKGGDQLRFFQADLHEEGSFDEAVKGCVGVFHIAASMELNVSDKENNEAFVQANIINPAIKGTINLLKSCLKSNSVKRVVFTSSISTVTAKDINGKSKHIVDESCQIHPDTCLCTFKASHRRSSISICKRERH

SEQ ID NO: 139989 - protein, 87 aa, Glycine max
  Coding DNA Sequence Number=SeqID_23211
  Gene Ontology: Mol. function=catalytic activity; Biological process =cellular metabolic process
  Homolog annotation: Hit_ID=Q5UL13; Match level="QueryCoverage=89%, HitCoverage=28%, E-value=3e-11, Identity=40%"; Hit description =Dihydroflavonol 4-reductase
MGSIALVHIEDICSAHIFLTEHAKAEGRYKCSSQSCTLKTEKNYDKVPSVISSKKLEDLGFSYKHGLEDIIYQTLMCFLDYGYLPPV

SEQ ID NO: 139990 - protein, 189 aa, Glycine max
  Coding DNA Sequence Number=SeqID_23212
  Pfam annotation: Domain name=zf-CCHC; Domain location=108-125; Score =20.2; E_value=0.00047; Accession=PF00098.13; Description=Zinc knuckle
  Subcellular localization annotation: CTP_CleavageSite=27; ConfidenceScore=5.14e-01
MHVFTSLSLSLSLNSSPKTLTPPRPPPTTTGSYHEHPLLVVIPPYKDERFNQSEIFIIYLKDSIKNKALNPFFVVSSRSAGPMKNKKNGPQNQGKPYQTPPKQYDKDMTCFNCKQKGHIQRDHPYPKNEHNGGGLNDQTRRLKATRRVFTLDGVKASKSKDIIQGSTQELIKEHKVEKDKCAHYRKRKP

SEQ ID NO: 139991 - protein, 182 aa, Glycine max
  Coding DNA Sequence Number=SeqID_23213
  Pfam annotation: Domain name=zf-CCHC; Domain location=118-135; Score =11.9; E_value=0.011; Accession=PF00098.13; Description=Zinc knuckle
MKVFMRKTFLPPSCEKDAYERLQNLTQGSKSLEEDIQCIVKLKHYESLEDMVQKAKKVERQPERKHSYKKTYHYDFSSGKDKSKKEGSSLPKQQGSKSLSGKHDPNPITPSTSRSSSIKCFKCLGKGHIALHYPNKKTKVLRDNQIITSEFASISSSNISSDNDSGCGTKCLDDVLEVVGYP

SEQ ID NO: 139992 - protein, 134 aa, Glycine max
  Coding DNA Sequence Number=SeqID_23214
MKIIISIPLMNCDLSRGEQHKDSCYFYSINNFDRRQESVMYEYLEEERAPDLESILADFMTYQASSKGSCYGMQQQGTQFQRNQFSTGYQWESFWQPNYHDKTEGVLNLDDLLMQFKDTVESMQQAFRRIATKI

SEQ ID NO: 139993 - protein, 219 aa, Glycine max
  Coding DNA Sequence Number=SeqID_23215
  Gene Ontology: Mol. function=RNA-directed DNA polymerase activity; Biological process=RNA-dependent DNA replication
MTTNDCHELSFLAAGARHRDEHFNQSRIFKIHLKDWVENEALNLSFVVSSRIAYALQALAQAMGNRNWGEDVGVAKYQGLDRFQQNNPPAFSGGYNPDGAQHWLWEIEKIFQVVECMEEQKVAFGTYILVEKVKYWWDNTCQSLEAKARLKELVTHYQGRDGESSKCGKFMNDLRHEVKQAVNYQGVHQCVGFGMRTPKTGQHIIGVRAQWRTIRGLLL

SEQ ID NO: 139994 - protein, 110 aa, Glycine max
  Coding DNA Sequence Number=SeqID_23216
MKADMEAMMSMKKIMEVNAAAVSATSVVAEVREGKSWEVRAAPIACKFKTSTSSHHMACLPTIHHPMWHTLPMRMSMTPLPYSLRAKNLNLIMHMSLNPWGRHMKYPTTI

SEQ ID NO: 139995 - protein, 138 aa, Glycine max
  Coding DNA Sequence Number=SeqID_23217
  Gene Ontology: Mol. function=nucleic acid binding; Biological process= transport
  Homolog annotation: Hit_ID=Q8H6Q8; Match level="QueryCoverage=82%, HitCoverage=42%, E-value=4e-12, Identity=40%"; Hit description=CTV.20
MEYNIMNTLQHMTMVATAYQTSHECSEETIIDILVVGFSGQLKVKTDLNGKVITNDEDKEIPNAVNTLIFTIAQHFIGDPSLWKDRSAKLLSNLKCRTLADFRWYRDTFLTRIYTRDTLGEPHTCVHNHCMFSSLGDQ

SEQ ID NO: 139996 - protein, 58 aa, Glycine max
  Coding DNA Sequence Number=SeqID_23218
MVAENQLRRGGGGGGGGEEASDCGEESGRGGGVIVVDDVVHAFGRVTWFRMCIVDVSN

SEQ ID NO: 139997 - protein, 83 aa, Glycine max
  Coding DNA Sequence Number=SeqID_23219
MWSSAPFPEMSASSGRDSFGLTTSADPDPCVRWQADIPKWQADIPKGLSVQGQHLLILTHASGGRWKYPKWLPVQTQFCYPDL

SEQ ID NO: 139998 - protein, 72 aa, Glycine max
  Coding DNA Sequence Number=SeqID_23220
MFGVGTKEWALAELIKNPNIMAKERQEIDSMVVKNSEADWLSEPRSLSEATNSLSGCKILEDDKPEITALSA

SEQ ID NO: 139999 - protein, 91 aa, Glycine max
  Coding DNA Sequence Number=SeqID_23221
  Subcellular localization annotation: CTP_CleavageSite=61; ConfidenceScore=5.67e-01
MKGSPHGINANFTSISASKRNFEGNLPCKHALSALSARPASHLSLLVLSAPSSLSQRSLTRAKRKNGAKRAFKDRKPFLKPEVKEKRGLGG

SEQ ID NO: 140000 - protein, 252 aa, Glycine max
  Coding DNA Sequence Number=SeqID_23222
MTKNEKVIGDSKYLSSLKGHQDACSMSTDESDSFVGNEHLKKRTVRIERQSEKQLELKHTNGTFSEKDLTLHTKKRLGNRMQDCKDFLSNDLKCTHLSSSICDARETAEVTAKAFEASKEFNENRVQGRMVPIEALKEESLESISGKDFEKTIKQNAGNDFMKNALEHKLENSHKDNYTDPKNNNTCNTFMISKKFECDAVKHKSASGAKVKERQNGLKVANQLLVVLPIAEDNIAAEMISSIGVPLVVAED

SEQ ID NO: 140001 - protein, 74 aa, Glycine max
  Coding DNA Sequence Number=SeqID_23223
  Homolog annotation: Hit_ID=Q1SEE1; Match level="QueryCoverage=74%, HitCoverage=4%, E-value=1e-18, Identity=75%"; Hit description =Integrase, catalytic region; Zinc finger, CCHC-type; Peptidase aspartic, catalytic
MYKGISGSLLCLKELVGAMALQEGKVKIEKFNGRDFNFWKMQIEDYLYQKKLYQPLSRIKPDDMKQEEWNLLDR

SEQ ID NO: 140002 - protein, 64 aa, Glycine max
  Coding DNA Sequence Number=SeqID_23224
  Subcellular localization annotation: CTP_CleavageSite=55; ConfidenceScore=5.17e-01
LISWANCAPIAKRSFSVLSAIEESGRASISRLRAKREISALSTAVVFSQAQRTTSAKLKSTYSH

SEQ ID NO: 140003 - protein, 237 aa, Glycine max
  Coding DNA Sequence Number=SeqID_23225
  Gene Ontology: Mol. function=nucleic acid binding; Cellular component= intracellular; Biological process=regulation of transcription
  Homolog annotation: Hit_ID=Q1SGQ8; Match level="QueryCoverage=95%, HitCoverage=51%, E-value=7e-87, Identity=72%"; Hit description=Zinc finger, C2H2-type
  Pfam annotation: Domain name=zf-C2H2; Domain location=208-231; Score =16.8; E_value=0.077; Accession=PF00096.16; Description=Zinc finger, C2H2 type
MEKVEEKKKIKGNIKDNMPTVWFSLKKSLHCKSEPSDVHDPKTRKQLSTILTKRAGRSGCSRSIANLKDVIHGSKRHLDKPPSCSPRSIGSSEFLNPITHEVILSNSRCELKITGYGGFQEGVGSGGSNAGGGGIGGSTFVGTLRPGTPGPGGHPTMHYFNPSFRTSSTPPRKSPFLSDKEGSGPHGAGLHPSNRLSLETDSNGSSTVTCHKCGEQFNKWDAAEAHHLSKHAASIFK

SEQ ID NO: 140004 - protein, 389 aa, Glycine max
  Coding DNA Sequence Number=SeqID_23226
  Gene Ontology: Mol. function=nucleic acid binding; Cellular component= mitochondrion; Biological process=DNA integration
MSNNTQRQSNNINNPQDEHIGNELVDNVQVTNEQVIEEAPNVTRKGNIERYKARLITKGFIQKDGIDYKQTLSPISKKDSLRIVLTLMAHYDSELHQIDVRTAFLKTIVDRCIYMKKGYIKKVLENYMFTYRRSDHLEVIGYSDSNYVGCVDSRKSTFGYIFLLAGDAVSWKSAKQSMIATSTMKAEFVHVLRPQFEHCGCKFLLQGLNEKYSKGAKHVNLKYLSVKEEVQKHKVFIEHIGTNLMITDSLTKGLPPKAFIGHVERMGVMDKSLRPRKGNQRRKKYQPGNSKVHYGFGLNKQALKLCGKLPIRMIGRSLQKNKKGAPLTLKQRKRRNRVIGNARLVRVTMSFTSTTLVSGPAKKEKQRELPWVQEMEMRQIGGMRQWSRG

SEQ ID NO: 140005 - protein, 78 aa, Glycine max
  Coding DNA Sequence Number=SeqID_23227
  Gene Ontology: Mol. function=protein transporter activity; Cellular component=integral to membrane; Biological process=intracellular protein transport
  Homolog annotation: Hit_ID=Q9FFK1; Match level="QueryCoverage=54%, HitCoverage=12%, E-value=4e-10, Identity=74%"; Hit description =Syntaxin-31
MPLEHWLAFAFFYNLNYNICTPSQQMEMSMVQQVVPRHDNYAQSRATALHNVESTITELSGIFSHLATMVAHQGELAI

SEQ ID NO: 140006 - protein, 112 aa, Glycine max
  Coding DNA Sequence Number=SeqID_23228
MLRKVLIESAMLAILSFLQSQYATVYVLHGGNGYLDTSTLKSYTTNLRLLSRKDEGYSRGETRLWNIVEMHMVHLMILELAELSLDEPELEAMLFLDDGNEGEENETGSVRL

SEQ ID NO: 140007 - protein, 68 aa, Glycine max
  Coding DNA Sequence Number=SeqID_23229
MGATNVLCGMWSKKYILIVSPSVEFVIPITLEEVSYGAWSRREEQENGGSKRDDIIEEHATVEMLIDF

SEQ ID NO: 140008 - protein, 938 aa, Glycine max
  Coding DNA Sequence Number=SeqID_23230
  Gene Ontology: Mol. function=actin binding; Cellular component =phragmoplast; Biological process=actin cytoskeleton organization and biogenesis
  Homolog annotation: Hit_ID=Q1SGQ9; Match level="QueryCoverage=84%, HitCoverage=79%, E-value=0.0, Identity=71%"; Hit description =Pyridoxal-dependent decarboxylase; Actin-binding FH2
  Pfam annotation: Domain name=FH2; Domain location=474-879; Score =485.8; E_value=5e-143; Accession=PF02181.13; Description=Formin Homology 2 Domain
MEETKDEEVEFVKDFLGMVLLNNGGLVILMLQHLPKFLFLFGVAFLIDSCVLIFGANPWLVLRDATLKGDEGIEWAAVSPSEKKQTEDDLVREILDPASGLLDEHTHISEPPSPGPAVGSPSPSLTPSPEPSLAPSSEPSLAPSPFAPTPLVHRPLHNSLPPTSFFPKLTPPAASEISAPPPSDINKQEEKHSNKKTVVLAVVITALVTFIAAAVLFLCCTRYRKTGHVRLNDDRPLLSLSMSDYSVGPSSYSFGNSMKGEKVGFQSSSNSLVDNKKYSVQESQSIGALNAAAGSPFELKPPLGRVPTIPSGMPPLKPPPGRLNPLPPEPPSFRPSGDAAPAATAAVAAASPAPQQPAISSTPPPPRPPAGAKPGPPLPLLPALAGARPGPPPPPPASVGAKPGPPPPPPGPAGAKPGPPPPPPPAGAKPGSRPPPPPPMSGVAPPRPPPPFGSKVQRPLASGSKATVEAGVEGEADAPKAKLKPFFWDKVQANPDQSMVWNQIKSGSFQFNEEMIETLFGYNAVDKNNGQKQKQSSSQDPSPLFIQIIDKKKAQNLLILLRALNVTMEEVCDALYEGHELPPEFLQTLLKMAPTSDEELKLRLFSGDLSQLGPADRFLKAMVDIPFAFKRMEFLLFMGSLKEELATIMESFAILEVACKELRNSRLFLKLLEAVLKTGNRMNDGTFRGGAQAFKLDTLLKLSDVKGTDGKTTLLHFVVLEIIRSEGIKAIRKAKESQSSSSIKSDGLPDSTQETEDHYHEIGLQVVSRLSSELENVKKAAVIDADSLTGTTAKLGYGLIKTRDLVTKTMKNVEEDRGFCETVKSFVQNAEADVTKLLEEEKKIMTLVKSTGDYFHGNAGKDDGIRLFIVVRDFLIMVDKVCKEVRDTRKKLAKTLKQETPRGASSSETRPPPDFHQRLFPAIAERRMDDISSDDESP

SEQ ID NO: 140009 - protein, 92 aa, Glycine max
  Coding DNA Sequence Number=SeqID_23231
MEEEAEEAIRQSKETLKKQEENGGERERLGQITTTTPKSSREGTRKKIVFGGEESNSISSATNTCAFIFSPPLWESPWQWRCEQRERVRRII

SEQ ID NO: 140010 - protein, 53 aa, Glycine max
  Coding DNA Sequence Number=SeqID_23232
MHLSIVSSNVLPLGKNTLNITIIAQMGEEYNMTGDELMSKVMQDLFKLYEVPL

SEQ ID NO: 140011 - protein, 54 aa, Glycine max
  Coding DNA Sequence Number=SeqID_23233
MENMVRSYTSSTLPLLPLNWTRSTSSLQLPGFKFHEERDWEDTRMSSMNVSLTW

SEQ ID NO: 140012 - protein, 85 aa, Glycine max
  Coding DNA Sequence Number=SeqID_23234
  Subcellular localization annotation: CTP_CleavageSite=24; ConfidenceScore=5.20e-01
MAGTGSLTMRTHSMSSTAHNGRCRESEVSRNFQGERGVRVKAQQSFRERGSALIGKVSKRVWATHVRNKDGLIRGSSLSYIKVTF

SEQ ID NO: 140013 - protein, 235 aa, Glycine max
  Coding DNA Sequence Number=SeqID_23235
  Gene Ontology: Mol. function=metal ion binding; Biological process =cell redox homeostasis
  Homolog annotation: Hit_ID=Q94HJ7; Match level="QueryCoverage=96%, HitCoverage=66%, E-value=1e-54, Identity=44%"; Hit description =Putative RING-H2 finger protein
  Pfam annotation: Domain name=PHD; Domain location=158-202; Score=0.6; E_value=0.05; Accession=PF00628.19; Description=PHD-finger
  Pfam annotation: Domain name=zf-C3HC4; Domain location=159-199; Score= 44.4; E_value=3.8e-10; Accession=PF00097.15; Description=Zinc finger, C3HC4 type (RING finger)
  Pfam module annotation: Pfam domain module=PHD::zf-C3HC4; Domain location=158-202::159-199
MASLGSPSSSFWCYRCNRIVRVPQNDAVLLCPDCNSGFLEELQTPPHSRRSTRGGGGSPFNPVIVLRNANDVVSPETRNFELYYNDAVSGSSGPSTLRPLPQGVTEFLLGSGFDNLLDQLDGAAGGSAPPPPAAASKAAIESMPVVKILASHTYAESHCAVCMENFEINCDAREMPCGHVYHSECIVPWLSVRNSCPVCRHEVPSDEVEESNSNSNNNTVGLTIWRLPGGGFAVG

SEQ ID NO: 140014 - protein, 146 aa, Glycine max
  Coding DNA Sequence Number=SeqID_23236
  Gene Ontology: Mol. function=RNA-directed DNA polymerase activity; Biological process=RNA-dependent DNA replication
  Homolog annotation: Hit_ID=Q1T5K4; Match level="QueryCoverage=59%, HitCoverage=9%, E-value=2e-17, Identity=50%"; Hit description=RNA -directed DNA polymerase
MRYLREFHAHGILPRGTNSSFISLIAKCENPQGFGDFRSISLVNCLYKILAKLLANRMSKVLGEVIDLTQSAFLAEGLSGLMKEAKRCNLFSGYKVDDNGCEVGLLQYADDAIFVGEGYQVGRWKNVWTCCIVICFLFLLYTWASL

SEQ ID NO: 140015 - protein, 110 aa, Glycine max
  Coding DNA Sequence Number=SeqID_23237
  Subcellular localization annotation: CTP_CleavageSite=25; ConfidenceScore=5.29e-01
MDGGFNGANGAPRRVAWDSSVGRSRESRGFGSALRNVFSYFGRVKELVFSPNEKFACQRKISLLKKKHCNFHRNLKVFEVTDSVKRSRNRRHHIGRVLSYQRLGRDETPQ

SEQ ID NO: 140016 - protein, 112 aa, Glycine max
  Coding DNA Sequence Number=SeqID_23238
MLDLHFKISDDSLILLTLSSSPSKLLLLHRAQDRDSLPPYPGTFCDSFFFSTVLLKPRSFWGTRAHCKDLCLFLLQGFGLWNSCSLQGASTVKHSKDFARHSEAGRALHYAT

SEQ ID NO: 140017 - protein, 102 aa, Glycine max
  Coding DNA Sequence Number=SeqID_23239
  Gene Ontology: Mol. function=actin binding; Cellular component =cytoskeleton
  Homolog annotation: Hit_ID=Q9FKI0; Match level="QueryCoverage=78%, HitCoverage=12%, E-value=2e-15, Identity=57%"; Hit description =Fimbrin-like protein 2
MASEPVHSSRTSNPQIQERTQSGRVTVGNFRPIFKKLKGFSELFTEDEIKDALAESHQNMDEEIDFESFLRVFKRLGICGVHLLVSLFVTQKIIVERFKSVA

SEQ ID NO: 140018 - protein, 121 aa, Glycine max
  Coding DNA Sequence Number=SeqID_23240
MVELCLVPDVVIPLKFKVSDFDKYKGTTCPKNHLKLQNMCKREHESFKEYALRWRDLATQVVPPMMEREMITMIVDTLPVFYYESMVGYMPSSFADLLFVGERIKAGLKRGKFDYCFDEFW

SEQ ID NO: 140019 - protein, 63 aa, Glycine max
  Coding DNA Sequence Number=SeqID_23241
MSQNFTNSMTMGIKHFEVVKRRSHADKHWFPDEIRVDFVANLRVAFMDDWAFLAGRVVGNEKD

SEQ ID NO: 140020 - protein, 72 aa, Glycine max
  Coding DNA Sequence Number=SeqID_23242
MEMQLKTKEKRKLSNDFFERSLSLEEWVTNKARPVLIPEVPLTQHEPLPPPRSIVMLSSSSSSKDSSPSMND

SEQ ID NO: 140021 - protein, 77 aa, Glycine max
  Coding DNA Sequence Number=SeqID_23243
MKADMEAMKEKMTTMMEAMMSMRNMMEVNTATIVVISTATEVDPTHPSSLNQVNRPTLDMVGQGGEALGSMGGPHFV

SEQ ID NO: 140022 - protein, 152 aa, Glycine max
  Coding DNA Sequence Number=SeqID_23244
  Homolog annotation: Hit_ID=Q1RWU1; Match level="QueryCoverage=95%, HitCoverage=40%, E-value=9e-15, Identity=32%"; Hit description =Resistance-like protein HAAS-2-related
ALRDLTQTRRYAWRAASLVHMYDHLNDASNSTSRHVTGYITLLQCWIYEHFSSVAECNADPDYDEVSPRQLRWGAVAIRYRSERVMRQFGYVQGIPAHPDDSWVSFDDVDDRWTHYSDHLAPTGDICVVPGQCAPDYIDWFFVISHPFMTAP

SEQ ID NO: 140023 - protein, 138 aa, Glycine max
  Coding DNA Sequence Number=SeqID_23245
MHQSLFKDNDSHKESNEGHSRKTTKLTKVDGGEHPSRHDQSATTASRWLCETQSKESRWWRRPESVGVFTSKTKKKKTKNAETPKTKKKKNAKIPKIEKKKTKNAEIPQTMAKRRGIEKSPKRRTRRRLRNQSSATTL

SEQ ID NO: 140024 - protein, 105 aa, Glycine max
  Coding DNA Sequence Number=SeqID_23246
MYTPLELIHKRCTLSCSPYNNPSRCMLYLYHKGCFQFLASSPLFRCLYPSSFASFSLQEKFLEQFMQEAYAFCVRDRKKCLRCRDFWMISSISFRNYKMRVVHIL

SEQ ID NO: 140025 - protein, 44 aa, Glycine max
  Coding DNA Sequence Number=SeqID_23247
MSRYARSSWLLKQNDADTKHACALSVNSILRYSEKFRLSTSTLH

SEQ ID NO: 140026 - protein, 83 aa, Glycine max
  Coding DNA Sequence Number=SeqID_23248
MSSSLCWGHHKFVCRILGSSIFVRAGSNYFLVYCAMHNVNNFNIKEMKRCPLTNKEDRLTGISVPHLRSASQANALPVMGVNL

SEQ ID NO: 140027 - protein, 55 aa, Glycine max
  Coding DNA Sequence Number=SeqID_23249
MEQCHVPSRSIMTVEELIDGILALGLQNMQLVLRWIIELARAHVVPSAGSSLSDY

SEQ ID NO: 140028 - protein, 155 aa, Glycine max
  Coding DNA Sequence Number=SeqID_23250
MFCFSLISSSLEDCSFFISFLSRDLETQSISITGKCILFATAIHNCSRGKARPETPAARSSCTRSTTLSKFLYIFDMNISTPRLSLLSKITDWFGRWMPWKDAEKELSHACLECHGKMLIQVFLFLAQSCNLLLGIGVPPQMSEGNFLAYDFSIL

SEQ ID NO: 140029 - protein, 86 aa, Glycine max
  Coding DNA Sequence Number=SeqID_23251
MAPKKLSTKRSRRAAVAEVSSAAPEFDSHRFRSVEHWQHFEAIKGWSLHRERRVQLREDEYTDFQEEIARRHWTSLVTPMAKLDPE

SEQ ID NO: 140030 - protein, 73 aa, Glycine max
  Coding DNA Sequence Number=SeqID_23252
MADKRSCIESSTSDAYRGIPSPFLSSSLFHIKKNMTSRRIFCCDKGELATFRNERRISHKTHHQNHGHIEKDE

SEQ ID NO: 140031 - protein, 114 aa, Glycine max
  Coding DNA Sequence Number=SeqID_23253
MASAITWVTCMLIRQREVGVVVARQDIAEQQCHPYLGQSSHAGAHDPHPPPCNRSGEILPRYAQQQGDGFLIEIVCLAPPLAEFTLLVFLQNQRVTQELAEGICIKGNPLTLLP

SEQ ID NO: 140032 - protein, 216 aa, Glycine max
  Coding DNA Sequence Number=SeqID_23254
  Homolog annotation: Hit_ID=Q1SKD7; Match level="QueryCoverage=95%, HitCoverage=53%, E-value=5e-09, Identity=25%"; Hit description =Ankyrin
MASKKRKAPSTPSQVRYDRSRFTSQEAWERYANIEMPRKLLPERNVVVYYTEFDKFKDELERRHWDEELTSFADDNIDVAIVKEFYANHYDLEDKSPKQVRVRGHLIKIDEDTLNTFPKTPVIEEEGEILCAYSRFALLRPNPQELAAKLCIPWRGFKLNADGQPSKILRKNMTTLAQTWSVLSFSNLIPTSHTSDVTLDKAKLIYGIIMKMDMNV

SEQ ID NO: 140033 - protein, 233 aa, Glycine max
  Coding DNA Sequence Number=SeqID_23255
PLVTPLISEEGQLCEHNQREAIVQPRCILGQDFTRAAAKRRVWIMHTNMTTLTQIWMTLLLSNILPSDHNSNLPLQSVRITPTRHPVDPEESNRALGFPALVTSLYQSYRVPVPPARNRARKTPSGPGEVQQGPRVSSSTYGPLSVLQSARRPQQVHQAPTNQALIKKYCAPRQAQGETPQQAFIKKFWVHLLGLLTENKRGYISCGSVLVEGTSTRLFKENKGGHIPCGSLL

SEQ ID NO: 140034 - protein, 179 aa, Glycine max
  Coding DNA Sequence Number=SeqID_23256
  Gene Ontology: Mol. function=helicase activity; Biological process =protein amino acid phosphorylation
  Homolog annotation: Hit_ID=Q1SN45; Match level="QueryCoverage=97%, HitCoverage=10%, E-value=1e-33, Identity=39%"; Hit description=AAA ATPase
  Pfam annotation: Domain name=DUF889; Domain location=1-179; Score =163.2; E_value=6.6e-46; Accession=PF05970.5; Description=Eukaryotic protein of unknown function (DUF889)
MRLHSNLESVDEQETATFAKWILDIGDGIIDDENDGYATIQIPTHLLITQYDDPISAIVKSTFPDLDQHHNNPEFFKSKAILASTNETVEQINHYVLSFIPGDHMECLSSDSVDKSETSEDSYFQSITTEFLTSLNTSSLPTHSIKLKIGSPIMLLRNLDQNQGLCNGTRLVVTKMANM

SEQ ID NO: 140035 - protein, 59 aa, Glycine max
  Coding DNA Sequence Number=SeqID_23257
MCLGPHDVGKNKIIKFSTPMGNGQIWKLITSVVTLLACGQMLEVSQLKYKHSLDHRQGL

SEQ ID NO: 140036 - protein, 323 aa, Glycine max
  Coding DNA Sequence Number=SeqID_23258
  Homolog annotation: Hit_ID=Q1T493; Match level="QueryCoverage=86%, HitCoverage=51%, E-value=4e-16, Identity=24%"; Hit description =Nucleic acid-binding, OB-fold, subgroup
MTVWEEYALQLDDAIEKNHFVQKPLVVMLTLAKIKEPKDKYPLSVQNIKHGSKLYVNGDIVEIQQFHDRYTFIFFIHAVYVCIYIGGLDDEGGVSQSQSTQYCQDKFLHNAQIVSFGEIKTLRQDCYCLAVGTVDEVMIDTPWSYDSCPYCTTTFNPLKIGAVCRSCQNHVTHTIPRYKLVVKMKQNGEKANFHFWDAVCIKIFGKTADECRQELIASGDEIKVLPACVDQLLGKTWVVRFKHRIQMHQSSVLDFSEQKHHIQSVISTLGLQPSSSQSAEYDPGNTVFVTPAKRMSDQQGSSQFDSDEFATYELSTNKHIKAE

SEQ ID NO: 140037 - protein, 73 aa, Glycine max
  Coding DNA Sequence Number=SeqID_23259
RLGREEDEEGQGDDQSVVSDNNNKPYLSEAWDVLDQREMGNPLLNWRVPARGNEIDMKDNLRFWAHTVASIVR

SEQ ID NO: 140038 - protein, 643 aa, Glycine max
  Coding DNA Sequence Number=SeqID_23260
  Gene Ontology: Mol. function=nucleic acid binding; Cellular component= spliceosome; Biological process=mRNA processing
  Homolog annotation: Hit_ID=Q6ZK48; Match level="QueryCoverage=80%, HitCoverage=97%, E-value=0.0, Identity=70%"; Hit description =Putative step II splicing factor SLU7
MATASVAFKSREDHRKQIELEEARKAGLAPAELDEDGKEINPHIPQYMSSAPWYLNAERPSLKHQRKWKSDPNYTKSWYDRGAKIFQADKYRKAMTHDSKSCMERPRRVGAKWTNKHIAPDEKIETFELDYDGKRDRWNGYDASTYARVIERYEARDEARKKYLKEQQLKKLEKSNQNGEDAASDEEEEEDEDEDEDDLRVDEAKVDESKQMDFAKVEKRVRTTGGGSTGTVRNLRIREDTAKYLLNLDVNSAHYDPKTRSMREDPLPDADPNEKFYLGDNQYRNSGQALEFKELNIHAWEAFDKGQDVHMQAAPSQAELLYKNFKVMKEKLKYQTKETIIEKYGNAADEDKLPRELLLGQSERQVEYDRAGRIIKGQEVALPRSKYEEDVYINNHTTVWGSWWKDHQWGYKCCKQTIRNSYCTGAAGIEAAEAASDLMKANIARKEAATEDPTPVEEKKLATWGTDVPDDLVLDEKLLAEALKKEDQRKREEKDERKRKYNVRWNDEVTAEDMEAYRMKKSTSLSVMLLPAAGLGRMDYQFGILDPLTCSEKEELGGSSRGGGFNNCGGGRRGSTDGGDRDCGRFVNFQCQPNFNSGYGQSNANSGQHNGDDNHHANVWVNNNYKSENSGASFHVAGESQNT

SEQ ID NO: 140039 - protein, 95 aa, Glycine max
  Coding DNA Sequence Number=SeqID_23261
MDMLTSVAPTGVIFLRRIDSIGREKEGDEGATSSSNDPLHWIGGPMIRSKTKKMKQAFQGMILTIKEKEDSCELRATPNWVALGIPIDEDALSPT

SEQ ID NO: 140040 - protein, 54 aa, Glycine max
  Coding DNA Sequence Number=SeqID_23262
MNSWVSRLDGGRCMKDNQYFGLQAINSRRSRLDGGGCMNGNQFMGLRIRFEGGG

SEQ ID NO: 140041 - protein, 71 aa, Glycine max
  Coding DNA Sequence Number=SeqID_23263
MDFVGDAGEVFVVEWAFSVGRVIVLVRGILVHGVVRGLLGTWPRGSCGYNMGISLLFLSSTYSSPPIADTY

SEQ ID NO: 140042 - protein, 97 aa, Glycine max
  Coding DNA Sequence Number=SeqID_23264
MEVKFLEAVKRRLHVIKQWSLDEIRERLRAIEGGGDYPFADMAELCLVHDVIIPPKFKVPNFDKYKGITCPKNHMKMYYWKMGAYAKDEKLSMHFIQ

SEQ ID NO: 140043 - protein, 61 aa, Glycine max
  Coding DNA Sequence Number=SeqID_23265
MASGHPSAQRFLTAIHVVICSPEHKVQDHHRIQTQTTHREETSQGHAVLRECSNYVESALA

SEQ ID NO: 140044 - protein, 110 aa, Glycine max
  Coding DNA Sequence Number=SeqID_23266
MMDIPGGGIKMVRVLSISGGDGSESLIIHSQCIDGARVSYFILYGNSINFVSLSPWGGRVSCARQGDLDTYCLVFLSESVTWTHLGYFLTDGTTLHLRVEVRCMHHTEHD

SEQ ID NO: 140045 - protein, 55 aa, Glycine max
  Coding DNA Sequence Number=SeqID_23267
MALQHGKIRRHSRRREDLHSNFMKKVIGISLVHLLIALLVLLVRVKVNVMYNPWM

SEQ ID NO: 140046 - protein, 275 aa, Glycine max
  Coding DNA Sequence Number=SeqID_23268
  Gene Ontology: Mol. function=double-stranded RNA binding; Cellular component=intracellular
  Pfam annotation: Domain name=dsrm; Domain location=2-46; Score=7.5; E_ value=0.29; Accession=PF00035.15; Description=Double-stranded RNA binding motif
  Pfam annotation: Domain name=dsrm; Domain location=80-145; Score =51.5; E_value=2.7e-12; Accession=PF00035.15; Description=Double -stranded RNA binding motif
  Pfam module annotation: Pfam domain module=dsrm::dsrm; Domain location=2-46::80-145
MREGQDHVPKFRSTVWVAEMGYASQSTFSKKKAAEQDAARVALEGMLQRTRDEGLSLVNQQIILYHVAEVLGSQQISPFSKSIMNEYADKLHVQPTYDTVQEQLGGVLRVFKTSLVFNGTSYTGDPARTKKEAEQSAAKAAILSIMGDSTSGTTLIEIIKSKSTFYDAIKGKGPPLLQPSAVLSTTNTGQISVTLGHRDTGVTASVLDNNNNNKNIEAKVEFPESSKMLSTCQETPMIKQESSLEANNVSLQTGSEHSIDNSSTSKKAEKEQEEV

SEQ ID NO: 140047 - protein, 82 aa, Glycine max
  Coding DNA Sequence Number=SeqID_23269
MAAISSTKSHQNSKSKGYETTYEEGENEREQELEVEAQKKTKPWSSSLASVERGKLKGKNCAVPFYRFTGQSIQEVPLTGNC

SEQ ID NO: 140048 - protein, 145 aa, Glycine max
  Coding DNA Sequence Number=SeqID_23270
MAWEVRYVIVGNTINFIFPFLYPNTKLGLSPFPILLLLCHVLTWKCRGLKVLHLVTLRKLFGGRGVSGDGANNSGVSDRAPLSPVCNCKPLVVVQTTFTTASGEDFGVVLTTGNNVGVRVAATSFNGVQMTLMTKILLCQTEEED

SEQ ID NO: 140049 - protein, 87 aa, Glycine max
  Coding DNA Sequence Number=SeqID_23271
  Homolog annotation: Hit_ID=Q1RW99; Match level="QueryCoverage=65%, HitCoverage=7%, E-value=8e-08, Identity=55%"; Hit description=RNA -directed DNA polymerase
MDVWYRLTLGHEMVKRGWVKCNPVGVTKGASSSVVCEGIFRDYRVSFMGGFSFNLGNSFALHVELVGIMVAIETTFDTRRKKGFDRM

SEQ ID NO: 140050 - protein, 219 aa, Glycine max
  Coding DNA Sequence Number=SeqID_23272
MWFLSIVDMVEAGLRPLTDDNGAMQTINIANQHGNVHLYVLHPIYVGEAIECIDCVPADQENNIGPVADNSLGQQNNGPVAENGAVVDDSIQVDDNGPDSNIGPVDHSGNCGSINVNKDKGATEKKKRKRGRPIGRSSLPAPTFEADVSTSDDDLFGALNIAKGGYARDLSDSEYDFEDVATDIESDEEMEPKMKYPTFVQPTKMADYKWEPGTYFLDK

SEQ ID NO: 140051 - protein, 96 aa, Glycine max
  Coding DNA Sequence Number=SeqID_23273
  Gene Ontology: Mol. function=nucleic acid binding
MEALNVDENNKKLKDLMWRATKATYPQKRERLMRDIKALNVDGYKYLMQEPPRFTSNNKPNMLLNNMSEAFDSVIVEARAKHIYTMLKDIRLYLLN

SEQ ID NO: 140052 - protein, 71 aa, Glycine max
  Coding DNA Sequence Number=SeqID_23274
MTKDNDCTSKPYTGAMRGIVHEPQVNIGADQKFSPVDVFKQQKKGGETNPGISIDLLNVKWLHCRHSTMVK

SEQ ID NO: 140053 - protein, 295 aa, Glycine max
  Coding DNA Sequence Number=SeqID_23275
  Gene Ontology: Mol. function=transcription regulator activity; Cellular component=nucleus; Biological process=regulation of transcription
  Homolog annotation: Hit_ID=Q651K2; Match level="QueryCoverage=28%, HitCoverage=28%, E-value=2e-24, Identity=65%"; Hit description=BHLH protein-like
  Pfam annotation: Domain name=HLH; Domain location=211-258; Score =33.0; E_value=1.1e-06; Accession=PF00010.16; Description=Helix-loop -helix DNA-binding domain
MALSLTSNGVNEYQKCVVEEEDGSQSTNGLSNDSASAITHSPPLCSNSNEYVHNKSTHYQLEEAESLINFKANEYNTLIQGSESFLSVQKSWLFPKESNLHEGYNQWNHAISPKSTTDMRLVQNFSCFETSADYSSIFNGAKEKQHGESSSSGWLYSEPNVPSDSLLESAAQELVLTKRSSMGENMQATNAKKPCTSASKAAKPKLNPFKDPQSVAAKNRRERISERLKILQELVPNGSKVDLVTMLEKAISYVKFLQLQVKVLAADEFWPVQGGKAPDISQVRQAIDAILSSQR

SEQ ID NO: 140054 - protein, 66 aa, Glycine max
  Coding DNA Sequence Number=SeqID_23276
MGDGGGIGGVTVVLGLRGSDSLLLHCHWRQGPPCYENLNLRRKELAMCGVTCWDSEKKRLSKVTFG

SEQ ID NO: 140055 - protein, 130 aa, Glycine max
  Coding DNA Sequence Number=SeqID_23277
MFPAGAVCAVTGQCASDYIDWFFRISHPFMKPCQASVPLPDGHAPQPRVVPQAPETDIPHVSELGALLTSARPAVEEPRHAEVCYGIAERLELHLSLGVVTPSSSIHEVIEECLKMARSVTQDQLVYVRS

SEQ ID NO: 140056 - protein, 541 aa, Glycine max
  Coding DNA Sequence Number=SeqID_23278
  Gene Ontology: Mol. function=oxidoreductase activity; Cellular component=intracellular; Biological process=lignin catabolic process
  Homolog annotation: Hit_ID=O24044; Match level="QueryCoverage=99%, HitCoverage=91%, E-value=0.0, Identity=69%"; Hit description=Laccase
  Pfam annotation: Domain name=Cu-oxidase; Domain location=169-322; Score=219.5; E_value=7.3e-63; Accession=PF00394.12; Description =Multicopper oxidase
  Pfam annotation: Domain name=Cu-oxidase_2; Domain location=434-541; Score=94.5; E_value=3.3e-25; Accession=PF07731.4; Description =Multicopper oxidase
  Pfam annotation: Domain name=Cu-oxidase_3; Domain location=43-159; Score=227.2; E_value=3.6e-65; Accession=PF07732.5; Description =Multicopper oxidase
  Pfam module annotation: Pfam domain module=Cu-oxidase::Cu-oxidase _2::Cu-oxidase_3; Domain location=169-322::434-541::43-159
MGCAYLNMPGFMRAMFVVLCALMILPELTHAKHARVTRHYKFNIKMQNFTRLCQTKNIVTVNGRFPGPRIIAREGDRIMVKVVNHVQYNVTLHWHGIRQLKSAWADGPAYITQCPIQTGQSFVYNFTVIGQRGTLWWHAHISWLRTTLYGPIVILPKRHVPYPFPQPFREVPIILGEWWKADTEAVINQAMQTGLAPNVSDAHTINGLPGPVSNCAAKETFKLKVKPGKTYLLRLINAALNDEMFFSIANHTLTMVEADAVYVKPFSTKVVLITPGQTVNVLLKAKSKAPNATFAISTRPYATGPAAFDNTTATGFLEYKKPSLASSKSNTKKLPLLRAVFPKFNDTVFAMNFHNKVRSLASARFPAKVPKTVDRRFFFTVGLGISQCSKNQQCQGPNNTRVAAAVNNVTFVTPNIALLQAHFFNKSKGVYTTDFPANPPFKFNYTGTPPSNIFVSSGTKAVVLPYNTSVELVLQDTSIIGAESHPLHLHGFNFFIVGQGNGNFDPKKDPKKFNLVDPAERNTAGVPSGGWVAVRFLADNP

SEQ ID NO: 140057 - protein, 370 aa, Glycine max
  Coding DNA Sequence Number=SeqID_23279
  Gene Ontology: Mol. function=structural constituent of ribosome; Cellular component=intracellular; Biological process=translation
  Homolog annotation: Hit_ID=Q9ZQW2; Match level="QueryCoverage=97%, HitCoverage=62%, E-value=1e-168, Identity=76%"; Hit description =Laccase
  Pfam annotation: Domain name=Cu-oxidase; Domain location=1-112; Score= 107.6; E_value=3.6e-29; Accession=PF00394.12; Description=Multicopper oxidase
  Pfam annotation: Domain name=Cu-oxidase_2; Domain location=220-354; Score=179.4; E_value=9.1e-51; Accession=PF07731.4; Description =Multicopper oxidase
  Pfam module annotation: Pfam domain module=Cu-oxidase::Cu-oxidase_2; Domain location=1-112::220-354
MTFHDFFEDTYTLKVKPGKTYLLRLINAALNEELFFSIANHTLTVVEADAKYTKPFDTDTLLIAPGQTTNVFLKTKPYFPNATFQMAARPYFTGRGTFDNSTTAGTLIYKQHSNVKNLTLLKPTLPPINATSFVANFTAKFRSLASAKFPVKVPQKVDRKFFFTVGLGTNPCPKNTTCQGPSNNTKFAASVNNISFALPSSVSIMQAYYSSQANGVFKTDFPATPLNPFNYTGTPPNNTMVTNDTKLVVLKFNTSVELVLQDTSILGAESHPLHLHGYDFFVVGQGFGNYDPNNDPARFNLIDPVERNTAGVPAGGWIAIRFFADNPGVWFMHCHLDLHTSWGLRMAWLVLDGPEPNQKLQPPPSDLPKC

SEQ ID NO: 140058 - protein, 168 aa, Glycine max
  Coding DNA Sequence Number=SeqID_23280
  Gene Ontology: Mol. function=structural constituent of ribosome; Cellular component=intracellular; Biological process=translation
  Homolog annotation: Hit_ID=Q9ZQW2; Match level="QueryCoverage=92%, HitCoverage=28%, E-value=7e-60, Identity=65%"; Hit description =Laccase
  Pfam annotation: Domain name=Cu-oxidase_3; Domain location=29-145; Score=232.4; E_value=9.9e-67; Accession=PF07732.5; Description =Multicopper oxidase
MDFPHFPSFASLRVLLFCFCVMTLFPEFVVEYLNVTRLCHTRNILSVNGKFPGPRLVAREGDRVVVKVVNHVSNNVTIHWHGIRQMTTGWADGPAYVTQCPIQTNQSYTYNFTIVGQRGTLLWHAHISWLRATIYGPIIILPKQNESYPFEKPHKEIPILFGIIATRY

SEQ ID NO: 140059 - protein, 101 aa, Glycine max
  Coding DNA Sequence Number=SeqID_23281
MKMLEVSLARNFDVTRKSNEFWLIDVGLKLQPKFGTFAKMTKIENYEREESGNYILKRQGYLAQFVQDPQVQTYSWEPYSETTLALHCHGCETSDAETRSS

SEQ ID NO: 140060 - protein, 197 aa, Glycine max
  Coding DNA Sequence Number=SeqID_23282
MYIKYGPKYIMKHSQQNKLSNETKTPHTYSQNNSKAPKFLKDMDASTRIKPRLLCKQSMGQNTPNDYNDGWLKFSQRGYIYLGIVILRTREGTPLVDQFKWRVLPLGFSKRTREGTSFVDLWLVKDFTRLKEISRTAGCLGTGCRHGFEVKAIGVGGGEKSDQNSKRVIVGVKVKRGQRWHGLSGKKCIPKEEGGSE

SEQ ID NO: 140061 - protein, 54 aa, Glycine max
  Coding DNA Sequence Number=SeqID_23283
MALKKLLAKRARKAIAGEGSSAALQAEIERQWTQLTEPMAKYDPEIVMEFCANA

SEQ ID NO: 140062 - protein, 98 aa, Glycine max
  Coding DNA Sequence Number=SeqID_23284
MTDILEPFGTFSRGALCVNTTPIRESLGASGKVIGVSRNISSHLHVNTFFVKALGQVPTGARSMIRSAHNQGRGVKEDEMAKPRPPPRFRLKTLKKRS

SEQ ID NO: 140063 - protein, 94 aa, Glycine max
  Coding DNA Sequence Number=SeqID_23285
  Homolog annotation: Hit_ID=Q3BQP5; Match level="QueryCoverage=64%, HitCoverage=6%, E-value=4e-19, Identity=78%"; Hit description=TonB -dependent outer membrane receptor precursor
MKLKSSQLRDAVVIALVAGATTATAHAQEATNLDRIEVTGSRIRQVDTETAQPVLSMSRATIEKSGFKTVADVLQNISAAGSPAISRSEPLSLR

SEQ ID NO: 140064 - protein, 104 aa, Glycine max
  Coding DNA Sequence Number=SeqID_23286
MRNNNLHDLEPFPNEKAVNDLGKSESGGKTSSVLMVKEHFSPEEFAILTRTKAANRQGILDEMPPYSQDVLDQFKQMMSQRLLPAGTFHSKQTHVPSSAQFHPA

SEQ ID NO: 140065 - protein, 59 aa, Glycine max
  Coding DNA Sequence Number=SeqID_23287
MAGAGWAETPECLTARGIKRGALKRPLTRPFCDYPQSRSRTASRTGQNHLKLQVGAGIT

SEQ ID NO: 140066 - protein, 137 aa, Glycine max
  Coding DNA Sequence Number=SeqID_23288
  Subcellular localization annotation: CTP_CleavageSite=49; ConfidenceScore=5.53e-01
MPQGCGINKLSLCKIAGKSAGQSTLFTKSLKNSTRLSLRSALWPAPLLRVSTGGHKVPCPHGSRAASQTREAVAGLLTRSPPCAGHSVRSGGACGLRVRPCLLSWSPGFVEVTAPEGAPFIHRSTAMSRFMHGDSVQ

SEQ ID NO: 140067 - protein, 115 aa, Glycine max
  Coding DNA Sequence Number=SeqID_23289
  Homolog annotation: Hit_ID=Q94BM7; Match level="QueryCoverage=53%, HitCoverage=7%, E-value=1e-20, Identity=74%"; Hit description =Putative phytochrome A supressor spa1 protein
MVFIDLEKTYNWVLREVLWNSLETKVGESRGNRREVRHVETRLGSTRLFFQVEVFIYHKAFPMPALSFKFYSSDPLFGNEEDDSTQFITSVCWRGQSSTLLAANSTGNVKILEMT

SEQ ID NO: 140068 - protein, 536 aa, Glycine max
  Coding DNA Sequence Number=SeqID_23290
  Gene Ontology: Mol. function=protein kinase activity; Cellular component=nucleus; Biological process=protein amino acid phosphorylation
  Homolog annotation: Hit_ID=Q9LJR3; Match level="QueryCoverage=88%, HitCoverage=55%, E-value=1e-151, Identity=57%"; Hit description =Photomorphogenesis repressor protein-like
  Pfam annotation: Domain name=WD40; Domain location=220-258; Score =15.7; E_value=0.17; Accession=PF00400.22; Description=WD domain, G -beta repeat
  Pfam annotation: Domain name=WD40; Domain location=270-308; Score =1.7; E_value=23; Accession=PF00400.22; Description=WD domain, G-beta repeat
  Pfam annotation: Domain name=WD40; Domain location=312-351; Score =41.7; E_value=2.5e-09; Accession=PF00400.22; Description=WD domain, G-beta repeat
  Pfam annotation: Domain name=WD40; Domain location=371-409; Score =5.0; E_value=9.5; Accession=PF00400.22; Description=WD domain, G -beta repeat
  Pfam annotation: Domain name=WD40; Domain location=414-451; Score =34.5; E_value=3.6e-07; Accession=PF00400.22; Description=WD domain, G-beta repeat
  Pfam module annotation: Pfam domain module=WD40::WD40::WD40::WD40::WD4 0; Domain location=220-258::270-308::312-351::371-409::414-451
QLLQSEFLNEPRDDIENCEAAVEVRERIDDQELLQEFLSLIQQKKEEAAEKLQHTISFLCSDIEEATKQKTLFNEITGTGLDDCTTSTFPSITVVDNEESACLGTRKRVRTIPCVDDTEGIDNNMSDDQKNDRSILSKTPRFLNNLQKLESAYFLTRCKSAYSSGKLAVQHSPIGTDERSCVNKVALKEKFREGKSPWTNPFLEGLSKYLSFSKLKVKADLKQGDLLQSSNLVCSLSFDRDAEYFATAGVNKKIKVFECNTTINEDRDIHYPVVEMVSRSTLSSTCWNTYIKSQIASSNFEGVVQLWDVTRSHVQSEMREHEQRVWSIDFSSADPTLLASGSDDGSVKLWNINQAIRPNILLYVLCLILDGISVGTIKTKANVCCVQFPLEFAHSLAFGSADHRIYYYDLRNLKVPLCTLVGHDKTVSYIKFVDTMSLVSASTDNTLKLWDLSLCASRVIDSPIQSFTGHMNVKSQWFDAMFDLDKYNGVSDGSMDIGIPCIESLLNGISELEVKESIKEDDYGSNLLATTDGAIS

SEQ ID NO: 140069 - protein, 48 aa, Glycine max
  Coding DNA Sequence Number=SeqID_23291
MHSLLGVCHLSTFSCPFSVILRLFMCGLSVYAYMFLVEVGIVGARYAG

SEQ ID NO: 140070 - protein, 49 aa, Glycine max
  Coding DNA Sequence Number=SeqID_23292
MDMFIATPHGTVRPNFFEKVLDTLMYDFIVEATLEVVKDDYLVVDVWVP

SEQ ID NO: 140071 - protein, 231 aa, Glycine max
  Coding DNA Sequence Number=SeqID_23293
MPTKGITPLPYTGNIMKGYNYKKLKTQVLAIEKEKGQPIVTQAYEKVVEGASQKYAQADVEIDQPIIKPTLDGGVSKDPNAGNLPIVVEAKAKLKADADEKRKLKDVAKSKIKEMDFILAKKNEDNKGLTEKTNVLAKDVVDSKKLGEALSNQLTKEEEKMKVVEIEMDAALGEKKLVKDKEGFQKALCQVALFASQLELNKFNVNMDVKYGILMKESQIKILKRSMRAMK

SEQ ID NO: 140072 - protein, 160 aa, Glycine max
  Coding DNA Sequence Number=SeqID_23294
  Gene Ontology: Mol. function=protein kinase activity; Biological process=protein amino acid phosphorylation
  Homolog annotation: Hit_ID=Q9LJR3; Match level="QueryCoverage=47%, HitCoverage=8%, E-value=2e-32, Identity=85%"; Hit description =Photomorphogenesis repressor protein-like
MNGSSSGFSWQKIFSSRSLNFFGGFDRMGDISLRLWLDKPERSVNVSECLHIFREIVEIVHVAHSQGIVVHNVRPSCFVMSSFNHVSFIESATCSDSGSDTLEEAVEIKTPTPTPSYDMHQQRCLGSEDFVPVKTSTASLTDSSCMLSSLGVCGTCIINR

SEQ ID NO: 140073 - protein, 262 aa, Glycine max
  Coding DNA Sequence Number=SeqID_23295
MAAFHGYHSPYGASTFHYHHPHYSSPNEASMAAEDRLEAILTKLDAATRRLDSQLDALLLRLPRRPVHHYPPQSPCSTPIQPSPTPSPPLSRTPPPPPPFPAQPPLTPPSPLLLTTPPPPPLKPTPPPPALRPNHAAPLPVLFSMPVLHLAAHSKHQVAHASSSIFNQLGHTRVVASLNNLSRIVVHYGREAAPHDKLLGHRDMALLEKSNVPYGSTLVARERQSTAFALGTVADPKDPHRYRPWDPGGPRQTQNTLTTRCF

SEQ ID NO: 140074 - protein, 51 aa, Glycine max
  Coding DNA Sequence Number=SeqID_23296
MAVSKLRMMQRVPLGVGFQRRTMAVYGGYWWLWVMDERRRRNGIFPKLLGL

SEQ ID NO: 140075 - protein, 59 aa, Glycine max
  Coding DNA Sequence Number=SeqID_23297
MGSKKALNLVLKVVMVDNAKSAYRMDEWTNPREVKVNAYLVEVSHYPLPSIFDKATLPP

SEQ ID NO: 140076 - protein, 315 aa, Glycine max
  Coding DNA Sequence Number=SeqID_23298
  Gene Ontology: Mol. function=transcription factor activity; Cellular component=intracellular; Biological process=regulation of transcription, DNA-dependent
  Homolog annotation: Hit_ID=Q12EN7; Match level="QueryCoverage=70%, HitCoverage=89%, E-value=4e-76, Identity=63%"; Hit description =Transcriptional regulator, GntR family precursor
MSMSGHSQHLGQGLCGLRALQADAPLQVREMVVVDLDRLGHLPLFHQVDDLHVFAMLAGGVAGRFIQRHDQRAARHQFGQVAVQDGVARQFAQAHMEGAGLARPGRLAGAVQQGMLVAQLLAQRGVVGLGGARGRQRQQGRFQRAPRLEDLARVLGGGFGHHRAAVVVQVDHMLVGKALQRLARDRARNAEDVAQRRLGQLGAGRQPLAHDTFIDRLANAALHVGIGGRVLQVFGHGGGGPARRRRPGTGFGGIAGRHGGLGGNEGKGSINGKTVRSPVAAHRRARRSGPAWRTRSRPGRARPPTGPAPGAGAAG

SEQ ID NO: 140077 - protein, 152 aa, Glycine max
  Coding DNA Sequence Number=SeqID_23299
FDKFKEELKRRHWDEKLTDFSDSSIDIAVVKEFYANLYDPEDKSPKQELAAKLCIPWRGFERNADGHPLKILRKNMTMLSQTWSVPSFSNIIPTFHTSDVTLDRAKLIYGIIMKMDMNLVMQSYPARALDRKLQVDWARDAREGPRVLMSLR

SEQ ID NO: 140078 - protein, 85 aa, Glycine max
  Coding DNA Sequence Number=SeqID_23300
MKQLWDTLAITSEGSSQVKRNKLIEPFEVLKHGLEVFENKGPDIVSSKLVKLFFHDNNSVIIYEGFIYGLGLYLKHKSIGSKIFE

SEQ ID NO: 140079 - protein, 318 aa, Glycine max
  Coding DNA Sequence Number=SeqID_23301
  Gene Ontology: Mol. function=metal ion binding; Cellular component =intracellular
  Homolog annotation: Hit_ID=Q9SYM2; Match level="QueryCoverage=99%, HitCoverage=99%, E-value=9e-70, Identity=48%"; Hit description =Putative salt tolerance-like protein At1g78600
  Pfam annotation: Domain name=C1_1; Domain location=42-95; Score=-1.0; E_value=0.034; Accession=PF00130.12; Description=Phorbol estersdiacylglycerol binding
  Pfam annotation: Domain name=zf-B_box; Domain location=1-47; Score =51.0; E_value=4e-12; Accession=PF00643.14; Description=B-box zinc finger
  Pfam annotation: Domain name=zf-B_box; Domain location=52-99; Score =54.9; E_value=2.7e-13; Accession=PF00643.14; Description=B-box zinc finger
  Pfam module annotation: Pfam domain module=C1_1::zf-B_box::zf-B_box; Domain location=42-95::1-47::52-99
MKIQCNVCEAAEAKVLCCADEAALCWECDEKVHAANKLASKHQRVPLSLSASHMPKCDICQEMVGYFFCLEDRALLCRNCDVSIHTANACVSDHQRFLLTGVRVGLEATERGASSSSVKSQSGEKMSDAKSSSISRNVSSLPQPSNANEVLPLQMQGVEEFPPSNFSGYTSGNVSQWPIEEFLGLNELSQYYNYMDGSSKETRVNMTGVELVQPSEGKFPVKHVITADSGKLGDSDSSVLRSGEEDMDDDGFLGRVPDSSWTVPQIPSPPTASGLYWPKVPQYTSDSAMSVPDICFSHVRQPHHAQHNSNVSKRRRQL

SEQ ID NO: 140080 - protein, 269 aa, Glycine max
  Coding DNA Sequence Number=SeqID_23302
MKDVESVDHMFGKLQVLLNSLEALGQMYSKAHINLKVLDNFPKESDGLENSVGSTDDKVNLMSRKFKQMMKKKGNFQHSSRRKDSRYSKDKIKKILMVTWDESDSEQSSISNDGQANIYLMADTNDKTKCKKFEEKFKDYAYENTELRKSNEDLKKKIQTIQESLSLASKTDETFTVEKLSEEVIFLSKDFEKFLESSKTLTTLLKFHQHPHDKSDLGFEKGTTSSKSQFISNKCNFCDILGRKRMRFKLVPGQWMFMTHDGQKVYVPR

SEQ ID NO: 140081 - protein, 116 aa, Glycine max
  Coding DNA Sequence Number=SeqID_23303
MAKFDPEIVMEFYANAWPTEEGASNASIAGGGVRPQALMRRLLANCCACRGRTLPGPQQGESKILPSDHNSDLTLLKCQLVYTILTHVSVHVAQLISDAIYQFAGIVRTRHPVDPE

SEQ ID NO: 140082 - protein, 62 aa, Glycine max
  Coding DNA Sequence Number=SeqID_23304
MTVSWAKRASTAECSFGVLSAKENLAKHQHQGRALSTAGVFSQAQRKTGAKPKPTYPRKARG

SEQ ID NO: 140083 - protein, 252 aa, Glycine max
  Coding DNA Sequence Number=SeqID_23305
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=3e-37, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYMSSTSEDYTFSPLEDYMSLPYEGYTASPFEDYTPSPSEDYTSSASEDYTSSPSEDCTGLQALAFVGLHAPTLKGLLILTFRGLHVLTFSGLHAFALTGLHVLTYRGLHNLAFRGLGALAFKGVHILPLRGLHALAFVGLHTLTFKGVHILNFRGLYIVAIRGLHVLAFRGLHVLPFRGQHDLPFRGLHALALTGLHVLTFRGLHNLAFRGLDALAFRGVHILPLRGLHALAFVGLHTLTFKGVH

SEQ ID NO: 140084 - protein, 59 aa, Glycine max
  Coding DNA Sequence Number=SeqID_23306
MDVVESGSLEIGSTNVDSDSSEMELDMGDEMTTLSKQARTTAENAVDQKCHTHRIVQQR

SEQ ID NO: 140085 - protein, 147 aa, Glycine max
  Coding DNA Sequence Number=SeqID_23307
MGLHSSSSVNGEGCNCGSNAFQGYFDDAKESRVKKIPKIQELRFKNNQDQDSRINRRLNQDKSHTKHYSQRREKDRRLQKVNISLQYFHGKANVEIYLDWEMNVEQLFACHHISEERKVHWLPSTFKGMSFIGKLPLLGKEEFIRIL

SEQ ID NO: 140086 - protein, 35 aa, Glycine max
  Coding DNA Sequence Number=SeqID_23308
MSLDAIAKMINEDKIHILVNLNGYTKVGGSETACT

SEQ ID NO: 140087 - protein, 112 aa, Glycine max
  Coding DNA Sequence Number=SeqID_23309
  Gene Ontology: Mol. function=structural constituent of ribosome; Cellular component=ribonucleoprotein complex; Biological process =translation
  Homolog annotation: Hit_ID=O80361; Match level="QueryCoverage=94%, HitCoverage=37%, E-value=2e-33, Identity=69%"; Hit description=50S ribosomal protein L4, chloroplast precursor
FHRRDELLRLWLLGELRHKVLHHDGTGGSAGNSGGDGEALLLAVDLDGPVAGLRAEGDASAGAEGSAVGAAVGAAGFFLREGLPAAASDLAAGEGGGGAAVLVLEVGAAALV

SEQ ID NO: 140088 - protein, 82 aa, Glycine max
  Coding DNA Sequence Number=SeqID_23310
MVMGDPISRLSFPACLHFSGENTETFSSLTSYPELRRSEFLIGGYVGARASLLSTTPPFVAMTQELVARGDTLRLSATSSFS

SEQ ID NO: 140089 - protein, 92 aa, Glycine max
  Coding DNA Sequence Number=SeqID_23311
  Gene Ontology: Mol. function=structural constituent of ribosome; Cellular component=intracellular; Biological process=translation
  Homolog annotation: Hit_ID=Q1STG0; Match level="QueryCoverage=77%, HitCoverage=58%, E-value=3e-23, Identity=76%"; Hit description =Ribosomal L22e protein
MAAYKRSMAKRVPFREVAVGGDDDLALVPGDGNGIAKCTGLVTNLNPILKELLQRNNVHNLILHQLRAIDHEARCLLLPLHSAHFRASPFLP

SEQ ID NO: 140090 - protein, 461 aa, Glycine max
  Coding DNA Sequence Number=SeqID_23312
  Gene Ontology: Mol. function=zinc ion binding
  Homolog annotation: Hit_ID=Q1RSK3; Match level="QueryCoverage=73%, HitCoverage=41%, E-value=1e-160, Identity=74%"; Hit description=Zinc finger, RING-type; Transcription factor jumonji, jmjC
  Pfam annotation: Domain name=Ribosomal_L22e; Domain location=4-96; Score=44.5; E_value=3.6e-10; Accession=PF01776.7; Description =Ribosomal L22e protein family
MSGVKGKKKAASFVIDCAKLVEDKIMDIVSLEKFLQDRIKVGDKAGALGDSITVTRDKSKIIVTSDSNFSKRYSLRHAPLLQALGFIETPYINLDNPLAMELMEVYESMGDTLAFQYGGSAAHNKIRIREIPVLDKLQYLHVLLSSVLPVIKQIRREQCFQVELEKKLRDLQEATADHNKEPQTEQAKTFDRNILSKFLHWRSNDNGSIPCPPKEYGGCGYSTLNLSPIFKMNRVAKLVKNVEEMVSGCRISNADGPPETGLNDLRLCQYFHREASDDNYLYCPASDDIKTDGIGSFRKHWKTSEPIIVKQVFDGLSILSWDPMVIWRGILETTYEKEKDENGMVKAIDCLDGSKLAHFMKGYFEGHILENGWPQLLKLKDWPTPSASEEFLLYQRPEFISKLPLLQYIHSKWGLFNVVAKLPHYSLRNDVGPKIYISYGISDELRRGDSVTNLHFNMRDM

SEQ ID NO: 140091 - protein, 216 aa, Glycine max
  Coding DNA Sequence Number=SeqID_23313
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=65%, HitCoverage=9%, E-value=5e-45, Identity=58%"; Hit description=Chromo
  Pfam annotation: Domain name=Chromo; Domain location=131-176; Score =12.2; E_value=0.036; Accession=PF00385.14; Description='chromo' (CHRromatin Organisation MOdifier
MYLRCFVFDNPKLWYPMLAWAQYWYNSSYHHNLGMSPFKALFGREPPIVVPYQVHPKDPVSLQETLVNRDNLLQKLKGNLARAHNYMKMQANKKRRDFQLEVGDLVLVKLQPYRQHSIALRKNQKQGMHFFGPFEVVEHVGQILIQWESFDASEASWEDFTAIKQSYPRFNLKDKVDFKGKGMMDSWKAIHKTWPREEAQGPEAIEKAKLDLHLEI

SEQ ID NO: 140092 - protein, 110 aa, Glycine max
  Coding DNA Sequence Number=SeqID_23314
MLSGTEASSILQTSSQRSQRSDCEAADQISRRSNGMSLKKCTNTLGVKDDDDCSGEENSKKGPLAKVSWYLLIIPRFKCLFTKGDNAKYLTRHANGRDCDGILHHLADSS

SEQ ID NO: 140093 - protein, 295 aa, Glycine max
  Coding DNA Sequence Number=SeqID_23315
  Gene Ontology: Mol. function=N-acetyltransferase activity; Cellular component=intracellular; Biological process=metabolic process
  Homolog annotation: Hit_ID=Q2HRF3; Match level="QueryCoverage=97%, HitCoverage=43%, E-value=8e-99, Identity=65%"; Hit description=SDL-1 protein
ICITTSTSAGLEQTLPWIFYHKVIGVSSFLLFVEGKAASPNVTRVLETIPGVKIVYRTRELEEQQAKRELVEYMGFEIFISLVESLAFFMENLFWVVLSKCIPIWGHDAEIQNMDVIKCLSYEILLSYSRIWNETWLATFFYKPCNYELFVKQSLNMEMAIVMARDSGMDWIIHLDTDELMHPAGTQEYSLRQLLADVPGNVDMVIFPNYESSVERDDIKEPFSEVSMFKKNYDHLPKDVYFGNYKEATRGNPNYFLTYGNGKAAARIQDHLRPNGAHRWHNYMKAPKYVDPACH

SEQ ID NO: 140094 - protein, 327 aa, Glycine max
  Coding DNA Sequence Number=SeqID_23316
MVTRFNQTSIQRDKWHSTVPAWERKFCTSIGSVPWRKLVESKKYMHLFEHVVNWDDSAGKEAFDNAKMRYWAEINGVPCNISLPDPNIYTDEVDWNAIVDPQLILDMEMELAKVPNEELRNDHEIVMIGGALFLNEQQLPCTGWDDDYAAEAPNPNSAVQGWAANLQANNGVESGQQNHAPAEHVEEHFAPAEPAKEDFAPAEHAKGYEWQDWRNDSWGWNQRENNGGGGDLHKMGRGRNGRGYGNWGTWDGYNRRRENMSWSKTPTNGNNEYHVNNRGRRNYREGGGRRGNFVYVPKEVPPTPTPAGWLRLQQGDPNETAEVAEDI

SEQ ID NO: 140095 - protein, 328 aa, Glycine max
  Coding DNA Sequence Number=SeqID_23317
  Gene Ontology: Mol. function=hydrolase activity, hydrolyzing O -glycosyl compounds; Cellular component=vacuole; Biological process =carbohydrate metabolic process
  Homolog annotation: Hit_ID=Q39900; Match level="QueryCoverage=92%, HitCoverage=87%, E-value=1e-143, Identity=83%"; Hit description=Beta- 1,3-glucanase
  Pfam annotation: Domain name=Glyco_hydro_17; Domain location=21-328; Score=577.0; E_value=1.8e-170; Accession=PF00332.9; Description =Glycosyl hydrolases family 17
SVINSALVPYCSSISGAGAQSGVCYGRVGNNLPSPQEVVALYKQYDFRRMRIYDPSQQVLQALRVSNIELLLDLPNVNLQSVASSQDNANRWVQDNVRNYANNVRFRYISVGNEVKPWDSFARFVVPAIQNIQRAVSAAGLGNQIKVSTAIETGALAESYPPSRGSFRSDYLTSYLDGVIRHLVNNNAPLLVNVYPYFAYIGNPRDISLDYALFRSPSVVVQDGSLGYRNLFNAMVDAVYAALEKAGGGSLNIVVSESGWPSSGGTATSLDNARTYNTNLVRNVKQGTPKRPNRPLETYVFAMFDENQKQPEYEKQAGMVRMELYLHY

SEQ ID NO: 140096 - protein, 54 aa, Glycine max
  Coding DNA Sequence Number=SeqID_23318
  Subcellular localization annotation: CTP_CleavageSite=14; ConfidenceScore=5.25e-01
MAAATAISQLGCFSAVHRSSHLRRRSLLFPCPRSKGSCLATIVCIKHANVEVTT

SEQ ID NO: 140097 - protein, 122 aa, Glycine max
  Coding DNA Sequence Number=SeqID_23319
  Gene Ontology: Cellular component=membrane
  Homolog annotation: Hit_ID=Q016B4; Match level="QueryCoverage=92%, HitCoverage=43%, E-value=8e-16, Identity=39%"; Hit description=[S] KOG4267 Predicted membrane protein
  Pfam annotation: Domain name=TMEM14; Domain location=6-104; Score= -1.3; E_value=0.0011; Accession=PF03647.4; Description=Transmembrane proteins 14C
  Subcellular localization annotation: CTP_CleavageSite=44; ConfidenceScore=5.15e-01
MEHCAEQGGFVLTGGIIGFLFSRSPATLGSGVLFGGALLFLSTFSMKVWRQGKSSLPFILGQAALAGVLIWKNFQSYSLAKKIFPTGISAIISSAMLCFYLYVLISGGNPPPKKLKPSASTA

SEQ ID NO: 140098 - protein, 150 aa, Glycine max
  Coding DNA Sequence Number=SeqID_23320
PVLGWSEDWESQTRLVALYAGLTKRRVQDFVKSCDHPCIAKTVTELFSRCDKAAWYSQISVALPQWVMWAQLWYNKSLQAATGRKLGFLKIVPNNLPKGLELELQDQGEPEYVMVMDEFVPCSQFPSFILKDKAEAPGKGHVRTQGSVME

SEQ ID NO: 140099 - protein, 379 aa, Glycine max
  Coding DNA Sequence Number=SeqID_23321
  Gene Ontology: Mol. function=nucleoside-triphosphatase activity; Cellular component=mitochondrion; Biological process=response to DNA damage stimulus
  Homolog annotation: Hit_ID=Q8RY99; Match level="QueryCoverage=99%, HitCoverage=93%, E-value=1e-101, Identity=53%"; Hit description=DNA repair protein recA homolog 2, mitochondrial precursor
  Pfam annotation: Domain name=Rad51; Domain location=46-295; Score= -134.9; E_value=0.022; Accession=PF08423.2; Description=Rad51
  Pfam annotation: Domain name=RecA; Domain location=36-379; Score =311.1; E_value=2e-90; Accession=PF00154.11; Description=recA bacterial DNA recombination protein
  Pfam module annotation: Pfam domain module=Rad51::RecA; Domain location=46-295::36-379
MSRIGMTACSLSSAAEASDFECDAIHDDVKAAEKDNALCLAVSQLASEFSKESMLSLQKIFGVRRAHVISTGSLKLDLALGIGGLPKGRIVEIYGREAAGKTTLAIQIIKEAQKLGGIGVTINSWLSNDNELLELGYCAYLDVENALDFSLMESMGIDTENLLISHPDCAENLLSMVDTLTKSGAVDVIVIDSVAALVPKCELDQLGVTTNRDLQSRMMTQALRKIHYSLSHSQTLIVFINQIRLSPKSAKEYGSVEEVTCGGNALRFYAAVRLRLSRVRLIKTEDKVEGVMICAQVVKNKLAPAATKRAELGIKFGRGFCHESDVLDLACEHGIFVKHEGSYFIEGNSFDSREAAELFLAQNHAVCDKVVKDMRRLYF

SEQ ID NO: 140100 - protein, 74 aa, Glycine max
  Coding DNA Sequence Number=SeqID_23322
MQNVLNLIRPNLKTDESGIWNNPMEGCMKNNSGGAYLPVVGVASCGVVIKGNNGSFVWAYSRRLGHCLILEVEL

SEQ ID NO: 140101 - protein, 77 aa, Glycine max
  Coding DNA Sequence Number=SeqID_23323
  Subcellular localization annotation: CTP_CleavageSite=62; ConfidenceScore=5.43e-01
MVFGASVVFVKFLKTLGKIKKDENQIRNTSVRLPKSKSRCFRNASVSDSVKILHRSSPFLVRSSSFFGFQPFSFPPL

SEQ ID NO: 140102 - protein, 51 aa, Glycine max
  Coding DNA Sequence Number=SeqID_23324
MIPSVRGLGNLHTARSTRELELEGEKEKRPMLNHLRLAVIGMDKLYPTNNA

SEQ ID NO: 140103 - protein, 129 aa, Glycine max
  Coding DNA Sequence Number=SeqID_23325
MKGGEDLHHHHYHQNNFPFQLLEKKEDQETASCSTSSLYPSLRSSGSFMSVPSQLRSSYFNPNFSLQQHQRRTFFLSIACSSDNTNNNTSTLLNFQSNTLNTTMLQQQAKPELSNDGVPSCLDISDTIV

SEQ ID NO: 140104 - protein, 57 aa, Glycine max
  Coding DNA Sequence Number=SeqID_23326
MGAKYLEVVKRGSHPNNGWSPDETRMEAVLPIEVEIPSLRVLMEAKLEVLDKWPQIS

SEQ ID NO: 140105 - protein, 130 aa, Glycine max
  Coding DNA Sequence Number=SeqID_23327
  Gene Ontology: Mol. function=DNA binding; Biological process=RNA -dependent DNA replication
MVIPKFKVPDFDKYKGTTYPMNRLKMYCRKMGAYAKDNKLLIHFFQESLTGVDVTWYANLKPSQVHSWKDLMVAFIRQCQYDSDMAPDRMQLQNMCKKGHESFKEYAQRWRDLAAQVAPPMTKREMLTVI

SEQ ID NO: 140106 - protein, 185 aa, Glycine max
  Coding DNA Sequence Number=SeqID_23328
MTIICLYVPSYLIVSGWRKAHNDHNLSLRAIGLDRLWMVKRCGMTIICLCVSTGSPPLVDKRCGITIICLRMSSGSPPLDDKRRRMSIICLCMSTSSPPLVDRRCGMTIICLYMSPGPPPLDDKRCRMTIIYLCVSTGSPPLVDEKVRNDHNLSPHVIGLATSGLQKAQNDHNLSLRVNELTASG

SEQ ID NO: 140107 - protein, 107 aa, Glycine max
  Coding DNA Sequence Number=SeqID_23329
  Homolog annotation: Hit_ID=Q1SFH9; Match level="QueryCoverage=38%, HitCoverage=12%, E-value=1e-09, Identity=73%"; Hit description=SH3; tRNA-binding arm
MGLAFACLALVLMMFNIFRLEAVVLDLVADDGAGIQKQRSMYHWDKRGKIMVILRIQQVWQVLDPLRQMINGVPLEDACHLTQRYSRMRQEAEAQEMNLDTRDLSRR

SEQ ID NO: 140108 - protein, 219 aa, Glycine max
  Coding DNA Sequence Number=SeqID_23330
MDECERIDERLRAWTWLNGVPNFTRRLREVSLTGGETCKTKTPTLNDPCKDSLAYVMPNPSRLEDDLRVDAKAILNTPTPYATLFDDNKVIWRLSKDGCLPTRHALSATQCVVHSSQLTTRGNNIGHRHDFVELVVRARSSQRVEPMVNHQLQRWMLPPPGSLKCNLDETFFSQEMALSNVIQDFSNWKPYFPMVKEGEAMTLKSALLWLQTERGEGHH

SEQ ID NO: 140109 - protein, 263 aa, Glycine max
  Coding DNA Sequence Number=SeqID_23331
MSWKFTDCLTMGIKYLEVVKRRQHRKQDLVEVGPWLPGKDFSFDIYEELCLNFPWLKFLPNQCGDSSLDLQSSSSNDYEDGPRRWLGFSRSMYQGWTLGFHTKGGTWERLSRVDLAYLEFPWGWNLVMERASPRVTLGLSSLGPGTCLSKYKCYALAYMALAVGGIYWRRGGVNQWDLPRADLGFCNPFRGLTRKLFDLGFEHRALEHMSLVVGGTHRRRGDMLLHICHSPWVTHIGVMMGGCFMWELPSSPGRAGQQPPPSF

SEQ ID NO: 140110 - protein, 186 aa, Glycine max
  Coding DNA Sequence Number=SeqID_23332
  Subcellular localization annotation: CTP_CleavageSite=37; ConfidenceScore=5.21e-01
MGVQIATRPSWALQDVPLQGGCFWRKQPSSPGRAGFCQVKVKSLGTTSLKELGQLMGHLQRQAFRKAYSKIWDLAIIEVSTKAIASLAQYYDQSLRKPYLFSGFYPSLARISKIVQISAQELDHRKRMGPVHRYSRTVDLRRSPLSECGWPTYMTPSTEDVKRAIQGLFAVLQLFMYGWFRTFFAK

SEQ ID NO: 140111 - protein, 134 aa, Glycine max
  Coding DNA Sequence Number=SeqID_23333
  Gene Ontology: Mol. function=sequence-specific DNA binding; Cellular component=nucleus; Biological process=regulation of transcription, DNA-dependent
  Homolog annotation: Hit_ID=O22300; Match level="QueryCoverage=55%, HitCoverage=17%, E-value=2e-38, Identity=96%"; Hit description =Homeobox protein knotted-1-like LET12
  Pfam annotation: Domain name=Homeobox; Domain location=29-86; Score= -9.9; E_value=0.054; Accession=PF00046.19; Description=Homeobox domain
MSLVVAVVSPSLAHVAVDKIVDIREEILRKRRAGKLPGDTTSLLKAWWQSHSKWPYPTEEDKARLVQETGLQLKQINNWFINQRKRNWHTNPSSSSGSKSKRKRWVSSFLVYFWIKVRRDQSSGAGESSNQSFM

SEQ ID NO: 140112 - protein, 251 aa, Glycine max
  Coding DNA Sequence Number=SeqID_23334
  Homolog annotation: Hit_ID=Q1SS89; Match level="QueryCoverage=26%, HitCoverage=7%, E-value=3e-07, Identity=46%"; Hit description =Integrase, catalytic region
DTKRLKESGIVRDLASGTTTWLISSKKGWSKQMVCCNTPIESHQNERDSEAVQNSTINRDWLGVVIVPGSRRSRLLRSQKGLPMRVLTNKDIKDATRVGSARPFPSYHEALPVTVLKLPPSHEPLSWWLDASLSPPLSCLCLEWVVICCARGCAAIKVVSPSFIPVSIPRSYHGGYSQQMVNGSFPEDPTMGANVQVGEHQGEGALGKRLMFKKHEHMKVKGYTYAYWVGNITDRHSRSDYFTFVASFLVT

SEQ ID NO: 140113 - protein, 62 aa, Glycine max
  Coding DNA Sequence Number=SeqID_23335
MTTTSKCNDSPFHGNDGYTFFQIWKKSRTTTHCSDLEQIITISNNQLRCCNYKEEDREDEQM

SEQ ID NO: 140114 - protein, 52 aa, Glycine max
  Coding DNA Sequence Number=SeqID_23336
MPLLKITNNTFLSVYEHYPKGLIRGIPLKSTKIQELLRRAKATEPSSHKVKA

SEQ ID NO: 140115 - protein, 233 aa, Glycine max
  Coding DNA Sequence Number=SeqID_23337
MAEDQPQTVTLEDYSSSTLIQGNLFHGLPNEDPYARLATYIEICSTVKIVGVPEDAVVEKFLKKYFPESKTAEGKASISSFHQFPDESLSHSPSSYWMLLLEEKTKLKTPEEAMELIENMVASNHAILRDRTQVPTKRSLLELSSQDALLAQNKLLAKQLESLTETLSKLPTQLQVTQPSHLTVLQVGGCSLCGGAHESGCCIPLEDATKEVNYMGNQHRPGFNAGGFVGYQQ

SEQ ID NO: 140116 - protein, 138 aa, Glycine max
  Coding DNA Sequence Number=SeqID_23338
MRDKEQHDMQIRKRSKDGPRAIQYNHQTKHLVMGLHINHLTNIAKKQQSKNHISKGKGKIRWRWHLLESDERNAKINDRKVHKMLEDAAANGIPVSLGNGFCDFEENGRPLAQDYDRGFAISSFLTPFLDFEKILSWT

SEQ ID NO: 140117 - protein, 87 aa, Glycine max
  Coding DNA Sequence Number=SeqID_23339
MVGLSCKLTLRMCRRKKWLQRSFQLRGQGKMPFEKVDKSGALAPTYLPSKRKSDLHNSFLRVNHTISFYLKGDHLKVLDLNKLIIER

SEQ ID NO: 140118 - protein, 76 aa, Glycine max
  Coding DNA Sequence Number=SeqID_23340
MGNGDNTKCQFIIEFKEMNANAKRKAKMHKWRLRATGLEDSHELWVVFEGWGRNGVKNGFTSPLLKLSSDMLAQAS

SEQ ID NO: 140119 - protein, 101 aa, Glycine max
  Coding DNA Sequence Number=SeqID_23341
MSSAFYLSKTVRVFCLRDYQVYWLAETIEVFTAWASDSGRSDAPWLAQASLWLTWATKNLRVEVTSSPTRAELAWARKVTFGGSNQLAWASYYATSTPHFL

SEQ ID NO: 140120 - protein, 175 aa, Glycine max
  Coding DNA Sequence Number=SeqID_23342
  Subcellular localization annotation: CTP_CleavageSite=69; ConfidenceScore=5.61e-01
MVAMVSIVLGSIQTKSRRRYKGLTLVVFVSLVRPMRVGPCATFPFVTFMFNLSNFISKPQHFFHLNVPLARSRNSSMLLEEVSLGEEHMQVLLRVCGPIMTLQVEQFPTQGQVNHHDSIYERKSSSHPSFMSICMRGVVIIHGILGLTRMRFPLGALIDCMGGVFVSLKEPNMSL

SEQ ID NO: 140121 - protein, 102 aa, Glycine max
  Coding DNA Sequence Number=SeqID_23343
MNHLFKSSVPLLLVLVQSLLLDTKDALPPQDERTPSPPPQRDDSALMTKVLSELQGLRTYVGEHFDSLDNRFAGMDIRLTQLEEDVGYIRLSFDLPPPPPPS

SEQ ID NO: 140122 - protein, 1478 aa, Glycine max
  Coding DNA Sequence Number=SeqID_23344
  Gene Ontology: Mol. function=RNA-directed DNA polymerase activity; Cellular component=chromatin; Biological process=chromatin assembly or disassembly
  Pfam annotation: Domain name=Chromo; Domain location=1386-1436; Score= 19.1; E_value=0.0055; Accession=PF00385.14; Description='chromo' (CHRromatin Organisation MOdifier
  Pfam annotation: Domain name=RVP; Domain location=343-448; Score= -4.4; E_value=0.011; Accession=PF00077.10; Description=Retroviral aspartyl protease
  Pfam annotation: Domain name=RVP_2; Domain location=329-462; Score= -41.9; E_value=0.0018; Accession=PF08284.2; Description=Retroviral aspartyl protease
  Pfam annotation: Domain name=RnaseH; Domain location=845-966; Score= -24.9; E_value=0.012; Accession=PF00075.14; Description=RNase H
  Pfam annotation: Domain name=rve; Domain location=1099-1255; Score =112.4; E_value=1.3e-30; Accession=PF00665.16; Description=Integrase core domain
  Pfam annotation: Domain name=zf-H2C2; Domain location=1040-1081; Score=10.2; E_value=0.016; Accession=PF09337.1; Description=His(2) -Cys(2) zinc finger
  Pfam module annotation: Pfam domain module=Chromo::RVP::RVP_2::RVT _1::Retrotrans_gag::RnaseH::rve::zf-H2C2; Domain location=1386 -1436::343-448::329-462::587-756::110-200::845-966::1099-1255::1040 -1081
MADHATRKTTTDRLEEAITRLSNSQSSLLDKHADLVDKYSELSGKVDTLLDHLHLRSPAREHHGTSSQFHQRNSVKIDVPRFDGRDPMGWIFKISQLFEYQNTPEEERITVASFYLDGAALSWYQWMFRNGFITSWSGFLQALESRFAPSFYDDPKGALFKLTQRGTVNEYLTEFERLANRVIGLPPPFLLSCFVSGLTQDIRREVLALQPISLPQAMALAKLQEDKIRDRRQAPSRGHNTPSPSYAPPSRKPQSTYVQRTPEEMALRREKGLCYNCEEKWSSTHRCKGRVLLFIADNPSLLPDEPNPEPPLLPEPILACPLDLDTTSDFTSPHVSLHALSGLPSSETFRLVGIINHSSLTILIDSGSTHNFLQPRLAQFLHLKTENTNPLHVLVGNGSVLECNQVCRDTSLLLQGHQFTVTFHLLPISGADAVLGIEWLRQFGPVITDYTAFSMKFTHMGRPIELHADISTGPKPISAPQVKRLLQTGSVSALFHLKMIPDQQPDPLLHLPHPIPAVEALLTQFHKLFRQPSSLPPPRSIVHHINLLPNTTPINVRPYRYPQVQKSEIEKQVLELLESGLIQPSMSPYSSPVLLVKKKDGTWRMCVDYRALNAVTVRDRFPIPTIDELLDELGGAAWFSKLDLRQGFHQILMHGPDVEKTAFRTHQGHYEYRVMPFGLCNAPSTFQAAMNTLLTPFLRKFAAVFFDDILIYSRTLASHLHHLELIFQTLLQSQYYLKKTKCLFAQKQIEYLGHVVSGQGVEPEPSKVQAMVQWPTPSSAKELRSFLGLTGFYRKFIKNYAMITAPLTSLCSKEPFEWPSEAQSAFDRLKTAMTSAPVLALPDFDEPFIIETDASGAGMGAVLMQKGHPLAFFSKQFGPRMVHASTYVRELHAIVAAVRKWRQYLLGHPFTIFTDHKSLRELMSQVIQTPEQHYYLSKLLGFDYTIQYKVGSSNAVADALSRTTPSGEFLLLSVPHLDFMRDLRNTLHSSNEFQELLSKVRDNPGDFPDYRIHQGLILFKNRIWLNNDNPSIPSLMFEFHATPIGGHLGVTKTTHRLESNFFWSSLRKDIKRFVKECTTCQQTKSSTQRPAGLLQPLPPPTGVWEDISMDFITQLPSSHGYTTIMVVVDRYSKGVHLGALPSNHSAFKVASLFIDIVCKHHGFPRSIVSDRDPIFLSSFWRELFRLSGTRLRMSTAYHPQSDGQTEVMNRVLEQYLRSFVHAQPNTWYRYLTMAEWCYNTSIHSSSGMTPFEVIYGKPPPTLPHYLQGASTNEAVDSMLHSRQEIHRKLQQRIRKAQDAMKKAADKKRRDVNYSIGQWVYVKLRPSGSVPSQISERVGQVSYKLKLPDAARIHPVFHCSLLREHHGTPPTQPDRWPLQFIAHKPVARPLCILDSKLDTSSSPPNQLVLVQWAGQPPEDTTWESWPEVRDLHHLEDKVVFTGEGIVSNHLNNITTGPETADTRPKRRTSRPSFLIDYET

SEQ ID NO: 140123 - protein, 269 aa, Glycine max
  Coding DNA Sequence Number=SeqID_23345
  Homolog annotation: Hit_ID=Q00Z49; Match level="QueryCoverage=42%, HitCoverage=25%, E-value=9e-22, Identity=47%"; Hit description=[S] KOG0324 Uncharacterized conserved protein
  Pfam annotation: Domain name=DUF862; Domain location=1-138; Score =88.5; E_value=2.1e-23; Accession=PF05903.5; Description=Eukaryotic protein of unknown function (DUF862)
MINAQSKGTCDRSSYISDSDGRRNLSFIFTDFCLVFGDDEWSFGFCEQGTGVFSCPSGKNPMYTYRESIVLGKTNCSIFKVNQILRELSREWPGSSYDLLSKNCNHFCDEFCERLGVPKLPGPRSWLVLVQSNSVMSWAFGFTFLLPLYILTASMTGWVNRFANAGDTAMEVAGNTALRFRQAKTEIVSASKVAYRFLLGVTNNVTNNVKNGPESPDNSNRGGSPRLQASWLKNIVTNGAKPSTSSEAENQNGVMPLPPTRDDKALLHS

SEQ ID NO: 140124 - protein, 63 aa, Glycine max
  Coding DNA Sequence Number=SeqID_23346
MDLLLGGYGIGGWMGKCKGCGKLGRMRPSHMSAYEFSLMLAPVVSVWDCIVRKMRYSYRPEWV

SEQ ID NO: 140125 - protein, 195 aa, Glycine max
  Coding DNA Sequence Number=SeqID_23347
  Gene Ontology: Mol. function=cobyrinic acid a,c-diamide synthase activity; Cellular component=chloroplast; Biological process =selection of site for barrier septum formation
  Homolog annotation: Hit_ID=Q45RR8; Match level="QueryCoverage=81%, HitCoverage=54%, E-value=3e-58, Identity=67%"; Hit description =Plastid division regulator MinD
MSAGDAVGVAEAGDVGGSDEDGLVGGRDGGDEAGVNAGGAVDEDEGLAAESEGEFGSGFGDAEEFEVGPALVADEGLVEAAFAIQDLDHGVVDAVLEAEEEVEVAEADVGVDGDHGEAETGEGEADVGGGGGLAHATLAGGDDGDAGGGAGELGLAIPLEEGGGRFGFFGGGERTLGREEREREKKKMNDDEEEA

SEQ ID NO: 140126 - protein, 395 aa, Glycine max
  Coding DNA Sequence Number=SeqID_23348
  Gene Ontology: Mol. function=cobyrinic acid a,c-diamide synthase activity; Cellular component=chloroplast; Biological process =selection of site for barrier septum formation
  Homolog annotation: Hit_ID=Q45RR6; Match level="QueryCoverage=70%, HitCoverage=84%, E-value=1e-125, Identity=81%"; Hit description =Plastid division regulator MinD
  Pfam annotation: Domain name=CbiA; Domain location=131-342; Score =110.8; E_value=4.1e-30; Accession=PF01656.13; Description=Cobyrinic acid a,c-diamide synthase
  Pfam annotation: Domain name=Fer4_NifH; Domain location=128-387; Score=-111.3; E_value=0.004; Accession=PF00142.9; Description=4Fe-4S iron sulfur cluster binding pr
  Pfam module annotation: Pfam domain module=CbiA::Fer4_NifH; Domain location=131-342::128-387
MYLNVRIFAVKYIKGRMVAFEKKKKKLPSSGKNQPSSLSFLTFSVHSLISTVLLLHHHSSSSSPSPSLPFPMSSLHLLPGATTAPNSAFLLRPHSPLFPSKTLTPKKPKPPSALLQWNRKPELSGSTPRVAVITSGKGGVGKTTTTANIGLSLARLGFSVVAIDADVGLRNLDLLLGLENRVNYTVIEVLNGECRLDQALVRDKRWSNFELLCISKPRSKLPLGFGGKALTWLVDALKARSQGCPDFILIDCPAGIDAGFITAITPANEAVLITTPDITSLRDADRVTGLLECDGIRDIKMIVNRVRTDMIKGEDMMSVLDVQEMLGLPLLGVIPEDSEVIRSTNRGFPLVLNKPPTLAGLAFEQAAWRLVEQDSMQAVVVEEQPKRGFFSFFGG

SEQ ID NO: 140127 - protein, 71 aa, Glycine max
  Coding DNA Sequence Number=SeqID_23349
MVSLSAPLEYLEGVEYEHPNTRTSMVYMLSTDILWDLQQYYKKSHRIILPTLKTIEVLFSKRYSLIWRLTL

SEQ ID NO: 140128 - protein, 51 aa, Glycine max
  Coding DNA Sequence Number=SeqID_23350
MVETVYLNQEGETLTNSSECRPWGSSSLSTPLSLTDLPMISLSESDLTYPL

SEQ ID NO: 140129 - protein, 457 aa, Glycine max
  Coding DNA Sequence Number=SeqID_23351
  Gene Ontology: Mol. function=RNA-directed DNA polymerase activity; Cellular component=chromatin; Biological process=chromatin assembly or disassembly
  Pfam annotation: Domain name=RVP; Domain location=32-136; Score= -12.8; E_value=0.07; Accession=PF00077.10; Description=Retroviral aspartyl protease
  Pfam annotation: Domain name=RVP_2; Domain location=37-151; Score= -29.1; E_value=0.00019; Accession=PF08284.2; Description=Retroviral aspartyl protease
  Pfam module annotation: Pfam domain module=RVP::RVP_2::RVT_1; Domain location=32-136::37-151::236-428
MRSRMPKRKVTWFLDGECSALSLRGMDDEKTGSHSTMKLQGKISGISILLLVDSGATHNFISRKLVEALGWTWEETKSMKILMGDGHATETSGMCKEIKIETKAGRFTLDVVLFDLEYINVILGMSWLKTLGVMMVDWNTQIMKFETELGMKNLRGVNQEEPLFATLCGVLDERQEQKENGLSSEQQRALGDILTSFDDVFVKPKGLPLVHVNEHTINLKLGHDPINIGHIRPSQSEYSSPIILVKKKNKWRMCVDYRALNKATIPDKFPIPVIEELLDELHGSTYFSKLDLSYAIWANEWEEHMEQLKSVLEDLRKQQLYANKEKWVEVDPNKVKSVLDWPIPTNVKGVCGFLGITGYYRKFIKDYGKIARPLTELTKKDGFGWNDQAQKAFEELKNKITSAPVLTLPNFEQEFELECDASDLGIGAILMQSRKPVAYFSKALSSRNVTKSAYERE

SEQ ID NO: 140130 - protein, 428 aa, Glycine max
  Coding DNA Sequence Number=SeqID_23352
  Gene Ontology: Mol. function=RNA-directed DNA polymerase activity; Cellular component=chromatin; Biological process=chromatin assembly or disassembly
  Pfam annotation: Domain name=rve; Domain location=298-428; Score =54.2; E_value=4.3e-13; Accession=PF00665.16; Description=Integrase core domain
  Pfam annotation: Domain name=zf-H2C2; Domain location=239-280; Score =8.7; E_value=0.025; Accession=PF09337.1; Description=His(2)-Cys(2) zinc finger
  Pfam module annotation: Pfam domain module=rve::zf-H2C2; Domain location=298-428::239-280
MEIPLIFPCSFMVLWLPVFSSSIPLRDKALHSPSKNHVTFLLGILERIFFFALNLQLIISYDETKLFYGALMQWAIRSTTFETQTFFSPVNQILICQMLGRYYAIRKFIVYSDQKSLKQLLQQRITTGSQQNWLAKLLGYNFEIVYKLGLENKGADALSRSMGEMELISLAYILVWLDYPNLITEVHESSTWRKVIEDLKQDQGKHIGFEYKQCVLFFKDKLVVAKTSSWIPKLMEEFHATPQGVHSGFYRTYRRLASNLFWKEIKGDIMRFVQDCDVCQCQKYLTTAPGGLLQPLPIPYQVWEDISLDFITGLPRSKGFEAILVVVDRLSKYSHFIPLRHPYAARAIAKIFVKEVIRLHGVPNFVKEFFKLQGITLKMSTTYHPQTDGQSEVTNRCLETYLRCFITDQPKGWVIWLLWAEYWFNTTY

SEQ ID NO: 140131 - protein, 128 aa, Glycine max
  Coding DNA Sequence Number=SeqID_23353
  Gene Ontology: Mol. function=ribokinase activity; Biological process =D-ribose metabolic process
  Homolog annotation: Hit_ID=Q5SN59; Match level="QueryCoverage=96%, HitCoverage=42%, E-value=4e-25, Identity=47%"; Hit description =Ribokinase-like
MQAARNAGVRVLLNFVDILSPNETELARLTGLPTESFEEITQAALKCHEMGAKQVLVKLGHKGSAQKPIQQPAILSKTVVDTTDAGDTFTAAFTVALVEGKSKKECLGFGASPCMPDRKSVLDLLNCQ

SEQ ID NO: 140132 - protein, 702 aa, Glycine max
  Coding DNA Sequence Number=SeqID_23354
  Gene Ontology: Mol. function=polygalacturonase activity; Cellular component=cellulose and pectin-containing cell wall; Biological process=carbohydrate metabolic process
  Homolog annotation: Hit_ID=Q1T649; Match level="QueryCoverage=65%, HitCoverage=90%, E-value=0.0, Identity=75%"; Hit description =Peptidase S26A, signal peptidase I; Glycoside hydrolase, family 28
  Pfam annotation: Domain name=Carotene_hydrox; Domain location=145 -281; Score=105.7; E_value=1.4e-28; Accession=PF03897.5; Description =Carotene hydroxylase
  Pfam annotation: Domain name=Glyco_hydro_28; Domain location=297-680; Score=19.9; E_value=3.7e-10; Accession=PF00295.8; Description =Glycosyl hydrolases family 28
  Pfam module annotation: Pfam domain module=Carotene_hydrox::Glyco _hydro_28; Domain location=145-281::297-680
  Subcellular localization annotation: CTP_CleavageSite=47; ConfidenceScore=5.42e-01
MAVGLSAAITMKSLLRFHQPHLNLPKSIPTTLPFSPMRIFHHTASPRTQKVSTFTVCVLMQDPKQGTHMEIEPQEQPPPPPPPPAQQVLSPKLAEKLARKESERFTYLVAAVMSSFGITSMAVFAVYCRFSWQMEGGEVPWSEMFGTFALSVGAAVGMEFWARWAHRALWHASLWHMHESHHRPREGPFELNDVFAIINAVPAIALLSYGFFNKGLVPGLCFGAVVGVIYTVLLLGLQGVRVVECRVANGLDCFEYPAISCRKHSAVLTDFGGVGDGKTSNTKAFQYAISNLSHYASDGGALLVVPPGKWLTGSFNLTSHFTLFLQKEATILGSQYIIRIWSPNIKSLAFLFAFLPNCDFLADESEWPTLPVLPSYGRGRDAPDGRFSSLIFGTNLTDVIITGYNGTIDGQGCYWWDKFHKGELKLTRPYMIEIMFSDHIQISNLTLINSPSWFVHPIYTSDIIIQGLTILAPVDSPNTDGIDPDSCSNIRIEDCYIVSGDDCVAIKSGWDEYGIKFGMPSQHIIIRRLECVSPDSAMIALGSEMSGGIQDVRAEDLTAINTQSAVRIKTAVGRGAYVRDIFIKGMNLNTMKYVFWMTGSYSSHPDNGFDPKTLPNITGINYRDVIAENVTYSARLEGIANDPFTGICISNVTIHSGKKKLQWNCTDIEGVTSNVYPKPCELLPLKQEKIECPYPDDKVSIE

SEQ ID NO: 140133 - protein, 154 aa, Glycine max
  Coding DNA Sequence Number=SeqID_23355
  Gene Ontology: Mol. function=glutaminyl-peptide cyclotransferase activity
  Homolog annotation: Hit_ID=O81226; Match level="QueryCoverage=94%, HitCoverage=51%, E-value=7e-54, Identity=67%"; Hit description =Glutamine cyclotransferase precursor
  Pfam annotation: Domain name=Glu_cyclase_2; Domain location=1-134; Score=-15.1; E_value=5.6e-10; Accession=PF05096.3; Description =Glutamine cyclotransferase
MKDGWGLATDGTLLFGSDGSSTLYQIDPQTFKVVSKQVVYYKGHQVHNLNELEYINGEVWANVFMTDCIVRISPHDGNVLGWILLQNLRKELIEAGNNNINVLNGIAWDGEQKRIFVTGKLWPELYEIKVSPVNKPIEEGIIEKLCLRSPFKFT

SEQ ID NO: 140134 - protein, 178 aa, Glycine max
  Coding DNA Sequence Number=SeqID_23356
  Homolog annotation: Hit_ID=Q10SF6; Match level="QueryCoverage=42%, HitCoverage=16%, E-value=2e-14, Identity=53%"; Hit description =Fringe protein, putative, expressed
MYYSSKQRIITWLILIMIVLYILYSSNFLLLTKVKKDCSTSIHLDEATQEHLEMSGNISSTTKTIERSNVEEGNNEKEEEEEEEEEEEEEVSLDQLSQRQDTKLKHIVFGIAASSNLWDIRKEYIKVWWKPNQTRGVVWLDSKVRTQANEGLPEIRISGEPLNLIYKYTRAKSALRIQ

SEQ ID NO: 140135 - protein, 319 aa, Glycine max
  Coding DNA Sequence Number=SeqID_23357
  Gene Ontology: Mol. function=transferase activity, transferring glycosyl groups; Cellular component=membrane
  Homolog annotation: Hit_ID=Q9FN55; Match level="QueryCoverage=99%, HitCoverage=60%, E-value=1e-121, Identity=64%"; Hit description =Arabidopsis thaliana genomic DNA, chromosome 5, P1 clone:MYC6
  Pfam annotation: Domain name=DUF604; Domain location=37-292; Score =593.2; E_value=2.4e-175; Accession=PF04646.3; Description=Protein of unknown function, DUF604
MGDDDTIFIVDNVVRILSKYDHTQFYYVGSSSESHVQNIHFSYAMAYGGGGFAISYPLAKELAKMQDRCIQRYPALYGSDDRMQACMAELGVPLTKEPGFHQYDVYGDLLGLLGAHPVAPLVTLHHLDVVQPIFPMMNRVQSLQQLMKSVKQDSGSVMQQSICYDKKRYWTISISWGYVVQVLRGVLSPRELEMPTRTFLNWYKRADYTAYSFNTRPVTNKNPCQKAFLFYMNRTRYDPVRKQIIGTYYRFKSRPPYCTWKMESPEKINSIIISKRPNPLRWQMSPRRDCCRVLPSRKNSTMYIWVGKCQQGEVSELSL

SEQ ID NO: 140136 - protein, 45 aa, Glycine max
  Coding DNA Sequence Number=SeqID_23358
MTPYLLIGMERSTTSQALNNHGWGNDGSHNGGGGDRDSDDRFDIF

SEQ ID NO: 140137 - protein, 130 aa, Glycine max
  Coding DNA Sequence Number=SeqID_23359
MGSRNGSGYEAKMVSIFSQIESPDRSLHDHIIEALGKLTVEQGIPYVTKKVQEAAHCYSLLFSSNLAFFAIADNIGAKKVKFTGLTSTVDAQTTVALRGSFLAAPPHLLNEEEEEPQRRRATNEEEEAGR

SEQ ID NO: 140138 - protein, 106 aa, Glycine max
  Coding DNA Sequence Number=SeqID_23360
MTKEVIHGHDFAVPRLHFSSYVVFSLKNPFSVGETRQVSYLLRAEGISLPRRVACLGLKFSLSPGELDASLGKFRVRNLHDKTILPFLLYLFLDLTNNNQNLQNHG

SEQ ID NO: 140139 - protein, 217 aa, Glycine max
  Coding DNA Sequence Number=SeqID_23361
MKLSKEEQTFLEGLMLNMAQNVDPQPKKVVEQGQVDQIAQDKEINILNLHVTSNIRFHVLMEMEISVKVTPILTPQVAASDATFGTKSINRFLASPQLLGDLPQIEPIQAPPPDISPVFESPCPILEELEPTQEDQSHHPKIPELSMVTSEENPDNSLAKLFSEIYSLKYLRNKTRHDQKKELRNSTTLHASIQQTAEKHDQFLHWFNYKMLPSLAP

SEQ ID NO: 140140 - protein, 331 aa, Glycine max
  Coding DNA Sequence Number=SeqID_23362
MEEKEKKMTVGGKRRRRDEGVGKLPTGGEANRGRVRDRERIPKLTMPPKGKDKFKKAQFKRWGDVREIFIPNHRNKGGRRYGFVRYLGVLDERKLERQLDNIILGELKLCVNVPKCGRGKMRLEEQTVKHGTKLEGHNTEVVDRRHTGTRYRNPSMTYAKDSKAKEIMSEELQHGTSPFYSLQKWNPMMRPGHRLIWVQCWCVPLEVWDIGNFQKLVAAVEDLIEIVEEGSSDVGIRAPHHRGAIESIEEIDSDDNDSDISRAVMAPTPNFRHLLKGFDGDRNADNDDHWSQPLLDGPSLMDYPVDNNQDNWLHLPSIDIRARPEMKKGKK

SEQ ID NO: 140141 - protein, 113 aa, Glycine max
  Coding DNA Sequence Number=SeqID_23363
MEELINKTQLSPKIIPMSSRRLGGSTKESHFLYSTVVILLPRTMVCDHHSMMHAPDLNSQMQMWYHPLGNSLSVSTQHSHLGKLGSKYRGHPVVHRHLPPPHGDQPESQGSSK

SEQ ID NO: 140142 - protein, 307 aa, Glycine max
  Coding DNA Sequence Number=SeqID_23364
  Homolog annotation: Hit_ID=Q6H7C6; Match level="QueryCoverage=10%, HitCoverage=10%, E-value=4e-07, Identity=69%"; Hit description =ATMYB4-like
WSSIAKHLPKRTDNEIKNYWNSYLRKQFEKNAGDSSSPKPISSDSSPESKSNDMCMVPLEKTDCHEPNTNQSHQHKLSKSTSSSTHLLNKVASKILASGYLEAIKSCQPVVAGNSKSEGVVKSGIGPQKDNIRDPLVPNLTSPSHSVTSAKLLNKMATSLPHKVYGLEAVKAVFSKLMESSEKGGIATSDGSSFVGSDQVGSCLNALSPFEDGPHISKIIDSPSSPTLMFNQVTTPSCFSEDNEDNWQCVSSNYVSFRNCAASGGGGDCSVSEINLGESSSSTSCFLFENADLGTCDDEIRKYIQYL

SEQ ID NO: 140143 - protein, 107 aa, Glycine max
  Coding DNA Sequence Number=SeqID_23365
MTTSTPANIVININIISYQYYHKHQRHLILNNVINNNIINIPHPISQKHCFHENQHATGTNIHPIVRFPDPNYGIKNGFFKGSVKNPILAPKSEEMQREAQTNKEQA

SEQ ID NO: 140144 - protein, 156 aa, Glycine max
  Coding DNA Sequence Number=SeqID_23366
MKQKEETTKSTQRAFQSAEIQVGELAEKVTQFMVRSEKDFVEVEAQEENPVKEHESREKDEEKDEEQAQQQWEKYSTVKNQQESILQINNLPHQLIFKKGRQGKHEETLSAILSLITNTSPTMIWNVLPEYMKFMEFLAKRQDYKEDVFYVTFMPP

SEQ ID NO: 140145 - protein, 86 aa, Glycine max
  Coding DNA Sequence Number=SeqID_23367
MSMIQDHEKLDSDLIDTCVVGTIKEDPSIKVSLIQERINSEFAYKVSYRKAWMAKQKAIAIEYDDRVNKHLRFLPIVDHVVGVKAQ

SEQ ID NO: 140146 - protein, 384 aa, Glycine max
  Coding DNA Sequence Number=SeqID_23368
  Gene Ontology: Mol. function=transporter activity; Cellular component= mitochondrial inner membrane; Biological process=transport
  Homolog annotation: Hit_ID=Q8LCT8; Match level="QueryCoverage=89%, HitCoverage=83%, E-value=1e-141, Identity=72%"; Hit description =Putative carrier protein
  Pfam annotation: Domain name=Mito_carr; Domain location=188-275; Score=102.8; E_value=9.9e-28; Accession=PF00153.17; Description =Mitochondrial carrier protein
  Pfam annotation: Domain name=Mito_carr; Domain location=282-366; Score=89.0; E_value=1.5e-23; Accession=PF00153.17; Description =Mitochondrial carrier protein
  Pfam annotation: Domain name=Mito_carr; Domain location=88-184; Score= 115.5; E_value=1.5e-31; Accession=PF00153.17; Description =Mitochondrial carrier protein
  Pfam module annotation: Pfam domain module=Mito_carr::Mito_carr::Mito_ carr; Domain location=188-275::282-366::88-184
  Subcellular localization annotation: CTP_CleavageSite=59; ConfidenceScore=5.09e-01
MSESEERATLTWRKIPILLKSSPNDVVLVPPTSPRKNDAVTGFFAPTSGTRCKFASVSVAERKFDKEFAPTAAQLLQHPLAVVALVPKDAALFLAGALAGAAAKSFTAPLDRIKLLMQTHGVRVGHGSAKKAIGFIEALTVIGKEEGIKGYWKGNLPQVIRVIPYSAVQLFAYEIYKKIFKGKDGELSVLGRLAAGAFAGMTSTFITYPLDVLRLRLAVEPGYRTMSEVALSMLREEGFASFYYGLGPSLIGIAPYIAVNFCVFDLLKKSLPEKYQKRTETSLVTAVVSASLATLTCYPLDTVRRQMQLRGTPYKTVLDAISGIVARDGVIGLYRGFVPNALKNLPNSSIRLTTYDIVKRLIAASEKEFQTITEENRNKQKKPQ

SEQ ID NO: 140147 - protein, 152 aa, Glycine max
  Coding DNA Sequence Number=SeqID_23369
  Gene Ontology: Mol. function=transporter activity; Cellular component= membrane; Biological process=transport
  Homolog annotation: Hit_ID=Q6DXT0; Match level="QueryCoverage=47%, HitCoverage=15%, E-value=5e-28, Identity=73%"; Hit description =Putative permease
MPFLEFCFWIKIPCPLEWGAPTFDAGHAFGMVVTAYKAASRLTSTTPPPAHVLSRGIGWQGIGILLNSLFGTLTGSTVSVAESHNVQRTEKLTSINQQPHCAQTVSNIIYLDSPASVGLSYSENTSKYATGDPLFLSLSALSFYSFMDIPRF

SEQ ID NO: 140148 - protein, 181 aa, Glycine max
  Coding DNA Sequence Number=SeqID_23370
  Gene Ontology: Mol. function=heat shock protein binding; Cellular component=integral to membrane; Biological process=protein folding
  Pfam annotation: Domain name=DnaJ; Domain location=48-107; Score=9.1; E_value=0.00058; Accession=PF00226.21; Description=DnaJ domain
MSRVSANSSPSRLVSMASIVRAYTLPILLFAGAMFYQLFLIPNAFPPSHYDVLQIESYSSVEKVKEAYDKLESKWNSAVEVFDIHEFLKIRYAYELLTNPLWKRDYDIFGIDEQLHIVESASKRYAGKHISELDFPLLQAPSGSIDHSSKVITASDFQYIFPDAKPWLIQEYVQIYTSEGY

SEQ ID NO: 140149 - protein, 81 aa, Glycine max
  Coding DNA Sequence Number=SeqID_23371
  Gene Ontology: Mol. function=oxidoreductase activity
  Homolog annotation: Hit_ID=Q8LBR3; Match level="QueryCoverage=73%, HitCoverage=15%, E-value=3e-16, Identity=65%"; Hit description =Alcohol dehydrogenase, putative
MGNVGIANIASGWGLAVLVGIHLSPKMLPIHPMELFHGRRIVGSNFGGIKGKSQLPHFAKECMNGVTTTIPSEFAFVLFKK

SEQ ID NO: 140150 - protein, 100 aa, Glycine max
  Coding DNA Sequence Number=SeqID_23372
MQTKTQQYNAETCGEGFTNLEGDQEDQRNNSHEEDKSTIAATKDHDEPANHPWRKQEEEALSNKRGRTSIATREQRKKKHQRKEEEEVLPKKKKRHRRGE

SEQ ID NO: 140151 - protein, 122 aa, Glycine max
  Coding DNA Sequence Number=SeqID_23373
  Gene Ontology: Mol. function=oxidoreductase activity; Cellular component=cytoplasm; Biological process=aldehyde metabolic process
  Homolog annotation: Hit_ID=Q8LMT9; Match level="QueryCoverage=65%, HitCoverage=24%, E-value=8e-18, Identity=54%"; Hit description =Putative alcohol dehydrogenase
MAGRVVVANGNLNPNNTRGKTITCKAAVAYGPGEPFVVERVLVHPPQKMEVRIKILFTTICHTDLTAWQGQGHQRVRFDALILGFSAMKLPGRTQKLILTLTMTDYNINDLEPLYIRRIENL

SEQ ID NO: 140152 - protein, 136 aa, Glycine max
  Coding DNA Sequence Number=SeqID_23374
  Gene Ontology: Mol. function=heat shock protein binding; Cellular component=integral to membrane; Biological process=protein folding
MYPGARRLLAMLYLKVFETLPKFQVPNFLGKTSLHKVKVIFFSNSGERAAPFIRQAAKDYWASASFAFILWREEESSYWWGAFGVESAPAIVFLKDPGVKPVVHHGSVNNSFFLNLMENNKQQECRKAESGVEQNA

SEQ ID NO: 140153 - protein, 448 aa, Glycine max
  Coding DNA Sequence Number=SeqID_23375
  Gene Ontology: Mol. function=metal ion binding; Cellular component =intracellular; Biological process=protein kinase C activation
  Homolog annotation: Hit_ID=Q8RZK3; Match level="QueryCoverage=87%, HitCoverage=69%, E-value=1e-79, Identity=36%"; Hit description =Selenium-binding protein-like
  Pfam annotation: Domain name=PPR; Domain location=145-179; Score =38.5; E_value=2.3e-08; Accession=PF01535.11; Description=PPR repeat
  Pfam annotation: Domain name=PPR; Domain location=247-280; Score =23.9; E_value=0.00058; Accession=PF01535.11; Description=PPR repeat
  Pfam annotation: Domain name=PPR; Domain location=288-322; Score=4.8; E_value=2; Accession=PF01535.11; Description=PPR repeat
  Pfam annotation: Domain name=PPR; Domain location=324-358; Score=4.0; E_value=2.5; Accession=PF01535.11; Description=PPR repeat
  Pfam module annotation: Pfam domain module=PPR::PPR::PPR::PPR; Domain location=145-179::247-280::288-322::324-358
MTHLKLKWFSILLRRSVNKLVHRPMSTWHHKAETPISLKPPKPNQTLKNHLECNRHAKVLLLFRSFLRKKPTLNLIDSFSLLYALKACNHKHPSTQGKQLHTLIIKLGYQPIVQLQTTLLKTYAQRSNLRDAHQVFDEIPAKNIICWTSLISAYVDNHKPGRALQLFREMQMNNVEPDQVTVTVALSACAETGALKMGEWIHGFVRRKQVMNRDLCLDNALINMYAKCGDVVRARKVFDGMRNKDVTTWTSMIVGHAVHGQAREALQLFLEMSARRDKDDCVMTPNDVTFIGVLMACSHAGLVEEGKLHFRSMSEVYGIQPREAHFGCMVDLLCRGGHLRDAYDFIIEMLVPPNAVVWRTLLGACSVHGELELAAEVRQKLLKLDPGYVGDSVAMSNIYANKGMWNNKIVVRNQIKHSRAPGCSSIEVGSGAGEFVTSDDDHPLMTDV

SEQ ID NO: 140154 - protein, 192 aa, Glycine max
  Coding DNA Sequence Number=SeqID_23376
  Homolog annotation: Hit_ID=Q9FF41; Match level="QueryCoverage=62%, HitCoverage=22%, E-value=4e-09, Identity=30%"; Hit description =Arabidopsis thaliana genomic DNA, chromosome 5, P1 clone:MXA21
MGRAMRWLKGPYNTACVRWAPTALINRLTAIQRQFLWGGSFEGKKIASVAWRQMSASRDLGAKASEVVALGKLKTLTESTIRERALTAQHSSMITISKFEYEYLTNHAASVEEIADKKVAAAEAWIEALKASEKEIMMETKIAQRQLKESKLEQELEVYTKEKMLSRRVSSSEELDNWPRKCEKSSSKNFIV

SEQ ID NO: 140155 - protein, 68 aa, Glycine max
  Coding DNA Sequence Number=SeqID_23377
MARRRLQVDRGVFVVGWFKSLRESLEGDMPSQVGGAVVTRKEVLGWLKGVGYKYGDIGSNFPFHVLIA

SEQ ID NO: 140156 - protein, 75 aa, Glycine max
  Coding DNA Sequence Number=SeqID_23378
MEKKRRTRKQCALQEEKKNKWKGAQLLREKEDEEGEEDIEGVESFVNWPNASFAQGNTEHCYVHPAKLLVNPTIL

SEQ ID NO: 140157 - protein, 553 aa, Glycine max
  Coding DNA Sequence Number=SeqID_23379
  Gene Ontology: Mol. function=transferase activity, transferring glycosyl groups; Cellular component=integral to membrane; Biological process=cell wall biogenesis
  Homolog annotation: Hit_ID=Q9M5Q1; Match level="QueryCoverage=85%, HitCoverage=84%, E-value=0.0, Identity=80%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=48-521; Score =964.5; E_value=4.1e-287; Accession=PF03254.4; Description=Xyloglucan fucosyltransferase
  Subcellular localization annotation: CTP_CleavageSite=57; ConfidenceScore=5.12e-01
MKRHWRNRSHDDDGLPDSDSDTRSSRRFPLTRLMALFFFSIFLFSLTFLLPHPPIQSASTAKTLLQLKQTQQGDVSDSVELQKDKLLGGLLADGFDEQSCLSRYHSATYSKGLSGNPSSYLISRLRKYEALHKKCGPYTESYNKTVKDLRSGHVSESPECKYVVWISYSGLGNRILTLASVFLYALLTDRVLLVDPGVDMGDLFCEPFPHVSWLLPPNFPLNSQFPNFGQKSDQCYGQMLKNKSTTNSMVPSFVYLHLAHDYDDQDKLFFCDEDQAFLQKVPWLVVRTDNYFVPSLFLMPSFEKQLSDLFPNKETVFHFLGRYLFHPTNKVWGLVSRYYQAYLAKVDERVGIQIRVFDTGTGPFQHVLDQILACSLKENLLPDVNRKGDIVNSLAKPKSKAVLMTSLSSGYFDMVRDMFLEHPTVTGEVVGIYQPSHEGHQQTEKKMHNQKAWAEMYLLSLTDMLVTSSWSTFGYVAQGLGGLKPWILYKPENGTAPDPPCQRAMSMEPCFHAPPFYDCKAKRGTDTGALVPHVRHCEDMSWGLKLVDSNSWQ

SEQ ID NO: 140158 - protein, 330 aa, Glycine max
  Coding DNA Sequence Number=SeqID_23380
  Gene Ontology: Mol. function=transferase activity; Cellular component= mitochondrion; Biological process=metabolic process
  Homolog annotation: Hit_ID=Q9FLJ4; Match level="QueryCoverage=97%, HitCoverage=74%, E-value=2e-76, Identity=35%"; Hit description =Similarity to salt-inducible protein-like
  Pfam annotation: Domain name=PPR; Domain location=10-44; Score=35.6; E_value=1.8e-07; Accession=PF01535.11; Description=PPR repeat
  Pfam annotation: Domain name=PPR; Domain location=118-152; Score =51.6; E_value=2.6e-12; Accession=PF01535.11; Description=PPR repeat
  Pfam annotation: Domain name=PPR; Domain location=153-187; Score =37.4; E_value=5e-08; Accession=PF01535.11; Description=PPR repeat
  Pfam annotation: Domain name=PPR; Domain location=188-222; Score =31.5; E_value=3e-06; Accession=PF01535.11; Description=PPR repeat
  Pfam annotation: Domain name=PPR; Domain location=223-257; Score =48.4; E_value=2.3e-11; Accession=PF01535.11; Description=PPR repeat
  Pfam annotation: Domain name=PPR; Domain location=258-292; Score =53.4; E_value=7.4e-13; Accession=PF01535.11; Description=PPR repeat
  Pfam annotation: Domain name=PPR; Domain location=293-327; Score =13.8; E_value=0.17; Accession=PF01535.11; Description=PPR repeat
  Pfam annotation: Domain name=PPR; Domain location=45-79; Score=35.5; E_value=1.9e-07; Accession=PF01535.11; Description=PPR repeat
  Pfam annotation: Domain name=PPR; Domain location=83-117; Score=27.3; E_value=5.4e-05; Accession=PF01535.11; Description=PPR repeat
  Pfam module annotation: Pfam domain module=PPR::PPR::PPR::PPR::PPR::PP R::PPR::PPR::PPR; Domain location=10-44::118-152::153-187::188 -222::223-257::258-292::293-327::45-79::83-117
MSRGFCPTVITYGILMNCCCAQGDFSNARRVSNEILERGIEPNVVIYTILIRVFCNEGQMGEAEDVFGRMRESGVRGLHPDVVTFATLIDVLRKMGDLKAARNCFGYMAEFDVVPNAHAYNSLIDGYCKAGNLPEAMQLRVEMERCGIFPDVVTYNILIKGLCGSGRLEEATSLIEKMDEVAVLANSATYNVVIDGFYKTGDMEKAIEACSQTTERKIEPNVITFSTLIDGFCQKGNVKAAMGLYTEMVIKGIVPDVVTYTALIDGHCKVGKTKEAFRLHKEMLDAGLTPNVFTVSCVIDGLLKDGKTNDAIKLFLEKTGAGCPGGKIDS

SEQ ID NO: 140159 - protein, 72 aa, Glycine max
  Coding DNA Sequence Number=SeqID_23381
  Subcellular localization annotation: CTP_CleavageSite=35; ConfidenceScore=5.37e-01
MNKLMFQDSMTSQLQFSPAKSSAQQSIQKYEGNVSSSPRTSIKLYLSICKITSSKSSKATDDVANKPRTSIS

SEQ ID NO: 140160 - protein, 239 aa, Glycine max
  Coding DNA Sequence Number=SeqID_23382
  Gene Ontology: Mol. function=oxidoreductase activity; Cellular component=cytoplasm; Biological process=retinoid metabolic process
  Homolog annotation: Hit_ID=Q8LBR3; Match level="QueryCoverage=75%, HitCoverage=50%, E-value=2e-64, Identity=61%"; Hit description =Alcohol dehydrogenase, putative
  Pfam annotation: Domain name=ADH_N; Domain location=22-153; Score =111.1; E_value=3.1e-30; Accession=PF08240.2; Description=Alcohol dehydrogenase GroES-like domain
AVAYGPGEPFVVERVLVHPPQKMEVRIKILFTTICHTDLSSWQGKNEAQRAYPRIFGHEACGIAESVGEGVNDMKEGDLVVPIFNGECGDCKYCKCEKTNMCERFGVDPMKKVMASDGATRFSTTDGKPIFHFLNTSTFTEYTVVDSACVVKIDVDGHGVGAAWNIADEHFGSTVAVFGLEPPTLFLEVWLEENPTYTVATRVLKHSWVFKAQSFLREESLKFRAILLDLTAIITVWVR

SEQ ID NO: 140161 - protein, 645 aa, Glycine max
  Coding DNA Sequence Number=SeqID_23383
  Gene Ontology: Mol. function=two-component response regulator activity; Cellular component=nucleus; Biological process=two -component signal transduction system (phosphorelay)
  Homolog annotation: Hit_ID=Q56TL2; Match level="QueryCoverage=86%, HitCoverage=87%, E-value=1e-149, Identity=54%"; Hit description =Timing of CAB expression 1 protein
  Pfam annotation: Domain name=CCT; Domain location=571-609; Score =69.0; E_value=1.5e-17; Accession=PF06203.4; Description=CCT motif
  Pfam annotation: Domain name=Response_reg; Domain location=41-159; Score=0.5; E_value=0.0032; Accession=PF00072.14; Description =Response regulator receiver domain
  Pfam module annotation: Pfam domain module=CCT::Response_reg; Domain location=571-609::41-159
MEYYQIVPKSPKHNPLSAEVVWFSFWVCHHALAEFSLFGLKALQLIYDMLPEILYIYKPLDFLCFTVTLVKSARQVIDALNAEGQHIDIILAELDLPMKKGMKMLKYIARDKEFRRIPVIMMSAQDEVSIVVKCLRLGAADYLEMLKILQEPHCIPFIRLPHLCNSLVAMPNTVSYPQFMSATVTETLFILGLVEKNILNYDFDLVVSDPSDANTNSTTLFSDDTDDKSKRSTNPEAGISVQQEQEVGFFIQLGAYFANNSTFQSINFDIDIVIGLHVEYEEKWWCVSSSQIQRGSTIANAAAVEGPPDAHASECGPDVDGVNDHQTAHFSSGPKKSELRIGESSAFFTYVKASILKSNFEGVVNVDNNGATHVGMEVMHQACAQQGVNSLQILENGEACESQSQDDLPSSTSIPDSLSIERSCTPPASMEVSQQKHYREENSQQGVMHPRNGTHCSEHEVSGMASQHAYPYYISGVVNHVMMPSSAQMYHQKNIQDLQNHTSTAMISQYNHLPQGGPHGTGMTSFPYYPMSICLQPGQIPNPHSWQSFGNSSPSEAKLIKVDRREAALMKFRQKRKERCFDKKIRYINRKRLAERRPRVRGQFVRKLNGANVDLNGEPASIDYDEDDEEDEDDQGARDSSPEDA

SEQ ID NO: 140162 - protein, 100 aa, Glycine max
  Coding DNA Sequence Number=SeqID_23384
  Subcellular localization annotation: CTP_CleavageSite=14; ConfidenceScore=5.09e-01
MDQPRACDNCGLLYFSTRPPSQPLSIRSPSSPLPPSQPSPIYLNRPLPPDTHIRPPLPETHIDLNHPPPPEKSVTSAFSTYRPPPPKTHIDLNHPPPPNK

SEQ ID NO: 140163 - protein, 230 aa, Glycine max
  Coding DNA Sequence Number=SeqID_23385
MKMRPKEINIAYSSNCENCKHLQCKIEYLEKTLAKFTNHNALEHLSEEKKDEEEAHFEPQNEVLIADAGDQTTQNVEGEGLLTPIWKKAAHKAGEKTYMRSSKDLLFNTKHAKSLQLSSFDISIKVAFGLGPILGESFTFSIPFPPLPTELINSEPPKVSKNIPYAHIPIPPPLFASFPKSVENRLTSLEKQVRKFRFDQKSPFSNKMISLRDFLGLSNGFLKRKTFLDS

SEQ ID NO: 140164 - protein, 42 aa, Glycine max
  Coding DNA Sequence Number=SeqID_23386
MVSSPSPHSSWCLNCLMYVMIFEDNLKCPKCKSTALIHFTSP

SEQ ID NO: 140165 - protein, 73 aa, Glycine max
  Coding DNA Sequence Number=SeqID_23387
MVGTKKTRQITFEAAKEIADKIIRFFRGVGFTGFLCRPWTLGSSVTIKQYFGSAPRTSHTSLSMAPEDLEQLT

SEQ ID NO: 140166 - protein, 204 aa, Glycine max
  Coding DNA Sequence Number=SeqID_23388
  Subcellular localization annotation: CTP_CleavageSite=61; ConfidenceScore=5.36e-01
MTGKYLQLQKNDMQGQSAPPQAAPTQAQASFMKQSSTLSKSKWPPSPPNATTETVEVHHVSQTEYVDEEDEEPCQPEPVTIIDGQDQSVSVKDRINRARARLRRLDSQQQQSPRTPRTLPSPHRQQIDKYLLNLEGSVYKAETCGERVVIVGGGGESVVEVAEEAVADGHVLVVARGGGVASSGGERKHVFEGSVRRSFQEEWV

SEQ ID NO: 140167 - protein, 108 aa, Glycine max
  Coding DNA Sequence Number=SeqID_23389
  Subcellular localization annotation: CTP_CleavageSite=38; ConfidenceScore=5.20e-01
MAYQAPTPSKRNIATIAFHFLDFLTGFPTLLLLLPFFTVAVRETASTREEERKFELEDKGLEGCRFGKEWRESDEKREAALVGAGDNFAEAKGGGSASDKRKEIPIEV

SEQ ID NO: 140168 - protein, 78 aa, Glycine max
  Coding DNA Sequence Number=SeqID_23390
MASQRGVVEPHCFEESHFRCCERPKKILSPLMCLMPRSERSKVRLGGPNPIWVIKVDGVMKVVMCVIERREDMGLVNG

SEQ ID NO: 140169 - protein, 110 aa, Glycine max
  Coding DNA Sequence Number=SeqID_23391
MNDGNGTTSTMVLPPSPHSSCASTEPNQEDNNNDDDNDNNNLNNNDDENNNNNNNNNNNNNNNNNNNNNENNNNNNPEAPSLVLVRCPHCLMYLMISEDNLKCPKFKSTN

SEQ ID NO: 140170 - protein, 118 aa, Glycine max
  Coding DNA Sequence Number=SeqID_23392
MCDVAAIAFHFLDLLIGFPTLLSLLPFFILDVRETTSTREEERKCELEEESLEGCGFGEEWRESDEKRKVALVGAGENFAEDEGDGSATDKRKEIPIEKFKVKSGAHVALLIKIVLKR

SEQ ID NO: 140171 - protein, 70 aa, Glycine max
  Coding DNA Sequence Number=SeqID_23393
MLTSSKRVQMTTLASACQSDLGSPNDEVRITERCLRMLPDSWVMRAKGGVVDKREPFAPTYPPFVMKNSD

SEQ ID NO: 140172 - protein, 39 aa, Glycine max
  Coding DNA Sequence Number=SeqID_23394
MSSRRLGGSSTESHPGTLLLPRTKVRNHHKYQPHDTKLQ

SEQ ID NO: 140173 - protein, 212 aa, Glycine max
  Coding DNA Sequence Number=SeqID_23395
  Homolog annotation: Hit_ID=Q1SP02; Match level="QueryCoverage=51%, HitCoverage=26%, E-value=1e-10, Identity=32%"; Hit description=IMP dehydrogenase/GMP reductase
MTGIKGAPYRARIDALTVTDVCWMPYAEHRGVRGYDLISSYTGQVRWGPIIVYLRPERVVRQMGYIQIVPPPPVRDLLTDHVAPTGELCVVPGQVAPDYMEWFFQISHSFVTPTEDTAEPRPVPPPPTHDDDFVEPPVAEVPVASDPPMHSVVDCTACVRMGRIAEHLERVINLKMVTAGTDLYDIIDLCLRIARDDDLDDSLRPRQRPRID

SEQ ID NO: 140174 - protein, 133 aa, Glycine max
  Coding DNA Sequence Number=SeqID_23396
MCFQEKIERGATGSGFNERCYRAVSHGGVQRWGPRRTTVYSGAVIWDFRWASVSVGLAHTNHGPFLSCSWNVGWSVNKFIVFHPDKKEGKSEESQGPMLIFASLKGFFWTQGEKNLLNYLEKYLMGFHRHGMR

SEQ ID NO: 140175 - protein, 76 aa, Glycine max
  Coding DNA Sequence Number=SeqID_23397
MYIKYGPKYIMKHSQQNMLSNETKPPTLIPKTIPKLQNSLRLVMSFKLKKGKHRLKGLSKELIQGSINKNQAKAIV

SEQ ID NO: 140176 - protein, 90 aa, Glycine max
  Coding DNA Sequence Number=SeqID_23398
KVGVEKDKDAEAVVPVPIDEVILVGQTLNTFLAWPTHLVKCLSEQLCLQQKLQIGRIMRSMIPIFDDIDHPTALFEAFPGYVGSYRVRGV

SEQ ID NO: 140177 - protein, 88 aa, Glycine max
  Coding DNA Sequence Number=SeqID_23399
MSVKNLIGRLGVHDKTNHTLDRHRVKGALISGVFTPKAYTSKSPSGPLPHDSGPTHKAFYHTDSLYELYKTHDSSIVLKIILSCCACD

SEQ ID NO: 140178 - protein, 188 aa, Glycine max
  Coding DNA Sequence Number=SeqID_23400
MRIDPQEFASRLCIPGRGFVLNAGGHPWKLLRKDLTTLAQTWSVLSYNNLTPTSHTSDLNMDRDRLVYGLVTGMDVNIRALISGQISTIAKSNSFRLGFPALITALYRARGVTSDSLTYESLSPTINLAYIKKNCWNVDDLTVNFRGDRKVRARAADVPSSSAPPAPPTSTTPTPAAHDSQCFEAVIP

SEQ ID NO: 140179 - protein, 83 aa, Glycine max
  Coding DNA Sequence Number=SeqID_23401
MLGFTSDSPQISANPHQLDFAPHASRSYSAQWNAPGLLDDKHTLRSSRILGKMEVKEPWLELWLPLIYRVDMGASHHRTLELG

SEQ ID NO: 140180 - protein, 169 aa, Glycine max
  Coding DNA Sequence Number=SeqID_23402
  Homolog annotation: Hit_ID=Q1S0F5; Match level="QueryCoverage=84%, HitCoverage=32%, E-value=2e-08, Identity=30%"; Hit description=IMP dehydrogenase/GMP reductase
MGQLQRQAFCKAYGKIWDLAMAELSPTVEEFEEILGCPLGERKPYLFSGFYPSLARISKIVQISMQELDHRKQVENGVVGVPRKCLEAKARVLAGKGEWAPFTDILVLLIFGGRLTLFSHFNRKESPVIAILADLYDTFDRRCEKSSTRIVCCTLALYVWLVSHLFHQE

SEQ ID NO: 140181 - protein, 62 aa, Glycine max
  Coding DNA Sequence Number=SeqID_23403
  Subcellular localization annotation: CTP_CleavageSite=38; ConfidenceScore=5.41e-01
MPISPCKSISWSVSSRHGDRTHKTPSGPGKVQQGPGVSSSGYGPLSVLQGARTPPTRSRHHR

SEQ ID NO: 140182 - protein, 151 aa, Glycine max
  Coding DNA Sequence Number=SeqID_23404
MGSSQTPSLKKRFYQVKVKSIGITSLKELGQLMGQLQRQAFCKAYGKIWDLAMVEVSTEAIASLAQYYDQPLRRPYLFSGFYPSLARISKIVQISAQELDHKKQVKNGVVGIPRKYLEAKARILASKGEWALFIGILALLIFGGVLFPNVD

SEQ ID NO: 140183 - protein, 85 aa, Glycine max
  Coding DNA Sequence Number=SeqID_23405
MWIKRSFKVVMGPRTRLVVSFKTRKGKQGSKGLSKELIQGKSIWLEAYKNKIASIISKYACELGRINKNQAKAIVQAINGAKHTK

SEQ ID NO: 140184 - protein, 97 aa, Glycine max
  Coding DNA Sequence Number=SeqID_23406
  Homolog annotation: Hit_ID=Q0ZCC8; Match level="QueryCoverage=70%, HitCoverage=7%, E-value=2e-07, Identity=43%"; Hit description =Integrase
PAPTLELKPLPTTLKYAYLEDKEKFLVIIFASFVAEQEEKLLLVLKKHKKAIGRTLADIPGISPSTCMHRILLEDAAKPVRDLLKEASQGGELSYEK

SEQ ID NO: 140185 - protein, 105 aa, Glycine max
  Coding DNA Sequence Number=SeqID_23407
MSLHSSSSVNGEGSTPKDPLYKILDELRSLKLWKEKQERKEKERKVPLATFSFQGYALYWWTSLVRERRIHGDPLESIGMVLRVTLRRCTFFDKPKGSLREAPKA

SEQ ID NO: 140186 - protein, 61 aa, Glycine max
  Coding DNA Sequence Number=SeqID_23408
MWTTVGTYPLKIEERMKNVEERLKPLRISSRKTLRKRFGSASAYPLKIEESIIRTVVVSIL

SEQ ID NO: 140187 - protein, 89 aa, Glycine max
  Coding DNA Sequence Number=SeqID_23409
METLKIEQCKSHIETLEIEQRKLSKNSNGHKLSHGGPIQEHHISTRSKLNNGSAREIEIVITFHSDVRFRHIRYRHARNYNTEALDNFI

SEQ ID NO: 140188 - protein, 56 aa, Glycine max
  Coding DNA Sequence Number=SeqID_23410
MSRNFTDCATMLSFDFWHVSELHKLPNDGCQVPRGVKQGLHPNNGWSPDEIRIKGK

SEQ ID NO: 140189 - protein, 364 aa, Glycine max
  Coding DNA Sequence Number=SeqID_23411
  Homolog annotation: Hit_ID=UPI00005F72ED; Match level="QueryCoverage =99%, HitCoverage=42%, E-value=1e-105, Identity=53%"; Hit description= COG1357: Uncharacterized low-complexity proteins
  Pfam annotation: Domain name=Pentapeptide; Domain location=316-355; Score=39.3; E_value=1.4e-08; Accession=PF00805.12; Description =Pentapeptide repeats (8 copies)
MAEGDQQFPQRDSLPPRAAYRIWNMHPSEPVQQGHLPPWRTRCFINRLRGDETHFEEIAMRHTTVWFFPHREQMLLIYQGSTRINEDDAADVMQLMPALEIEGEPRSTAHYRQVLTQRLDKERGALHAFREQELLPEACIGAWLDTETPTQQSPMAENIAAYEHRQREEHRQRLLREGQDIDELFPLPSQDAPPKLDELAEFVERLESQAEAQYQDMLKLAQAEGIDPRNPGGDHVPPSGAESYQQQRDLLFQEARRHPDAFSEKQLGESERALHQMYLMSAQAQSPALRLSGDLAQIIRQRVTAAMLRDKDLSGLDLTGADLSGMDLCQANLRGALLENANLRQTRLVGCDLREAMLARADLS

SEQ ID NO: 140190 - protein, 90 aa, Glycine max
  Coding DNA Sequence Number=SeqID_23412
  Subcellular localization annotation: CTP_CleavageSite=69; ConfidenceScore=5.43e-01
MASSTCFQQISSQITITKQKPSKTTHHISQNPISTKFKRERKMRFTTPKMPSFRDLEQKWAPKVEALFGASMENEGEENGNVREREEKGF

SEQ ID NO: 140191 - protein, 105 aa, Glycine max
  Coding DNA Sequence Number=SeqID_23413
AHWQMVVILPKENVVIWFCSLHNKPDNYLKGIINRSVLFFNTFALALVGTECGYYVMHWMSTIILGNFQNNWEMYFTDPRPLEPERLKALRNQWAKYYLKVKNET

SEQ ID NO: 140192 - protein, 171 aa, Glycine max
  Coding DNA Sequence Number=SeqID_23414
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=P09003; Match level="QueryCoverage=68%, HitCoverage=60%, E-value=8e-41, Identity=74%"; Hit description =Uncharacterized mitochondrial 22 kDa protein
  Pfam annotation: Domain name=Mt_ATP-synt_B; Domain location=1-127; Score=38.4; E_value=2.5e-08; Accession=PF05405.4; Description =Mitochondrial ATP synthase B chain precursor (ATP-synt_B)
KTFKVTLDGRIQAIQEESQQFPNPNEVVPPESNEQQRLLRISLRICGTVVESLPMARCAPKCEKTVQALLCRNLNVKSATLPNATSSRRIRLQDDLGTKANASYAPALSPELLSTSTKVVRAETELRTGVVEGIALRKTPAVAMLKVLEVFSEFKDTKKEHRAILAELQQN

SEQ ID NO: 140193 - protein, 110 aa, Glycine max
  Coding DNA Sequence Number=SeqID_23415
MKILGLQAPMELTSVIVSRVLGTKVVLSSNSIAKSIRCLHKESTYQEGWEKIYDSHVARALYKENDQGIYHVFDKMDDDSKHTVIAKGSIIAKQQKFNKTNLKALKVASE

SEQ ID NO: 140194 - protein, 126 aa, Glycine max
  Coding DNA Sequence Number=SeqID_23416
MQSSQRDVYLGAYLNGFHCSGHWQMVVILPKEHLVVWFCSLHNRPDNYLKGIINSAIKGLDDAPQPKSKAPARWIVVKMSTIILGSFRNNWEAYFNDPRPLEPERLKALRIQWAQFYLRVRVRPRI

SEQ ID NO: 140195 - protein, 192 aa, Glycine max
  Coding DNA Sequence Number=SeqID_23417
  Gene Ontology: Mol. function=transposase activity; Cellular component= intracellular; Biological process=transposition, DNA-mediated
  Homolog annotation: Hit_ID=Q877S7; Match level="QueryCoverage=95%, HitCoverage=57%, E-value=4e-20, Identity=35%"; Hit description =ISPpu10, transposase
  Pfam annotation: Domain name=Transposase_20; Domain location=65-147; Score=77.4; E_value=4.5e-20; Accession=PF02371.7; Description =Transposase IS116IS110IS902 family
VRALQALRSTVVRVSTSLRLSGQRHGCASVHQKKALAGLSSWAEQLERELIAKIKAQSEWAKIYGLLTGICGIGPINGVALTALFTRVHFTSSDAVVAFCGLDPRPKESGRKVGRRRLSKQGDKAARSLLYNAASSAVRTPHFKDYYAALRARGLASTAALVVIARKLLRIAYGVWRTGRAFDPDRLNLKTA

SEQ ID NO: 140196 - protein, 142 aa, Glycine max
  Coding DNA Sequence Number=SeqID_23418
MRPSTCGRNIEEVGWRYAMWEDASPYDQAGKLKGWNRKEEGAPSHEAVTWRKSTHDAVRQLKRPRHRQRQALNQWRSTEPAERDHAYPAKKHVQRAPLRKRAAHTVPTQQIAYAITGRAGRPVIADNASLSAPPSDLTAPQT

SEQ ID NO: 140197 - protein, 75 aa, Glycine max
  Coding DNA Sequence Number=SeqID_23419
MENKATLENIVEEEIETSSSTFSEDNLNIIQQDDQPSSRDDDEREINTLTREQDLLLEAINSILDPQEKKVFRKN

SEQ ID NO: 140198 - protein, 98 aa, Glycine max
  Coding DNA Sequence Number=SeqID_23420
MKNFHRIAYGSVSEAPRLRFSSRKRFFQANSKEREVPKGLNLLKQLPPPLFIEKKGGFRKFYGSITEAAEAPKTIFQKRGGACRPVASSLSNPTSKMF

SEQ ID NO: 140199 - protein, 50 aa, Glycine max
  Coding DNA Sequence Number=SeqID_23421
MSASRKLNTGEKTVLSWMIETGTILQHEKVLCSLLTRCTCKEDYEDRDEL

SEQ ID NO: 140200 - protein, 46 aa, Glycine max
  Coding DNA Sequence Number=SeqID_23422
MELNGGGGHNPLFEDSPSESGSGAATVRFGLISNDTHEARCKCKAV

SEQ ID NO: 140201 - protein, 90 aa, Glycine max
  Coding DNA Sequence Number=SeqID_23423
MKVKHKRYAINTLDSSLYAIWYHFSVKNLVRCLGVHDKTCLTMGRPVRVTLFCEHAPTMWDRHRLKGALKSDNPKAYTPKNLSGPLPPDS

SEQ ID NO: 140202 - protein, 162 aa, Glycine max
  Coding DNA Sequence Number=SeqID_23424
  Gene Ontology: Mol. function=chitin binding; Cellular component =extracellular region; Biological process=chitin metabolic process
  Homolog annotation: Hit_ID=UPI0000612705; Match level="QueryCoverage =61%, HitCoverage=90%, E-value=3e-10, Identity=30%"; Hit description =UPI0000612705 related cluster
MASQGSFLKETSQGSFLKKASQGHHVLSFRGLDVFAFRGLHVLAFRGLHALAFKGLHVLAFKGLHVLAFIGLHTLAFRGLHAFAFRGLDVLSFRGLHVLTFRGLHALAFRGLHVLAFRGLHALVEAMFSKIILMMRKSQVKNEASSKFQESKSCSIKASFKN

SEQ ID NO: 140203 - protein, 340 aa, Glycine max
  Coding DNA Sequence Number=SeqID_23425
  Gene Ontology: Mol. function=transcription factor activity; Cellular component=intracellular; Biological process=regulation of transcription, DNA-dependent
  Homolog annotation: Hit_ID=UPI00005F7DB2; Match level="QueryCoverage =53%, HitCoverage=55%, E-value=3e-73, Identity=73%"; Hit description =COG1609: Transcriptional regulators
  Pfam annotation: Domain name=Peripla_BP_1; Domain location=1-186; Score=-57.2; E_value=0.0078; Accession=PF00532.11; Description =Periplasmic binding proteins and sugar b
MVMMDWAPFEGRGDIIQDNALLGGELATQYLIDRGYTRIACIAGPLDKTPARLRLDGFHQAMAASGLAVPPGYVVDGDFEFQGGFNAMNQLLALDPPPQAVFTSNDAMAVGVYHALYQAGLRVPQDMAVMGYDNIELARYLTPPLSTIHQPKDELGELAIDTLIHRMSDPDASQQTLVLTPELKRQRRQHGNHAHGKEGGVELLHRGALKILVKAQHGGADRHAKTDRHLLRYRQHAIAAAGVLIIQIRQCDGIHGGKLGRHRHAQYKQRHQQHDDASVRRLQREAGDQHADDNRNAHQRFTIAKAAQHLSHGGFSQQRANRRGPHHAAGDDRRIAKSYL

SEQ ID NO: 140204 - protein, 282 aa, Glycine max
  Coding DNA Sequence Number=SeqID_23426
HSPSSYWMLLLEEKTKLKTPEEAMELIENMVASNHAILRDRTQVPTKRSLLELSSQDALLAQNKLLAKQLESLTETLSKLPTQLQVTQPSHLTVLQVGGCSLCGGAHESGCCIPLEDATKEVNYMGNQHRPGFNAGGFVGYQQGSNFNLNQGQWRSHPGKQFNKDQVASSNRPQNQGPSLYERKTKLEETLAQFIQVSMSNHKSTEFAIKNLEIRVGQLAKQIAENSSGSFGANTEKNLKEECKRETMVEDEGRNVDEQEEGSTIPFGAIQERQGMTLHSFP

SEQ ID NO: 140205 - protein, 56 aa, Glycine max
  Coding DNA Sequence Number=SeqID_23427
MRVPFNTYWWPFGHCQDYPPHRDVKKFIYDCATFWAKRREGQVAGVSLSEAYALSE

SEQ ID NO: 140206 - protein, 86 aa, Glycine max
  Coding DNA Sequence Number=SeqID_23428
MASSSLSEVVLCVAWLAMEGAGRTSWYELGLSQGDGFVSRTRETRFILLLGRNNGKKEATRPTHQGEFALALVSWLLNAKGTHSPR

SEQ ID NO: 140207 - protein, 103 aa, Glycine max
  Coding DNA Sequence Number=SeqID_23429
MRNLSKIKGIYVKSNIDKDSKGKDNEDKYVKAKKHGGHHANNEKGFGKDYPKKDMGTPKHPSNVAKDDLKLMPTIQPHVAKGGDLRIRGKTTFKNTKPTCDKA

SEQ ID NO: 140208 - protein, 104 aa, Glycine max
  Coding DNA Sequence Number=SeqID_23430
MSRHHDIGKDRAHKTPSGPGGVNRALGYPALVMGLCQFYREPVAPNKVIRPLLIGISSRSTAPPGRRRARHHSSGQQHTATISRVHLNSSTKRLECCLRHMADQ

SEQ ID NO: 140209 - protein, 220 aa, Glycine max
  Coding DNA Sequence Number=SeqID_23431
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=2e-31, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSSTSEDYMSSTSKDYTFSPLEDYMSLPYEGYTASPFEDYTPSPSEDYTSSASEDYTSSPSEDCTGLHVLTFKGLHVLAFSGLQALAFVGLHAPTLKGLLILTFRGLHVLTFSGLHALALTGLHVLTYRGLHNLAFRGLDALAFRGVHILPLRGLHALTFVGLHTLTFKGVHILNFRGLYIVAIRGLHILAFRGLHVLPFRGQHDLPFRGMQALALTGLR

SEQ ID NO: 140210 - protein, 78 aa, Glycine max
  Coding DNA Sequence Number=SeqID_23432
  Subcellular localization annotation: CTP_CleavageSite=45; ConfidenceScore=5.18e-01
FLLGCPIESRNPCSVYPDLSSFTGSGVYPDLSSFTGSGVIQTSVACIKRSAPTQVHTKRRRAFFSISTGESGFFAEVA

SEQ ID NO: 140211 - protein, 131 aa, Glycine max
  Coding DNA Sequence Number=SeqID_23433
  Gene Ontology: Mol. function=hydrolase activity; Biological process =electron transport
  Homolog annotation: Hit_ID=P0A8Z0; Match level="QueryCoverage=96%, HitCoverage=96%, E-value=2e-61, Identity=89%"; Hit description=Acyl -CoA thioester hydrolase yciA
  Pfam annotation: Domain name=4HBT; Domain location=25-102; Score =82.1; E_value=1.7e-21; Accession=PF03061.12; Description =Thioesterase superfamily
MTTTNAPQGELVLRTLAMPADTNANGDIFGGWLMSQMDMGGAILAKEIAHGRVVTVRVDGMTFLRPVAVGDVVCCYTRCVKRGNTSISINIEVWVKKVSSEPIGQRYKATEALFIYVAVDSEGKPRQLPQA

SEQ ID NO: 140212 - protein, 134 aa, Glycine max
  Coding DNA Sequence Number=SeqID_23434
  Gene Ontology: Mol. function=iron ion transporter activity; Cellular component=outer membrane-bounded periplasmic space; Biological process=entry of virus into host cell
  Homolog annotation: Hit_ID=P25945; Match level="QueryCoverage=85%, HitCoverage=47%, E-value=6e-34, Identity=64%"; Hit description =Protein tonB
  Pfam annotation: Domain name=TonB; Domain location=55-89; Score=58.9; E_value=1.7e-14; Accession=PF03544.4; Description=Gram-negative bacterial tonB protein
KVEERPKREERPVEPRATQPVENAAPSSPVIINTATTTKPTVAAPAGPRAVSRSQPQYPPRAQMLCIEGRVRVKFDVTVDGRVDNVEILSAQPWNMFERDVKAAMRKWRYEPGKPGSGLVINIVFRLNGGAQME

SEQ ID NO: 140213 - protein, 106 aa, Glycine max
  Coding DNA Sequence Number=SeqID_23435
MAKVQKTMLVSACHRTQLCLDGKSAEDDVSLCVPSDTIVSGWQKVSGMTIICLCMSSGPPPLDDKRCRMTIIFLCVPSDTTVFEWRKNVRNDHNLSPHVIGPAASG

SEQ ID NO: 140214 - protein, 86 aa, Glycine max
  Coding DNA Sequence Number=SeqID_23436
MGAKYLEVVKRGSHPNKRMVPGRNSGADDHNLSPRAIGLDCFWIVKKVWDQMVPRMPSGLPPLDDKKVKKCGTKWFSHVIGPAASG

SEQ ID NO: 140215 - protein, 790 aa, Glycine max
  Coding DNA Sequence Number=SeqID_23437
  Gene Ontology: Mol. function=transporter activity; Cellular component= membrane; Biological process=transport
  Homolog annotation: Hit_ID=P02925; Match level="QueryCoverage=36%, HitCoverage=98%, E-value=1e-133, Identity=85%"; Hit description=D -ribose-binding periplasmic protein precursor
  Pfam annotation: Domain name=BPD_transp_2; Domain location=32-301; Score=256.3; E_value=6.3e-74; Accession=PF02653.6; Description =Branched-chain amino acid transport system  permease component
  Pfam annotation: Domain name=Peripla_BP_1; Domain location=334-602; Score=32.6; E_value=5.8e-09; Accession=PF00532.11; Description =Periplasmic binding proteins and sugar b
  Pfam module annotation: Pfam domain module=BPD_transp_2::Peripla_BP _1; Domain location=32-301::334-602
  Subcellular localization annotation: CTP_CleavageSite=43; ConfidenceScore=5.25e-01
KAWMLEQKSLIALIVLIAVVASQSPNFFTLPNMFNIMQQTSVNAIMAVGMTLVILTSGIDLSVGSLLALTGAVAASIVGLEVNALVAVAASLALGAFIGAITGVIVARGKVQAFIATLVMMLLLRGVTMVYTNGSPINTGFSDNADLFGWFGIGRPLGIPTPVWLMAVVFALAWYMLHHTRLGRYIYALGGNEAATRLSGINVNRVKVIVYSLCGLLAALAGTIEVARLSSAQPTAGTGYELDAIAAVVLGGTSLAGGKGRIMGTLIGALILGFLNNGLNLMGVSSYYQMIVKAVVILLAVLVDNKSSKIKEMKKLTALAVILGATLSAGAMAKDTIALVVSTLNNPFFVSLKDGAQKEADKLGYNLVVLDSQNNPAKELANVQDLTVRGTKLLLINPTDSDAVGNAVKMANQANIPVITLDRMAAQGKVVSHVASDNRFGGKMAGDFIAKKLGDGAKIIELQGIAGTSAARERGEGFKQAADAHKFNVLASQPADFDRTKGLNVMQNLLQAHPDVQAVFAQNDEMALGALRALQTAGKTDVLVVGFDGTADGVKAVESGKLSATVAQMPDKIGMIGVDTADKVLKGEKVQAINPVDLKLVAFGGKGANQAVAAGRAGADIAFIACVGADDIGERIRQQLQQDQIDTAPVETVAQEATGVAMIFVNGEGENNIGIYSGANAALTPACVERHQQVIRSADALLMQLESPLDSVLAAARIARASHTQVILNPAPATQLSDELLALIDIITPNETEAEILTGIAVNDDDDAARAAQALHAKGIDTVLITLAGA

SEQ ID NO: 140216 - protein, 443 aa, Glycine max
  Coding DNA Sequence Number=SeqID_23438
  Gene Ontology: Mol. function=phosphogluconate dehydrogenase (decarboxylating) activity; Biological process=D-gluconate metabolic process
  Homolog annotation: Hit_ID=Q1RSD6; Match level="QueryCoverage=42%, HitCoverage=19%, E-value=7e-54, Identity=50%"; Hit description =ATPase, E1-E2 type
  Pfam annotation: Domain name=6PGD; Domain location=89-306; Score= -20.7; E_value=6.7e-15; Accession=PF00393.9; Description=6 -phosphogluconate dehydrogenase, C-terminal domain
MEVEVPNEEDSKFILGSNEKPMFERGCGFDIHDHTVSHRHVSFELDHSNLEDANVVSFKVMRMNPFWVYDREALRLFSKFNKGHLQFEHTLLGNVDVLMATHLGVVFMPQGLRHFLGIDTFDHGGYLKGTGKWIVQQAVELSIVAPTIEASLDARFLSGLKEERLEATKVFKSSGIGVIVTDKPVDNQKLIDDVRKALHAAKICSYAQGMNLICAKSIEKGWDLKLGELARIWKGRVVCLAINFGINTPDLNVGVAYGRGVTEVERALSKRHESHPGQELKKISESKSSIKGFNFMDERVVNGNWSKEPNANPGNLDLNFYERIHTTISLRELDTILGQKINKSYKLLNILEFTSARKQMSVIVKDVDGKLLLLSKGTDRVMFERIAKNGRDFEEKTKQHISEYTDSGLRALILGYRELIDDEYNKFNKDFIEAKNLVSEDQE

SEQ ID NO: 140217 - protein, 61 aa, Glycine max
  Coding DNA Sequence Number=SeqID_23439
  Gene Ontology: Cellular component=cytoskeleton; Biological process =phagocytosis
  Homolog annotation: Hit_ID=Q1SD88; Match level="QueryCoverage=67%, HitCoverage=13%, E-value=1e-16, Identity=83%"; Hit description =Engulfment and cell motility, ELM
MTTKNDYIENKKVCTLEDLWDDEKKKAQFHWTFIFSNLIVQWAQWLGMRWMTVLVYLSYTI

SEQ ID NO: 140218 - protein, 77 aa, Glycine max
  Coding DNA Sequence Number=SeqID_23440
MNSVITVLYFTGRVYEDNDGVIFEGSKKAIQIKRGISFNALKKKIGDKENILPCKFVMTKTLRRCWKVLNNNKKCQF

SEQ ID NO: 140219 - protein, 102 aa, Glycine max
  Coding DNA Sequence Number=SeqID_23441
  Subcellular localization annotation: CTP_CleavageSite=62; ConfidenceScore=5.46e-01
MATSTSNRQCYWLLPIAAQIASRTGAFNCKKVVPPATLPAARSLSKQSPTLNSPVKLASPSSCKAPTALVTPVPGVTSPWEAPICAAICMKFARGQQPMSDE

SEQ ID NO: 140220 - protein, 74 aa, Glycine max
  Coding DNA Sequence Number=SeqID_23442
MACIGLGKRTDKNNIVDWVGTEATNCKQEKLVEPTTRQENGAVSPLSVFLSEMTHLVLVATYFHHHTNIFSSTR

SEQ ID NO: 140221 - protein, 158 aa, Glycine max
  Coding DNA Sequence Number=SeqID_23443
MGVSIRFNIDKGGVWEEVDMVLNGTRRREVGGFAKNVREVTEDKGNLWGCNEDEDSDALGLGKVLKLLAEAREGVNGVLMITMMITKDDDKGDDKKLKDQSRTIQEVQDKNQEEFKTQEESLETRIKIQGSRSQESRSRFKTQDSRMKRRLNQDKYYQ

SEQ ID NO: 140222 - protein, 158 aa, Glycine max
  Coding DNA Sequence Number=SeqID_23444
  Gene Ontology: Mol. function=chromatin binding; Cellular component =chromatin; Biological process=chromatin assembly or disassembly
  Homolog annotation: Hit_ID=Q1SAV4; Match level="QueryCoverage=61%, HitCoverage=24%, E-value=2e-29, Identity=66%"; Hit description =Integrase, catalytic region
MGVAKTLHYLQQNFDWPQIQADDLSLDFITGLPLSHGFTAILVVVDYFSKGAHFGALPHHHSAYKVAQLFLDMVCKLHGFPCSLISDRDPILACNFWRELFRLSSTKHTEVMEQHNNGARAMMGVVVIVDLGWLSSPTVVLDKLVVLPPLINEEEKDN

SEQ ID NO: 140223 - protein, 88 aa, Glycine max
  Coding DNA Sequence Number=SeqID_23445
MGAKYLEVVKRKLHATKKWSPDEIRAGAGGDDPPYLDGAQRLLLDAMTEQMQRVTRQNNEELYGRIEGIENQLNHNVGGPNVDRRWQA

SEQ ID NO: 140224 - protein, 169 aa, Glycine max
  Coding DNA Sequence Number=SeqID_23446
  Gene Ontology: Mol. function=RNA-directed DNA polymerase activity; Biological process=RNA-dependent DNA replication
MPHFIPCKKVDGACHVADLFFKEVDAPAKVDCVRKLHECVKAQIEKKIESYAKQANKGRNKVIFEPVLDRISDNAYKINLPGKYVVSTNLNAANLTPFDVGDDFKDLRTNASQEGGNDEDIEAQGPTQGLGGPMTKARARKTEETLQQVVATILEAAPAMNHIEPKLYQ

SEQ ID NO: 140225 - protein, 186 aa, Glycine max
  Coding DNA Sequence Number=SeqID_23447
DRELRGSSNGIIAGYHKWLRVRTQGLDWLPNLKTVRDDEVKASEESDEVQALKAELERAWVVEEKFKAAIVSSSSEEVKGIITGQRHDLEGRAKGNMWAIIDKCKEKLSLAATHEQRLEDEYAKISAEREARERIIDSLHQEATMWTDRFALTLNRSQELPPLLAKAKAVADTYSAPEEIHGLLSY

SEQ ID NO: 140226 - protein, 109 aa, Glycine max
  Coding DNA Sequence Number=SeqID_23448
MEIYHTELDEFKGELERCNFHKRLTNLVDCSIDLALVKEFYTDLYSPKGPSPKQVRIQGHLIRIDADSLNAFLETPVVLAEGESLPAYSRYYKMPTDIREIEVALCIPG

SEQ ID NO: 140227 - protein, 209 aa, Glycine max
  Coding DNA Sequence Number=SeqID_23449
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=2e-17, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VLALRGLHVLTIRGLHALTSRGLHVLALIGLHALTLEDYVTLAVERAARPHLERTTRPRHQRATRPHLQRTTCPRLERTTRPHLEVLVTLALRGLYVLALRGLHVLTIRGLHALTSRGLHVLALRGLPALTWGLHILTIRGLHALTFRGPHVLALRGLHALTLGLHVLTIRGLHALTSRGLHVLALRGLHALTLGTSCPHLQRTTRPHL

SEQ ID NO: 140228 - protein, 88 aa, Glycine max
  Coding DNA Sequence Number=SeqID_23450
  Subcellular localization annotation: CTP_CleavageSite=54; ConfidenceScore=5.41e-01
MQRQDETKGQISVSFSTETASQVGKFRSNRRVPLVVEFQWRTTMLSTKFREDPTVNEGWEAFLPRQLHVAFSRSFIKRLPPEASLWLL

SEQ ID NO: 140229 - protein, 151 aa, Glycine max
  Coding DNA Sequence Number=SeqID_23451
  Homolog annotation: Hit_ID=Q4J2V5; Match level="QueryCoverage=62%, HitCoverage=9%, E-value=1e-26, Identity=67%"; Hit description =Acriflavin resistance protein precursor
MAALLGALPLMLASGSGAELRQPLGLVIVGGLLVSQVLTLAVSATCSAGSSRRGASHEHHPAVYLSPGCHAAADAGDPAARGAGLPAAARRAAAAGGFSYHHGQRQPGRCQPGNHGGHGGDAAGAFARPDCRCDGDDVDQLAGLDQRDTAV

SEQ ID NO: 140230 - protein, 195 aa, Glycine max
  Coding DNA Sequence Number=SeqID_23452
MASRKRKAPSTPTQARLYRSRFTSQEAWERYTDVIVLRNLLLERNMVEFYANLYYPEDKSPKQVRVRGHLNKCDEDTLNTFLKTPVIVEEGPYPQELATKLCIPGRGFELNANGYPLKILRKNMTTLAQTWSVLSFSNLIPTSHTSDVTLDKAKLIYGIIMKMDMNVRYLISHQISLIAQHDTSRLVFLALITTL

SEQ ID NO: 140231 - protein, 160 aa, Glycine max
  Coding DNA Sequence Number=SeqID_23453
  Gene Ontology: Mol. function=metal ion binding; Biological process =metal ion transport
  Homolog annotation: Hit_ID=Q1SWG8; Match level="QueryCoverage=54%, HitCoverage=79%, E-value=2e-23, Identity=61%"; Hit description=Heavy metal transport/detoxification protein
  Pfam annotation: Domain name=HMA; Domain location=5-72; Score=31.7; E_ value=2.5e-06; Accession=PF00403.16; Description=Heavy-metal -associated domain
MKQKVVLKVDLHDDRMKKKAMKIASGVTGVELVSVKVKDKKMILLGDIDPVSVVSKLRKWCHTEIVSVGPATVDNKKVEPEKEDKKIESPKVRSVLQSKSLARTCSNRKERRVFKKEFPGSKEYLRSTKLRQERGLRVIGQFELVYGRVEVEAARVLDLA

SEQ ID NO: 140232 - protein, 82 aa, Glycine max
  Coding DNA Sequence Number=SeqID_23454
  Subcellular localization annotation: CTP_CleavageSite=48; ConfidenceScore=5.09e-01
MGNGDRGDGYTVNVRSVLQSKSLARTCSNRKERRVFKKEFPGSKEYLRSTKLRQERGLRVIGQFELVYGRVEVEAARVLDLA

SEQ ID NO: 140233 - protein, 153 aa, Glycine max
  Coding DNA Sequence Number=SeqID_23455
  Gene Ontology: Mol. function=metal ion binding; Biological process =metal ion transport
  Homolog annotation: Hit_ID=Q1SWG9; Match level="QueryCoverage=78%, HitCoverage=98%, E-value=9e-23, Identity=44%"; Hit description=Heavy metal transport/detoxification protein
  Pfam annotation: Domain name=HMA; Domain location=34-101; Score=40.0; E_value=8.1e-09; Accession=PF00403.16; Description=Heavy-metal -associated domain
GCESVSVDMKDKKLILSVEVDPVSSAVSKPRKEIVLKVELHDDRIKQKAMKTASSLSGVESVSVDLKDRKMIILGNIDPVSAVSKLRRCCHTEIVTVGPAKKEKEKEKVKPAEVPVPLHQAYPLIYYQMTPPPYPQIYYVKSYDENPCGCVIC

SEQ ID NO: 140234 - protein, 448 aa, Glycine max
  Coding DNA Sequence Number=SeqID_23456
  Gene Ontology: Mol. function=protein binding
  Homolog annotation: Hit_ID=Q1S8G7; Match level="QueryCoverage=98%, HitCoverage=96%, E-value=2e-68, Identity=38%"; Hit description =Cyclin-like F-box; FBD
  Pfam annotation: Domain name=F-box; Domain location=30-77; Score =32.8; E_value=1.2e-06; Accession=PF00646.23; Description=F-box domain
  Pfam annotation: Domain name=FBD; Domain location=381-432; Score =50.9; E_value=4.1e-12; Accession=PF08387.1; Description=FBD
  Pfam module annotation: Pfam domain module=F-box::FBD; Domain location=30-77::381-432
MEGSSGSTANDSSTRKQNLLKRHKINEGEGTLSKLPEPLVSHILSFLPTKDAVRTSVLSKKWQFRWTFITKLDLDDTVFYKRKSGGKMYFVNFVYRALLLTKSSSLESFSLVIANKYDVFLLNTWICNILIRDIKNLCIVTQSEMSFSAHASHSLFNSRLLEELVLKTMHSFAIRVTESVVQFEHLKLLKLSGILFSLDFNSKHLTLSLPVLKVFETLNCTWLNAKRITLKVPLLESVIITQDTKPPSYVKPHCAFEFSASHLKEFSYCGCGYISHYFKLLDTSSAHNASLNITVNQCPINRDPETEVRAFLLLKQFSQVKYLKFEGCQVLAQSKVASLPLFGMLSELELGLVSGEVLLGLLLKSPVLKTLLFEGISNFDKELLNSAAVPECLTSTLQVVKFHKLHGCEHELCLAKFVMENGLVLERMSFFLASHCLGKSKIMEEFKA

SEQ ID NO: 140235 - protein, 181 aa, Glycine max
  Coding DNA Sequence Number=SeqID_23457
  Gene Ontology: Mol. function=DNA binding; Biological process=DNA integration
  Homolog annotation: Hit_ID=Q1S645; Match level="QueryCoverage=81%, HitCoverage=40%, E-value=5e-20, Identity=35%"; Hit description =Integrase, catalytic region
MASQTPHDKIKLWHLRLGHVNERGLVELEKQNLLNGRLSMFIDCFQMNGLYILDCSIVIALASMASQTSHDKIKLWHLRLGVKFGTGMHVSSRPFGYVHWDLWGPSRVKTLGGGLPKSFWGEAISATIYGINRCLSSTINIKAPTKLWSLMAIMNRHDMELEHVKTAFLHGDLEETIYRHQ

SEQ ID NO: 140236 - protein, 67 aa, Glycine max
  Coding DNA Sequence Number=SeqID_23458
MCVVVIRLIRQVCEVLIFICSLSQSAGLASHLLSALFPWLSARKKDELCMFAKRGFIPLSAPLQSIR

SEQ ID NO: 140237 - protein, 81 aa, Glycine max
  Coding DNA Sequence Number=SeqID_23459
MENKMPQSIQMSLKKLGMQKDKTSLSSKGHIPMGHKPFRPHHTFPHKNVDHSHPYAQKVMLSPHVVTHHWPLSRIGVQVLS

SEQ ID NO: 140238 - protein, 535 aa, Glycine max
  Coding DNA Sequence Number=SeqID_23460
  Gene Ontology: Mol. function=RNA binding
  Homolog annotation: Hit_ID=Q1T6A5; Match level="QueryCoverage=85%, HitCoverage=83%, E-value=3e-97, Identity=46%"; Hit description =Cyclin-like F-box; Agenet
  Pfam annotation: Domain name=Agenet; Domain location=8-64; Score =32.5; E_value=1.5e-06; Accession=PF05641.3; Description=Agenet domain
  Pfam annotation: Domain name=F-box; Domain location=130-177; Score =35.1; E_value=2.4e-07; Accession=PF00646.23; Description=F-box domain
  Pfam module annotation: Pfam domain module=Agenet::F-box; Domain location=8-64::130-177
MVPKPMVFELGSAVEVSIYDGSWFSGTIIGCDNSDRFLVQYHCNSVEIAVVSLHHLRPLPPPNSHQEFKSGDKVEVFHDHCWREGHITGDLVNGRFVVSFRYSKEMTFPKEQLREHRQWINDNWVSSNRDRISELPDNVLLHIMNFVDTKDAVKTCVLSKRWKDLGKGLVKLTFSPNLFELGLVGTVESADLLKVNGLVESFKKFASWVFSSRDDSCSLLNLTIRHTWTEPEHLDRIIKYAVFHNVQHLTLRIYSGFRPNFESIPLIFFSKSLTYLEIWNGCDLPEIILPKSLNLPALKSLKIGYFKFTATDNDCAEPFSNCLVLNSLMLIGCSLHDDAQVLRISNSTLSRLTIFGGKTYQIVLSTPNLSSFTILDSTVSHQLFSTCNLPFLGEVNIDMYRDGGSDEGWNEKSSIIMKWLHVLANVKMLTLYPRAFEIILRELSNPISLRPQPPSFVRLESLTVNTRLYANISDEAKNFTECPVFVYFVLTFLVVLNSLYSENYRFAILLFCQYVISLSSMGSNKDAVLLKLVLK

SEQ ID NO: 140239 - protein, 63 aa, Glycine max
  Coding DNA Sequence Number=SeqID_23461
  Homolog annotation: Hit_ID=Q9LTD8; Match level="QueryCoverage=85%, HitCoverage=10%, E-value=2e-10, Identity=55%"; Hit description =Arabidopsis thaliana genomic DNA, chromosome 5, BAC clone:F6N7
MSSYFEERAPCCGSHFWILLSMCWASVLFAAITSGLALGLLSFSQVDLEVFVKAGQPKIQKNA

SEQ ID NO: 140240 - protein, 244 aa, Glycine max
  Coding DNA Sequence Number=SeqID_23462
MGNCLLGGMSDPDTIIKVTTSNGGIMEFYAPITVSFITSEFPGHGIFLSHDLFCKPLSQFDELVAGQSYYLLPLNNQPEHPSASGHIGGDNRAIRLGHVRSHSVPTTPYPPPYRMSLDYQHHQGMRFLNKTSTEPFSCRTSTIKRSKITTSSKRSKITSSSKSSRFWKVKLVITPQQLMDILSQEARTKELIESVRIVAKCGVAAGGILPVSAAASIVSDQWSLSSSGRSACDSSKIDALVVDM

SEQ ID NO: 140241 - protein, 186 aa, Glycine max
  Coding DNA Sequence Number=SeqID_23463
  Gene Ontology: Mol. function=nucleic acid binding; Cellular component= nucleus; Biological process=DNA integration
  Homolog annotation: Hit_ID=Q1S3Z1; Match level="QueryCoverage=88%, HitCoverage=16%, E-value=8e-40, Identity=48%"; Hit description =Integrase, catalytic region; Zinc finger, CCHC-type
MVEQFRMCQSKPVSTHLGHHTTLSITQALSTKEERSIKNSIRYANGVGSVMYGMVRSRPDLARVVSIIIRFIENPSFGGFKVGIEVFEWLSKRWFELHDNQDTLQSIIALSTTQTEYIALVKGVKEAMRLNGMIGELGIMQGCVTIHYDSQSVIHLANHQVYHERIDKCHISDIFGIKMLALIFRL

SEQ ID NO: 140242 - protein, 98 aa, Glycine max
  Coding DNA Sequence Number=SeqID_23464
MKNGGKSARNRSRKRLRSVTEGKEGGGCHLARPGELGCFHQNAPPSIGTPWKAQVACHQTNGPWTKLGYDNMDDILIASSSKDEIGKLKEKLNLEFEM

SEQ ID NO: 140243 - protein, 137 aa, Glycine max
  Coding DNA Sequence Number=SeqID_23465
MNLSYFHGKDNVKANLDWEIRIKQQLKRKSTSKSFGVHTYPKKDQGQGILGDIYSSQDEATTSPSFSESEEGKGEESSEEIYPQEEGQPLMVKEECKEISVSSKSIATPLGLEVIPQVKKLLDEGLVHKSLNPYALL

SEQ ID NO: 140244 - protein, 150 aa, Glycine max
  Coding DNA Sequence Number=SeqID_23466
  Gene Ontology: Mol. function=DNA binding
MAKNGKLDRIEERLRVVKGSGDYAFADMVELCLVPDVITPPKFKVPEFNKYKGTTCPKNHLKLYCQKMGAYAKDEKLLMHFFQKSLTGAVVTWYTNLEPSQIHSWKDLMIAFIRQYQYNSDMAPDRMQRQSMRIISNWAWIRNWAEPAWT

SEQ ID NO: 140245 - protein, 184 aa, Glycine max
  Coding DNA Sequence Number=SeqID_23467
  Gene Ontology: Mol. function=5-methyltetrahydropteroyltriglutamate -homocysteine S-methyltransferase activity; Cellular component =cytosol; Biological process=methionine biosynthetic process
  Homolog annotation: Hit_ID=Q42662; Match level="QueryCoverage=90%, HitCoverage=69%, E-value=3e-40, Identity=81%"; Hit description=5 -methyltetrahydropteroyltriglutamate--homocysteine methyltransferase
  Pfam annotation: Domain name=Meth_synt_1; Domain location=1-181; Score=-84.7; E_value=6.2e-09; Accession=PF08267.2; Description =Cobalamin-independent synthase, N-termina
MDDAGIKYIPSNAFSYYDQVLDTTTMLGAVPPRYNWNCGEIGFDVYFLMARRNAYVPAMEKTKCFDTNYRYIVPELGSDVKFSYASHKVVDEYKEAKVHTKHSSKCNHSSPCCVKPPIMYGDVSYPKPMIVFWSSTAQRLTKRPMKGMLIGLVTILNWSFVRDDQPRFVSFGAEKLYSSTKVLV

SEQ ID NO: 140246 - protein, 78 aa, Glycine max
  Coding DNA Sequence Number=SeqID_23468
MNRVYNFPNWFLQWWNFFGPILEILPEQFDSSKADPEQVKLWFQFHPEFLKAADPETSVFLNQKSHMAAFLAGSKSKE

SEQ ID NO: 140247 - protein, 244 aa, Glycine max
  Coding DNA Sequence Number=SeqID_23469
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=1e-43, Identity=34%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=PT; Domain location=120-155; Score=1.3; E_value=0.59; Accession=PF04886.3; Description=PT repeat
  Pfam annotation: Domain name=PT; Domain location=40-75; Score=0.9; E _value=0.65; Accession=PF04886.3; Description=PT repeat
  Pfam annotation: Domain name=PT; Domain location=80-115; Score=8.3; E_ value=0.087; Accession=PF04886.3; Description=PT repeat
  Pfam module annotation: Pfam domain module=PT::PT::PT; Domain location=120-155::40-75::80-115
MTGPLDESISCFLIRVDPWGCTPSPSEGCTPSPSEGYTPSPSEGYTPSPSEGCTPSPSEGYTPSPSEDCTSLPSEDCTSSPSEDCTSSPLEDCTSSPSEGYTSSPSEGCTSTPSEGYTPLPSERYTPLPSEGYTPSPSEDYTSSPSDDYTSSPSEDYTSLPSEDYTSSPLEGYTPSPSEGYKSSPSKDYRYSHSEDYKTSPSGDYTSSPLEGYTPSPSEGYTPSPSEGYTPLPSEGYMPSPSED

SEQ ID NO: 140248 - protein, 388 aa, Glycine max
  Coding DNA Sequence Number=SeqID_23470
  Homolog annotation: Hit_ID=Q10SE0; Match level="QueryCoverage=84%, HitCoverage=64%, E-value=8e-88, Identity=50%"; Hit description=CBS domain-containing protein, putative, expressed
  Pfam annotation: Domain name=CBS; Domain location=129-237; Score =25.3; E_value=0.00022; Accession=PF00571.18; Description=CBS domain
  Pfam annotation: Domain name=DUF21; Domain location=1-110; Score= -42.6; E_value=0.0017; Accession=PF01595.10; Description=Domain of unknown function DUF21
  Pfam module annotation: Pfam domain module=CBS::DUF21; Domain location=129-237::1-110
MALEGVSVFMEKMFPEWLSVLLAATILATIAEIIPLALCSRYGLSVGATLSPFVRVLMMVFFPIAYPLSKLLDWIFGKGHTALLGRAELKTLVHLHANEAGKGGELSLHETTIIAGALDLTQKTAKDAMTPISETFSLDINSKLDMHTMGLIMSKGHSRIPVYSGKQTNVVGIILVKNLIFCHPEDETPIKYMTIRRVPRVGEDWPLYDILNQFKNGQSHMAVVLKCGENIRTVATHTESKTPGHCSSVELGDYIRISTDASNWHSQETEYYSATLKSIMHREGDSDLLQRRSEQPDASSSFENLESLPTADEEVIGIITLEDVMEELLQYQNQTATCKKRVIRVLHKGFKLSSKTEKFRCISSLLFNSYICFTRFSLSKKVTSPVSP

SEQ ID NO: 140249 - protein, 330 aa, Glycine max
  Coding DNA Sequence Number=SeqID_23471
  Homolog annotation: Hit_ID=Q2R2Z9; Match level="QueryCoverage=76%, HitCoverage=45%, E-value=5e-52, Identity=42%"; Hit description =Expressed protein
MEQVIVGINSMEMISEMDLSGPSEIDFGIEEIDDEDTEDVDDNNEDEDKDEDENEDYDSEWVAVFSDDDEQEDDDETLADWAKLETMRSSHPVYFAKKLAEIASDDPVDWMEQPPACVAIQGVIRPAFVDEHSTIQKHLSANQSSDTDKSKSIESKGENIGVINGHVLNSESSGDNAAQQVENNGNSVIPFSETSFYKLVMIKIQVFSAQGQPTAIELEDYMNAQPDVIAHSASKIISRLKADGEETLEALKSLCWRCKGIQVEEAQLICLDSLGFDLRVCSGTQIQTLRFTFKNRATSEYSAERQLNDILFPRIHPKQQKMKQTHQNEC

SEQ ID NO: 140250 - protein, 142 aa, Glycine max
  Coding DNA Sequence Number=SeqID_23472
MIIIEAPIAVRFHATAAIRSAAAPSPHNNRSMWSADDVNGVRYAASCRLACSCGFDAPWVRSKINSGTPFTRRNKLVKNRIRASSEHLGSAQDPLKKNEKPSYHPFEEVAVSTSENSEDATLTAAETSRTIIERERRAYCLD

SEQ ID NO: 140251 - protein, 411 aa, Glycine max
  Coding DNA Sequence Number=SeqID_23473
  Homolog annotation: Hit_ID=Q6ZFC1; Match level="QueryCoverage=52%, HitCoverage=84%, E-value=1e-37, Identity=41%"; Hit description =Pentatricopeptide (PPR) repeat-containing protein-like protein
  Pfam annotation: Domain name=PPR; Domain location=134-168; Score=5.0; E_value=1.9; Accession=PF01535.11; Description=PPR repeat
  Pfam annotation: Domain name=PPR; Domain location=170-204; Score =22.3; E_value=0.0018; Accession=PF01535.11; Description=PPR repeat
  Pfam module annotation: Pfam domain module=PPR::PPR; Domain location =134-168::170-204
MLKRVVQVLKMLALTDSPLLIAKTFEAIKIPTSTRGTVLCAAKGQRPRYPRVWKTHKKIGTISKAAKLVNSIKELSNVKEEVYGALDSYVAWELEFPLITVKKALKTLESEQEWKRVIQVTKWMLSKGQGKTMGSYFTLLNALVEDDRLDEAEELWTKLLMQYMESLPRRFFDKMISIYHKRGMHEKMFEIFADMEELCLRPNIAVVSMIGDAFKELGMLDKYQKLHAKYPPPQWEYRYIRGKRVKVKVEVQSNQVNTYIERHGNVEPNSDLNKNYRLSEKTSEIVDQQLRQDANVISMKPEQISGINNNYRSEETSDMIDDQQLGQEADVISMELEQISDDSYDSMEPIFNLLLIIVGIIISMCISYKLLGDKSEDTLGIGLEEHVLKNFTKCEIENLVMAISSTQKFSC

SEQ ID NO: 140252 - protein, 127 aa, Glycine max
  Coding DNA Sequence Number=SeqID_23474
MRTPEWLKKIFAPITKSERNGPVFRFFIDLEDAEKDISQSEMRNLKVGVNKISSTTKKSRYDKDKEKNKLKHATRLPNLCIFRKRQLKLKLPCAAHQIKAKNNSQWQRGTFKDVSIWVQSSASKRLI

SEQ ID NO: 140253 - protein, 91 aa, Glycine max
  Coding DNA Sequence Number=SeqID_23475
KQRGSTRIHGTAQSLKNRPRYIHSEEAKQVAALYYASDSQIGACKLNSPENLHEIEGHFGVEVTVAATRSEDTCFIKEFKIEVRKDQDSGK

SEQ ID NO: 140254 - protein, 70 aa, Glycine max
  Coding DNA Sequence Number=SeqID_23476
  Gene Ontology: Mol. function=small conjugating protein ligase activity; Cellular component=proteasome complex (sensu Eukaryota); Biological process=protein modification process
  Homolog annotation: Hit_ID=Q06H24; Match level="QueryCoverage=94%, HitCoverage=44%, E-value=3e-33, Identity=97%"; Hit description =Ubiquitin-conjugating enzyme 9
  Pfam annotation: Domain name=UQ_con; Domain location=5-69; Score=5.3; E_value=1.4e-05; Accession=PF00179.16; Description=Ubiquitin -conjugating enzyme
MASKRILKELKDLQKDPPTSCSAGPVAEDMFHWQATIMGPADSPYAGGVFLVSIHFPPDYPFKPPKVFIF

SEQ ID NO: 140255 - protein, 157 aa, Glycine max
  Coding DNA Sequence Number=SeqID_23477
MLLGITCEECHVESTHRSENEGKHDNGHGKMMNLTSSAAFALMAMSLSKLQLGFEVGVSNFLFGCFLVTLMKMSFKLAPLAAFFCYLLLNVRSISDFLLEMRTQHADDDTVEANFLPLEAISDVLEDEAGFQGLEPYSDVLGFRSSAIPFQTAWDLA

SEQ ID NO: 140256 - protein, 399 aa, Glycine max
  Coding DNA Sequence Number=SeqID_23478
  Gene Ontology: Mol. function=protein binding; Cellular component =integral to membrane; Biological process=protein amino acid phosphorylation
  Homolog annotation: Hit_ID=Q1T435; Match level="QueryCoverage=90%, HitCoverage=82%, E-value=7e-47, Identity=36%"; Hit description =Leucine-rich repeat; Leucine-rich repeat, cysteine-containing type
  Pfam annotation: Domain name=LRRNT_2; Domain location=30-68; Score =58.1; E_value=2.9e-14; Accession=PF08263.3; Description=Leucine rich repeat N-terminal domain
  Pfam annotation: Domain name=LRR_1; Domain location=109-132; Score =9.7; E_value=4.3; Accession=PF00560.23; Description=Leucine Rich Repeat
  Pfam annotation: Domain name=LRR_1; Domain location=134-156; Score =13.3; E_value=0.89; Accession=PF00560.23; Description=Leucine Rich Repeat
  Pfam annotation: Domain name=LRR_1; Domain location=158-181; Score =15.7; E_value=0.17; Accession=PF00560.23; Description=Leucine Rich Repeat
  Pfam annotation: Domain name=LRR_1; Domain location=183-205; Score =16.5; E_value=0.1; Accession=PF00560.23; Description=Leucine Rich Repeat
  Pfam annotation: Domain name=LRR_1; Domain location=207-229; Score =20.7; E_value=0.0053; Accession=PF00560.23; Description=Leucine Rich Repeat
  Pfam annotation: Domain name=LRR_1; Domain location=231-253; Score =18.1; E_value=0.032; Accession=PF00560.23; Description=Leucine Rich Repeat
  Pfam annotation: Domain name=LRR_1; Domain location=255-277; Score =21.1; E_value=0.004; Accession=PF00560.23; Description=Leucine Rich Repeat
  Pfam annotation: Domain name=LRR_1; Domain location=331-358; Score =5.0; E_value=33; Accession=PF00560.23; Description=Leucine Rich Repeat
  Pfam annotation: Domain name=LRR_1; Domain location=360-383; Score =8.3; E_value=7.8; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=30 -68::109-132::134-156::158-181::183-205::207-229::231-253::255 -277::331-358::360-383
MPTMNPDSFKFIEALIILMVVCAEEEIMCIEREREALLQFKAALVDDYGMLSSWTTADCCQWEGIRCTNLTGHVLMLDLHGQLNYYSYGIASRRYIRGEIHKSLMELQQLNYLNLGSNYFQGRGIPEFLGSLSNLRHLDLSNSDFGGKIPTQLGSLSHLKYLNLAGNYYLEGSIPRQLGNLSQLQHLDLNWNTFEGNIPSQIGNLSQLQHLDLSGNNFEGNIPSQIGNLSQLQHLDLSLNSLEGSIPSQIGNLSQLQHLDLSGNYFEGSIPSQLGNLSNLQKLYLEGPTLKIDDGDHWLSNLISLTHLSLLSISNLNNSHSFLQMIAKLPKLRELSLIDCSLSDHFILSLRPSKFNFSSSLSVLHLSFNSFTSSMILQWLSGCARFSLQELNLRGNQIN

SEQ ID NO: 140257 - protein, 722 aa, Glycine max
  Coding DNA Sequence Number=SeqID_23479
  Gene Ontology: Mol. function=protein-tyrosine kinase activity; Cellular component=cellulose and pectin-containing cell wall; Biological process=protein amino acid phosphorylation
  Homolog annotation: Hit_ID=Q9LVM0; Match level="QueryCoverage=94%, HitCoverage=94%, E-value=1e-134, Identity=65%"; Hit description =Receptor-like protein kinase
  Pfam annotation: Domain name=LRRNT_2; Domain location=47-85; Score =34.3; E_value=4.4e-07; Accession=PF08263.3; Description=Leucine rich repeat N-terminal domain
  Pfam annotation: Domain name=LRR_1; Domain location=115-137; Score =11.9; E_value=1.7; Accession=PF00560.23; Description=Leucine Rich Repeat
  Pfam annotation: Domain name=LRR_1; Domain location=139-158; Score =14.9; E_value=0.29; Accession=PF00560.23; Description=Leucine Rich Repeat
  Pfam annotation: Domain name=LRR_1; Domain location=161-183; Score =18.2; E_value=0.03; Accession=PF00560.23; Description=Leucine Rich Repeat
  Pfam annotation: Domain name=LRR_1; Domain location=185-206; Score =11.2; E_value=2.3; Accession=PF00560.23; Description=Leucine Rich Repeat
  Pfam annotation: Domain name=LRR_1; Domain location=207-229; Score =15.4; E_value=0.21; Accession=PF00560.23; Description=Leucine Rich Repeat
  Pfam annotation: Domain name=Pkinase; Domain location=360-694; Score =75.8; E_value=1.4e-19; Accession=PF00069.15; Description=Protein kinase domain
  Pfam annotation: Domain name=Pkinase_Tyr; Domain location=359-694; Score=83.3; E_value=7.6e-22; Accession=PF07714.7; Description =Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=47-85::115 -137::139-158::161-183::185-206::207-229::360-694::359-694
MTEVTLNSSVNILYHTAKKISMKFYSLQAHRFLFIIVILCPLVIADLSSDKQALLDFAAAVPHRRNLKWNPATPICSSWVGITCNLNDTRVVSVRLPGIGLVGTIPANTLGKIDSLRNISLRANLLSGSLPADITSLPSLQYLYLQHNNLSGNIPTSLSTRLNVLDLSYNSFTGAIPKTLQNLTQLIKLNLQNNSLSGLIPNLNVTKLRRLNLSYNHLNGSIPAALQIFPNSSFEGNSLCGLPLKSCPVVPSTPPPSSTPAPPSTPARHSSKSKLSKAAIIAIAVGGGVLLLLVALIIVLCCFKKKDDGSPRATKGKGPSGGRSEKPKEEFGSGVQEPEKNKLVFFEGSSYNFDLEDLLRASAEVLGKGSYGTAYKAILEESTTVVVKRLKEAVVGKREFEQQMEIVGRVGHHPNVVPLRAYYYSKDEKLLVYDYIPSGNLSTLLHVKAVKYDHIRKKWNLLSHVGITLMFEVLQDNLIPTVYVIYFRMGLYVLESARSLSLSPKSDLNLMIGNRASGRTPLDWNSRIKISVGIARGIAHIHSVGGPKFAHGNVKSSNVLLNQDNDGCISDFGLTPLMNVPSTPSRAAGYRAPEVIETRKHTHKSDVYSFGVLLLEMLTGKAPQQSPGRDDMVDLPRWVQSVVREEWTAEVFDVELMRYQNIEEEMVQMLQIAMACVAKVPDMRPSMEEVVRMIEEIRLSDSENRPSSEENRSKEESTAQTP

SEQ ID NO: 140258 - protein, 89 aa, Glycine max
  Coding DNA Sequence Number=SeqID_23480
  Gene Ontology: Mol. function=small conjugating protein ligase activity; Cellular component=proteasome complex (sensu Eukaryota); Biological process=protein modification process
  Homolog annotation: Hit_ID=Q5YJR0; Match level="QueryCoverage=92%, HitCoverage=59%, E-value=9e-41, Identity=95%"; Hit description =Ubiquitin-conjugating enzyme 9
  Pfam annotation: Domain name=UQ_con; Domain location=6-83; Score =67.2; E_value=5.2e-17; Accession=PF00179.16; Description=Ubiquitin -conjugating enzyme
MSIGWVQVAFRTKVFHPNINSNGSICLDILKEQWSPALTISKVLLSICSLLTDPNPDDPLVPEIAHMYKTDRAKYEATARSWTQKYAMG

SEQ ID NO: 140259 - protein, 79 aa, Glycine max
  Coding DNA Sequence Number=SeqID_23481
MKEERLKGIYSARGGICPIGYFTKHFSRESRVLELNWSHSSEVVSVSEWRRVVTAFGFCVKGLQKSENRPNFTRWSSLP

SEQ ID NO: 140260 - protein, 261 aa, Glycine max
  Coding DNA Sequence Number=SeqID_23482
  Gene Ontology: Mol. function=DNA binding; Biological process=DNA integration
  Homolog annotation: Hit_ID=Q1S3I6; Match level="QueryCoverage=88%, HitCoverage=16%, E-value=2e-26, Identity=33%"; Hit description =Integrase, catalytic region
  Pfam annotation: Domain name=zf-CCHC; Domain location=42-59; Score =13.2; E_value=0.0066; Accession=PF00098.13; Description=Zinc knuckle
  Pfam annotation: Domain name=zf-CCHC; Domain location=79-96; Score =14.2; E_value=0.0046; Accession=PF00098.13; Description=Zinc knuckle
  Pfam module annotation: Pfam domain module=zf-CCHC::zf-CCHC; Domain location=42-59::79-96
MPTIPKIFSYVAQQERQLSGINSFSNLSLESKENISINAVKVTCEFCGRIGHTESVCYKKHGVPTSYKGRSKTYNRNGKTCTHCGKIGHTIDVCYKKHGYPPGYKFGNNKVVNNIMEGKAASDQMQRQESHDLVHFSPEQYQALLALIQQPSSGSSIPTQPQVASISSCSTNTSPGMILSLKTTDSTSWILDSGATDHVSSSLANFHSYHQVNPIMVKLPNGHEVHATHSGTDTNTKAKIGTVEIYGDPVQKFLCMGIIIF

SEQ ID NO: 140261 - protein, 229 aa, Glycine max
  Coding DNA Sequence Number=SeqID_23483
  Gene Ontology: Mol. function=receptor activity; Cellular component =integral to membrane; Biological process=intracellular protein transport
  Homolog annotation: Hit_ID=Q307Y3; Match level="QueryCoverage=92%, HitCoverage=95%, E-value=6e-84, Identity=73%"; Hit description =Vesicle transport v-SNARE 11-like
  Pfam annotation: Domain name=V-SNARE; Domain location=41-196; Score =169.1; E_value=1.1e-47; Accession=PF05008.5; Description=Vesicle transport v-SNARE protein
MSEVFEGYERQYCEQSANLSRQCTAASALDGEQKKQKLSDIKAGLDDADTLIRKMDLEARSLQPSVKAALLAKLREYKTDLSNLKSEVKRVTSASVNLTARDDLLESGRADTLAASNDQKGRLLMSTERLNQSSDRIKESRKTMLETEDLGEFILRDLHQQRESLLHAHKTIHGVDDNISKSKKILSAMSRRMSRNKWIVSSLMTALLCLILECMLPNNVTMFEELCEQ

SEQ ID NO: 140262 - protein, 746 aa, Glycine max
  Coding DNA Sequence Number=SeqID_23484
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q9SX33; Match level="QueryCoverage=98%, HitCoverage=61%, E-value=0.0, Identity=73%"; Hit description =Putative phospholipid-transporting ATPase 9
  Pfam annotation: Domain name=Hydrolase; Domain location=229-699; Score=26.1; E_value=0.00012; Accession=PF00702.16; Description =haloacid dehalogenase-like hydrolase
MNLDGETNLKLKQGLDVTSSLQEDFKFRDFRAVIKCEDPNANLYSFVGSMDFGEQKYPLSAQQLLLRDSKLRNTDYVFGAVIFTGHDTKVIQNSTDPPSKRSKIEKKMDKVIYFLFCVLFLIAFLGSILFGFATKGDLDNGLMKRWYLRPDSSTIFFDPKRAAAAAIFHFLTALMLYNFFIPISLYFSIEMVKVLQSIFINQDIHMYYEETDKPALARTSNLNEELGQVDTILSDKTGTLTCNSMEFIKCSVAGVAYGRGVTEVEQAMGKSNGLPIFHEHINGLESKLNEIRDSPDRKEPIKGFNFTDERIMNGNWVNEPYADVIQNFFRLLAICHTAIPEVDEETGKVSYEAESPDEAAFVIAAREVGFKFYKRTQTCLSIYELDPASGNEVERTYKLLNVLEFNSSRKRMSVIVKDEEGRIFLLCKGADSVMFERLAKNGRKFEEKTLEHVREYADAGLRTLVLAFCELDEEEYKEFDDKFSEVKNSVAADQETLIEEVSDKIERNLILLGATAVEDKLQNGVPDCIDKLAQAKIKIWVLTGDKMETAINIGFSCHLLRQGMKQIIIHLEIPEIQALEKAGDKMAIAKASRESVHHQISEAAQLLSASRGTCQTFALIIDGKSLTYALEDNMKNMFLELTSHCASVICCRSSPKQKALVTRLVKSGTGKTTLAIGDGANDVGMLQEADVGIGISGVEGMQAVMSSDIAIAQFRYLERLLLVHGHWCYRRMSSMVLPLKLDPNIL

SEQ ID NO: 140263 - protein, 707 aa, Glycine max
  Coding DNA Sequence Number=SeqID_23485
  Gene Ontology: Mol. function=RNA-directed DNA polymerase activity; Cellular component=chromatin; Biological process=chromatin assembly or disassembly
  Pfam annotation: Domain name=rve; Domain location=407-530; Score =15.4; E_value=0.00031; Accession=PF00665.16; Description=Integrase core domain
  Pfam annotation: Domain name=zf-H2C2; Domain location=348-389; Score =34.5; E_value=3.7e-07; Accession=PF09337.1; Description=His(2) -Cys(2) zinc finger
  Pfam module annotation: Pfam domain module=RVT_1::rve::zf-H2C2; Domain location=12-196::407-530::348-389
MLQKGLIQPSTSPFSSPVLLVHNHDGSWRFCMDYRALNIVTVKDRFPIPTVDELLDELRGARCFSKLDLLQGYHQIRMDADDISKTAFRTHHGHYEFKVMPFGLCNTPSLFQATMNPIFGPYLRQFIIVFFDDILVQYLRHVVPHTGEAPVAAKVAVVQQWPTPRSIKALRSFLSLTVFEQLKLALTNAPVLALPNFDIPFTVESDASDSGIGVVLAQNGHPIAFFRKSFIPKLLRASTYELEGALNSGDPYIQAAYLLSEAADTLSRLPDTSATAHMLLFVPCLTFLDALRQQLDTHDEYCQKRQLILASPANHPFFFITQGLILHKGRIWLTRGLPIITTLLLEYHATTTGGHAGVAKTLARLSENFHWDGIRDDVARFVAQCLDCQVTKYEAKKFVGLLCPLPILARPWEDLSLDFIVGLPPYHGNTVILVVIDRFSKGIHLGLLPTSHTAHMELFGLSGTLLKMSSAYHPQSDGQTEVLNRVIEQYLHAFVHHRPGTWGKLIPWVEWSNNSSWNVATGTTPYEITSGRKSFSFSEYVVGTSKLDVVDELLTERDATFQAIRRKLEKAQENMKKFADVKHREVIYQILERLAEVAYCLQLPEGAPHSPRAIDGQPMITLISIMDSRRRSNDDTASWEVLEQLCDTYHLEDKVLFQGPGNDRAVETSSTDTGTGKELTNKDEQRVQIVEKPNRKVTRPAYLDDYA

SEQ ID NO: 140264 - protein, 64 aa, Glycine max
  Coding DNA Sequence Number=SeqID_23486
MDSPCVSLSQLSDGVVNADVDFLEITPKKKTERIKDCKKDCSAVILCTIKHIMGDEEWWYTTYT

SEQ ID NO: 140265 - protein, 224 aa, Glycine max
  Coding DNA Sequence Number=SeqID_23487
MSGGPETARPHSRRDTISFDDSRLTAGGGKRVGAAKRQGVGGWVVVVRRDVVPALFPPEYVQGPRLALRPRGKLAIALHPLELGKSSPFHIKGSDNQPGRMCVTEGQQGWLMAWMGRVRSHVNESTKLIGAGVWLQGPVPLELRKEKRIRDNSNQDGYGVVLAGYVEAVIQSLRDNSNQDGYGVVLAGYAEAVIQSLVSAALSTVNIITIIGVMHLMQQEMINI

SEQ ID NO: 140266 - protein, 483 aa, Glycine max
  Coding DNA Sequence Number=SeqID_23488
  Gene Ontology: Mol. function=nucleic acid binding; Cellular component= beta-galactosidase complex; Biological process=DNA integration
  Pfam annotation: Domain name=rve; Domain location=224-374; Score= -3.1; E_value=0.011; Accession=PF00665.16; Description=Integrase core domain
  Pfam module annotation: Pfam domain module=RVT_2::rve; Domain location=398-483::224-374
MEAYLDANDLWEAVEEDYEVPPLPNNPIVAQMKSHKERRLRKSKAKSILFTVVSPKICKSSQKQENVQAVVEEVDEEELFVVSCFATARSTESWLIDSGCTNHMNYDKELFKDLDATYNTNVRIGNEEKIAVKGKGTIVIEGCTSLKLIPDVLYVPEINQNLLSVSQLLKKGYKVLFEDKSCMIKDSDNKELFRVQMKGKSFALYLIDEEQLAEHKVEDNTLVWHKRMGHFHHGALLYLRKNDLVQGLLELEEKSPVCVACQYGKQTRLPFPKGKSWRATSKLQLVHTDVGGPQKTPSLNGRIEHQLTAPYTPQQNGVVERKNRTILEMARYVLFFEEEKWSKENEKLQVQEESEEDVDDQPVRGTRSLSDIYQRCNVAVMEPVDYNEAATDSKWVNAMKEELDMIEKHQTWELTEKPKDKNDIGVKWVYRTKLNADGFVNKHKARLVVKGYAQMFEVDFSETFSPIARLDTIRLLLALAAHK

SEQ ID NO: 140267 - protein, 274 aa, Glycine max
  Coding DNA Sequence Number=SeqID_23489
  Gene Ontology: Mol. function=DNA binding; Cellular component=beta -galactosidase complex; Biological process=DNA integration
  Homolog annotation: Hit_ID=Q1T2W1; Match level="QueryCoverage=97%, HitCoverage=65%, E-value=1e-65, Identity=52%"; Hit description =Integrase, catalytic region; Asp/Glu racemase
MSDYEVTEIEDPITHFALFSDCDPTTFERVKWVFKTKLKENGEVDKYEACLVAKGYKQQYGVDYTKVFSPVGRHDTIRYMENPTKMHFLVAKRILRYLQGTREFELFYRRGEKFNLLGFTDSDYAGDSDDRKRTFGYVFMMGSTTICWSSRKQPIITLSITKAEFVAASTCACQEIWLRNILEEVHFKQQGPTLIYCDNSSTIKLSKNPIMHGRSKHIDVRFHFLRDLSNEGIIDLIYCKSEEQIDDIMTKPLKLSAFQKLRNLLGVCMLNESH

SEQ ID NO: 140268 - protein, 177 aa, Glycine max
  Coding DNA Sequence Number=SeqID_23490
MSRKENLLCELHTKKGTWKIVVRITDMWRLNKHNGRQSIEMVLMNHTGTKIVATLWQELFPEFEPKLRCGGAYVIQNVKVVDTHSDYKTKSVKEVDRPEIPPNVHAITSFADIISGVAKPDTLVDKYSLSVQNIKHGSKLYVNGDIVEIQQFHDSLRVPFYIGGLDDEGGVSQSQST

SEQ ID NO: 140269 - protein, 187 aa, Glycine max
  Coding DNA Sequence Number=SeqID_23491
MPRTRGGDRTRPTTSVCRHKRCVVADEEQEIYEATEHVAADDVAPKDVLFGGGPEDKLVLTKSDDHMACKLWDDLDVDERWLNFAYHLVRPNETISGPSGCATVNKDDIPIVPPVIPDIRDVPESTSQHNSVYDICHKAAEPLQEMIYLRMVLMVEILVEDEVVEEFRVVGETMDKLRDYLCKNLLA

SEQ ID NO: 140270 - protein, 157 aa, Glycine max
  Coding DNA Sequence Number=SeqID_23492
MTRRITLRNLVLEDVGTQYSDKYEGCTRGRGRGRGKVTDRRCRKEEEGRVRGEGEGGRSHEGEREEEGEGHELLMPEGRGKVERWGRGREKNFFPNSRLHEIVIDEIGGSSTKKKPRVVFAVEEDTHLISSWLNISTDPIVGVGQGKEAFWLRVTEN

SEQ ID NO: 140271 - protein, 67 aa, Glycine max
  Coding DNA Sequence Number=SeqID_23493
  Gene Ontology: Mol. function=ATP-dependent peptidase activity; Cellular component=integral to membrane; Biological process=ATP -dependent proteolysis
  Homolog annotation: Hit_ID=Q8H0X2; Match level="QueryCoverage=79%, HitCoverage=14%, E-value=2e-10, Identity=52%"; Hit description =Expressed protein
MDCCNTKLLKYHTDPRKLERLASVELATLSNRRPAERLDLLRIRDTAERIRRGLIFLRQEEQGCRIQ

SEQ ID NO: 140272 - protein, 107 aa, Glycine max
  Coding DNA Sequence Number=SeqID_23494
MSCLVHMPFERKTNEPILFTENCSKRTKISTSRTYSSSSNPETPVKADTPSPIVLPMGQKAVKRKSKGKGVGASTNPVDLTSAEEAVRERNVINAKLVALREKELEK

SEQ ID NO: 140273 - protein, 82 aa, Glycine max
  Coding DNA Sequence Number=SeqID_23495
WTLDGLSVTDPVLCLPLALDLVAYCSAMGRKQRSNLFVDELRLLWCFALRLPGDAVLLDESSISKGPDALAGGDRHSVELTE

SEQ ID NO: 140274 - protein, 54 aa, Glycine max
  Coding DNA Sequence Number=SeqID_23496
MTGYLTLLQCVIDDAYDETTPRASQWLTMKAHMKGITGVSYRARLNALTIADVC

SEQ ID NO: 140275 - protein, 89 aa, Glycine max
  Coding DNA Sequence Number=SeqID_23497
  Subcellular localization annotation: CTP_CleavageSite=26; ConfidenceScore=5.18e-01
MRSAGCLSKQTNGLHPHSAFKIAPCVASLVNVRIYTRFSSNFSQHQLDLAPYTSEPYNAQWNAPGLLRDKHTLRSSRILGEMEVDEPWL

SEQ ID NO: 140276 - protein, 253 aa, Glycine max
  Coding DNA Sequence Number=SeqID_23498
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=1e-17, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
KSDKPAFINAKTRANEEDENEGETLAMTVIPTRSNFSSAQQCHYSTNNRLHVLAFRGLHVLAFRGLQVLAFRGLQVLAIRGIHTLANRAARPYLQRTAHPRLQRAARPRLQRTTCPRLQRPTRQHVLTFRGVHILAFRGLHVLAFRGLQVLAFRGLQVLPFRGLHALAFRGLHVLAFRALHVLAFRGLDILAFRGLHILAFRGLHVLTFRGLHVLAIRGLNVLTFRGLHALVFRGLHVLPFRGLHILAFRGLH

SEQ ID NO: 140277 - protein, 56 aa, Glycine max
  Coding DNA Sequence Number=SeqID_23499
MCDLPMSKLSLLCFRIQTKAWVFHLGPVDQPMRISLGFLNVAHLTTQYMDVTSLLA

SEQ ID NO: 140278 - protein, 113 aa, Glycine max
  Coding DNA Sequence Number=SeqID_23500
  Gene Ontology: Mol. function=nucleoside-triphosphatase activity; Cellular component=membrane
  Homolog annotation: Hit_ID=Q1SK92; Match level="QueryCoverage=56%, HitCoverage=8%, E-value=4e-15, Identity=62%"; Hit description=AAA ATPase, central region; DEAD/DEAH box helicase, N-terminal
MLAKAIANEASVQVSLMSQCQPSFTSKWFGEDEKNIRALFTLPAKVYSMIGQRTRIGEHEAMRKRMKDMEKKQREEEGQSSEDASNNKDKEEQEIKARSLNMEDMRQAKSQVG

SEQ ID NO: 140279 - protein, 334 aa, Glycine max
  Coding DNA Sequence Number=SeqID_23501
  Gene Ontology: Mol. function=protein binding; Cellular component =integral to membrane; Biological process=defense response to fungus
  Homolog annotation: Hit_ID=Q1T435; Match level="QueryCoverage=78%, HitCoverage=83%, E-value=5e-56, Identity=38%"; Hit description =Leucine-rich repeat; Leucine-rich repeat, cysteine-containing type
  Pfam annotation: Domain name=LRRNT_2; Domain location=36-74; Score =58.1; E_value=3e-14; Accession=PF08263.3; Description=Leucine rich repeat N-terminal domain
  Pfam annotation: Domain name=LRR_1; Domain location=103-126; Score =12.2; E_value=1.5; Accession=PF00560.23; Description=Leucine Rich Repeat
  Pfam annotation: Domain name=LRR_1; Domain location=128-150; Score =17.0; E_value=0.066; Accession=PF00560.23; Description=Leucine Rich Repeat
  Pfam annotation: Domain name=LRR_1; Domain location=152-175; Score =15.7; E_value=0.17; Accession=PF00560.23; Description=Leucine Rich Repeat
  Pfam annotation: Domain name=LRR_1; Domain location=177-199; Score =16.2; E_value=0.12; Accession=PF00560.23; Description=Leucine Rich Repeat
  Pfam annotation: Domain name=LRR_1; Domain location=201-223; Score =21.3; E_value=0.0035; Accession=PF00560.23; Description=Leucine Rich Repeat
  Pfam annotation: Domain name=LRR_1; Domain location=225-254; Score =0.7; E_value=2.1e+02; Accession=PF00560.23; Description=Leucine Rich Repeat
  Pfam annotation: Domain name=LRR_1; Domain location=283-310; Score =5.5; E_value=26; Accession=PF00560.23; Description=Leucine Rich Repeat
  Pfam annotation: Domain name=LRR_1; Domain location=312-334; Score =4.6; E_value=39; Accession=PF00560.23; Description=Leucine Rich Repeat
  Pfam annotation: Domain name=LRR_1; Domain location=79-101; Score =0.5; E_value=2.3e+02; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1; Domain location=36 -74::103-126::128-150::152-175::177-199::201-223::225-254::283 -310::312-334::79-101
MPTINPVGLKFMEGIITFMMMMLQVVVSAQDHIMCIQTEREALLQFKAALLDHYGMLSSWTTSDCCQWQGIRCSNLTAHVLMLDLHSLGLRGEIHQSLMELQQLNYLNLSWNSFQGRGIPEFLGSLTNLRYLDLSHSDFEGKIPTQFGSLSHLKYLNLAGNYYLEGSIPRQLGNLSQLQHLDLRANQFEGNIPSQIGNLSQLQHLDLSYNSFEGSIPSQLGNLSNLQKLYLGGSYYDDDGALKIDDGDHWLSNLISLTHLSFDSISNLNTSHSFLQMIAKLPKLRELSLIHCSLSDHFILSLRPSKFNFSSSLSRLDLSWNSFTSSMILQWLSN

SEQ ID NO: 140280 - protein, 522 aa, Glycine max
  Coding DNA Sequence Number=SeqID_23502
  Gene Ontology: Mol. function=RNA-directed DNA polymerase activity; Biological process=RNA-dependent DNA replication
MGIGIPLLLHDATINKTFGHYVRILVNVDLARDLHDQILIERKDYAFFVDIVYEHLALFCSSCKVVGQSHDNCKKKEKDVVFRQDPQVESKKKHIDQPQEKNKAIVLQNDNNDAVGEVQKFVVSSIVDIQDDLNSCKESLHLESLVMKALVEDVSTQRIAEDIGNIKGLWGDISQQKKLKKKSKDTKARTSVPRTRSRAGPKNHTDEGHLLERTAEPWVDSSTVPTQFWKNLNLKLFALNDQGEKPGPASFRFQKMWLEHNDYEQLVSTTWNQSIAGCPMFVLGSKLRLSKQAFRSWNKCCFGNVHDNVKACQDVVNVVQRDIDTSVYSDELKDRESQAQIDLEKLYPCRGNFLEEKAKRMSVLQSGDVMMESQEALDAWMDLGNVFSKGSGILLVNLSFKLFFNAFNRFKIITEVLTDRLAKIAPKILYPDQRGFVKGRHISDCICIAFEVVNLLKHRSIGVLSAFGFDHKFVQWILALLHFAKLSFVVSSKAAGYFILSMGDSSRRSLIPSSLLFGRRFL

SEQ ID NO: 140281 - protein, 77 aa, Glycine max
  Coding DNA Sequence Number=SeqID_23503
  Subcellular localization annotation: CTP_CleavageSite=42; ConfidenceScore=5.05e-01
MATFWMFPGLSSPRPASGLPGPWNAFILKQPALLGELIPSAPCKGRVSRTDSGVSSIGACRPRIFFINGFLCFLEDE

SEQ ID NO: 140282 - protein, 171 aa, Glycine max
  Coding DNA Sequence Number=SeqID_23504
MIGLKEYIVANPALLQQYATTIHSQISNASMPNPEFVDAEIQDEFYDAISAESLSSDEESEEDKELDQVWNKEKGHKVKLKNVSWAMTTLALKRTTGLSKELDPDASSITIDVSGKFGSLCKGVDENDTNCWTSPSGEGFMIRGKNYLKDNSKNSYKQSKAISVPIPEKGT

SEQ ID NO: 140283 - protein, 1002 aa, Glycine max
  Coding DNA Sequence Number=SeqID_23505
  Homolog annotation: Hit_ID=Q1SXR1; Match level="QueryCoverage=20%, HitCoverage=28%, E-value=1e-44, Identity=66%"; Hit description =Integrase, catalytic region; Zinc finger, CCHC-type
  Pfam annotation: Domain name=zf-CCHC; Domain location=301-318; Score =4.8; E_value=0.16; Accession=PF00098.13; Description=Zinc knuckle
  Pfam annotation: Domain name=zf-CCHC; Domain location=74-91; Score =13.5; E_value=0.0058; Accession=PF00098.13; Description=Zinc knuckle
  Pfam module annotation: Pfam domain module=RVT_2::zf-CCHC::zf-CCHC; Domain location=407-589::301-318::74-91
MTLEELVKILKVHKQDLAQDNGIKKGKSLSKTKMQPCIQGVIVQSLCQRYGETRTPPGSTNHPKDPSTRKRKVQIYYKYKKLGHFMSKCPNLAKPKDKKKKFFKSKKRSLMSTWGDFDDSSSNEDSEEEANLCLIADASTSKAKSALDVSLDNEDSQPKDTFNSDGEEVIFESREDLIKGYNQLLFASACVTKAYRKLNKHFQHLEKEHEDLRKAHKVHLVDFVLETSLPSSEKDTCVCEEVKALLDEKVFSGRKTLLKDFQDMEERVKSLTTTFEDLVEGHKEMIKQKLTNARTSLKEVIVCYLYGKVGHETHKCKDLPEKGNPSKGSSSAYQHPYANQRKEPKKIWVPKSKIILVIDLLDSQKETPIMENLGKLDSKCDSKILLEYSESSKAYRVYNSRTLTAEEAIHKNDICMLVELPKGKSTFGAKWVFRKKLDEMGKVVRNKARLVAKGYSQQEGIDYTETFAPISRLEAICILLSFVVHHAMILYQMDVKSVFLNSIIMEEVYVEQPPEFQSSIYPRHVFKLNKALYGLKQAPQACKKQGTIALSTAKTKYISATSYCSQLLWTKYQLEDYNLFESNIPILCDNIAAIDLSKNPIMHLRAKRVEIKHHVIRVFRRVNLVKRKAWHAPCGMKFQIYVKDFRNNPPFASSKEGEVVQIPRPTPMSIIAAKVSVKDKEPKVYIEHFFNIDSSEIVGYVIKARLMLCCIHHFFEDPKVVVPELICEFWRTAKDNSIEKDIYHSIVLTKVLEAHGVIRKFLYETPKEQTPPVDESILSEIHQKFRLNTGRDDQLNVVWKTTNEDQVVDVDAMATQIEKRSKKKMDALSSKAAPTPQCPPPSLVAPKATGAMAHVSRRAVSKKQQPSSTTDHLRELSETDDDEDGLVFRKCKVAPPLDDTFMPQVKKRLVNEQVDVAAAHDPQYAKIPPIREQTSTIQQFEHSLRRTGIIHLKKKKITKSNDDMDDEVPLQAPPSPIHLNRFVYQGPLAIDPNLSEEDLARL

SEQ ID NO: 140284 - protein, 184 aa, Glycine max
  Coding DNA Sequence Number=SeqID_23506
  Gene Ontology: Mol. function=protein serine/threonine kinase activity
  Homolog annotation: Hit_ID=Q337P5; Match level="QueryCoverage=89%, HitCoverage=22%, E-value=4e-40, Identity=50%"; Hit description =Pleckstriny domain-containing protein, putative, expressed
  Pfam annotation: Domain name=DUF1336; Domain location=1-177; Score =206.3; E_value=7.1e-59; Accession=PF07059.3; Description=Protein of unknown function (DUF1336)
VIGGDPLLKLIAVDWLKVDKSIDRIALHHRSLVQSEAGKNLPFVFVLNLQVPAKPNYSLVLYYASDRPVNKDSLLAKFLDGNDMFRDSRFKLIPSIVEGYWMVKRAVGTKACLLGKAVTCKYFKQDNFFEIDVDIGSSSVARSVIGLVLGYVTSLVVDLAILIEGKGFSYDLGSKMFIYTFFMG

SEQ ID NO: 140285 - protein, 70 aa, Glycine max
  Coding DNA Sequence Number=SeqID_23507
MKVCMEMAPRKLASKRSRKDKAAEGTSSALEYDSHRFRSAEHQQRYEAIKGWSFLRERRVQLRDNEYTDF

SEQ ID NO: 140286 - protein, 112 aa, Glycine max
  Coding DNA Sequence Number=SeqID_23508
  Subcellular localization annotation: CTP_CleavageSite=70; ConfidenceScore=5.62e-01
MGVDADGDGMSSISGLTSMTKTPVTWSGSRENSGLRWFVVLVSGGFLGKLRWFPSMTLVWPQRCRRRWLSAGNESRSEEETRRREDFDIEVVIGVGSGGADDWRRIVKEKAV

SEQ ID NO: 140287 - protein, 129 aa, Glycine max
  Coding DNA Sequence Number=SeqID_23509
  Homolog annotation: Hit_ID=Q1S3D8; Match level="QueryCoverage=48%, HitCoverage=8%, E-value=5e-09, Identity=44%"; Hit description=WD-40 repeat
MLVLLASYATHRIGLFALFGPFVLGLATPEGPPLGTAITKKIDSFVNWVLMPTFVTTCAMRVDLRDFMNWREKMNGGIGEFTVQTLALCLLCAATCKGVVEMAGYSLVRDVMQFKGECCLKEYVKRLCY

SEQ ID NO: 140288 - protein, 170 aa, Glycine max
  Coding DNA Sequence Number=SeqID_23510
  Subcellular localization annotation: CTP_CleavageSite=41; ConfidenceScore=5.00e-01
MNCVFVHVSSTFEFGAMRSDCLVQFPIHNLFRSPMNCIFVHVSSTFEFGAMRSDCLVKFSILTLLQGLMNCVFVHVSSTFELGAMRSDCLVQFSILTFFRSPMNCVLVLVSSTFEFGAMLSDCLVQFSILTLFHRPMNCVFVHVSSTFEFGAMRSDCLVQFSILNLFGAP

SEQ ID NO: 140289 - protein, 84 aa, Glycine max
  Coding DNA Sequence Number=SeqID_23511
RITKNPNVRLTVVRFLALSVELNTKDWQGMLDTEILNDIEEKKKCSEYPELWVLEDLLASIDDVGKASVFIMQQQRREQTRMLE

SEQ ID NO: 140290 - protein, 149 aa, Glycine max
  Coding DNA Sequence Number=SeqID_23512
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q9BBS4; Match level="QueryCoverage=86%, HitCoverage=70%, E-value=4e-48, Identity=76%"; Hit description=ATP synthase B chain
  Pfam annotation: Domain name=ATP-synt_B; Domain location=1-121; Score= 39.1; E_value=1.5e-08; Accession=PF00430.9; Description=ATP synthase BB' CF(0)
MSINGLNPITYGKKLKTDNRKQKILRTIRNSEELREGAIEQLEKAQARLRKVETEADRFRVNGYSEIEREKLNLINSIYTTLEQLENYKNEAIHFEQQRVINQVRQRVLQQALQGALGTLKSCLNNELHLRTVSANIGMFGTMKEKITD

SEQ ID NO: 140291 - protein, 158 aa, Glycine max
  Coding DNA Sequence Number=SeqID_23513
  Gene Ontology: Mol. function=RNA-directed DNA polymerase activity; Cellular component=chromatin; Biological process=chromatin assembly or disassembly
MDYRGLNAITVKDRFPIPTIDELGGACYFSKLDVLQGYHQILMREKDVSKMVFRTHHGHYEFRVMPFGLCNAPPSFQATMNNVFQTYLHLGGIFGPFGVKRGGGNTTGEGSSSATVSHSLISQSFARFPRVIRIRLLLHQGLCVQCCSSNPNPGKGSL

SEQ ID NO: 140292 - protein, 342 aa, Glycine max
  Coding DNA Sequence Number=SeqID_23514
  Gene Ontology: Mol. function=chromatin binding; Cellular component =chromatin; Biological process=chromatin assembly or disassembly
  Homolog annotation: Hit_ID=Q1SAV4; Match level="QueryCoverage=86%, HitCoverage=79%, E-value=1e-76, Identity=46%"; Hit description =Integrase, catalytic region
  Pfam annotation: Domain name=rve; Domain location=1-117; Score=5.3; E_ value=0.0021; Accession=PF00665.16; Description=Integrase core domain
MLQPHYIARSVALLFMEMVGKLHGMPRSLVSDRDPLFISRFWQELFKMSGTTLRMSSAYHPQTDGQTKVANRVVEQYLRAFVHQLSSSWGRFLLWAKWLYNISQHSSTDLPPYEITFRKKPPSIPQYIAGTSQVEVGDDFMTNHEAVFISLRKKLLKAQESMKQIADAHRKDNIFEVGDWLLIKLQPRHQVSATGEPFSMLAKLFYGPFQILQKIDMVAYRVKLPKGCRIHPVFHCFLFEPFQSSSTLHEPLVELPPMVKDNQTVITPLMILNTRLPPKETSWEESETLKVEYHLEDKVFFDEGGNVSRKEKDQLCTIPLTKNNNPRPRRKIIPPRHLADFI

SEQ ID NO: 140293 - protein, 85 aa, Glycine max
  Coding DNA Sequence Number=SeqID_23515
MSLPCAVHVSSIFESGAPRMSLPSAVRQFSILHFYSDPHECHCLALFMHPPPKEFGAMLHDCLSVDPLVQSSILLFFRSPMNVFA

SEQ ID NO: 140294 - protein, 81 aa, Glycine max
  Coding DNA Sequence Number=SeqID_23516
MTKRGGEENAKGHNLVTGIFATSPKMLGVPAVGLVPKEMPNKKFMSRTSSKPKPKNLKSVSDSIDPNLVDGYIDPNFVKIV

SEQ ID NO: 140295 - protein, 51 aa, Glycine max
  Coding DNA Sequence Number=SeqID_23517
MWKESLRHQRESLGDCVSEARGMKRLAQKLLIGVLMRRKEGLEKLQLRFFY

SEQ ID NO: 140296 - protein, 47 aa, Glycine max
  Coding DNA Sequence Number=SeqID_23518
MGKVIEAFICNAERDCYMLAKEGEKEKEPLISKPSIMVIVLKSPNYN

SEQ ID NO: 140297 - protein, 113 aa, Glycine max
  Coding DNA Sequence Number=SeqID_23519
MASGAYCLQIFKFILADQVDPHDLRIKLIRELRADQVDLDGRRKLTSMKNERMELAEEEEEALLGRRRKTREKTDEDAGERNSSSWEKEEDADEGGRRRRKASWERRKEALGA

SEQ ID NO: 140298 - protein, 72 aa, Glycine max
  Coding DNA Sequence Number=SeqID_23520
MASNSLDAKLLVGQEKCARYGGGGRRRQVETNLHDDVSENGRRGIPSCKKNVELPSFVGHDLLGWIARAEKF

SEQ ID NO: 140299 - protein, 129 aa, Glycine max
  Coding DNA Sequence Number=SeqID_23521
MVRIRRLYRPLGRVLERVLSRHVSGDEEKVPQHRRPTTSICKQWAVAAVVEDVENVDNAANEPHKEPHDPVTKDERIELKLASHGRKLEKFGRPTLEIEDIVVAIGLSSLITCLLETSDKRLLSTFAGR

SEQ ID NO: 140300 - protein, 114 aa, Glycine max
  Coding DNA Sequence Number=SeqID_23522
MWEVVGLNMWEVARLWSLIKPKFYQAKRKTKESGKHYSKHLNLSHYAIPPQMDLCLKDLSTAKRISDNLCTLAMDKTTKEVLEHQYSGSLEAKEAKAYALLRAIKWAQELNISK

SEQ ID NO: 140301 - protein, 211 aa, Glycine max
  Coding DNA Sequence Number=SeqID_23523
  Gene Ontology: Mol. function=chitin binding; Cellular component =extracellular region; Biological process=chitin metabolic process
  Homolog annotation: Hit_ID=UPI000044A8F0; Match level="QueryCoverage =86%, HitCoverage=99%, E-value=9e-23, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MSHLLEFGMIDPLNESISCFLKRVDPWVLVPSPSEDYTSSPSEGRTPSPSKGCTPSPSEDYTSSPLEDYTSSPSKDNTSSPSKDYASSPSEGCTPSPLEGYASSPSEGYMHALRGLRILIFRGLHALAFRGLHALTFRGLHVLTFRGLHVLAIRGLHVLAFRGLHALTFRGLHVLTFRGLHVLTFRGLHTLSFSGLHALAFRGLDALAFKG

SEQ ID NO: 140302 - protein, 656 aa, Glycine max
  Coding DNA Sequence Number=SeqID_23524
  Gene Ontology: Mol. function=protein serine/threonine kinase activity; Cellular component=nucleus; Biological process=protein amino acid phosphorylation
  Homolog annotation: Hit_ID=Q7XIB4; Match level="QueryCoverage=96%, HitCoverage=93%, E-value=0.0, Identity=56%"; Hit description =Putative cyclin-dependent kinase CDC2C
  Pfam annotation: Domain name=Pkinase; Domain location=107-401; Score =286.7; E_value=4.5e-83; Accession=PF00069.15; Description=Protein kinase domain
  Pfam annotation: Domain name=Pkinase_Tyr; Domain location=107-378; Score=17.1; E_value=1.6e-13; Accession=PF07714.7; Description =Protein tyrosine kinase
  Pfam module annotation: Pfam domain module=Pkinase::Pkinase_Tyr; Domain location=107-401::107-378
  Subcellular localization annotation: CTP_CleavageSite=47; ConfidenceScore=5.06e-01
MGCVSSKQAVSVTPAIDHSGAFRSNAGGLAEPEKKRSKKRTESGGASQSEVGESGRTSSNCDSLSFRLGNLHKYVQGEHVAAGWPAWLSAVAGEAIHGWVPLRADAFEKLEKIGQGTYSSVFRARELETGKIVALKKVRFDNFEPESVRFMAREILILRRLDHPNIIKLEGLITSRLSCSIYLVFEYMEHDITGLLSSPDIKFTEPQFLLGYFGYIKIKCYMKQLLVGLEHCHLRGVMHRDIKGSNLLVNNEGVLKVADFGLANFVNPGHRQPLTSRVVTLWYRPPELLLGSTDYGPAVDLWSVGCVFAELLVGKPILQGRTEVEQLHKIFKLCGSPPDEYWKKSRLPHATLFKPQQPYDSCLRQSFKDLPVTSVHLLQTLLSIEPYKRGTATSALSSEYFKTKPYACDPSSLPVYPPSKEIDAKHREESRKKISGRVRGTETRKPSRKPLGFNKLAPAEDLASQTQTSHKVNARSFRVLEEERTKIGDKAQKPSSGKPEDASHVKNASQGDIPLSGPLQVSTSSGFAWAKSRKDDTSFRSHCRTISRGHTFNPLEPCTLNSRNNLDTRNQENKEFSGGCTNSRGHDLLEISKLSMQNQWSKFDRPDSFDASDEYHSQELSIALYHREDSASKRSNLRLIQVTQGKRESGIYYAGN

SEQ ID NO: 140303 - protein, 91 aa, Glycine max
  Coding DNA Sequence Number=SeqID_23525
MTVSKLRNDAKGSSRCGVLTENNGALWWLMVAVDDGEKACHVGNGFGRKKGEEMAFFQSYLDYKAQNAQVSNALGNGNVAHTPDIFSKIPM

SEQ ID NO: 140304 - protein, 33 aa, Glycine max
  Coding DNA Sequence Number=SeqID_23526
MSISSSTASTRIRYPIVRPPAIIQFRAAFHNDQ

SEQ ID NO: 140305 - protein, 98 aa, Glycine max
  Coding DNA Sequence Number=SeqID_23527
MEANAVTIAATSIVAKVNPMPPSGLNQMNHPTLDMIGKDLGSRGGPHYAQNKHAFPPYGLPLNYTPPNVAYTPNKNVNNSIPIPIESQQPQTDHAPVS

SEQ ID NO: 140306 - protein, 504 aa, Glycine max
  Coding DNA Sequence Number=SeqID_23528
  Gene Ontology: Mol. function=transferase activity, transferring glycosyl groups; Cellular component=integral to membrane; Biological process=metabolic process
  Homolog annotation: Hit_ID=Q9LK73; Match level="QueryCoverage=94%, HitCoverage=99%, E-value=1e-119, Identity=48%"; Hit description =Flavonol 3-O-glucosyltransferase-like protein
  Pfam annotation: Domain name=UDPGT; Domain location=4-480; Score= -55.8; E_value=8.2e-08; Accession=PF00201.9; Description=UDP -glucoronosyl and UDP-glucosyl transferase
MKEAVVFYPAPLIGHLVSTIELCKFILTHQPSLSIHILITIAPYDTSSTSNYISTVSTTLPSITFHTLPTFTPPQTLLSSSLNHETLLFHVLHHNNPHIHQTLLSLSQTHTLHALIVDILSSQSISVASQLNLPCYLFVPASASLLAAFLYHSTLHETYHKSFKDLNNTFLNIPGVPPMPARDMPKPLLERNDEVYKNFLSCSLAAPKAAGLIVNTFEALEPSSTKAICDGLCLPNSPTSPLYCLGPLVTTTEQNQNNSSDHECLRWLDLQPSKSVVFLCFGSLGVFSREQLCEIAIGLEKSEQRFLWVVRNPVSDQKHNLALGTQEDPDLEFLLPKGFLDRTKEKGLVVKNWVPQAAVLSHDSVGGFVSHCGWNSVLEAVCAGVPMIAWPLYAEQRFNRVVLVEEMKVALWMHESAESGFVAAIEVEKRVRELMESERGERVRNRVRVAKDEAKAATREGGSSRVALDKLLKSWKERDKVMSDQSHMQCKLLPSSFLFGKYEN

SEQ ID NO: 140307 - protein, 528 aa, Glycine max
  Coding DNA Sequence Number=SeqID_23529
  Gene Ontology: Mol. function=steroid hormone receptor activity; Cellular component=nucleus; Biological process=regulation of transcription, DNA-dependent
  Homolog annotation: Hit_ID=Q1S1V4; Match level="QueryCoverage=95%, HitCoverage=75%, E-value=0.0, Identity=74%"; Hit description=SPX, N -terminal; Major facilitator superfamily MFS_1
  Pfam annotation: Domain name=SPX; Domain location=10-146; Score=91.2; E_value=3.2e-24; Accession=PF03105.10; Description=SPX domain
KPFQLLKVMVAFGKKLKDRQIQEWQGYYINYKLMKKRVKQYAQQIQLGALDRRHVLKDFSRMLDNQQQGLLACQITKLGEQRDALQEEPEISKIIELREAYRALGQDLLKLLFFVEINAIGLRKILKKFDKRFGYRFTDYYVKTRANHPYSQLQQVFKHVGLGAVVGALSRNLHDLQDRQGSYLSIYDQPTLPLQAGCWLGIPVAAHGWWGFFIIYTWSCMQDPVVDSINAAVDRLTNSTNFLNFLGQHALIMQEELPSPTEEHVDDQRYHFMSLLLNLANTFLYMVNTYIIVPTADDYSMSLGAAPTVCGIVIGAMAVAQVFSSVYFSAWSNKSYFRPLVFSSIVLFLGNILFGSARAVNRRYISDCVPLKIRMQASAGFVSASALGMACGPALAGILQINFKISKLTFNQNTLPGWVMAVAWLIYLVWLWITFKEPSREAEEDHSPHQSNDEVNNALEKGLKQPLLISSENKVDEDADQDCDDSEEAPEESRQPVNSIRMAYRLLTPSVKVCEQLPVTAIILDFYL

SEQ ID NO: 140308 - protein, 188 aa, Glycine max
  Coding DNA Sequence Number=SeqID_23530
  Gene Ontology: Mol. function=RNA-directed DNA polymerase activity; Cellular component=chromatin; Biological process=RNA-dependent DNA replication
MGTEKGAMEDWVDMCVRWEIESIGDQTNAFNNLKWAKEALREFWVARSGDRRLSSWAQLDIYPLPLFEVQLLTRLKQGLDNFVIRHARDIIEDWIDTGAMWMVDHERSSGGIAQVFGSSPSSGHRTEGDGVNEEAGDPERCESRGKSTQMHPLQEPIYHNHDDSKSVRGNTFFNKPLNILLKVEPEKT

SEQ ID NO: 140309 - protein, 608 aa, Glycine max
  Coding DNA Sequence Number=SeqID_23531
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=78%, HitCoverage=30%, E-value=1e-90, Identity=38%"; Hit description=Chromo
  Pfam annotation: Domain name=RVP_2; Domain location=184-292; Score= -27.3; E_value=0.00013; Accession=PF08284.2; Description=Retroviral aspartyl protease
  Pfam module annotation: Pfam domain module=RVP_2::RVT_1; Domain location=184-292::403-578
MADHGTRKTTTDRLEEAIVRLSNGHASINERYNDLAGKVDSILEHLRSNDSGNHTNTPATNHHSHQCNTVKLDIPRFDGRDPLGRIFKITQLFQYQNAPEEERITVASLYLDGAALNWCKGRVLLFITDEQSQINEAIEPEPQDDQTAAHGNSPKPIPEAVCSHISLHALGGLPSSETFRIFGTIKKARLTVLIDSGSTHNFLQPRIAQFLKLLLQTTHPLQVMVGNGSTLASDQVCPETQVTIQGHPFVVSFHLLQISGADAVLGIDWLKHLGPVTTDYAECIMHFNHLGRDITLKADVNLGPEPASAAELKHFIQTGSTSALYQLHLLPTDQPDPTTTLHPFISVEHLLHQYEHVVHRITLHPFTTPISVRPYRYPHFQKNEIERQVSDLLVARLIRSSTSPYSSPVLLVKKKDATWRLCVDYRALNSVTIRDHFPIPTIDELLDELGHASWFSKLDLRQGFHQILMSELDIEKTAFRTHNGHFEYLVMPFGLCNAPSALQCTFNIPIRYEPTPATIPTKVCQSFFDDILVYSDSLSSHLYHLEIIFQALQHAEFYLKHSKCLFAQESIEYLGHIVSGKGVTPEPSKVQAMLQWPPPTSVRELRAF

SEQ ID NO: 140310 - protein, 99 aa, Glycine max
  Coding DNA Sequence Number=SeqID_23532
  Homolog annotation: Hit_ID=Q8S9A4; Match level="QueryCoverage=76%, HitCoverage=16%, E-value=8e-08, Identity=40%"; Hit description =Glucosyltransferase-5
MKRSRIHEVNDEGFEVRGFGEGLEGNGEVLRAVAGEFDGEDVRGEGRSGGGECGEGGVVECDGGGRGGDGGDVSSIRVAGDAGGGRGGGWSEDEDSDGK

SEQ ID NO: 140311 - protein, 157 aa, Glycine max
  Coding DNA Sequence Number=SeqID_23533
  Gene Ontology: Mol. function=transferase activity, transferring glycosyl groups; Cellular component=integral to membrane; Biological process=metabolic process
  Homolog annotation: Hit_ID=Q8S9A4; Match level="QueryCoverage=98%, HitCoverage=32%, E-value=2e-53, Identity=67%"; Hit description =Glucosyltransferase-5
MEELSLDELMPEGFLERTKEKGLIKRNWAPQVQLLSHDSVGGFVTHCGWNSVLEAVCEGVPMVAWPLYAEQKMNRVIMVKEMKVALEVNENKDGLVSATELGDRVRELMDSVKGKEIRQRVFEMKKRAEEAMAEGGTSCVTLDKLAIKLWKGNMIDI

SEQ ID NO: 140312 - protein, 68 aa, Glycine max
  Coding DNA Sequence Number=SeqID_23534
MPTQTLTPYSPPPTTTGGHHEPPLLAAEPPHQEERFNQSGILRIHLKEPCVWTDERERERPLSAAKRN

SEQ ID NO: 140313 - protein, 110 aa, Glycine max
  Coding DNA Sequence Number=SeqID_23535
MVIDAEVQKAIARLDLGGVHKGMLLDLTRNLRNRLSVGSLTAKDRMLVYLKTYIFTTRSNNHTQVTNDDLQIVYGFKSDFTKASSDITERHLKKLRMRFIGHEWIMVEAQ

SEQ ID NO: 140314 - protein, 526 aa, Glycine max
  Coding DNA Sequence Number=SeqID_23536
  Gene Ontology: Mol. function=RNA binding
  Homolog annotation: Hit_ID=Q69N36; Match level="QueryCoverage=68%, HitCoverage=44%, E-value=7e-34, Identity=41%"; Hit description =Agenet domain-containing protein / bromo-adjacent homology (BAH) domain-containing protein-like
  Pfam annotation: Domain name=Agenet; Domain location=225-307; Score =84.4; E_value=3.6e-22; Accession=PF05641.3; Description=Agenet domain
ILRVFGLAGSEIESYSSSGDAAMVGKHGYEPEIGALKDNQLQRMRNCTKEFSWIGLPWACKKRRKHYQAYKRNGFQISVHDFIFVLAEEDKRLVAYLEDLYEDSKGNKMVVDALIKGYWKQEILRYMYTQLDSKSSGSSRQSDDDLELDENHMTTVFIRPKKRLRLTKADDAKEAVDLVGLKTENVNNSKNNTKINTGNNSGKLIGHTNMTATIKGTNEHASHHLVVGSLVEVLSQDGGMRGCWFRASVIKKNKDKVKVQYQDIQDAVDETKKLEEWVLASRIAVPDNLGLRMRGRTMVRPAPPSNKRELSWVGDVGFVVDAWWHDGWWEGIVVQKDSESNCHVYFPGEKVVSVFGPGNLRESQDWVGNEWVFVRERPDLVASVLSSLKTKQNSCKSNSNNIQSTGAITRDGIQFGQSDTCLDSDKDRPRKAEVVPDLLKNVLSSQLRWKTTRKRKRGRSSASYQKPRCTDTHQKRSPNVMKSNAPDSFLIPASLKVDHDDCKYVGDPSIFSSSVVPSLTNMVMCR

SEQ ID NO: 140315 - protein, 139 aa, Glycine max
  Coding DNA Sequence Number=SeqID_23537
MPKWLSAQMISVNPDLGSQVGGGGQMSPLTGRDLHHLLHLLSSRDSKLSGWQRYLMVVRTFRQPGANELIDAQRLTSSSAPFVIQGQRVGWQAEIPYGRPHLSSTEANEFDGFYSRRPETFKPDDARDSSLRGGDDQVR

SEQ ID NO: 140316 - protein, 139 aa, Glycine max
  Coding DNA Sequence Number=SeqID_23538
  Gene Ontology: Mol. function=DNA binding; Biological process=DNA integration
  Homolog annotation: Hit_ID=Q1S3Z1; Match level="QueryCoverage=62%, HitCoverage=8%, E-value=2e-17, Identity=41%"; Hit description =Integrase, catalytic region; Zinc finger, CCHC-type
  Subcellular localization annotation: CTP_CleavageSite=27; ConfidenceScore=5.30e-01
MEACGNVVNQARKFVHPSRSTMTSFVSAVSQSGSHVSNGSSDNSLWYICLSYMSEKGLDIMSKRGLFGNHKVKPLQFYEHCVYGKQHQTKFPKGPLRVPSPGGARYFLSIIDDYSRMTWASMMNQKYETFKFSSIRRFL

SEQ ID NO: 140317 - protein, 60 aa, Glycine max
  Coding DNA Sequence Number=SeqID_23539
MYPTVEIASDAGKAKEVTRGGEREIKNAKESRWWCPELPVEKGKNGKTRSFWVPAGHMPK

SEQ ID NO: 140318 - protein, 157 aa, Glycine max
  Coding DNA Sequence Number=SeqID_23540
MGEIEEVQEWMKADIEAMKEQMDTMMEAMMNMKKIMEVNAAVVAATSAIADMDSTTPSGLNQISHPTSDMVEHACLPTIRLAPNYTPPNVVHTPDEDVNNSTPIPIESQQPQSIHAHEAPQDHNLADFEPYLGYATEGQAVGGVPLPSTLEGPQFHP

SEQ ID NO: 140319 - protein, 62 aa, Glycine max
  Coding DNA Sequence Number=SeqID_23541
MHGMGEEIFLIEPIAPPVTGTPDPYPSDDATKSMINERIYGWLSGEANSTKKSHVSEIDSLE

SEQ ID NO: 140320 - protein, 82 aa, Glycine max
  Coding DNA Sequence Number=SeqID_23542
MALIPVEGKPRLDNSILTILDCEESSPHCFGLQKDENLSLGGVITRSRLKKLQEDINMKMNSLMEKEEEGALKIINFSQLFD

SEQ ID NO: 140321 - protein, 111 aa, Glycine max
  Coding DNA Sequence Number=SeqID_23543
MKVDQIFNCHNYSEEKKKIRLASIEFEGYALVWWNQLQVDVDRLRRPRVETWLEMKKVFKERAEMEETQEDTMARFLHGLNKDIQDEVVLQSYNSMDELIQWRLKGIWKGC

SEQ ID NO: 140322 - protein, 139 aa, Glycine max
  Coding DNA Sequence Number=SeqID_23544
  Gene Ontology: Mol. function=DNA binding; Biological process=DNA integration
  Homolog annotation: Hit_ID=Q7XYU6; Match level="QueryCoverage=63%, HitCoverage=26%, E-value=7e-17, Identity=45%"; Hit description =Integrase
MLGFDHIKELLACDDDFSRLYELCEKNAHNGFFSHDGFLFKDKRLCVTKSTLCELLIREAHDIGLMGDFGDFVGKAWHQAFFLHNLPSLNRWANQSVVYGFNLMSPLDLIPLPNVDSMLNGDELFKASFIRNLHEKVKA

SEQ ID NO: 140323 - protein, 121 aa, Glycine max
  Coding DNA Sequence Number=SeqID_23545
MHSIGVRGPLEQPPSAYLLKKRSGACRRARPGLQEFNGSITEALEAIFQQNQGGGCHPARQGELGCFLLKQPSFQNVLEVHRFENCYLHPYLDKFSPCFCVFWMFSFRNLMELYGFHDDGC

SEQ ID NO: 140324 - protein, 462 aa, Glycine max
  Coding DNA Sequence Number=SeqID_23546
  Gene Ontology: Mol. function=3-dehydroquinate dehydratase activity; Cellular component=cytoplasm; Biological process=aromatic amino acid family biosynthetic process, shikimate pathway
  Homolog annotation: Hit_ID=Q30D00; Match level="QueryCoverage=93%, HitCoverage=74%, E-value=1e-149, Identity=64%"; Hit description =Putative 3-dehydroquinate dehydratase/shikimate dehydrogenase
  Pfam annotation: Domain name=DHquinase_I; Domain location=1-170; Score=-11.7; E_value=1.3e-06; Accession=PF01487.6; Description=Type I 3-dehydroquinase
  Pfam annotation: Domain name=Shikimate_DH; Domain location=284-413; Score=89.4; E_value=1.1e-23; Accession=PF01488.10; Description =Shikimate  quinate 5-dehydrogenase
  Pfam annotation: Domain name=Shikimate_dh_N; Domain location=185-265; Score=132.7; E_value=9.9e-37; Accession=PF08501.1; Description =Shikimate dehydrogenase substrate bin
  Pfam module annotation: Pfam domain module=DHquinase_I::Shikimate _DH::Shikimate_dh_N; Domain location=1-170::284-413::185-265
MKPNETFPISAISPKVAHEFYDSIRGKTFNKTKVIVSSHNYQLTPSIEDLGNLVARIQATGADIVKIATTALDITDVARMFQIMVHSQMKLLGSSIEEERPNMLSRWISSEIRTNAIATNVPFIGLVMGDRGLISRILSAKFGGYLTFGTLESGVVSAPGQPTLKDLLYLYNLRQLAPDTKVFGIIGKPVGHSKSPILFNEVFKSIGLNGVYLFLLVDDLANFLRTYSSTDFVGFSVTIPHKETALKCCDEVDPVAKSIGAVNCIVRRPTDGKLIGYNTDYVGAITAIENGLRGKHNGSSTTISPLAGKLFVVIGAGGAGKALAYGAKAKGARVVIANRTYDHARKLAYAIGGDALALADLDNYHPEDGMILANTTSIGMQPKVDETPVSKHALKYYSLVFDAVYTPKITRLLKEAEESGATIVTGLEMFMGQAYGQYENFTGLPVIGYLCNTIKESNGEVL

SEQ ID NO: 140325 - protein, 59 aa, Glycine max
  Coding DNA Sequence Number=SeqID_23547
MSPQYTLIIFLISKNSRRDVEFANCKVIEFKVQGTTVVLSSELIAKATGCLREGSTYQE

SEQ ID NO: 140326 - protein, 212 aa, Glycine max
  Coding DNA Sequence Number=SeqID_23548
MLKWIQTTVKLAEWDIIGAENAGDLKIGCHFVLAILVNCLVQMGALLHRLQPVPGELLEGMRGRELRSDKELGRVNMECLLSSSQSFLMTLGRKNVENFLEIGEELEKHLDNIRIDSIKMHVKIPFFRKDRDPNMDMKFDDKGKDVMKVGKFEGSTGSDRYNNTTHKGGQVSFAQVVHNGPSRNNLDNKFEDKGKGTMKVGEVEGTRGGRKI

SEQ ID NO: 140327 - protein, 128 aa, Glycine max
  Coding DNA Sequence Number=SeqID_23549
  Gene Ontology: Mol. function=DNA binding; Biological process=DNA integration
  Homolog annotation: Hit_ID=Q1SKC8; Match level="QueryCoverage=75%, HitCoverage=29%, E-value=1e-14, Identity=38%"; Hit description =Integrase, catalytic region
MGGSNTCSTCKCKDRYSLPKEKHLFKVWHTKAGEHRKLQLPKLEELRFQAYKNFKLYNKKLLKMEFQPGKLKSKWSGPFIITKVMPHRVVILEDPATKRTWTMNGSKIKHYLGGDVERLTTVIQLQEA

SEQ ID NO: 140328 - protein, 151 aa, Glycine max
  Coding DNA Sequence Number=SeqID_23550
MRGTPSEETIMPFIAQGFNEANTKILQKIRKAWNKVGKKDKELKGRRNGVIGSYHKWLKSRVQGIAWLKKLKGLNGEETEVLKESEEVQVLKAELEKTKVAKEKLKVVVTRVRKECDRLEDINMFAAEALEQETKKAIKEKWSRNKFWGLC

SEQ ID NO: 140329 - protein, 119 aa, Glycine max
  Coding DNA Sequence Number=SeqID_23551
MGDIEEVQEQMKADMEALKDQMTSMMEAMLSMKRKIESNVAAAAATSATAEADPTHPSTIIQANQPIPDVLGQGGERASAKRNTQWLSTRKNPEEDELYRFAERITPGHQAHRFCSSAK

SEQ ID NO: 140330 - protein, 153 aa, Glycine max
  Coding DNA Sequence Number=SeqID_23552
MALVTGPFLGRIASRSQASGFDHEAISQLLCISGQDFAQSVAGRRVRIMRTSFTTITQIWMTLLLSNILPNDHNSDLPLQKCQLVYAILTQVSVHVAQLISDPIYQFAGITPLRHPMDLEKSNRALGFPALITGLCQFYGVVVTPIQLIRAPI

SEQ ID NO: 140331 - protein, 128 aa, Glycine max
  Coding DNA Sequence Number=SeqID_23553
MGVIIKKWENVNHACFDDFEKKSLDNECHHQKGGGCEYCFNKQRLASRLTKDQALPQNKVFPRHPRLCKREIFQENFIVKFSLNNSWETLVSQRAIHGRARARLTGALSKGGKMRGVATNVYLWKGIL

SEQ ID NO: 140332 - protein, 133 aa, Glycine max
  Coding DNA Sequence Number=SeqID_23554
MGGVYKFEETTDGYSKMQTYKGMLLDPAKNLKNLLRVGGLTTEDKMLVYLITYILTPRSNCIRSKIRYQDELGIVDRRHHINELSMDEDAKAKAPQEPAHQWSPFELIMIHKMDAMLHSIKRTQLKFTVRWRT

SEQ ID NO: 140333 - protein, 142 aa, Glycine max
  Coding DNA Sequence Number=SeqID_23555
  Gene Ontology: Mol. function=nucleic acid binding; Cellular component= oxygen evolving complex; Biological process=DNA integration
MSMMGELNFFLGLQVKQIKHGTFLCQTRYCTKLIKKFDMEKCKETSTPMASSTYFDLDEKCKSVDESRYRAVKRIIKFLKGPTNVGLWYPKGCKLDRKSRSGTCHLLGRSLVSWNCKKQACVALSTIEAKYIVAESCYAQSL

SEQ ID NO: 140334 - protein, 121 aa, Glycine max
  Coding DNA Sequence Number=SeqID_23556
  Subcellular localization annotation: CTP_CleavageSite=41; ConfidenceScore=5.12e-01
MPFKICMFVGRGCAHKTPSGPGEVQQGPAVSSSSYGPLSVLQGARTPRQGIAPTRHPVDPKKANRVLGFPALITGLCQFYGVPVTPNKVIRPPTNRDFIKRYYAPRQAQGETPQQPGDGQQ

SEQ ID NO: 140335 - protein, 180 aa, Glycine max
  Coding DNA Sequence Number=SeqID_23557
  Gene Ontology: Mol. function=oxidoreductase activity, acting on NADH or NADPH, quinone or similar compound as acceptor; Cellular component=photosystem II; Biological process=mitochondrial electron transport, NADH to ubiquinone
  Homolog annotation: Hit_ID=P56754; Match level="QueryCoverage=63%, HitCoverage=72%, E-value=2e-51, Identity=82%"; Hit description =NAD(P)H-quinone oxidoreductase chain J, chloroplast (EC 1.6.5.-) (NAD(P)H dehydrogenase, chain J)
  Pfam annotation: Domain name=Oxidored_q6; Domain location=1-50; Score= 3.6; E_value=2.7e-05; Accession=PF01058.12; Description=NADH ubiquinone oxidoreductase, 20 Kd
MGACTITGGMFSTDSYSTVRGVDKLIPVDVYLPGCPPKPEAIIDAITKLRKTNTKFIKKFRRSKKMQGRLSSWLVKHGLIHRSLGFDYQGIETLQIKPEDWHSIAVILYVYGYNYLRSQCAYDVAPGGLLASVYHLTRLEYGIDQPEEVCIKIFVARKKSQNSFHFLGLEKCGFSRKGIL

SEQ ID NO: 140336 - protein, 79 aa, Glycine max
  Coding DNA Sequence Number=SeqID_23558
  Gene Ontology: Mol. function=structural constituent of ribosome; Cellular component=ribonucleoprotein complex; Biological process =translation
  Homolog annotation: Hit_ID=P49200; Match level="QueryCoverage=62%, HitCoverage=60%, E-value=1e-08, Identity=72%"; Hit description=40S ribosomal protein S20-1
MAIYVAMKPTKFDLEEPREQIHKTSGSGLRDLLGCPLRLFTSLPGSPFVVKAVASLRETTGAVVKVSPHRAIVYGPEPG

SEQ ID NO: 140337 - protein, 151 aa, Glycine max
  Coding DNA Sequence Number=SeqID_23559
  Gene Ontology: Cellular component=integral to membrane; Biological process=protein transport
  Homolog annotation: Hit_ID=P59277; Match level="QueryCoverage=56%, HitCoverage=28%, E-value=1e-26, Identity=72%"; Hit description =Syntaxin-81
RKHSAETSKSGDMEFREPEELCSEPLRVQQQLLDDETRALQVELTSLLNTGQETETNMVEMSALNHLMSTHVLHQAQQIEHLYDQAVEATKNVELGVCPYIEPCDSKTQKSNLGIALVGVGCEQNKVDVRVDNKLRKTSEIVLGLSGAYID

SEQ ID NO: 140338 - protein, 107 aa, Glycine max
  Coding DNA Sequence Number=SeqID_23560
MALRKRHASTSKPQEPYDSSRFVSEVAWERYEQNVHARNILPEKNVELAFSQYDEFLWELERQCKVWGKLIKFNAATLNKFLETLVVLDLGERYSAYSRFCSTYLDP

SEQ ID NO: 140339 - protein, 46 aa, Glycine max
  Coding DNA Sequence Number=SeqID_23561
MPADTPMEEHEEGGIAKTGIDEDYVAYVTMDTSIPPQDDPTPAQED

SEQ ID NO: 140340 - protein, 194 aa, Glycine max
  Coding DNA Sequence Number=SeqID_23562
MDGSAGAEGAGGVGAGAGAGVGVGVGAEAEVEASERALALALRDPGNVIVGSSGFQDSKVSESGTTPLAMHNVVINARKPSLEELDWAIWEIWPEMIEPTKGHSMSNPIWPVRQIRSASGIRLARDTTHLAGWETLQEDKSEMCSPSMQPAHLVRTLSLLELNALSLAKPKFTYSAQEEEQQIELRLEVVKFRV

SEQ ID NO: 140341 - protein, 114 aa, Glycine max
  Coding DNA Sequence Number=SeqID_23563
  Gene Ontology: Mol. function=glutathione transferase activity; Cellular component=nucleus; Biological process=glutathione metabolic process
  Homolog annotation: Hit_ID=Q9FQD5; Match level="QueryCoverage=59%, HitCoverage=27%, E-value=8e-26, Identity=80%"; Hit description =Glutathione S-transferase GST 23
  Pfam annotation: Domain name=GST_N; Domain location=1-76; Score=40.1; E_value=7.7e-09; Accession=PF02798.10; Description=Glutathione S -transferase, N-terminal domain
MKLKVYADRMSQPSRAILIFYKVNGIDFEDVKVDLSQHHQLSPQFRVINPLMKVPAVVDGRFKLFERHRFCAMAEERQVIGFHTGDAWKGNSRMQKTPKNWSVPKLLHLLFAPS

SEQ ID NO: 140342 - protein, 170 aa, Glycine max
  Coding DNA Sequence Number=SeqID_23564
  Gene Ontology: Mol. function=transferase activity, transferring phosphorus-containing groups; Cellular component=intracellular; Biological process=tRNA splicing
  Homolog annotation: Hit_ID=Q1RSQ9; Match level="QueryCoverage=79%, HitCoverage=47%, E-value=1e-54, Identity=79%"; Hit description =Phosphotransferase KptA/Tpt1
  Pfam annotation: Domain name=PTS_2-RNA; Domain location=1-164; Score =172.4; E_value=1.1e-48; Accession=PF01885.7; Description=RNA 2' -phosphotransferase, Tpt1  KptA family
MASELNLNMRSDGYVKVNDLLKLNLKTFANIPLRSHTIDHIREAVRKDNKQRFSLLEENGELLIRANQGHTVKVVETESLLKPILSAKEFPVCLHGTYRKNLESILGSGLKRMKRLHVHFSCGLPTDGEVISGILRILRRASPGAAVKLCLGDLLVMGSNPETASLHMQG

SEQ ID NO: 140343 - protein, 66 aa, Glycine max
  Coding DNA Sequence Number=SeqID_23565
MTKHEAEPNEEEAKRPKMEISRPRYLEDYVVPPGSAFEFLQGIHYQNLLDFSSRICSRTSIYMRKM

SEQ ID NO: 140344 - protein, 366 aa, Glycine max
  Coding DNA Sequence Number=SeqID_23566
  Gene Ontology: Mol. function=RNA-directed DNA polymerase activity; Cellular component=chromatin; Biological process=chromatin assembly or disassembly
MAAADVCKTTFRTHHGHYEFLVMPFSLYNTPSSFQATMNMTFGPYLRKFIIVFFDDILIYTKSFSKHLDHLKIALQTLRDHNFFLKLSKCSLATQQVEYLGHIVSKRGVEPVPAKVEVVHQWPTPRFVRALRGFLGLFDFYPFVRNCFVSPHLWNLKELMAQAIQTPKQHTYLARLLGYDDTIQYRVGKSNLAADALDASGYHRELSQYQPSSSNFIPHPPKDAWGMPVNMLPIASHANKQNMIIGANQDYFVPYPFRHDHGKKLTKAQQRMKQFTDQRRRDDRGNCISVGLVGNLKDPSSVRLLLIKVVSVSHNRHPLELSALSEDNQPFITPLTILDTKWERKASGKQLLVLVQWSGLFPKDTS

SEQ ID NO: 140345 - protein, 128 aa, Glycine max
  Coding DNA Sequence Number=SeqID_23567
MGSNHPHLTKEDLFLIYLMIIEYFIVDTQEVFRFVEVEFEVKTKVLKQMAYIKSEEIGVGWIEKSKEDQTKQQDAEENPMSPFEQMMLAKMDKLMRVHKEDYTKLKEYFETIFERINAMRAPHHMDDI

SEQ ID NO: 140346 - protein, 54 aa, Glycine max
  Coding DNA Sequence Number=SeqID_23568
MDTWRRRLYIEEALKKQYTNSSQEKIQMADNQRQFITKGASLTRPLGFTGEYCP

SEQ ID NO: 140347 - protein, 165 aa, Glycine max
  Coding DNA Sequence Number=SeqID_23569
MQESDGLDDSGGSTNGEVVLMSRKFKKMMKKEGNFQHSSRRKDSKFKKTNKEENNEIICFECRKPRHMKADMSPTKEEKILAGQEEEKSDDILGRKRQRFKLILRYWMVTIHDEGKVYVPRAKPHEEGAIAFKGIGKGKIFGIGKVGIPNSSIESKLRSYPNRIV

SEQ ID NO: 140348 - protein, 69 aa, Glycine max
  Coding DNA Sequence Number=SeqID_23570
MDGPLDKDIMLQKILKPERRSLKEENAGGLSTICLKERMNNEKKGDERRDDGSDPSHDEQWLHLLLSSK

SEQ ID NO: 140349 - protein, 156 aa, Glycine max
  Coding DNA Sequence Number=SeqID_23571
  Gene Ontology: Mol. function=nucleic acid binding; Cellular component= mitochondrion; Biological process=DNA integration
MASPLYIHWITVKRILRYLKGTVLHGLHLRPAVSGQPYTLRALCDADWASDVDDRRSISGAAIYFGPNLTSWWSRKQQVVARSRTKVEYHNLAQTTAETSCQVPFCTPIIFCDNQSAVTIAHNPILYGRKKHMEIDVFFVPDKVLTEQLIVHHPCS

SEQ ID NO: 140350 - protein, 120 aa, Glycine max
  Coding DNA Sequence Number=SeqID_23572
MAYSELWPSLLENHLVVAIPGKVFQPPYPKWYNLVAKCPYHSGAPRNAIEEQGTSGAKRLEDVATSRRFIYQSLQAACMVSRGGDERDECLFYLKESHDMETCPAVEELLQWLMDWGQLE

SEQ ID NO: 140351 - protein, 99 aa, Glycine max
  Coding DNA Sequence Number=SeqID_23573
MLQQEEEGSSLKKEETSSAEVEEEEDPLYQNEDDCFAIKVPVKTTCLVTKSQIVPIKTTGNYRSQIFGYIRSPQPCCEVPFHLAIFLVSEERCSERKLL

SEQ ID NO: 140352 - protein, 66 aa, Glycine max
  Coding DNA Sequence Number=SeqID_23574
  Subcellular localization annotation: CTP_CleavageSite=35; ConfidenceScore=5.05e-01
MWGGTSPVGSDLEWQSQRKNHFKMGFPFVGGIRVLAFVIRSPFEEILLSSSSRERMRILFMGQGSK

SEQ ID NO: 140353 - protein, 86 aa, Glycine max
  Coding DNA Sequence Number=SeqID_23575
MAELLRCPLPPHKLKPGRYCLDASNGNTEVYMNGREIIELELRVLKTRVCHQMVQDINNTGCSYFPKLGGFWKMIKYSYMITQKVM

SEQ ID NO: 140354 - protein, 170 aa, Glycine max
  Coding DNA Sequence Number=SeqID_23576
  Homolog annotation: Hit_ID=Q9C516; Match level="QueryCoverage=21%, HitCoverage=4%, E-value=7e-09, Identity=80%"; Hit description=G -protein alpha subunit, putative
NPQETQRKDAHAKVEYVKRLYDQVKVQIAKKNESYVKQAHKKRKEVVLEHGDDPEHLRTNVFQEGGNDENHETGQIQAKGPSGEGRRPKWRRTKPPNLSSFIGSGVYPDLSSFTGSGVNQKLYSLYQAIRAPIKAYLEYPQFKFYDLSTIHVNLGVSITSIKAKFPSEIQ

SEQ ID NO: 140355 - protein, 111 aa, Glycine max
  Coding DNA Sequence Number=SeqID_23577
MFRDVSKGNEPKTQNGGGELINLGGVLFSLGPIRNLLEEATARLGEHVASSLSHQLIWAQASWAASSSSIFPIKWHLEVEGKGFSTFGNQISLKLVRRRRKKEKIKVEVLL

SEQ ID NO: 140356 - protein, 49 aa, Glycine max
  Coding DNA Sequence Number=SeqID_23578
QLHVDDAVDMLVELLEVSVAEARAETIQCHGSYVRLLWLRDVYQTKIEA

SEQ ID NO: 140357 - protein, 45 aa, Glycine max
  Coding DNA Sequence Number=SeqID_23579
MERCMMRSRNKPELIRQALKSAVFHLLAKPIRWLSEHLLSATLIG

SEQ ID NO: 140358 - protein, 112 aa, Glycine max
  Coding DNA Sequence Number=SeqID_23580
MAKRYEMTIICLRMSSGLPPLDDQKNDHSLSLRAIGHDHLQMEKRCGMTIICLHMSSGSPPLDGKKVCGMTIICLRMSSGSPTLDDKRRKMTIICLCVASETIVFGWRKGAE

SEQ ID NO: 140359 - protein, 99 aa, Glycine max
  Coding DNA Sequence Number=SeqID_23581
MEQHQIKELSPPSSANIDLDKRISENRKSLQDIMSMRWVSESDNVFTIHATINEINGSVGIMLHVRGAKRKLQKREINTFLENANNYPKAQQQGLMFCI

SEQ ID NO: 140360 - protein, 100 aa, Glycine max
  Coding DNA Sequence Number=SeqID_23582
  Subcellular localization annotation: CTP_CleavageSite=78; ConfidenceScore=5.33e-01
MSAHGGGGGGGVTVSGLRLRANRAQTMQFYVVGRIYNLQISRSKHVLLSRNPFSVLSVNFCAENNSSRVGIALSTTFRAEHNSSWVGIALSVIPLWQIPT

SEQ ID NO: 140361 - protein, 389 aa, Glycine max
  Coding DNA Sequence Number=SeqID_23583
  Gene Ontology: Mol. function=pyridoxal phosphate binding; Cellular component=nucleus; Biological process=amino acid metabolic process
  Homolog annotation: Hit_ID=UPI00005279F5; Match level="QueryCoverage =88%, HitCoverage=94%, E-value=1e-139, Identity=69%"; Hit description= Threonine aldolase
  Pfam annotation: Domain name=Aminotran_5; Domain location=56-379; Score=-188.5; E_value=0.0096; Accession=PF00266.9; Description =Aminotransferase class-V
  Pfam annotation: Domain name=Beta_elim_lyase; Domain location=45-340; Score=195.8; E_value=1.1e-55; Accession=PF01212.11; Description=Beta -eliminating lyase
  Pfam module annotation: Pfam domain module=Aminotran_5::Beta_elim _lyase; Domain location=56-379::45-340
TQNVRANHRKLVVTLAINVLTRTFAKARVAAVRCMASRHDPAIRGFASDNYSGIHPEVLAAIATANGGHQVAYGEDAYTMRLQEVFRDHFGDGVQAFPVFNGTGANVTGLQSMLPRWGAVIAASTAHINVDEGGAPEKIGGFKLLTVPTDDGKLTPELIDREAWGWGDEHRAQPLVVSITQSTELGTLYSAEEIRTIADHVHERGMKLHLDGARLSNAAAALDLPLRAFTRDVGVDVLTFGGTKNGAMLGEAIVVLNPDAAVGLPYARKFNMQLSSKMRFVSAQLIALLDGDLWLRNARHANAMAARLRSTIEAGIADGSISGVEFTQPTQANGVFATLPAGVADELRDVFRFYDWDASRREVRRMCGFDTEESDVDAFVAALSRLTTR

SEQ ID NO: 140362 - protein, 138 aa, Glycine max
  Coding DNA Sequence Number=SeqID_23584
MPPTRHPLDPDKSNRTLGFPALITGLCQSFGVPVTPSKVIRLPITRAFIEKYCMPRQAQGDAPQAADAPPPPHQADPVGSLGMERYLQHLVRQQAANHRGQSSLGLRSHGPEIGPRPRQGRSPQDPPVRQRRPVWMKK

SEQ ID NO: 140363 - protein, 78 aa, Glycine max
  Coding DNA Sequence Number=SeqID_23585
MCVYDLWVAGILQEMTSKKLSMKRSRRDAAAEGSSAAPKFDSHCFRSAEHQQRFEAIKGWSFHRERRVQLREDEYTDF

SEQ ID NO: 140364 - protein, 95 aa, Glycine max
  Coding DNA Sequence Number=SeqID_23586
MRKSLQKYVILLDIWWFHGGANNMELFQMFVRVFTCKAMKLWKQMDQSNFKNIWDILIRVLDAQAFIGSKGCKSDGLPLVIHYIQHAQLVAFLCK

SEQ ID NO: 140365 - protein, 63 aa, Glycine max
  Coding DNA Sequence Number=SeqID_23587
  Subcellular localization annotation: CTP_CleavageSite=41; ConfidenceScore=5.14e-01
MSVKNLVGRPGVHDKTNHTLASQVTLTRLKGAFKPGVFTPKAYTLKSSSGPLPHDSGSTQKTF

SEQ ID NO: 140366 - protein, 342 aa, Glycine max
  Coding DNA Sequence Number=SeqID_23588
  Pfam annotation: Domain name=Transposase_23; Domain location=177-247; Score=-7.9; E_value=0.0084; Accession=PF03017.5; Description =TNP1ENSPM transposase
MVWRTLSVRNTSSARKNWPSFARLTETLLGSNLKDYCFIFTGFVQKGTGHPEAEHCPHVLSHEGYDYLEQKLLAEKTKKKLEEVAQSGSVDGVIDPPSPVRRHVKWKMARTKKTGEMAIEAAKEIAEKILMASFSQMQSQMQSQGLALPPEPLVGPSDPRISTKGSCVDPSGNDPETGDSDRCGLYIEADPTRLVALGRVYEGSIVVYNTPLLLGQVKVGVEEVTNADAPVPVPTDEVSLVGQALHTFLAWPTHLVKSLSQQVAVSPAKPPPKPDPEVDDLLYLMTLTIPELFLRPYQVTWDAIVFRVFNLDFPLYIKHEDLSEIAHGGQCLSISVLQLWIL

SEQ ID NO: 140367 - protein, 87 aa, Glycine max
  Coding DNA Sequence Number=SeqID_23589
MAEPSWRKREQISAMEKGKHHHARFSCRERETSTEDSERELEGLLGIQKWSLRIEGLLGIQKGSLRVLERGFWVLLDGRVFRTVPQT

SEQ ID NO: 140368 - protein, 130 aa, Glycine max
  Coding DNA Sequence Number=SeqID_23590
MKQNLRNEVKCQIVNILEELSSSESPINSSAQFDPTSRGTKVDPKYDTVEIQMDKRYNLVDAFIIAHNVRQVHYVSYPVIRRDKHDLGGGVEEVNPANLLPNEGESNNFEEDNEGELEDDFEIYNSEEGD

SEQ ID NO: 140369 - protein, 275 aa, Glycine max
  Coding DNA Sequence Number=SeqID_23591
  Homolog annotation: Hit_ID=Q6CQF2; Match level="QueryCoverage=26%, HitCoverage=91%, E-value=1e-17, Identity=63%"; Hit description =Kluyveromyces lactis strain NRRL Y-1140 chromosome D of strain NRRL Y- 1140 of Kluyveromyces lactis
MARLNRAAAPSYLFKSFAPIPKSDERFARQYRCGPPPEFPLASPRSGIVHHLSGPDRYALTRTLHRRSGSVGGATHRGIPPISFLAPYGLLARDSHTCQTPCPCFKTGRMGSPQADARSAQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGIL

SEQ ID NO: 140370 - protein, 100 aa, Glycine max
  Coding DNA Sequence Number=SeqID_23592
MAHTKKTGQMTFEVAKEIADKIDPLVEQENPPRLVTLGRLYEGSTIVHSIPLRHDQVKVGVEEVRDADAPILVPTEEGAVGPAKPADRSVIKAVPESNKH

SEQ ID NO: 140371 - protein, 108 aa, Glycine max
  Coding DNA Sequence Number=SeqID_23593
  Subcellular localization annotation: CTP_CleavageSite=69; ConfidenceScore=5.40e-01
VQNCAKRTSMNKTTYLSLKSDFVKRVWAGIQSFACCRNVPFCGRARARLTGALSKGGKMRGVATNEGISTSHVDKSGAFAPTYPPLERKSDLRSSFLCVNQVIPFTLK

SEQ ID NO: 140372 - protein, 67 aa, Glycine max
  Coding DNA Sequence Number=SeqID_23594
MTSQVSQWGDQSGSLYLARMLQPCVMRILKLANYRLKAQVKYEGSSGKGQSPRVEKDDDVNLTGRNV

SEQ ID NO: 140373 - protein, 66 aa, Glycine max
  Coding DNA Sequence Number=SeqID_23595
MEIEYKCKVERVKLRDTRLDLNPGGETLTDSSDSRLWGVKTLNLSAPLTYVDHILLEHSHKQSDPD

SEQ ID NO: 140374 - protein, 148 aa, Glycine max
  Coding DNA Sequence Number=SeqID_23596
  Gene Ontology: Mol. function=transporter activity; Cellular component= integral to membrane; Biological process=transport
  Homolog annotation: Hit_ID=P0AFK4; Match level="QueryCoverage=63%, HitCoverage=44%, E-value=1e-30, Identity=75%"; Hit description =Spermidine/putrescine transport system permease protein potB
MTLESVVELENGKMVMVSEFFNEDDPDFDHSLDQKMAINWVESWEVVLADEEHHFLTRDDANFVKMVFTLDNYSRLLDPLYYDVLLHSLNMALLATLACLALGYPFAWFLARLPQKHQRLSERVPAVVGGHRYAGTHYVHAVSSDYRP

SEQ ID NO: 140375 - protein, 230 aa, Glycine max
  Coding DNA Sequence Number=SeqID_23597
MPCFDDNIEPIHDTNDEVGMNVDEELVQCIEPIFYTDDEVDTTVNEELVSDDLSTLSMPCRTILSPHSSKDYLHCTDSRMNLFNKGENDVEVWCNHGLKRDQRRKEDSLKDIAPISYVATNVNTLPKDRVQAIATQAMLKQWEETQELVNQAIMKQREETQIELRAYAEQQSPSLFLFDVRSIGACRPRIFFINGFLCFLEDEWKLNGEGREREEMPLQGEDESRRSSPP

SEQ ID NO: 140376 - protein, 165 aa, Glycine max
  Coding DNA Sequence Number=SeqID_23598
  Gene Ontology: Cellular component=mitochondrion
  Homolog annotation: Hit_ID=Q41658; Match level="QueryCoverage=56%, HitCoverage=62%, E-value=4e-29, Identity=70%"; Hit description=Vicia faba NADH ubiquinone oxidoreductase subunit 5
MLEDSASSGRSSSTSAVNQPLPGEQAMPPALPVMQEAANRALPYPYQNNEIIGGDSVESIQRRLLGRFPSPSAHEIQMARIEAEDLFEVNVDICQVMAGLHPSGDWMGRGARALDNLRTATGEESLSKLLRMREDLQTAGLQSATFRQLADRVAFRADGDQHSAT

SEQ ID NO: 140377 - protein, 84 aa, Glycine max
  Coding DNA Sequence Number=SeqID_23599
MSIIHPGGHSRTHAKSPTAFRAAIHRRQCLHHHHGVPESLSRIRLPCQCPPCHAAPRIDGSGRPDCITCLDHHAGSHSLAGSTS

SEQ ID NO: 140378 - protein, 104 aa, Glycine max
  Coding DNA Sequence Number=SeqID_23600
MTFDAHHKPPFLAVVPGHREERFNQSGILRIHLKDSVEKQALNPSFMLHVELVGLGSSSSMECFASSRSMVAKWRRRKGDWRCHFKDKMSQEQAHHHRKPWIRA

SEQ ID NO: 140379 - protein, 457 aa, Glycine max
  Coding DNA Sequence Number=SeqID_23601
MVLGVFFLLVLIGLHDGAKCVLVYCTRLLCLLFSSAMVLGVFLLCARGTRVAIACLTDPSSFEAFCGTIVVACEGIWEIMSDMEDYFPYLDSDKGNVDIFVHFMEKPSESCVVRNQDLEKFGIFYAHKDVYHFADQLKLPPCNLYTLWFKSSVGGKILPLKDDVGVLKMYSKNQNQRYIHLYACRNNDEFWRKPLAIGEKLIEPISVAVEPVNESVSVNETIGEVMNEVLNDVLNEGIHVSFNKDLSGKNNAENGREYANEQVHANAHEEVTHENVKGQDEVFVNDEDETFNGPRNVNGSSGNEYDHFNDEDCGSEIHDNDFLSDFEEIIHIVGNHHHSNDEIIEIYKENGIFGKSHEIPQNGRIHLEVGQLFMDLNHFRQVPKDFSIQEGFQLKRIKNVPSRGFVRGCKPWVGIDGCHLEGPFGGVLLSVAALDGIKGMFPVAIAMVEIENKDSWT

SEQ ID NO: 140380 - protein, 101 aa, Glycine max
  Coding DNA Sequence Number=SeqID_23602
  Subcellular localization annotation: CTP_CleavageSite=69; ConfidenceScore=5.05e-01
MTSSLIKIQGEQVLTNDFQDLSIKNGSLKGNPPSLNTLSTSSSRNSIIVNGIHRFMRHEPPQRNGLVVRSHHVHGHGHHGHVAKPHHSDKVASATVNIKVV

SEQ ID NO: 140381 - protein, 690 aa, Glycine max
  Coding DNA Sequence Number=SeqID_23603
  Gene Ontology: Mol. function=protein-tyrosine kinase activity; Cellular component=integral to membrane; Biological process=protein amino acid phosphorylation
  Homolog annotation: Hit_ID=Q2MHE4; Match level="QueryCoverage=40%, HitCoverage=75%, E-value=2e-90, Identity=57%"; Hit description =Serine/threonine-protein kinase HT1
  Pfam annotation: Domain name=Pkinase; Domain location=91-331; Score =190.5; E_value=4e-54; Accession=PF00069.15; Description=Protein kinase domain
  Pfam annotation: Domain name=Pkinase_Tyr; Domain location=91-331; Score=205.0; E_value=1.7e-58; Accession=PF07714.7; Description =Protein tyrosine kinase
  Pfam module annotation: Pfam domain module=Pkinase::Pkinase_Tyr::RVT _2; Domain location=91-331::91-331::418-590
MARVENVGKEKGKTGKVMGSGHCHADPASSVSHMKNLKWHKQISNSGNKLGRRLSLGEYNRAVSWSKYLVSPGAEIKGEGEEEWSADMSQLLIGSKFASGRHSRIYRGVYKQKDVAIKLISQPEEDEDLAAFLEKQFASEFIAACKKPPVFCIITEYLAGGSLGKFLHHQQPNILPLKLVLKLALDIARGMKYLHSQGILHRDLKSENLLLGEDMCVKVADFGISCLESQCGSAKGFTGTYRWMAPEMIKEKHHTKKVDVYSFGIVLWELLTGKTPFDNMTPEQAAYAVSHKNARPPLPSKCPWAFSDLINRCWSSNPDKRPHFDEIVSILEYYTESLQQDPEFFSTYKPSPTSSNTILGTKPCSSRSKATPTPELGYVSLGEPHQEYNLVKDKDRCTIKDNDMSLKNRLSWLFLHFSLVLEILVFFKRKPSVLEKEGEKIKAHLVSKGYAQQKGVDYHEIFSPVVRHTSVLALVASCDMNLEQMDVRTTFFHSDLEKQIYMEQPKGSLQGSGTSGLTLTCFGLATGDVSMIVVFTKNVDMKDLGPAKKILGMGIHRDRKSRQLWLSLQDYVEKTDAEVKYMSKVPYVNVVGYLMYVMVCIRPDLAHAVSQVYKFMSDLGKRHWERVKWIFSDPLVVGYVDSNYAGDLDDKRSTRYVFTFGGLVKELGIEQGGVQLHCDSQSAIDLTKNQ

SEQ ID NO: 140382 - protein, 38 aa, Glycine max
  Coding DNA Sequence Number=SeqID_23604
MTICCREEEHYIKHIVKEGALSGIPQFKEHFGPLNHLY

SEQ ID NO: 140383 - protein, 77 aa, Glycine max
  Coding DNA Sequence Number=SeqID_23605
MEYLLVGDEQKRKTESKNAKKDDPRAANSSIPWGNINHVPSFPKVGRDPIPTCIRPCVPASKKQPGVANLDHIAVLP

SEQ ID NO: 140384 - protein, 268 aa, Glycine max
  Coding DNA Sequence Number=SeqID_23606
  Homolog annotation: Hit_ID=Q9FM13; Match level="QueryCoverage=93%, HitCoverage=91%, E-value=1e-45, Identity=43%"; Hit description =Arabidopsis thaliana genomic DNA, chromosome 5, P1 clone:MQB2
  Pfam annotation: Domain name=DUF588; Domain location=114-250; Score =151.2; E_value=2.8e-42; Accession=PF04535.3; Description=Domain of unknown function (DUF588)
MNKSQSKNSKSSTQFDSPLSFYSPMHGDGTESPEYRSPENWPEKRDNSMAIVTAGKLKQFTPEKRAEHRKPPENPPSTAVMVFNASSAEEAQRPAAKAAPVIGGERRSRSAATEETVSKAALGFRLSEVVVCLISFSVMAADKTQGWSGDSFDRYKEYRYCLSVNVIGFAYSALQACDLTCQIATGKRLISHHLRNHFDFFMDQVLAYLLISASSSAATRVDDWISNWGKDEFTEMATASIGMAFLAFVAFAISSLISGYTLCNRSSM

SEQ ID NO: 140385 - protein, 73 aa, Glycine max
  Coding DNA Sequence Number=SeqID_23607
MTILRRFGPPLQWNVVVLDKGIGDKYVTLPWYKFLQEGDFSHGDELSFYYRRAEKIWEVVIRHAIDWDDSDID

SEQ ID NO: 140386 - protein, 638 aa, Glycine max
  Coding DNA Sequence Number=SeqID_23608
  Gene Ontology: Mol. function=transferase activity, transferring phosphorus-containing groups; Cellular component=chloroplast; Biological process=phosphorylation
  Homolog annotation: Hit_ID=Q93YW0; Match level="QueryCoverage=89%, HitCoverage=83%, E-value=1e-85, Identity=34%"; Hit description =EXECUTER1 protein, chloroplast precursor
  Subcellular localization annotation: CTP_CleavageSite=56; ConfidenceScore=5.54e-01
MAVAGVSQAISSTTATRTPSCIDFHSKKPFLLGLAHSPQPNLSISARRSRNTHCCRCTLNSDDTSLSWDWNRWCRHFSDIEQAENFASVLKFQLDDAIEKEDFEEAVKLNRALSEATSKDTVAEIMDQLKARAAQFSAIDDERYHDASRLCKCTGSGLVGWWVGYSKASDDPFGRIIHISPGMGRFIGKSYSPRQLMRASTGTPIFEIYVVKNADDTYHMQVVYLRQAKGKSRRNPQSIPAKGPSKPEVENASSVEVQEPEEKIERNDEKNSNIEGVTEEGIKSVINFLKEKIPGLKVKVMNVNVEEEAAENNDSIKQLMEEDSNESGSSENHEEEVNNLDEPDAVTLERDGDVTEEEKDFEMKLFIGGVVHNNEDTPVKDEFIRLPAEIKNIEKDSFVFHFASGNVDYGIKEDKIPNIKVAALAAQGISELMPPDVANAFWSSDKVSSKVSKSMRDIVRVAMSQAQKRTRLSGDTNFSRIICSRGDSDPFDGLYVGAFGPYGMEIVHLRRKFGHWNEVNNENNTSDVGFFEYVEAVKLTGDLNVPAGQVTFRAKIGRGNRNTNRGMYPDDLGVVASYKGQGRIADYGYRNPKWVEGELLQLNGKGMGPYMKGADLGFLYVVPEQSFLVLFHRLKLPE

SEQ ID NO: 140387 - protein, 66 aa, Glycine max
  Coding DNA Sequence Number=SeqID_23609
MVFPQTSRKNMVAAPYSLHSLKLLCLSNIECIITDLRTAKHKSDSERKQNSLGNRHLESINSNKFY

SEQ ID NO: 140388 - protein, 75 aa, Glycine max
  Coding DNA Sequence Number=SeqID_23610
  Gene Ontology: Mol. function=metal ion binding
  Homolog annotation: Hit_ID=Q6AUI1; Match level="QueryCoverage=71%, HitCoverage=13%, E-value=4e-16, Identity=70%"; Hit description =Unknow protein
MLPGGGQKWGFLIWLLFSYCGLLCIACLAMRKWLKRRQARMLGAQEGIPVSAFGLSSVIFVNVQNNWCYDESMML

SEQ ID NO: 140389 - protein, 88 aa, Glycine max
  Coding DNA Sequence Number=SeqID_23611
MKEERLGFDTNHLKLTPLMAIVGEIGVGCFMKRVGVIVIEHRRRSTEKVQSLLTRDGSQERLHHIAQRPEPGERLPLTNSSHENQKQV

SEQ ID NO: 140390 - protein, 129 aa, Glycine max
  Coding DNA Sequence Number=SeqID_23612
  Homolog annotation: Hit_ID=Q1T4S3; Match level="QueryCoverage=62%, HitCoverage=6%, E-value=7e-09, Identity=28%"; Hit description=Zinc finger, CCHC-type
MASLSLSQIASLINNDSNVDLHNSAIFTKVLKLSIKLDDKNSFCGIHRVLNCHHAHEIWDKIHTHYYATLKAKVRQLRSELKTTKKADSLIAIRETISDQELLDVVIDGLPEEYNTFVMMMHARPDKFL

SEQ ID NO: 140391 - protein, 587 aa, Glycine max
  Coding DNA Sequence Number=SeqID_23613
  Gene Ontology: Biological process=ripening
  Homolog annotation: Hit_ID=Q40161; Match level="QueryCoverage=99%, HitCoverage=93%, E-value=1e-178, Identity=53%"; Hit description =Polygalacturonase-1 non-catalytic subunit beta precursor
  Pfam annotation: Domain name=BURP; Domain location=370-586; Score =358.1; E_value=1.4e-104; Accession=PF03181.6; Description=BURP domain
PKASLIRYWNTRVSNNLPIPHLLLSKASTLTPHHYAILSKLLNQKPKPNENLHHSLCSSPNLLCSFDDTPFAQTHKNDDGNFAVYSNKRFANYGSSRVGGVDSFKNYSNGLNANNDAFRRYSAASTRRGEQFKNYADNGNVANTNFSSYGSTANQASAEFSNYDKTVNVPNLGFTTYDSGASNHKLSFSSYGNETNSGSQTFTSYGKRVRGGTSEFANYADDANILQSEFSSYGDLTTGASNDSFKFYSFNGNNPRHVFKSYGDGSAAGVDSFISYRNRANVGDDSFQSYAVRSKSGAATFANYGMSFNVGNDSFTEYGKGAMGKTSFGFKSYGLGRAFKVYNKDGASFSEYRNFSAARGKVVNKWVEPGKFFRESMVKEGNVIPMPDIKDKMPARSFLPLAIASKLPFSSSRINEMREVFHTREGSSTERVMVKALKECERAPSKGETKRCVSSAEEMIGFAVSVLGPNVAVRSTENLNGSGSSVMIGKVHSIDGGKVTKSVSCHQSLYPYLLYYCHSVPKVRVYEAEILDVDTLEKINHGVAICHLDTSAWGPQHGAFLALGFGPGKIEVCHWIFENDLTWTTAS

SEQ ID NO: 140392 - protein, 82 aa, Glycine max
  Coding DNA Sequence Number=SeqID_23614
MPPTLALCHSPLRPSCLRDCRATVAPLLSAHVVARSSIKLVKNLHFLGLTYTMKESGFKVLSFLQKYFLLYYRCIATRLSVG

SEQ ID NO: 140393 - protein, 234 aa, Glycine max
  Coding DNA Sequence Number=SeqID_23615
  Gene Ontology: Mol. function=transporter activity; Cellular component= outer membrane; Biological process=nutrient import
  Homolog annotation: Hit_ID=Q7WEI0; Match level="QueryCoverage=90%, HitCoverage=24%, E-value=1e-73, Identity=61%"; Hit description=Outer membrane heme receptor
VFGRRLAAARAVAADVATVVERVAVAHARLHQPEGVVMDLPGQRGVGAPTAVGGVVVGLGQRAEGLAVGQQVGRAERVQVGQSGNGPRTARAGVGATHDVQARQRIEVHRLQATLDAPGAVVEPRQPDAIDPRQHAVLVEPADVDAVVLAAEAHAGFGALAQVAPVLDLQIVHALAVGARFPCRRRHRAFALDRDRRELRDTRLRQGLQHEYAGAALARGQAAAGQQAGKAVSH

SEQ ID NO: 140394 - protein, 347 aa, Glycine max
  Coding DNA Sequence Number=SeqID_23616
  Gene Ontology: Mol. function=helicase activity; Cellular component =membrane; Biological process=viral genome replication
  Homolog annotation: Hit_ID=Q9LW42; Match level="QueryCoverage=98%, HitCoverage=23%, E-value=2e-93, Identity=47%"; Hit description =Helicase-like protein
  Pfam annotation: Domain name=DUF889; Domain location=63-263; Score =261.0; E_value=2.4e-75; Accession=PF05970.5; Description=Eukaryotic protein of unknown function (DUF889)
MSTTQNSTCNIHQGSDLAELLQRKKLIIWDEAPMCQKFSFEAVDKSLKDIMHNNRPFGGKVIVFGGDFRQILPVVPRDIGDGKLGQPNDGHCEITIPDEFLIMDFKDLIQAIVDATYPDLLQNYNNTDFLQKRVILASTKDVVDKINDYVLSLFPGDEKEYCSADSVDKSDELLNHTFGVLTPEFLKTLKTSGIPNHKLRIKIGTPIILLRNLDQEDGLCNGTRLIVTKLGTNVVEAEVITGPNVGHRTYIPRMNMCPSDSPWPFKLIRRQFPFIISFAMTINKSQGQSLAHVGLYLRNPIFCHGQLYVALSRVQSKKGLCILIHDKQGIAKNTTINVVYKEVFANL

SEQ ID NO: 140395 - protein, 87 aa, Glycine max
  Coding DNA Sequence Number=SeqID_23617
  Subcellular localization annotation: CTP_CleavageSite=41; ConfidenceScore=5.33e-01
YSARTHTVSRPTFAQEFGHSPFDLLSFLWVVSQRALRGRARARLTGALSKGRKMRGVATNVYLWKTSEKSKETGQNENSKFGSYIYA

SEQ ID NO: 140396 - protein, 132 aa, Glycine max
  Coding DNA Sequence Number=SeqID_23618
  Subcellular localization annotation: CTP_CleavageSite=35; ConfidenceScore=5.16e-01
MDMSIGGLIFGQMTMMAQSNSSRLGFPTLITTLCRLRGVGSDALTSYENLRPVIDLAYIIRNCWNANDQTVNFPEARKTKLRAADVPSSFAPIAGISTSSTSAPPPALADRCAIIFFYFLNPFCTILITDWS

SEQ ID NO: 140397 - protein, 104 aa, Glycine max
  Coding DNA Sequence Number=SeqID_23619
MGFHPTKLNFVPSDADEAPLDVSICLHAFGIVGCGSFSGVKSCEREDPFHPGLFVGDAGGFQSPTREPLNVGGLVPPHCSLKSVVSDDACPGACFVQRDATTLS

SEQ ID NO: 140398 - protein, 56 aa, Glycine max
  Coding DNA Sequence Number=SeqID_23620
MKKRVASTSTESSKLDRKTIEKNRRIHMKSLCHQLSSLIPPNLKPAKSKKFEGLQL

SEQ ID NO: 140399 - protein, 170 aa, Glycine max
  Coding DNA Sequence Number=SeqID_23621
MSVLELYIEKDVGGSSMFHSANSVTCGNNLSNELELPRNVSNLHYDDDDYYLVSNSYVKESLDEDDNVDDISDIDDEVIDMIQPITIVHPTEGVEEIQNPFWNDVLHYNNINWSHPDEEDICSLEMPSSFNVGQELYVGMDFDSKDVTVRLNVSCERHVTYEKFLELTAT

SEQ ID NO: 140400 - protein, 443 aa, Glycine max
  Coding DNA Sequence Number=SeqID_23622
  Gene Ontology: Mol. function=voltage-gated potassium channel activity; Cellular component=integral to membrane; Biological process=potassium ion transport
  Homolog annotation: Hit_ID=Q9SU64; Match level="QueryCoverage=98%, HitCoverage=63%, E-value=1e-175, Identity=69%"; Hit description =Putative cyclic nucleotide-gated ion channel 16
  Pfam annotation: Domain name=cNMP_binding; Domain location=217-318; Score=31.9; E_value=2.3e-06; Accession=PF00027.19; Description =Cyclic nucleotide-binding domain
MNRTHSPSCNPSFLDCGTITNYERQAWFKRTRVLSDCDALNDKNEFQFGMFADAFTDHVSSSRFFQKYFYCLWWGLKNLSSYGQNLQTSTYSGETLFSSFICIAGLILFAHLIGNMQNYLQSSTAKVEEWRLKQKDTEEWMNHRQLPPELQQRVRRFVQYKWLATRGVDEEAILRALPLDLRRQIQRHLCLDIVRRVPFFGQMDDQLLDAICERLVSSLNTKDTFIVREGDPVREMLFIIRGQVESSTTDGGRTGFFNSITLRPGDFCGEELLTWALMPSSSSLNLPSSTQTVKTLTEVEAFALRAEDLKFVASQFKRLHSKKLQHAFRYYSHQWRAWGAHFIQAAWRRHRKRKLAMELLEKENLYYTNVMEDDDEEEGSAGESSMAGHAQNFGATFLASKFAANTKKGAVKKVTINLPDAGSLKMPKMFKPTEPDFSIFHDD

SEQ ID NO: 140401 - protein, 363 aa, Glycine max
  Coding DNA Sequence Number=SeqID_23623
  Gene Ontology: Mol. function=aldehyde dehydrogenase (NAD) activity; Cellular component=mitochondrion; Biological process=metabolic process
  Homolog annotation: Hit_ID=Q84V96; Match level="QueryCoverage=94%, HitCoverage=76%, E-value=1e-129, Identity=61%"; Hit description =Aldehyde dehydrogenase 1 precursor
  Pfam annotation: Domain name=Aldedh; Domain location=58-363; Score =138.2; E_value=2.3e-38; Accession=PF00171.12; Description=Aldehyde dehydrogenase family
  Subcellular localization annotation: CTP_CleavageSite=33; ConfidenceScore=5.02e-01
MAVFNSLHKTSTRFFVPTGRNSGKWGNVNRFSTAAAVEELIIPQVPITYTKHLINGQFVDADAASGKTFPTYDPRTGEVIARVAEGDAEDINRAVSAARKAFDEGPWPKMTAYKHSDELAALKTWNNGKPYEQWATSELPTFVRLFRYYAGQIIPWNFPLLMFAWKVGPALACGNTVILKTAEQTPLTALYVAKAGLPPGVLNVVSGYGPTAGAALASHMDVDKLAFTGSTETGKVVLELAARSNLKPVILNLEGNLLSLGQCCCAGSRTFVHERIYDEFLEKAKARALKRVVGDPFIKGVEQGPQNWLKGLLCPAYCLLKCSGINKLAQVIHKIYNTLKHFLTRANNQDDMLIAKDEIFGPL

SEQ ID NO: 140402 - protein, 50 aa, Glycine max
  Coding DNA Sequence Number=SeqID_23624
  Homolog annotation: Hit_ID=Q70ET7; Match level="QueryCoverage=82%, HitCoverage=82%, E-value=3e-07, Identity=61%"; Hit description =Deleted in split hand/splt foot protein 1
  Pfam annotation: Domain name=DSS1_SEM1; Domain location=3-46; Score =38.9; E_value=1.7e-08; Accession=PF05160.4; Description=DSS1SEM1 family
MVFESSSEWDDKEEGKEVTQQWEDDWDDDDVSDDFSLQLRRELESNTEKN

SEQ ID NO: 140403 - protein, 104 aa, Glycine max
  Coding DNA Sequence Number=SeqID_23625
MEEFCTLTLAGPSLGMTRFVKVYNSSCPIVPCSSTFQESYDMMDGAKVKNPDTKYQSQIVRPVMIVDMQQLIACDFGQHFYNTGVKEQLQNMERGIGHGMEALR

SEQ ID NO: 140404 - protein, 240 aa, Glycine max
  Coding DNA Sequence Number=SeqID_23626
MATMIEVVMSMKKIVEVNAAAVVATSVVAEVDPTPPSGLNQINHPISDMVGQGGKELGSKGGPHFVQVQNKHAFPPYSLPPNYTPPNVAHTLNENVNNSTPILIKSQQPQFDHARVSQPMEETHEAPRDHNLADLEPYLGYATEGQAVGGIPLPNILEGAQFLPQPQTFHFHGGESPSCYGGKGEIFFHIKERLRTIEGGGDYAFADMAGLCLIPDIVIPPKFLVYDIDKHKGITCPRIT

SEQ ID NO: 140405 - protein, 33 aa, Glycine max
  Coding DNA Sequence Number=SeqID_23627
MDAEKEEDLNQSMYLLKDRRPRVRETLLHFLGL

SEQ ID NO: 140406 - protein, 100 aa, Glycine max
  Coding DNA Sequence Number=SeqID_23628
MRIQGTNRLRILCPNTLKGTSFVGQVEGTSTWVVILRTREDTSLVDQFKWRVHSLGCSKKTREGTSLVDLWLVKDFTRLKEISRTVGCLGTGCRHGLWPN

SEQ ID NO: 140407 - protein, 383 aa, Glycine max
  Coding DNA Sequence Number=SeqID_23629
  Gene Ontology: Mol. function=transferase activity; Biological process= RNA-dependent DNA replication
  Homolog annotation: Hit_ID=Q1SWC8; Match level="QueryCoverage=38%, HitCoverage=20%, E-value=4e-19, Identity=46%"; Hit description=RNA -directed DNA polymerase
MGFDPKWVTWMRMCVESVNFNVLVNGEAVGPISPGRGQGNPPQVFPSSSRNLNFFSRNTPPSIKQQISGQLQVTDCLGTGKYLGMPSMNVLIKSVSQAILAYCMSVFLLPSTLQDEIQKMMNSFWWGSNRNYGKGINWLSWERLTIRKKDEYGKTAKVWKDPSPRSTDGSFVTNPIIDAEDVTRILSMPTYFRDELDKLTWMFSRDGFYTVKSAYFHATQSMVDNSSLREEGRLLTKGVDCPPTCSLCSHYIENDWHIFVGCEHAKKAWEEVSLWNKIQEVAVTGDDMKSLIFTSLKAFTTVQTDTFGFFGSDGLLPPMEAEDRALSQVITWLLNNNFTKVILEIDCQQLVDTINTSYFQKNEVGDILKLCVSKCSSFENCSI

SEQ ID NO: 140408 - protein, 1228 aa, Glycine max
  Coding DNA Sequence Number=SeqID_23630
  Homolog annotation: Hit_ID=Q9XIA4; Match level="QueryCoverage=42%, HitCoverage=95%, E-value=0.0, Identity=69%"; Hit description=Similar to CCS1
  Pfam annotation: Domain name=PFU; Domain location=329-442; Score =224.7; E_value=2e-64; Accession=PF09070.1; Description=PFU (PLAA family ubiquitin binding)
  Pfam annotation: Domain name=PUL; Domain location=475-689; Score =99.8; E_value=7.9e-27; Accession=PF08324.1; Description=PUL domain
  Pfam annotation: Domain name=ResB; Domain location=784-1206; Score =597.9; E_value=9.3e-177; Accession=PF05140.4; Description=ResB-like family
  Pfam annotation: Domain name=WD40; Domain location=170-207; Score =34.5; E_value=3.7e-07; Accession=PF00400.22; Description=WD domain, G-beta repeat
  Pfam annotation: Domain name=WD40; Domain location=210-247; Score =32.6; E_value=1.4e-06; Accession=PF00400.22; Description=WD domain, G-beta repeat
  Pfam annotation: Domain name=WD40; Domain location=249-285; Score =17.7; E_value=0.041; Accession=PF00400.22; Description=WD domain, G -beta repeat
  Pfam annotation: Domain name=WD40; Domain location=52-95; Score=26.0; E_value=0.00013; Accession=PF00400.22; Description=WD domain, G-beta repeat
  Pfam annotation: Domain name=WD40; Domain location=8-45; Score=35.4; E_value=1.9e-07; Accession=PF00400.22; Description=WD domain, G-beta repeat
  Pfam annotation: Domain name=WD40; Domain location=99-168; Score =30.1; E_value=7.9e-06; Accession=PF00400.22; Description=WD domain, G-beta repeat
  Pfam module annotation: Pfam domain module=PFU::PUL::ResB::WD40::WD40: :WD40::WD40::WD40::WD40; Domain location=329-442::475-689::784 -1206::170-207::210-247::249-285::52-95::8-45::99-168
MDIDFKEYQLRCELRGHEDDVRGICVCGSEGIATSSRDRTVRLWSLDDSRKFVSSKILLGHTSFVGPLAWIPPNSEFPHGGVVSGGMDTLVCVWDLKTGEKVHTLKGHQLQVTGIAFDDGDVVSSSVDWNGQSVEWWEAHKAPVQAVIKLPSGELVTGSSDSTLKLWRGKTCLHTFQGHSDTVRCLSVMSGLGILSASHDGSLRLWAVSGEVLMEMVGHTAIVYSVDSHASGLIVSGSEDHFAKVWKDGVCVQSIEHPGCVWDAKFMENGDIVTACSDGVVRIWTVDQDNVADQLELDLYTSQLSQYKASRKRVGGLKLEELPDLEALKIPGTTDGQTKVVREGDNGVAYGWNMKEQKWDKIGEVVDGPEESNRQFFDGIQYDYVFDVDIGDGMPTRKLPYNRSDNPYDVADKWLLKENLPLSFREQIVQFILQNTGQNNTTFDASFRDPFTGSHAYVPGQPSRMSDISAKPTFKHIPKKGMLVFDAAQFDGILKKISEFNCALQSDQEKQNLSLTELNVSRLGAIVKILKDTSHYHSSKFADSDIALLLNLLRSWPMAMIFPVIDIVRMLVLHPDGAILLQKHFEAENVEEGWAVLRASGFFFRACYAVLLIETKDQEGQSQVLSAALEIGEDENVEVDPKFRALVAVGSLMLEGLVRKTALDFDVVNIAKAAKGSKEGKIAEIGSDIELFKPFSNSSHGAKRAHTLPLTISCKLKNSQEMKNKGKSVSQKIVLSEASPPPLTEDDKNNGDSKDVPESSKKKGGLSGVANMLRRKTLQILSNLPLAIGEMFAVASLMALGTFIDQGEAPDFYFQKYPEDHPVFGFFTWRWVLTLGFDHMFTSPIFLGVLALLGASLMACTYTTQLPLIKVSRRPKLFHRWSFLHSAEAIRKQEFSESLPRASIQDVGTILMGAGYEVFLKGPSLYAFQGLAGRLAPVGVHIALLLIMAGGTLSATGSFRGSVTVPQGLNFVVGDVLAPFGFLSSPTDAFNTEIHVNKFSMDYYESGEVSQFHTDLSLRNMDGKEVMRKTISVNDPLRYGGITIYQTDWSISALQILKDNEGPYNLAMAPLQINGDKKLFGTFLPVGDINSPDVKGISMLARDLQSIVLYDKEGKFAGVRRPNSKLPINIDGSEIVIVDAIGSSGLELKTDPGVPVVYAGFGALMITTCISYLSHSQIWALQDGTTVFVGGKTNRAKMEFPEEMSRLLDKVPEIVESNLPKHADSISG

SEQ ID NO: 140409 - protein, 183 aa, Glycine max
  Coding DNA Sequence Number=SeqID_23631
  Gene Ontology: Mol. function=RNA-directed DNA polymerase activity; Biological process=RNA-dependent DNA replication
  Homolog annotation: Hit_ID=Q1RVP6; Match level="QueryCoverage=60%, HitCoverage=76%, E-value=5e-21, Identity=44%"; Hit description=80C09_ 29, related
MARQSWLDTFPDCKLMNTIAGVSDHSPIIMALFRQETLKKMTLTQLEGMGGFKSASFLRRIILETETQSSLIRDGDANTKKIHAIANARKKKSFISKLSNDGEDIISNHSDLCNLARNYFESLYSYNDVDVAVTVDHVEPKLTMFDNVSLVTPFEKWEFKEAAFQMHSNKSPGPDGFNPTFYK

SEQ ID NO: 140410 - protein, 266 aa, Glycine max
  Coding DNA Sequence Number=SeqID_23632
  Gene Ontology: Mol. function=catalytic activity; Cellular component =chloroplast; Biological process=cellular metabolic process
  Homolog annotation: Hit_ID=Q8SKU2; Match level="QueryCoverage=82%, HitCoverage=53%, E-value=1e-42, Identity=42%"; Hit description=Tic62 protein precursor
MRNICSLYLAATVAKIWKRKEEATLLASGLPYTVSDRPGNMHEAQHGRPQRKVIAETNAPPTPMEKLLAKIPSQRPYISSPKEPDIAAVSVPDPSANVVAVYDDLKPPSSPSPSQPGDGKQTKISETVPKPSALDSPSSVLGVHGISQTTSLSEMEKPLFPYVAYPDLKPPTSSPNASTIPFSTSAGDGVPEIATVSSNGPAQLSIADEPKEEHLPEPKSRSLSPYTTTSEKSMPQFISRMASWSLKYEEKHFCELKISAMAFIFL

SEQ ID NO: 140411 - protein, 142 aa, Glycine max
  Coding DNA Sequence Number=SeqID_23633
  Gene Ontology: Mol. function=catalytic activity; Cellular component =chloroplast; Biological process=cellular metabolic process
  Homolog annotation: Hit_ID=Q8SKU2; Match level="QueryCoverage=51%, HitCoverage=19%, E-value=3e-12, Identity=48%"; Hit description=Tic62 protein precursor
MYLTVREPTLPVAPATNTKLSSLESVFSEIPSAVQGYLVKWERLTWEAKGFSVASLHDKEEGMVTVISDCTEKASIAKGRRMSLRLRMRWGIVNFVNSFDRVCYPLAPMSFSTVRECEMMIDAHTHMCDSQVLRSYIDSPQS

SEQ ID NO: 140412 - protein, 109 aa, Glycine max
  Coding DNA Sequence Number=SeqID_23634
  Gene Ontology: Mol. function=catalytic activity; Cellular component =chloroplast; Biological process=cellular metabolic process
  Homolog annotation: Hit_ID=Q8SKU2; Match level="QueryCoverage=98%, HitCoverage=21%, E-value=3e-21, Identity=54%"; Hit description=Tic62 protein precursor
  Subcellular localization annotation: CTP_CleavageSite=52; ConfidenceScore=5.05e-01
MEAFSVQSLITVTIPSSLSCREATEKPFASHVNLSHFTRYPCTSRATKHKIRCTNAQASGSTKSSTSTAEGISEKTDSKDDNLVFVAGATGRVGSRTVRELIKLGFRVS

SEQ ID NO: 140413 - protein, 286 aa, Glycine max
  Coding DNA Sequence Number=SeqID_23635
  Gene Ontology: Mol. function=catalytic activity; Cellular component =chloroplast; Biological process=cellular metabolic process
  Homolog annotation: Hit_ID=Q8SKU2; Match level="QueryCoverage=99%, HitCoverage=54%, E-value=1e-119, Identity=77%"; Hit description =Tic62 protein precursor
  Pfam annotation: Domain name=3Beta_HSD; Domain location=84-286; Score= -132.1; E_value=0.0031; Accession=PF01073.9; Description=3-beta hydroxysteroid dehydrogenaseisomerase family
  Pfam annotation: Domain name=Epimerase; Domain location=83-285; Score= -60.9; E_value=0.037; Accession=PF01370.11; Description=NAD dependent epimerasedehydratase family
  Pfam annotation: Domain name=NAD_binding_4; Domain location=85-285; Score=-90.8; E_value=0.0093; Accession=PF07993.2; Description=Male sterility protein
  Pfam annotation: Domain name=NmrA; Domain location=83-285; Score= -89.3; E_value=0.0051; Accession=PF05368.3; Description=NmrA-like family
  Pfam module annotation: Pfam domain module=3Beta_HSD::Epimerase::NAD _binding_4::NmrA; Domain location=84-286::83-285::85-285::83-285
  Subcellular localization annotation: CTP_CleavageSite=54; ConfidenceScore=5.52e-01
MEAFSVQSLTATTIPTSSLSRRAATDKPSATSHVNLSHFTRYPCTTKHKIRCTRAQASGSTKSCTGTAEGISEKTDSKDDNLVFVAGATGRVGSRTVRELIKLGFRVRAGVRSAQRAGALVQSVEQLKLDGANGGVQAVEKLEIVECDLEKPETIGSALGNASTVICSIGASEKEVFDITGPFRIDYLATKNLIDAATVTKVNHFILVTSLGTNKIGFPAAILNLFWGVLVWKRKAEEALLASGLPYTIVRPGGMERPTDAFKETHNITLSTEDTLFGGLVSNLQL

SEQ ID NO: 140414 - protein, 323 aa, Glycine max
  Coding DNA Sequence Number=SeqID_23636
  Gene Ontology: Mol. function=hydrolase activity, acting on acid anhydrides, catalyzing transmembrane movement of substances; Cellular component=proton-transporting two-sector ATPase complex; Biological process=ATP ...
  Gene Ontology: Biological process=synthesis coupled proton transport
  Homolog annotation: Hit_ID=Q2HUJ7; Match level="QueryCoverage=66%, HitCoverage=55%, E-value=2e-74, Identity=63%"; Hit description=V -ATPase subunit C
  Pfam annotation: Domain name=V-ATPase_C; Domain location=16-323; Score=135.8; E_value=1.2e-37; Accession=PF03223.5; Description=V -ATPase subunit C
MSPLKEIVDGIHSQLSVRFRRWVVVAICCCVVSVVLNRSFIVGSWLANYSNYFMVAWLLQACNQVRRDATCFNSDLMSKQSNFGSFKLKGVHFGRKSLGSQPFESTVDIMVRVSEYNNIRSQLNAINRKQTGSMFYFFADLLDYFSLAVRDLSNLVPRSSKKLYEDNEYALYTVTLFSRVADNFRTSAREKGFQIRDFEYSPETHENRKQELDKLVQDQERLRASLLQWCYTSYGEVFSSWMHFCAVRLFAESILRYGLPPSFLVIYSSKIKVQSNDPWDFQTLITEYWVFQACVLAPSVKSEKKVRSILEGLTDSTNRQVAY

SEQ ID NO: 140415 - protein, 244 aa, Glycine max
  Coding DNA Sequence Number=SeqID_23637
  Gene Ontology: Mol. function=catalytic activity; Cellular component =chloroplast; Biological process=cellular metabolic process
  Homolog annotation: Hit_ID=Q8SKU2; Match level="QueryCoverage=91%, HitCoverage=41%, E-value=7e-63, Identity=60%"; Hit description=Tic62 protein precursor
MLLSLLPLINGNIYALIFKLIAELLAVMAKNRDLSYCKIVEAIAETTSPLTPMEGLLARIPSQRPYISSPKKPDIAVVSIPDPPANVVAKEPKVATQQETAQPKPVANQPLSPYIVYDDLKPPSSPSPSQPGGGKQTKISETVPQPSASDTPSSVLGVDGDSQTTSSSKVEKPLSPYVVYPDLKPPTSPSPNAPTVSVSTPAAAGVPKIDTISSNGPAQLSTADEPKKEHLPEPKSTPLSPYTM

SEQ ID NO: 140416 - protein, 360 aa, Glycine max
  Coding DNA Sequence Number=SeqID_23638
  Gene Ontology: Mol. function=binding; Cellular component=integral to membrane; Biological process=transport
  Homolog annotation: Hit_ID=O80412; Match level="QueryCoverage=93%, HitCoverage=93%, E-value=1e-143, Identity=75%"; Hit description =Mitochondrial phosphate transporter
  Pfam annotation: Domain name=Mito_carr; Domain location=157-245; Score=85.5; E_value=1.7e-22; Accession=PF00153.17; Description =Mitochondrial carrier protein
  Pfam annotation: Domain name=Mito_carr; Domain location=75-148; Score= 70.2; E_value=6.5e-18; Accession=PF00153.17; Description =Mitochondrial carrier protein
  Pfam module annotation: Pfam domain module=Mito_carr::Mito_carr; Domain location=157-245::75-148
  Subcellular localization annotation: CTP_CleavageSite=36; ConfidenceScore=5.33e-01
MALPDSSSRRNSLIPSFIYSSSSKTLPLHHMLNSASAAAPSPPPENLHAGSRGLVIPSPSESRKIKIPKMYSLEFYAACAKGGILSCGLTHLAFTPLEIVRCNMQGLKEQGFRAFFRGWVPTLLGYSAQGACKFGFYEFFKKYYSDIAGPEYASKYKTLIYLAGSASAEVIADIALCPFEAVKVRVQTQPGFARGLSDGLPKFVRSEGTLGLYKGLVPLWGRQIPYTMMKFASFETIVELIYKHAIPTPKNECTKGLQLAVSFAAGNIAGVLCAIVSHPADNLVSFLNNAKGATVGDAVKKLGLWDLFTRGLLFRIVMIGTLTGDQWVIYDALKLFAGLPTTGGPAPAAALASDAELAKA

SEQ ID NO: 140417 - protein, 64 aa, Glycine max
  Coding DNA Sequence Number=SeqID_23639
MLYSYMKEEWNLRSEFVGQGRSDSCEKVNLIAYWKTEDEVGAGMAGLAGDADAHPYVSFTINVA

SEQ ID NO: 140418 - protein, 213 aa, Glycine max
  Coding DNA Sequence Number=SeqID_23640
  Gene Ontology: Cellular component=integral to membrane
  Homolog annotation: Hit_ID=Q9FJV7; Match level="QueryCoverage=60%, HitCoverage=44%, E-value=2e-42, Identity=63%"; Hit description =Arabidopsis thaliana genomic DNA, chromosome 5, P1 clone:MFO20
  Pfam annotation: Domain name=DUF607; Domain location=4-191; Score =165.9; E_value=1e-46; Accession=PF04678.4; Description=Protein of unknown function, DUF607
METAVQFLNYSCRLQRMMMTWILILVWRNGALAGSLETVSFGWDMWNVAKSIESLIYQSIANPNDPRRKELELMEKQKWMIDEKAKAQVRAELYFGLGFLTVQTLGFMRLTFWELSWDVMEPICFFVTSFGFALAYLFFLKTSTEPTFQGFFHHRFKAKQERLMKTHNFDMSRYNELFKACYTNYHGGAKFESSYPFHYLGETHLTDLRALHR

SEQ ID NO: 140419 - protein, 38 aa, Glycine max
  Coding DNA Sequence Number=SeqID_23641
MTPIKGWMVKPQDGSGRTSKDKAVDCNYFKQLIRPLNI

SEQ ID NO: 140420 - protein, 132 aa, Glycine max
  Coding DNA Sequence Number=SeqID_23642
  Gene Ontology: Mol. function=methyltransferase activity; Biological process=metabolic process
  Homolog annotation: Hit_ID=Q2R2M2; Match level="QueryCoverage=99%, HitCoverage=42%, E-value=8e-35, Identity=68%"; Hit description =Protease, putative, expressed
IKVLQADMLELPFEDECFDLVIEKGTMDVLFVDSGDPWNPKPETIFKVMATLKGVHRVLKAGGTFISVTFGQVSKIVRCVVSLLMSIAVIDSNLSKIHASHISGALYLMHQISTGLLSGLLLVKPFTILSMF

SEQ ID NO: 140421 - protein, 248 aa, Glycine max
  Coding DNA Sequence Number=SeqID_23643
  Gene Ontology: Mol. function=protein binding; Cellular component =apoplast; Biological process=response to biotic stimulus
  Homolog annotation: Hit_ID=Q9SNY0; Match level="QueryCoverage=88%, HitCoverage=89%, E-value=2e-90, Identity=68%"; Hit description=SCUTL2
  Pfam annotation: Domain name=Thaumatin; Domain location=33-247; Score= 351.9; E_value=1e-102; Accession=PF00314.8; Description=Thaumatin family
MALIPNSKTSALFHLLLFLLGNVAYATVFTLENHCSYTVWPGTLSGNGAALLGEGGFALAPGSAVQLTAPAGWSGRFWARTGCSFDASGSGKCVTGDCGSGLKCSGGGVPPATLAEFTLGSASNGNKDFYDVSLVDGYNVGMGVRATGGTGDCQYAGCVADVNGVCPAELQVRDGSGAVVACKSACLALNTAEYCCTGDHNTPQTCPPTHYSEIFKNACPTAYSYAYDDASSTCTCSGSDYRITFCST

SEQ ID NO: 140422 - protein, 183 aa, Glycine max
  Coding DNA Sequence Number=SeqID_23644
  Gene Ontology: Mol. function=enzyme inhibitor activity; Cellular component=cell wall; Biological process=cell wall modification
  Homolog annotation: Hit_ID=Q9LSR2; Match level="QueryCoverage=74%, HitCoverage=61%, E-value=1e-19, Identity=43%"; Hit description =Arabidopsis thaliana genomic DNA, chromosome 5, BAC clone:F24B18
MDIDRYFKWVFVIHGYMYFFTHSLMVTVVVTVDGADGVFVGVGVSVDGEVDRAPVGAEEDVGRADVEAVEQDHGVPGADVVLHGPADRVGALVGEVDGHADFAACAGGGGGGGGGRGVVMARGGGVVDFDLRELRVGIQCGRVLVVAQVGIGDAIGEKVRNSEVRRKVIVMGKQKIRSTRKNE

SEQ ID NO: 140423 - protein, 257 aa, Glycine max
  Coding DNA Sequence Number=SeqID_23645
  Gene Ontology: Mol. function=1-acylglycerol-3-phosphate O -acyltransferase activity; Cellular component=integral to membrane; Biological process=phospholipid biosynthetic process
  Homolog annotation: Hit_ID=Q8L4Y2; Match level="QueryCoverage=99%, HitCoverage=74%, E-value=1e-101, Identity=64%"; Hit description =Probable 1-acyl-sn-glycerol-3-phosphate acyltransferase 4
  Pfam annotation: Domain name=Acyltransferase; Domain location=61-219; Score=52.9; E_value=1.1e-12; Accession=PF01553.11; Description =Acyltransferase
MEVCEPVKSENRLKHRPLTLLVAVVGLRLFSIRCSRKTVSFIFGLWLSLWPSLFEKINKTKVVFSGDGVPMKERVLLIANHRTEVDWMYLWDLALRKGRLGCIKYILKSSLMKLPIFGWGFHILEFIAVERKWEIDEQILQQKLSTLKDPQDPLWLALFPEGTDYTDQKSKNSQKFAAEAGLPVLTNVLLPKTKGFHACLEALRASLDAVYDVTIAYKNQCPSFLDNVFGVDPPEVHLHVRRIPVEEIPASETKAAS

SEQ ID NO: 140424 - protein, 99 aa, Glycine max
  Coding DNA Sequence Number=SeqID_23646
MHLLVVERVVQNEFWIFVSVLETSSKSFESIQRLTNGNEGNVSGVLLGRIDGDPVLRETRIWATWEYVSSVGGGQQGMVGLCPICGCGKLVVHHHPTAT

SEQ ID NO: 140425 - protein, 102 aa, Glycine max
  Coding DNA Sequence Number=SeqID_23647
MESCNVKNKSSGKRKMSSEDTRSYFAWNLEMEHVLADVLRDQRNLGNKGDGNWKAIAYSTAAQSLSKHFGVHLMADNVKNCFKLWRTWYEIVSDILSQSGFG

SEQ ID NO: 140426 - protein, 187 aa, Glycine max
  Coding DNA Sequence Number=SeqID_23648
  Pfam annotation: Domain name=KIP1; Domain location=7-63; Score=11.4; E_value=0.01; Accession=PF07765.3; Description=KIP1-like protein
MENKDPKSWSSAHIHQSQWLQTTLSDGDNSPNLEGMHGKWRGDLVQMLEEFGQSYRVLAVAYNQLKFKTSHGDFHLESLSSSGRSETICAICNRRATGNLEDKKLEECWNHHLDWNHHPKYSVEHSDIKFDSSNLGIDLLNQQGDECHEFLSADLCSMKFKSELEWRHSNGRQNDKIFHHRKCFKED

SEQ ID NO: 140427 - protein, 75 aa, Glycine max
  Coding DNA Sequence Number=SeqID_23649
MAFFTSLCHAVWTMLQSLWSCDIHMVKLTSNKCNIAPHFTVVGLEECVRKREYAKRVFSDNNERLILLEAYKSLE

SEQ ID NO: 140428 - protein, 664 aa, Glycine max
  Coding DNA Sequence Number=SeqID_23650
  Gene Ontology: Mol. function=catalytic activity; Cellular component =intracellular; Biological process=metabolic process
  Homolog annotation: Hit_ID=Q2HUK9; Match level="QueryCoverage=92%, HitCoverage=96%, E-value=0.0, Identity=77%"; Hit description =Tetratricopeptide-like helical
  Pfam annotation: Domain name=PPR; Domain location=136-170; Score =18.5; E_value=0.025; Accession=PF01535.11; Description=PPR repeat
  Pfam annotation: Domain name=PPR; Domain location=246-280; Score =28.4; E_value=2.5e-05; Accession=PF01535.11; Description=PPR repeat
  Pfam annotation: Domain name=PPR; Domain location=345-379; Score =45.6; E_value=1.7e-10; Accession=PF01535.11; Description=PPR repeat
  Pfam annotation: Domain name=PPR; Domain location=35-69; Score=27.2; E_value=6e-05; Accession=PF01535.11; Description=PPR repeat
  Pfam annotation: Domain name=PPR; Domain location=380-414; Score=9.5; E_value=0.56; Accession=PF01535.11; Description=PPR repeat
  Pfam annotation: Domain name=PPR; Domain location=416-450; Score =11.8; E_value=0.3; Accession=PF01535.11; Description=PPR repeat
  Pfam annotation: Domain name=PPR; Domain location=482-516; Score=3.8; E_value=2.6; Accession=PF01535.11; Description=PPR repeat
  Pfam module annotation: Pfam domain module=PPR::PPR::PPR::PPR::PPR::PP R::PPR; Domain location=136-170::246-280::345-379::35-69::380 -414::416-450::482-516
  Subcellular localization annotation: CTP_CleavageSite=86; ConfidenceScore=5.54e-01
MTMTQSVFRTSSTARTKTANLTSMFGKYVDKTSVHSWNTVIADLSRSGDSVEALSAFASMRKLSLHPNRSTFPCAIKACAALSDLRAGAQAHQQAFAFGFGHDIFVSSALIDMYSKCARLDHACHLFDEIPERNVVSWTSIIAGYVQNDRARDAVRIFKELLVEESGSLESEDGVFVDSVLLGCVVSACSKVGRRSVTEGVHGWVIKRGFEGSVGVGNTLMDAYAKCGEMGVARKVFDGMDESDDYSWNSMIAEYAQNGLSAEAFCVFGEMVKSGKVRYNAVTLSAVLLACASSGALQLGKCIHDQMDLEDSVFVGTSIVDMYCKCGRVEMARKAFDRMKVKNVKSWTAMIAGYGMHGCAKEAMEIFYKMIRSGVKPNYITFVSVLAACSHAGMLKEGWHWFNRMKCEFNVEPGIEHYSCMVDLLGRAGCLNEAYGLIQEMNVKPDFIIWGSLLGACRIHKNVELGEISARKLFELDPSNCGYYVLLSNIYADAGRWADVERMRILMKSRGLLKTPGFSIVELKGRIHVFLVGDKEHPQHEKIYEYLDKLNVKLQELGYMPNVTSVLHDVDEEEKGMVLRVHSEKLAVAFGIMNSVPGSIIQIIKNLRICGWVVFVWGLLVTEIEIKGVRIYGVGYALLLHHQCLTLHITRYNISESTHLSSKR

SEQ ID NO: 140429 - protein, 573 aa, Glycine max
  Coding DNA Sequence Number=SeqID_23651
  Gene Ontology: Mol. function=translation initiation factor activity; Cellular component=nucleus; Biological process=mRNA transport
  Homolog annotation: Hit_ID=Q2HUL1; Match level="QueryCoverage=97%, HitCoverage=53%, E-value=1e-168, Identity=78%"; Hit description =Initiation factor eIF-4 gamma, middle
  Pfam annotation: Domain name=MIF4G_like; Domain location=2-89; Score=- 12.7; E_value=1.5e-07; Accession=PF09088.1; Description=MIF4G like
  Pfam annotation: Domain name=MIF4G_like_2; Domain location=183-480; Score=167.7; E_value=2.9e-47; Accession=PF09090.1; Description=MIF4G like
  Pfam module annotation: Pfam domain module=MIF4G_like::MIF4G_like_2; Domain location=2-89::183-480
ALPGAFPAVVAGAVRTLFERIADLDMECRTRLILWFSHHLSNFQFIWPWEEWAYVLDLPRWAPQRVFVQEVLEREVRLSYWDKVKQLPCKATYNQNHASVKPSLDPICFCKPPTIIRAEKVEPSVLFSYPHALVCLAQWSLQQSRETDWSLQQRREASLLSHLSIENAPGLEELLPPKGGPNFSFGAEDDKESNEHVLSGQLNNMVKGKAPVREIISWIDESVLPNNGLEVTLRVVVQTLLNIGSKSFTHLMTVLERYGQVFAKLCPDQDKQVMLIAEVSSFWKSNTQMTAIAIDRMMGYRLVSNLAIVRWVFSAENIEQFHMSDRPWEILRNAVSKTHNRISDLRKEILSLKKNISSSEEAAKEAKAELDAAESKLTLVDGEPVIGDNPARLNRLKSHAEKTKEEVVSLQESLEAKEALLSRAIEENETILLIKHMFEVLALFLLLYKSFSNVLTERLPEGSRTLHELKSAQVDVVMAVDPEEPSSMELDNQNQRPQNSHTNGEKKGGAYNVGEKEQWCITTLGYVKAFSRQYAAEIWPHVEKLDAEVLTEDAPLLFRSAVYSGLRRPIHEA

SEQ ID NO: 140430 - protein, 85 aa, Glycine max
  Coding DNA Sequence Number=SeqID_23652
MVGRRVLGSGWIGRWRRPLCVQYPRLFLIANRMVSEMEVESFSQGGGVTYQYQDEYGLMWTKEVSEVYTIQSNYNYGGGCIECGG

SEQ ID NO: 140431 - protein, 188 aa, Glycine max
  Coding DNA Sequence Number=SeqID_23653
  Gene Ontology: Mol. function=RNA-directed DNA polymerase activity; Biological process=RNA-dependent DNA replication
MSLEDVEVRKGLQEDFWRNVMLNESLLKQKSRFKWLKDDRFGEEDWERPPLDEVNFKKISSEDNGMLISRFGDEEIKEAIWDCGNSKSLGSDDVNFKFIKEFWHILKGDIIKFLDDFHGSSNFTTGCMYKVVTKVLAKRLQKVVDETRRKKKKCMILKVDYEKMYDSICWKFLFYMMRRLCFDKIWIG

SEQ ID NO: 140432 - protein, 147 aa, Glycine max
  Coding DNA Sequence Number=SeqID_23654
  Gene Ontology: Mol. function=RNA-directed DNA polymerase activity; Biological process=RNA-dependent DNA replication
  Homolog annotation: Hit_ID=Q1T5K4; Match level="QueryCoverage=67%, HitCoverage=9%, E-value=8e-13, Identity=37%"; Hit description=RNA -directed DNA polymerase
MVVMKSILRSFELVFRLKVDFHKSRFGGFGVEREVVERFVKYLNCRVLSFSFVYLEIPIGVNPTRLETWESIIAKFKKNLTSWKQKHFSFAERICLINSMSAGTMVIEISILVMVAVVVTMVVIMTVVTIVIIRNDNGWGWAWIRAT

SEQ ID NO: 140433 - protein, 91 aa, Glycine max
  Coding DNA Sequence Number=SeqID_23655
MRKDFSETNEPHSVHNLEGHGQKANTFQKSQAHWLGMRADEIPLLDMAERKGEEEEEEEKANNVIFVIGGGVLGSERPPARISAFNPNSEK

SEQ ID NO: 140434 - protein, 142 aa, Glycine max
  Coding DNA Sequence Number=SeqID_23656
  Gene Ontology: Mol. function=translation initiation factor activity
  Homolog annotation: Hit_ID=Q2HUL1; Match level="QueryCoverage=95%, HitCoverage=14%, E-value=4e-57, Identity=81%"; Hit description =Initiation factor eIF-4 gamma, middle
MSSKVLQPSSLVAVFETFLSSAATTVDEEKGNPLWQPCADFYITCILSCLPWGGAELTEHWSMPCIDIAVEQVPEDIERVMVGVEAYLSIRKHTSDTGLSFFENDDENGEGLTDKDFLEDLWDRIQVLSSNGWKVDSGNVLK

SEQ ID NO: 140435 - protein, 65 aa, Glycine max
  Coding DNA Sequence Number=SeqID_23657
MGKSRVNHHQSSGVPVEKFVNMLLKFVESGIWVDLTTPSYTKSPPPMLLKPTQIQLQKKNMKTTS

SEQ ID NO: 140436 - protein, 295 aa, Glycine max
  Coding DNA Sequence Number=SeqID_23658
  Gene Ontology: Mol. function=metal ion binding; Cellular component =ribonucleoprotein complex; Biological process=ubiquitin cycle
  Homolog annotation: Hit_ID=Q84RR2; Match level="QueryCoverage=99%, HitCoverage=47%, E-value=6e-84, Identity=54%"; Hit description =ARIADNE-like protein ARI2
WLCGGATGREHTWSSIAGHSCGRYKEQEKTAERAKRDLYRYMHYHNRYKAHTDSFKIESKLKETIQGKIAISEEKDSTLRDYSWVNNGLSRLFRSRRVLSYSYAFAFYMFGDELFKDEMTDAQREIKQNLFEDQQQQLEANVEKLSKILEEPFETFSDDKVVEIRMQILNLSTIIDKLCQKMYECIENDLLGSLNLGIHSIAPYKSKGIERASELSVGWNNKFDFVDAHQKMLLSEKDYCIYAASVGVTEELDRPSGSGSSDDNGCSSRKRARKEGLGGGGFFDLNLPAEFVDRN

SEQ ID NO: 140437 - protein, 58 aa, Glycine max
  Coding DNA Sequence Number=SeqID_23659
MSGVLKHGNKEKDSLKATGFPLCSKRLSLTSDKTVPDNSNFLIAGFTVLSDGCLPSYQ

SEQ ID NO: 140438 - protein, 56 aa, Glycine max
  Coding DNA Sequence Number=SeqID_23660
MAIGAFKKVTCGIFTDNQGTPFFGLDITLEQMDQKFGARGNEDPFSQGRDLGRKLA

SEQ ID NO: 140439 - protein, 591 aa, Glycine max
  Coding DNA Sequence Number=SeqID_23661
  Gene Ontology: Mol. function=transcriptional elongation regulator activity; Cellular component=cytoplasm; Biological process =regulation of transcription, DNA-dependent
  Homolog annotation: Hit_ID=Q84U02; Match level="QueryCoverage=84%, HitCoverage=82%, E-value=1e-92, Identity=43%"; Hit description =Putative ternary complex factor MIP1
  Pfam annotation: Domain name=DUF547; Domain location=433-581; Score =201.2; E_value=2.5e-57; Accession=PF04784.5; Description=Protein of unknown function, DUF547
  Subcellular localization annotation: CTP_CleavageSite=50; ConfidenceScore=5.02e-01
MHEIKWRDSGSKQFKFMDPTVSISSHKRSNSDPMKRRVMGDGLGSISEASCQPEVDPGELKQNIESKKRQYHNMDLQSSLTQEILQLQKRLQQQFVIRRALEKACYVPFSQDATIENSIPKAAKELIKEIGILELEVVHLEQYLLSLYRKRFDQQISTLSTKERRLELASDTNQGTSAVPGNDAISDKEISVVHCSNVISPRNSSGFKLKECNNQLGAETGLDSSIHRCHSTLSQRTTCSIEASPGNIETKAVVDSYHSLPLSMLEVKYNENQKSGGILLFLMHTSLISGFQNLFHQQAQYAKSSSTSLAEHLGSSYVANVPETPNWLSEEMIRCISAIYCELTEPPSLGHKNAPSPISFSSSGNELSTQSQCTKKGSHWKEHSSFNLNSTNPFHVRGSKEFSGPYCSMIRIQQLCTDSQKLKEIEYMLRRFRSLVSRLEDVNPRNMKHEEKLAFWINVHNSLAMHALLVYGVSANHVKRMSSVLKAAYNIGGHTLSVDLIQNFILGCRLPRPGQWLRLWFPSMTKPKVRDARKGYAIHRPEPLLLFALCSGSHSDPAVDFWSFCTYFIFVNVDMYSDTYNERKYEITELI

SEQ ID NO: 140440 - protein, 78 aa, Glycine max
  Coding DNA Sequence Number=SeqID_23662
MVDSFAKNSGLGASDLVEMVKPYLPDSQMKSIQEIHPCMYVGRIIVCLSISIQDLHLMVSTDVMCKKEMCLPQSITGE

SEQ ID NO: 140441 - protein, 398 aa, Glycine max
  Coding DNA Sequence Number=SeqID_23663
  Gene Ontology: Mol. function=metal ion binding; Cellular component =integral to membrane; Biological process=ubiquitin cycle
  Homolog annotation: Hit_ID=Q67YI6; Match level="QueryCoverage=96%, HitCoverage=95%, E-value=2e-67, Identity=43%"; Hit description=RING -H2 finger protein ATL3G
  Pfam annotation: Domain name=zf-C3HC4; Domain location=137-178; Score= 36.2; E_value=1.2e-07; Accession=PF00097.15; Description=Zinc finger, C3HC4 type (RING finger)
  Subcellular localization annotation: CTP_CleavageSite=61; ConfidenceScore=5.85e-01
MAPSQPPHWAPSPSLTPTPILHKSFFPPPSNSPAVDFSPPLIAMVVVVAAAFLVVTYSRLIARHLRPPIHRLLRRFRRRRFLPSSVGDLESLPYESPFDGPHVFSPYGLDETVIKTIPFSLYTAKYDARFDESRNDCAVCLLEFEDDDYVRTLPICSHTFHVDCIDAWLRSHANCPLCRAGVLCTDSPFTPMMAARIRPSFDDDTILHRISIDPLIDPPLLPAAAISSVPEITPCVDENSPRRNQNHANVNSEDCFRDFLLKRSYSFGFERSLASERMVMEPATASPWRYRRGSSSFWSKRPSPFGSLGKPRVFSFRYYRGMKSPFFRRRGFFPLSESSVRYGGGGGGGGSSSRRSKSIASPMFLRSSGVTSAAAFSSSRLRCGDPEALLSPERFNGR

SEQ ID NO: 140442 - protein, 83 aa, Glycine max
  Coding DNA Sequence Number=SeqID_23664
  Homolog annotation: Hit_ID=Q10EJ2; Match level="QueryCoverage=85%, HitCoverage=46%, E-value=4e-22, Identity=63%"; Hit description =Integral membrane protein, putative, expressed
MGLVIPWSFTLALVDGYSVLVKCPIRQPGILLIIVVGDWVLSTLILAAACSTASVVDLLLNTHGSFCPPKLCSSMRNIRGAGF

SEQ ID NO: 140443 - protein, 302 aa, Glycine max
  Coding DNA Sequence Number=SeqID_23665
  Homolog annotation: Hit_ID=Q9XII1; Match level="QueryCoverage=99%, HitCoverage=99%, E-value=4e-42, Identity=37%"; Hit description =Expressed protein
MEEEGIGLVLARATELRLKISNCIQRATANGPSPHADDDDDDEATERLLNICDALEALETQLSSLQNYEDSSIELVLVLVLQQQQRYEREIALAEIESSRKMLIDKLKEYKGKELEVIQEASTFASETVEPNNDLLLPPYPSRPPYSVSMDKEYLSQIPSVNKSGRNGLITLDPMIEANKNLSEKEQNHVENGAKNSRKGLGFFITSAAKAMLTVVGVVSILSLSGFGPKLGVRFSVQGWRHRVENEERSTTKNGGERPNIQCPPGRILVWENGEARCLVKERVEIPFSAVAATPDINYGCG

SEQ ID NO: 140444 - protein, 487 aa, Glycine max
  Coding DNA Sequence Number=SeqID_23666
  Gene Ontology: Mol. function=transferase activity; Cellular component= mitochondrion; Biological process=metabolic process
  Homolog annotation: Hit_ID=Q2QT42; Match level="QueryCoverage=92%, HitCoverage=94%, E-value=2e-68, Identity=34%"; Hit description =Pentatricopeptide, putative, expressed
  Pfam annotation: Domain name=PPR; Domain location=161-195; Score =12.0; E_value=0.28; Accession=PF01535.11; Description=PPR repeat
  Pfam annotation: Domain name=PPR; Domain location=196-230; Score=4.7; E_value=2.1; Accession=PF01535.11; Description=PPR repeat
  Pfam annotation: Domain name=PPR; Domain location=245-278; Score =19.6; E_value=0.011; Accession=PF01535.11; Description=PPR repeat
  Pfam annotation: Domain name=PPR; Domain location=279-313; Score =37.2; E_value=5.7e-08; Accession=PF01535.11; Description=PPR repeat
  Pfam annotation: Domain name=PPR; Domain location=314-348; Score =31.9; E_value=2.3e-06; Accession=PF01535.11; Description=PPR repeat
  Pfam annotation: Domain name=PPR; Domain location=349-383; Score =32.9; E_value=1.1e-06; Accession=PF01535.11; Description=PPR repeat
  Pfam annotation: Domain name=PPR; Domain location=420-454; Score =36.7; E_value=8e-08; Accession=PF01535.11; Description=PPR repeat
  Pfam annotation: Domain name=PPR; Domain location=99-133; Score=6.3; E_value=1.3; Accession=PF01535.11; Description=PPR repeat
  Pfam module annotation: Pfam domain module=PPR::PPR::PPR::PPR::PPR::PP R::PPR::PPR; Domain location=161-195::196-230::245-278::279-313::314 -348::349-383::420-454::99-133
  Subcellular localization annotation: CTP_CleavageSite=46; ConfidenceScore=5.53e-01
MAIQILKQFSQTLRPKPWTLFFSFSCSNDASQSLVTDAVSILTHHRSKSRWSNLRSACPNGITPAEFSEITLHIKNKPQLALRFFLWTKSKSLCNHNLASYSSIIHLLARARLSSHAYDLIRTAIRASHQNDEENCRFNSRPLNLFETLVKTYRDSGSAPFVFDLLIKACLDSKKLDPSIEIVRMLLSRGISPKVSTLNSLISRVCKSRGVDEGYAIYREFFRLDEENNEISKRGSGFRVTPNVHTYNDLMLCCYQDGLVERVEKIWIEMKCNYKPNAYSYSVLMATFCDEGRMGDAEKLWEELRSEKIEPDVVSYNTIIGGFCTIGDVGRAEEFFREMAVAGVGTTASTYEHLVKGYCNIGDVDSAVLVYKDMARSDLRPDASTLDVMIRLLCDKGRVRESLEFVRCAVGKFDLIPMEKSYEALIKGLCFDGRMEEALKVQAEMVGKGFQPNSEIYGAFVDGYVRHGNEEMAEALRKEMLQNQMQS

SEQ ID NO: 140445 - protein, 657 aa, Glycine max
  Coding DNA Sequence Number=SeqID_23667
  Gene Ontology: Mol. function=long-chain-fatty-acid-CoA ligase activity; Cellular component=integral to membrane; Biological process=metabolic process
  Homolog annotation: Hit_ID=Q96537; Match level="QueryCoverage=97%, HitCoverage=96%, E-value=0.0, Identity=63%"; Hit description=Acyl CoA synthetase
  Pfam annotation: Domain name=AMP-binding; Domain location=79-547; Score=189.1; E_value=1.1e-53; Accession=PF00501.18; Description=AMP -binding enzyme
MPELYSVKVEEARPATHEKPSAGPVYRCIYAKDALTQLPSHFQSPWQFFRDTTTRCPSNPMLGRRQKSDSKVGPYQWITYQEAYDAAIRMGSAMRSRGVNPVTHLALFKILRIGKYGYRCGIYGSNCPEWIIAMQACNSYAVTYVPLYDTLGLCFVPFPITLKDSKIPSVLSCLDRWSSLKTIVSFGNVSTTQKKEAEELGASCFSWEEFLQMGNIDLDLPPKKKTNICTIMYTSGTTGEPKGVIIKNEAFMTQVLSIDQILNLTDRVGTEDDVYFSFLPLAHVYDQIMETYCIYKGSSIGFWQGDVGFLMEDILALKPTLFCGVPRVYDRVYAYFCTSILVPTNLESTDSKLGYLEKGLPQDKAAPLFDKLVFDKIKQALGGRVRLLLSGAAPLPRHVEEFLRVTFGATMSQGYGLTESCGGCFTGISNVFSMMGTIGVPMTTIEARLESVPEMGYDALSSEARGEICLRGNTLFSGYHKHQDLTEEVMVDGWFHTGDIGEWQPNGAMKIIDRKKNIFKLSQGEYVAVENIENKYLQCPLITSIWVHGNSFESFLVAVVVPERKGLEYWAVKHNSTDDFKSLCENPKARKYILDELNNTGQKHQLRGFELLKAVHLEPIPFDMERDLITPTFKLKRPQLLKQYKLIRKYYRIDNFN

SEQ ID NO: 140446 - protein, 139 aa, Glycine max
  Coding DNA Sequence Number=SeqID_23668
  Subcellular localization annotation: CTP_CleavageSite=84; ConfidenceScore=5.35e-01
MYPPLFSLNNLVDVSSTRTDPQEMYSLLFSVTTTQVDVPSTCTTKDVPSNVLRQSSQTGEGRHKRIQAVNPLFFWKRENRDTKRIQTVWKTRKLKKVFAKEEEEEEDVQRDSKVVKEYVEKFFVKVASVIEMQIKVLLL

SEQ ID NO: 140447 - protein, 65 aa, Glycine max
  Coding DNA Sequence Number=SeqID_23669
MEVGASNRMSFIEGKIGINEMAPKKLSTKRSRRDATGEGSSAAPEFDSHRFRSAEHDQRFEAIRG

SEQ ID NO: 140448 - protein, 70 aa, Glycine max
  Coding DNA Sequence Number=SeqID_23670
MACNHIPVEAKIVLDSKSDSPQISASPHQLDFAPYALGSYSAQWNAPGLLHDMHMLHSSRILGKMEVEET

SEQ ID NO: 140449 - protein, 71 aa, Glycine max
  Coding DNA Sequence Number=SeqID_23671
  Subcellular localization annotation: CTP_CleavageSite=37; ConfidenceScore=5.10e-01
MKVHIRDARNSTWKHMPISNGHNFGLGCPIQVNNIVRRTKLNNGSTRENQMVITFHSDFRFRRIVYQDARN

SEQ ID NO: 140450 - protein, 42 aa, Glycine max
  Coding DNA Sequence Number=SeqID_23672
MALVIKFVDKSGYVRVFFRCLTWTKDMMELAISMESGMVCKL

SEQ ID NO: 140451 - protein, 194 aa, Glycine max
  Coding DNA Sequence Number=SeqID_23673
  Homolog annotation: Hit_ID=Q10EK6; Match level="QueryCoverage=99%, HitCoverage=53%, E-value=3e-51, Identity=52%"; Hit description =Expressed protein
MADFLAGSGKKHIVVLSSLDFGKWQKVDMSRKLHCDTSHSDISIGYYISGLQIYYLSSSNSNGTDENCEQLGWKKLQEYDPSQMHWKYLSDLAEGNVTVEDITSVEDELEEENYYASLPFAALFSFLKAKGLKVTCLLCYCSEGDNISDAFQLGDAVCKLLQLSHPTTGIEGGKWRVPLSWMSVYGPPPDVSIF

SEQ ID NO: 140452 - protein, 86 aa, Glycine max
  Coding DNA Sequence Number=SeqID_23674
MFCSFFTCFLALDPEISPCYTPSISSPHILVLGFRIWSSMPENSSATASMSENDGSVVEDSGRESTERKKGRQRLDEEWCTIKFCT

SEQ ID NO: 140453 - protein, 384 aa, Glycine max
  Coding DNA Sequence Number=SeqID_23675
  Gene Ontology: Mol. function=ATP binding; Cellular component =ubiquitin ligase complex; Biological process=electron transport
  Pfam annotation: Domain name=WD40; Domain location=116-152; Score =18.6; E_value=0.022; Accession=PF00400.22; Description=WD domain, G -beta repeat
  Pfam annotation: Domain name=WD40; Domain location=154-190; Score =14.5; E_value=0.4; Accession=PF00400.22; Description=WD domain, G -beta repeat
  Pfam annotation: Domain name=WD40; Domain location=226-264; Score =24.7; E_value=0.00033; Accession=PF00400.22; Description=WD domain, G-beta repeat
  Pfam annotation: Domain name=WD40; Domain location=268-305; Score =36.2; E_value=1.1e-07; Accession=PF00400.22; Description=WD domain, G-beta repeat
  Pfam annotation: Domain name=WD40; Domain location=315-353; Score =16.1; E_value=0.13; Accession=PF00400.22; Description=WD domain, G -beta repeat
  Pfam module annotation: Pfam domain module=WD40::WD40::WD40::WD40::WD4 0; Domain location=116-152::154-190::226-264::268-305::315-353
MTNAHGGAMLVERNTNSTVRRQKFGALLHSEPTSLSTSNNDDDEFSHNQQRHSNASPRNYADSSTTSSNNASPNTMSPWSYQPNNNSSSPLDKSPWILPSSPAINHFHHHHDDTENGLFGSIVRQEGHIYSLAVSGDLLYTGSDSKNIRVWKDLKDFAGFKSSSGLVKTIVISGGKIFTGHQDGKIRVWKVSSKNPRNHKRIGSLPTFKEYVKSSMNPKNYVEVRRHRNAVKVKHFDAVSSLSLDEEEGLLYSGSWDKTLKVWRVEDSKCLDSINAHEDAVNAVVAAFGGCVLTGSADGTVKVWRRKNDGKKAKHVLDRVLLKQENAVTALAVNRLAKVVYCGSSDGLVNFWECDQKGGFSHGGVLRGHKLAVLCLAAAGNLVF

SEQ ID NO: 140454 - protein, 320 aa, Glycine max
  Coding DNA Sequence Number=SeqID_23676
  Gene Ontology: Mol. function=protein serine/threonine kinase activity; Cellular component=nucleus; Biological process=protein amino acid phosphorylation
  Homolog annotation: Hit_ID=UPI0000DA4162; Match level="QueryCoverage =86%, HitCoverage=36%, E-value=1e-19, Identity=24%"; Hit description =PREDICTED: similar to fibrillin 2
VDSAIPHPDLSGVSNDSGNSNGNGHSTKSFDNGNNSRTTDDGAKNNDDNTKSEDNGNNNNHSAKSNDGGNNNPNNNDRAKSIGNENKDCDNDNAKSIVSGNNNRNSDSTKSSYNGSNNPNNDGAYSNANNSHDTNSTKIIGNGNNNNNNNIDDASGNGKKNNNIDGASGNGKKNNNIDGASGNGNNNRNINSAKSIGGNNNRNSDSTKSSYNGSNNPNNDGAYSNANNSHDTSSTKIIGNGNNNNNNIDDASGNGKKNNNIDGASGNGKKNNNIDGASGNGNNNRNINSAKSIGGNNRNSDSTKSGDNSSNNRNNDNTNS

SEQ ID NO: 140455 - protein, 85 aa, Glycine max
  Coding DNA Sequence Number=SeqID_23677
MSAMVEVWVGELTKLREKVLARKPFLLSKAKEGSERNQEEKETQTAVVKRDTTNGTMSEATYFIENADKNFSSTLEGDSVNVCLS

SEQ ID NO: 140456 - protein, 159 aa, Glycine max
  Coding DNA Sequence Number=SeqID_23678
MEIAIITATVMVLKAMSLEITTKIVVVKAVEMAMKRAIATVAVVVLKAMAIASKTATVIVPEAMPMPTIITQTTPSKTIAPVPVTLETGTRGSCKVEINIWKQCEERVKAGNEDRKEVELTRDSENWTVGLGVVIVTGGGCLGLKKRDGLVRFPPKWST

SEQ ID NO: 140457 - protein, 3760 aa, Glycine max
  Coding DNA Sequence Number=SeqID_23679
  Gene Ontology: Mol. function=phosphotransferase activity, alcohol group as acceptor; Cellular component=cytoplasm; Biological process =mRNA catabolic process, nonsense-mediated decay
  Homolog annotation: Hit_ID=Q10D72; Match level="QueryCoverage=92%, HitCoverage=90%, E-value=0.0, Identity=46%"; Hit description =Phosphatidylinositol 3-and 4-kinase family protein, expressed
  Pfam annotation: Domain name=FATC; Domain location=3728-3760; Score =44.6; E_value=3.4e-10; Accession=PF02260.10; Description=FATC domain
  Pfam annotation: Domain name=HEAT; Domain location=51-87; Score=21.3; E_value=0.0034; Accession=PF02985.12; Description=HEAT repeat
  Pfam annotation: Domain name=HEAT; Domain location=650-681; Score =0.6; E_value=36; Accession=PF02985.12; Description=HEAT repeat
  Pfam annotation: Domain name=HEAT; Domain location=686-721; Score =2.9; E_value=19; Accession=PF02985.12; Description=HEAT repeat
  Pfam annotation: Domain name=PI3_PI4_kinase; Domain location=2003 -2281; Score=180.2; E_value=5.1e-51; Accession=PF00454.17; Description=Phosphatidylinositol 3- and 4-kinase
  Pfam module annotation: Pfam domain module=FATC::HEAT::HEAT::HEAT::PI3 _PI4_kinase; Domain location=3728-3760::51-87::650-681::686-721::2003- 2281
MQGIQQHQHLAALVSAALPKDDSAADPSPRLAAIHSLHRAILHPHNSLLLSHSATFLAQAFSQLLSDKCYEVRQAAVTAYGALCAVLASIPVAASNGRQNHLMLVDRFIGWALPSLNTAVTVDGTKELALEGLREFLNVGGTDRYALPILKACQVLLEDERTSLALLHRLIGVITLISLKFLRCFQPHFPDIVDLLLGWALVPDLAQSDRRVILDSFLQFQEHWVGSLPMSLRLLTKFLGDMEVLLHDGTPGTPQQLRRLFALLSCFSTILQSTASGLLEMNMLEQICEPLSALLPRLLRCLSMIGQKFGWSEWIEDSWKCLTLLAEILRERFSSFYPLAIDILFQSLEFGATVQRAGFRKISSFQIHGVLKTNLQLLSLQKLGLLSSSVKKLLKFHAAISQLRLHPNHLVTGSSAATYVFLLQHGNTEVVNEAIASLIEELKLLKIVIGNNTGHSDESNSVVDTKAFSKPELLALIKFDLKVLLACVSMGGDNSLIGQKDVASLYLSRSEKLVSFITKEMNPFELPIQAFIELQITVVKALERLNSVEFLIKCSDREQNCNKAFVEFPTKTEDSDDQFSNGFLAVITEHLEKYSKLLIKAFHVSSPLAIKLVALDWGQKFCENVMAFNKILGTRDFSHEECKYAGVIMNLVFSLLGGTFEREPEVRSHVAKTLEMFMQAKLLHPVCFYPLAEVILEKLGDPATEIQDAYVKLLAHILPTTIYTCGLYDYGRFRPVDPVLGKNSNMHWKQLFALKQLPLQLHSQQLVSILSYISQRWKVPLYSWIQRLIHGCQSSKDAFLSLPEETGNFGANSPWLDIQVDEDILQKICSVNNLAGAWWAVQEAARYCIATRLRTNLGGPTQTFAALERMLLDIAHLLQLDNEQSDGNLSMIGSSGAHLLPMRLLLDFVEALKKNVYNAYEGSVILPPASRQSTLFFRANKKVCEDWFSRICEPMMNAGLAVHCNDAVIQYCTLRLQELKNLSVSALKEKSRAQVTDNLHNIKGRYRGDVLKVLRHISLALCKSSDPDSLIGLRKWVSITFSSLLGEENQSSSEGGTAGPLSWISGLIYQARGEYENAAAHFTHLLQTEESLSSLGSDGIQFVIARIIECYAAVSDWRSLETWLLELQLLRAKHAGRSYSGALTMAGNEVNAIHALARFDEGDYQAAWSSLDLTPKSNSELTLDPKIALQRSEQMLLQSLLFQKEEKSDKVLHDLQKARSMLEEPLSVLPLDGLAEATPLAIQLHCIFLVEENCKLKATHEKAKQIPSILNSLKSLPSSISKIRQDCNPWLKVLRVYQTISPSSPVTLKFCMNLHNLARKQNNLLLANHLNNYIKDHVSACPEERHRNLLVLNLQYESILLQYAENKFEDAFTNLWSFLRPCMVSSTSRIPDTEERILKAKACLKLADWLTREYSDWSPESIVLKMPADFEMAESATLGKDGNEENIICKSNLGSITEEIVGTATKLSSRICPTMGKSWISYASWCFKQARDSLLVQRETILHSCSFSSILVPEILPERFKLTKDEVQRIKSLVLGLFQDNIDMKGFIDEQEERSSWLDSAEHSISSNPLLTLVWNIVNIIETAAGAPGAENSGGECLSAMVSSQLKICLLNTNFGLGEFDIISALDDFVDIWWSLRRRRVSLYGHAAHGYTQYLSYSSSPICHSQMHGSEYEALNQKTGSYTLRATLYILHILLNYGVELKDTLESALLVVPLLPWQEVTPQLFARVSSHPELVIRKQLEGLLIMLAKQSPCSIVYPTLVDVNAYEEKPSEELHHVLGCLRELYPRLVQDVQLMINELGNVTVLWEELWLSTLQDLQTDVMRRINVLKEEAARIAENVTLSQNEKNKINSARYSAMMAPIVVALERRLASTSRKPETPHEAWFQEEYKDQLKSAIVSFKIPPASSAAIGDVWRPFDSIAASLASYQRKSSVSLREVAPHLALLSSSDVPMPGLEKQMKVPDSGKATDLQGVVTIASFHEQVTILSTKTKPKKLGILGSDGQKYTYLLKGREDLRLDARIMQLLQAINGFLHSSSSACSNSLSIRYYSVTPISGRAGLIQWVGNVVSIYSVFKAWQTRVQLAQFLALGPANTKSSAPPPVPRPSDMFYGKIIPALKEKGIKRVISRRDWPHEVKCKVLLDLMKEVPRHLLYQELWCASEGYKAFSSKMKRYSGSVAAMSMVGHVLGLGDRHLDNILIDFCNGDIVHIDYNVCFDKGQRLKIPEIVPFRLTQMIEAALGLTGIEGSFKSNCETVIGVLRKNKDILLMLLEVFVWDPLVEWTRGDFHDEAAIGGEERKGMELAVSLSLFASRVQEIRVPLQEHHDQLLTSLPAVESALESFADILNHYELASTLYCRADQERSGLILRETSAKSILAEATSNSEKIRASFEIQAREFAQAKAMVAEKAQEAMAWAEQHGRILDALRCNLIPEINVSFKLNNMEAALSLTSAVTVAGVPLTVVPEPTQAQCHDIDREVSQFVAELGDGLTSATTSLQAYSLALQRILPLNYLSTSAVHNWAQVLQLSINALSSEILSLARRQASELIAKFHVDSIDSIKCSHDDLCFRVEKYAVEIEKLEKECAEIESSIGSESESKTKDRCLSAFMKFMQSIGLLRKEDVMSSVQSRPLGELEEEREKALSILNIAVSSLYNDVKHRIQNIYNDMSGGRNQYNMLQNDSGTIFAEFEEQVEKCNLVTEFVNDLCQFIGKDTPSVDINKVRSKFSSESNWVSIFKAILISCKGLVSQMTEVVLPNVIRAAVSLNSEVMDAFGLISQVRGSIETALEQLVEVEMERASLIELEQNYFVKVGLITEQQLALEEAAVKGRDHLSWEEAEELASQEEACRAQLDQLHQTWNQRDVRTSSLIKREADIKNALVSVNCQFQSLVGSEEERELHILRSKALLAALFKPFLELESMDIMLSAADGSVALPSSKFHTLADLINSGNSISEYVWKVGDLLDNHSFFIWKIGVIDYFLDACIHDVASSVEQNLGFDQSLNFMKKRLEIQLQKHIGHYLKERIAPSLLTCLDKENEHLKQLTESSKELALDQVKKDGAAKKVLLMLEEYCNAHETARAAKSAASLMKKQVNELKEALRKTALEVVQMEWMHDVSLNPSYNRRIRFEKYLDTDDSLYTIILNLSRSKLMDNIQSAVSKITTSMDCLQSCERNSLIAEGQLERAMAWACGGPNSSSSGNTSTKNSGIPPEFHEHIKTRRQILWESREKASDIVKLCVSVLEFEASRDGFLLIPGQPYPFRSSVDGKTWQQVYLNALTRLDVTFHSYTRTEQEWKLAQCTVEAASNGLYTATNELCIASLKAKSASGDLQSTVLSMRDCAYEASVALSAFARVSRIHTALTSESGSMLEEVLAITEDIHDVYNLGKEAAAIHLSLMEGLSKANAILFPLESVLTKDVAAMADAIARESEIKKEISHIHGQAIYQSYCLRIREACHTFKPLAPSLTSAVKGLYSLLARLARTANVHAGNLHKALEGIGDSQEVKSEDIALSRSDGGGGDAVEFDDKEGESLSRSEDDKTDDFIGFSRLSLEDKGWVSPPDSIYCSSSGSDISLAEVSLPDSLNDSAGNKDLLSQGSGSRIPTGYMHTTLLSQTDVEQISPFELSESSPVETDLNRAGSVKSINEATEHAEAISLSGDKSVAIPGNSQIPSNENLDKFDGEDELLSAKEVKNAAEHHEAPDPYINANTRVGRGKNAYALSVLRRVEVKIDGRDISENREIGTAEQVDYLLKQATSVDNLCNMYEGWTPWI

SEQ ID NO: 140458 - protein, 314 aa, Glycine max
  Coding DNA Sequence Number=SeqID_23680
  Gene Ontology: Mol. function=signal transducer activity; Biological process=G-protein coupled receptor protein signaling pathway
  Homolog annotation: Hit_ID=Q9SZ04; Match level="QueryCoverage=99%, HitCoverage=43%, E-value=1e-82, Identity=44%"; Hit description=Extra- large G-protein-like
  Pfam annotation: Domain name=G-alpha; Domain location=119-314; Score=- 223.1; E_value=0.00014; Accession=PF00503.10; Description=G-protein alpha subunit
MFCETNQIPAENVIVNGEPLDWDKLTLLLTCSNPPKGLKPGFYWYDKASGFWGKEGQRPSQIICPRLEVGGNLERNASNGKTNVTVNGREITIEELWLLKWAGVPCDGTTDFWMSHDGSYIEVGQKNVKGHIWEKAKLLYNVPLSENERQNIKLVIQSNLYRYLGLILEAREIFEESLCEKTNGQHFDESTSSGNLDAIFPAAAREYAPLVEELWRDAAIQATYKRINEIKYLPRSASYFLERAVEISRIDYEPLDMDILYAEGITLSNGLSSMEFSYTVTGHEDSLDPEYEDDPSLRYQLTRVHPKSLGENCK

SEQ ID NO: 140459 - protein, 72 aa, Glycine max
  Coding DNA Sequence Number=SeqID_23681
AEVGFEPTTYGEKYRIGCLSAAKAIPTSIPATLTSEAGTTVIWATAYGLLRRQRSGYGNIREAVYASGTCFE

SEQ ID NO: 140460 - protein, 419 aa, Glycine max
  Coding DNA Sequence Number=SeqID_23682
  Gene Ontology: Mol. function=transferase activity; Cellular component= mitochondrion; Biological process=metabolic process
  Homolog annotation: Hit_ID=Q1SQX3; Match level="QueryCoverage=70%, HitCoverage=76%, E-value=1e-77, Identity=35%"; Hit description=IMP dehydrogenase/GMP reductase
  Pfam annotation: Domain name=PPR; Domain location=169-203; Score =13.3; E_value=0.2; Accession=PF01535.11; Description=PPR repeat
  Pfam annotation: Domain name=PPR; Domain location=236-270; Score =38.9; E_value=1.7e-08; Accession=PF01535.11; Description=PPR repeat
  Pfam annotation: Domain name=PPR; Domain location=271-305; Score =44.5; E_value=3.5e-10; Accession=PF01535.11; Description=PPR repeat
  Pfam annotation: Domain name=PPR; Domain location=328-362; Score =42.3; E_value=1.6e-09; Accession=PF01535.11; Description=PPR repeat
  Pfam annotation: Domain name=PPR; Domain location=363-397; Score =46.8; E_value=7.3e-11; Accession=PF01535.11; Description=PPR repeat
  Pfam module annotation: Pfam domain module=PPR::PPR::PPR::PPR::PPR; Domain location=169-203::236-270::271-305::328-362::363-397
MKSGVGFVMALIYHTITYIVLQIGILGKREPRFLPLNFDTISCQLSVGNISVGVGWRRWNDSGSHSVNQKETRPGCPTPHPLPSLFHSNHPSPQPPAGPSPPLPSSQPPSFPRRLRPLSPPAYCELKKPNEALECFYFMKENGFVPNVETCNQMLSLFLKLNRTQMAWVLYAEEFIGHCLRGKFQRARRIFQTMIDKGLEPDCLRIIPLFLGCVKKEGLRRRLDEMISKGIMASLVTYNLFIHALFMEGRMGEADNMIKEMGEKGMMPDVVTNNILINGYCRCGDAKRAFGLFDEMVGKGIQPTLGKVEEARLLLDEMKRRGIKPDLISYNTLISGYSKRGDMKDAFGVRDEMMTTGFDPTILTYDALIQGLCKNREGEHAEELLKEMVSKGIPPDDSTYLSIIEAMEAVDDLEENDDK

SEQ ID NO: 140461 - protein, 873 aa, Glycine max
  Coding DNA Sequence Number=SeqID_23683
  Gene Ontology: Mol. function=RNA-directed DNA polymerase activity; Cellular component=chromatin; Biological process=chromatin assembly or disassembly
  Pfam annotation: Domain name=Chromo; Domain location=625-670; Score =24.5; E_value=0.00038; Accession=PF00385.14; Description='chromo' (CHRromatin Organisation MOdifier
  Pfam annotation: Domain name=RnaseH; Domain location=71-185; Score= -32.2; E_value=0.057; Accession=PF00075.14; Description=RNase H
  Pfam annotation: Domain name=rve; Domain location=319-475; Score =109.2; E_value=1.2e-29; Accession=PF00665.16; Description=Integrase core domain
  Pfam annotation: Domain name=zf-H2C2; Domain location=260-301; Score =21.8; E_value=0.00046; Accession=PF09337.1; Description=His(2) -Cys(2) zinc finger
  Pfam module annotation: Pfam domain module=Chromo::RnaseH::rve::zf -H2C2; Domain location=625-670::71-185::319-475::260-301
TLKSFLGLADFYRRFIKGYATIASPLVKATTSDALRWTADTQTAFDRLKHALSSAPVLALPDFTLPFTVETDAYGVGMGAVLSQQGHPIAYFSKPFSAKLLRSSTYVRELFAITAAIKKWRQYLLGHHFIIVTDHRSLKELLTQVIQTPEQHTYLARLLGYDYEIQYRAGAHNQAADALSRLPETTASLWVLSVPCLTFFEELQQQLQTQPDYVRKRQDIMEQPSNHPAFSISSNLILHKGRIWLPEGFHLIPTLIAEYHSTPTGGHAGIAKTVARVLENFSWPKLREDVAHFVTNCAECQCTKYETKRLAGLLCPLPVPFRPWEDLSLDFITGLPAYHGHTVILVVVDRFSKGVHLGTLPTAHTALTVASLFVDIVVKLHGVPRSLVSDRDPLFISRFWKELFRRSGTQLRMSTAYHPQSDGQTEVLNRIIEQYLRSFVHRRPHTWGKYLPWAEWSHNTSWNSATGTTPYELTFGRKPFNFLEYIAGTSAVDAVDSLLQDRDETFQLVRRKLLKAQSRMKEQADRHRRDVCYNLGDWVWLKLRPHRQTSAKGPQSSAGKLARRYYGPFKITEAIGKVAYRLQLPPDTKIHDVFHCSLLKPFHGHLDTTSFAPLPAQFHNDQPLITPAAIVDYRRTPSKAWEVLVQWHGLSPDDTSWEDWSALLNDYHLEDKVISQGPRDDRENTDHRAGVQREHSAELIPNAFVRLPQLQGRIPEDVILRNANFLVFKHDRSNEFKVVILESSTQCQKPVVKMEEENEQEQAAAQHVEDCDIEEEEDSSSKDENYDGSDSDDDEESEEEFSAGFKRQSHHRRACKRESASNSNPNAEDLLPEYVFDPEIRNEIERDDTCFCEVISGEEQGVRTLRVHVARRR

SEQ ID NO: 140462 - protein, 36 aa, Glycine max
  Coding DNA Sequence Number=SeqID_23684
MVMKGDANGRDNDCEAYGTRVVLVRDDNGNKHKPDK

SEQ ID NO: 140463 - protein, 102 aa, Glycine max
  Coding DNA Sequence Number=SeqID_23685
MDIRMKRGLASLIKTPIERGWGNGLRCFNSSSSVLKGVTTPTLLQPRVLLYDAVSHLCHREGIAPLPFVSYFFLTTQPTLYLREAAIAFAETPKTLTMWLKL

SEQ ID NO: 140464 - protein, 674 aa, Glycine max
  Coding DNA Sequence Number=SeqID_23686
  Gene Ontology: Mol. function=RNA-directed DNA polymerase activity; Cellular component=chromatin; Biological process=chromatin assembly or disassembly
  Pfam annotation: Domain name=RVP_2; Domain location=358-467; Score= -32.9; E_value=0.00037; Accession=PF08284.2; Description=Retroviral aspartyl protease
  Pfam module annotation: Pfam domain module=RVP_2::Retrotrans_gag; Domain location=358-467::99-189
MTEPPPSSADKLEELLVRLTHQQLSLTSKIDDLIHHVSPLIPLAPSFSSPLPRQFPAPVTHHRMKLDVPRFDGTDPLGWIFKINQFFEYHGTPEYERLTIASFYMEGRALSWFQWMTSNGHLTSWPVFLQALQSRFAPSQYEDPTGALCKLMQKGTVAAYQAEFEDLSNRVSGIPPAVLLSCFISGLLPEIRREVQAHQPLTLSQAAGLARLQEEKLIDHRPPPPPPPHRPRPPPPSPSNPISLRPNPLPPLLTPSPRPPPPPPPFKRLTSDEIASRRERGLCFSCDEKYHWGHRCASRVFLLLAEEEDNPNPPLIEPLDHIPEPAPDPPDTHDPYPAQLSLNSLAGHLAPETLRFVATISDRDVVLLVDGGSTHNFIQLQLVSQLGLRPMSTSPLRVMVGNGQQLECNSLCSAVPITIQTTTFHVDLYVLPISGANVVLGVHWLKSLGPVLTDYNHLTMQFFYEGNLIHLQGDMDAALSSLSSLQFRRLSRKNRDGLYYHITLLPNVDTSTQDLPPSILTLLTKYDTLFHPPNTLPPTRDTDHHIHLLPQAPPVNVRPYRYPHYQKQEIESQVDSMLQKGLIQPSSSPFSSPVLLVKKQDGSWRFCVDYRALNALTVRDRFPIPTIDELLDELGGARYFSKLDLLQGYHQIRMHPPDIPKTVFRTHHGHYEFK

SEQ ID NO: 140465 - protein, 647 aa, Glycine max
  Coding DNA Sequence Number=SeqID_23687
  Gene Ontology: Mol. function=RNA-directed DNA polymerase activity; Cellular component=chromatin; Biological process=chromatin assembly or disassembly
  Pfam annotation: Domain name=Chromo; Domain location=553-598; Score =23.5; E_value=0.00076; Accession=PF00385.14; Description='chromo' (CHRromatin Organisation MOdifier
  Pfam annotation: Domain name=rve; Domain location=247-403; Score =109.2; E_value=1.2e-29; Accession=PF00665.16; Description=Integrase core domain
  Pfam annotation: Domain name=zf-H2C2; Domain location=188-229; Score =13.2; E_value=0.0064; Accession=PF09337.1; Description=His(2)-Cys(2) zinc finger
  Pfam module annotation: Pfam domain module=Chromo::rve::zf-H2C2; Domain location=553-598::247-403::188-229
ASGVGMGAVLSQQGHPIAYFSKPFSAKLLRSSTYVRELFAITAAIKKWRQYLLGHHFIIVTDHRSLKELLTQVIHSPEQHTYLAQLLGYDYEIQYWTGAHNQAADALSRLPETTASLWVLSVPCLTFFEELQQQLQTQPDYVRKRQDIMEQPSNHPAFSISSNLILHKGRIWLPEGFHLIPTLIAEYHSTPTGGHARIARTVARVLENFSWPKLQEDVAHFVTNCAECQCTKYETKRLAGLLCPLPVPFRPWEDLSLDFITGLPAYHGHTVILVVVDRFSKGVHLGTLPTAHTALTVASLFVDIVVKLHGVPRSLVSDRDPLFISRFWKELFRRSGTQLRMSTAYHPQSDGQTEVLNRIIEQYLRSFVHRRPHTWGKYLPWAEWSHNTSWNSATGTTPYELTFGRKPFNFPEYIAGTSAVDAVDSLLQDRDETFQLVRRKLLKAQSRMKEQADRHRREVCYNLGDWVWLKLRPHRQTSAKGPQSSAGKLARRYYGPFKITEAIGKVAYRLQLPPDTKIHDVFHCSLLKPFHGHLDITSFAPLPAQFHNDQPLLTPAAIVDYRRTPSEAWEVLVQWHGLSPDDTSWEDWSALLNDYHLEDKVISQGPRDDRENTDHRVGVQREHSAEVQNMEKPKRRVMRPAYLQDYA

SEQ ID NO: 140466 - protein, 340 aa, Glycine max
  Coding DNA Sequence Number=SeqID_23688
  Gene Ontology: Mol. function=oxidoreductase activity; Cellular component=vacuole; Biological process=hydrogen peroxide catabolic process
  Homolog annotation: Hit_ID=O81755; Match level="QueryCoverage=66%, HitCoverage=70%, E-value=2e-33, Identity=39%"; Hit description =Putative Peroxidase 48
  Pfam annotation: Domain name=peroxidase; Domain location=1-202; Score= 118.5; E_value=1.9e-32; Accession=PF00141.13; Description=Peroxidase
MVNGLLLKGADMIDDIKLKLEEQCPQTVSCADTLAFTANEVMTMAGLPPRKPLGGRRDALVSLSSAADADNLPLPDWTMDQMVKLFTKKGFNIEEMVILLGAHSIGMAHCDLFIQRAYNFQNTGKPDPTLTVEAVEEFKKACPNVNTPKYRNPPVNFDATPTVLDNLFYMEMVERNRTFLITDSHLLTDQRTLPLVQQFAHDPSLFPRRFPEVMLKLGSLNVLTGNEGEIRKIYVGLHYLCHMLPNGQTPTQEQQRFKFESAVCVNNPYTTLLSLPFWVQLCFHRLLKSHAIRIHGLWTVQNCSLVLIHSNVAATGTDVREMKCSKRSLKDNCCRGGEGV

SEQ ID NO: 140467 - protein, 40 aa, Glycine max
  Coding DNA Sequence Number=SeqID_23689
MKATQIWRLADMELARLRISNGGLFITSLTVKGHESVIQK

SEQ ID NO: 140468 - protein, 102 aa, Glycine max
  Coding DNA Sequence Number=SeqID_23690
  Homolog annotation: Hit_ID=Q67VC9; Match level="QueryCoverage=66%, HitCoverage=33%, E-value=4e-21, Identity=65%"; Hit description=RNase H domain-containing protein-like
MSIYQLYFHHSAAFYVVLCVNLIVSSDSAAALRVLSHLPLPYSAFSALCVIPSPLRDGVYNYVAKRRYEWFGKADDYLVLQEKELLERFIDREELMSRDKDS

SEQ ID NO: 140469 - protein, 176 aa, Glycine max
  Coding DNA Sequence Number=SeqID_23691
  Homolog annotation: Hit_ID=Q9XGA0; Match level="QueryCoverage=18%, HitCoverage=8%, E-value=5e-07, Identity=72%"; Hit description=Ribose- phosphate pyrophosphokinase 3, mitochondrial precursor
  Subcellular localization annotation: CTP_CleavageSite=30; ConfidenceScore=5.34e-01
MLGKPSGNLLKFQLHRNYSNRNGHFQVPKIASTVTSTPTQQSNLAKWGHSKLMKNRDKKSNEPPRDVTKFNGISLRGDFLGENLGLGAVEKHDSFGIFGGELGSGGDRGDREEGRRRVGDVRIGGVFAHVGDALDGPATVALEAFDLAPQIRIEREKGSVFVGREAKQRVRVRGFV

SEQ ID NO: 140470 - protein, 259 aa, Glycine max
  Coding DNA Sequence Number=SeqID_23692
  Gene Ontology: Mol. function=pyridoxal phosphate binding; Cellular component=mitochondrion; Biological process=metabolic process
  Homolog annotation: Hit_ID=Q6D1F7; Match level="QueryCoverage=99%, HitCoverage=62%, E-value=1e-125, Identity=82%"; Hit description =Purine catabolism protein
MLQPLEQLGAICRQYGVLLYTDVTASLGGNPLETDAWGLDAVSAGMQKCLGGPSGTSPITLSPQMEAVIRQRKCVEQGIRTDAHQDGVDEMIYSNYFDLGMIMDYWGPERLNHHTEATSALFGARECARLILQEGLDNGIARHKLHGDALLKGIQGMGLETFGDLRHKMNNVLGVVIPQGINGDQVRKLVLDDFGIEIGTSFGPLHGKVWRIGTMGYNARKDCVMLTLSALESVLNHVGFRTTQGAALQAAWDHYGSHA

SEQ ID NO: 140471 - protein, 73 aa, Glycine max
  Coding DNA Sequence Number=SeqID_23693
MTQSDIHRDKHERATNTTQHNQFVAHDSSHSTDNDAVVAEIKLLMDKYAERRKRRQSILQERKKQRSATNGST

SEQ ID NO: 140472 - protein, 60 aa, Glycine max
  Coding DNA Sequence Number=SeqID_23694
MSTPRYQQKGKQGKGSQELPRLLTKAKAMADTYSAPEEIHGLLSYCQHMIDLMDHMIRNR

SEQ ID NO: 140473 - protein, 101 aa, Glycine max
  Coding DNA Sequence Number=SeqID_23695
  Gene Ontology: Mol. function=transferase activity, transferring nitrogenous groups; Cellular component=intracellular; Biological process=regulation of transcription, DNA-dependent
  Homolog annotation: Hit_ID=Q8U6P7; Match level="QueryCoverage=98%, HitCoverage=20%, E-value=1e-35, Identity=75%"; Hit description =Transcriptional regulator, GntR family
MRQKIAADILSHHIASTHSLSFCAWLKVPPRWTEDGLVRALTNQNVAVTPSEPFIAGPGHGGGIRICLGGRLNHATLIKALTTVRQTFEQLPPVYDIGSIG

SEQ ID NO: 140474 - protein, 273 aa, Glycine max
  Coding DNA Sequence Number=SeqID_23696
  Gene Ontology: Mol. function=pyridoxal phosphate binding; Cellular component=mitochondrion; Biological process=metabolic process
  Homolog annotation: Hit_ID=Q8U6P8; Match level="QueryCoverage=98%, HitCoverage=80%, E-value=1e-112, Identity=80%"; Hit description =Threonine dehydratase
  Pfam annotation: Domain name=PALP; Domain location=32-270; Score =143.7; E_value=4.8e-40; Accession=PF00291.15; Description=Pyridoxal -phosphate dependent enzyme
MTIMKSENPSISAEKSPLPVSLAAIEQAAARLAGQVERTPLVRSDNLSERCGHPVHLKLETLQPIGAFKLRGAMNAIFSLDDEARKRGLVTASTGNHGRAVAYAAAKLGIPATICMSALVPTNKVEAIRALGADIRIVGRSQDDAQEEVERLTRSHGLTAIPPFDHSDVVAGQGTIGLEVVEDMPELATILVPLSGGGLAGGIAVAVKALKPRARVIGISMERGAAMHASVKAGRPVSVQEEETLADSLGGGIGLANLVTFALCQALLDDIAL

SEQ ID NO: 140475 - protein, 96 aa, Glycine max
  Coding DNA Sequence Number=SeqID_23697
MPPTRHPLDPDKSNRALGFPALIMGLCQSFGSAGAWFRSFCCPTPEQFGVEVAWPGDWPEAQAREEPVGSPGEAEEARMDEDMTDLLGFLGGSGAT

SEQ ID NO: 140476 - protein, 96 aa, Glycine max
  Coding DNA Sequence Number=SeqID_23698
  Subcellular localization annotation: CTP_CleavageSite=58; ConfidenceScore=5.27e-01
MSLPSTVHVFSTFESGAPQMSLPSAIHVSCTFESGAPRIDVHVSSTFESGAPQMSLPSAVHVSSTFESGAPQMSLPSVVRQFSILHFFRSPMNVIA

SEQ ID NO: 140477 - protein, 231 aa, Glycine max
  Coding DNA Sequence Number=SeqID_23699
  Gene Ontology: Mol. function=DNA binding; Cellular component=nuclear pore; Biological process=DNA integration
  Homolog annotation: Hit_ID=Q1SLU3; Match level="QueryCoverage=97%, HitCoverage=16%, E-value=7e-62, Identity=50%"; Hit description =Integrase, catalytic region
MDPTLKFHKSSGIPFFDPTVYKRLMGRLLYLTHTRPDICYAVGKLSQYLKSPTNIHMQAAHHILKYLKDTVGRGLFFSSSSSTSLIGFSDSDLGACLDTRRSITSICFFLGTSLISWKKAKYRALAQASYEAQWLLFLLKDLHIEHPKPVVLYCDNQVALHTAANPVFHERTKHIEINCHVVRDKVQSDLIHLLPISTYEQLADILTKPLHAGLFNHIHSKLGMLDIHIRA

SEQ ID NO: 140478 - protein, 56 aa, Glycine max
  Coding DNA Sequence Number=SeqID_23700
MNEVSSWGGAANGISGIDVPPLTEAGTAGGAAIDSSGTGVSEGIVIVLTELPRLNS

SEQ ID NO: 140479 - protein, 447 aa, Glycine max
  Coding DNA Sequence Number=SeqID_23701
  Gene Ontology: Mol. function=DNA binding; Biological process=DNA integration
  Homolog annotation: Hit_ID=Q1S1E0; Match level="QueryCoverage=90%, HitCoverage=71%, E-value=5e-60, Identity=47%"; Hit description =Integrase, catalytic region
MADNVVVNNAAFANLLNPYYTHPNENPSVAIIAQVLYGANYHSWSCAMLLALKTKKKVQFVDGFLPRPALNDPNFTIWDHCNTLVVSWLHHSLNLDILQTIMWMETALDIWNTLKKRYYQGDVFRISDLQEEIYLLKQVDTSHATYGRGRGRGGYTSGGRGRGHMVDTCYKKHGYPPHLHRGGAINQYSMDDQEIEDNLQSLGQKEQTSQASPSHTTNQLVSFHKNGNSGIFCATLHAYSSNINSWVLNSGATDHAIQSELSSLIKTNTWKLTPLPRNKKPIGCKWVFKIKFKADGSIDRHKARLVAKGFTQIAGLDYIETFNPVVKMTTVRLVLSLAASQGWHLHQLDVNTAFLHGDLNEEVYMKIPPGLTVNNPALVCKLQRSLYGLKQVSRQWNAKLTSTLLDFGFQQSKADYSLFTKRSPTGLTIVLVYVDDLVLTDTDLAEI

SEQ ID NO: 140480 - protein, 178 aa, Glycine max
  Coding DNA Sequence Number=SeqID_23702
  Gene Ontology: Mol. function=hydrolase activity; Cellular component =vacuole; Biological process=cell wall catabolic process
  Homolog annotation: Hit_ID=Q1SCU0; Match level="QueryCoverage=77%, HitCoverage=56%, E-value=4e-48, Identity=64%"; Hit description =Glycoside hydrolase, family 19
  Pfam annotation: Domain name=Glyco_hydro_19; Domain location=58-178; Score=39.1; E_value=1.1e-12; Accession=PF00182.9; Description =Chitinase class I
MMGNKVHDIGVTGVMMSALVLMMVSKGVRAQNCGGCKQGPCYSTGTAKPNDDDSVADIVTPEFFNAIIDEAEDHCAGKNFYSRDAFLDALIAYNHFARTASSYDSKREIAAAFAHFTHETRRFCYLGEIEGASKNYCGKTTKKYPCAHDKGYHGREPIQLSWNFNYAWESWIGYGGGQ

SEQ ID NO: 140481 - protein, 116 aa, Glycine max
  Coding DNA Sequence Number=SeqID_23703
MNSSKACTLLNLIMLVVMLVAIFISQSRVEARVLSHSEEFAFARANNLQTYSSSAYEQAKKTMGFWMQRLASGPSPKGPATFYGFNIDVNIVLANDCHTKAINYLLALPDLFHYIP

SEQ ID NO: 140482 - protein, 87 aa, Glycine max
  Coding DNA Sequence Number=SeqID_23704
  Gene Ontology: Cellular component=chloroplast
  Homolog annotation: Hit_ID=Q8S0J7; Match level="QueryCoverage=90%, HitCoverage=15%, E-value=5e-13, Identity=58%"; Hit description =Probable membrane-associated 30 kDa protein, chloroplast precursor
MYGTGKAQLALQKGEEDLAREALKRRKSYALKLLESLDDDTTDFTVADSLKCFHMYISTHDNASSLKAQLDQQKTVVENLVSNTRQK

SEQ ID NO: 140483 - protein, 176 aa, Glycine max
  Coding DNA Sequence Number=SeqID_23705
LFIFQQQKVYTDNHSGISARQRDSKVSMTDLVSAEDDVNSACQQRDSKVSMTDLVSAEDDGAEDDLCLCVVSAFSSYRQQKVYTDNHSGISARQRDSKVNMTDLVSAEDDAFRLTDSKKFIRITTRVFPPVNGAEDEVSLCVLLGFSSYRQQKVYTDNHSGISARQRDSKVSMTDL

SEQ ID NO: 140484 - protein, 371 aa, Glycine max
  Coding DNA Sequence Number=SeqID_23706
  Gene Ontology: Mol. function=Rab GTPase activator activity; Cellular component=intracellular; Biological process=regulation of Rab GTPase activity
  Homolog annotation: Hit_ID=Q1SQV0; Match level="QueryCoverage=95%, HitCoverage=71%, E-value=1e-142, Identity=73%"; Hit description =RabGAP/TBC
  Pfam annotation: Domain name=TBC; Domain location=172-363; Score= -61.5; E_value=0.0034; Accession=PF00566.9; Description=TBC domain
MNKRQEDLRNIATTLDSRFNQTLRNVQGLLKGRSIPGKILLSRRVDPPDNSNSKISSPNYKRSFSHNDAGTSDNTSGAVEEEFQSKSKPISIANANKLKVSTSLGGSPPEEFHKSTMGARATDSARIMKFTKVLSGTVVILAIKPFGNLGLSTTIKHFLLEIYIVDKLRELAWSGVPDNMRPKVWRLLLGYAPPNSDRREGVLRRKRLEYLDCISQYYDIPDTERSDDEVNMLHQIGIDCPRTVPDVPFFQQQQVQKSLERILYAWAIRHPASGYVQGINDLVTPFLVVFLSEHFEGDIDNWSMSDLSSDIISNIEADCYWCLSKLLDGMQDHYTFAQPGIQRLVFKLKELVRRIDGNTFLRTFCFPPSIV

SEQ ID NO: 140485 - protein, 256 aa, Glycine max
  Coding DNA Sequence Number=SeqID_23707
  Gene Ontology: Mol. function=peptidyl-prolyl cis-trans isomerase activity; Cellular component=chloroplast thylakoid lumen; Biological process=protein folding
  Homolog annotation: Hit_ID=Q1SQV1; Match level="QueryCoverage=99%, HitCoverage=98%, E-value=6e-97, Identity=74%"; Hit description =Peptidylprolyl isomerase, FKBP-type
  Pfam annotation: Domain name=FKBP_C; Domain location=117-246; Score =88.1; E_value=2.7e-23; Accession=PF00254.18; Description=FKBP-type peptidyl-prolyl cis-trans i
  Subcellular localization annotation: CTP_CleavageSite=38; ConfidenceScore=5.52e-01
MASSLLLQLGSTCGKSPSFAPPQSILVDKLRRLVIKVKSSETRECTTAMFNANSRRDFLGLALGVSGLFIGSLDANGAGLPPEEKPKLCDDTCEKELENVPTVTTGSGLQYKDIKVGQGPSPPIGFQVAANYVAMVPSGQIFDRSSLLTLITIICVLSCLHFDKNEFEAFEDDIGSSLEKGQPYIFRVGSGQVIQGLDEGILSMKVGGKRRLYIPGSLAFPKGLTSAPGRPRVAPSSPVIFDVSLEYIPGLEVDEE

SEQ ID NO: 140486 - protein, 115 aa, Glycine max
  Coding DNA Sequence Number=SeqID_23708
  Gene Ontology: Cellular component=chloroplast
  Homolog annotation: Hit_ID=Q03943; Match level="QueryCoverage=98%, HitCoverage=39%, E-value=2e-25, Identity=54%"; Hit description =Membrane-associated 30 kDa protein, chloroplast precursor
  Subcellular localization annotation: CTP_CleavageSite=46; ConfidenceScore=5.70e-01
MAAKLQIFTGLPPAPFQSSSSTLCVLKKPLTTSFFGTARVEVLKLRVMRIAKPARGGGALGARMNLFDRFARVVKVKKALKRQSLSFNILIVVVVMVLASQKRLENKYKAAQQAF

SEQ ID NO: 140487 - protein, 100 aa, Glycine max
  Coding DNA Sequence Number=SeqID_23709
  Subcellular localization annotation: CTP_CleavageSite=40; ConfidenceScore=5.21e-01
RPFSPASSCRRGIGSACRPQQGHQVPPTNRAFIKKFCVSRQAQGETPQQPGDGRQRATDAPPSPLEFTSAHPQKGLSIAYTTWPTNRRPSPKPKDAPSCS

SEQ ID NO: 140488 - protein, 181 aa, Glycine max
  Coding DNA Sequence Number=SeqID_23710
  Gene Ontology: Mol. function=nucleic acid binding
  Homolog annotation: Hit_ID=Q1SK64; Match level="QueryCoverage=63%, HitCoverage=11%, E-value=4e-21, Identity=42%"; Hit description =Transposase
VFPTYEDVLQWARIIAYDIGFVTVIMRSDTSTRKKGRILSILIGCERSGKYRPHKKDLVPTTHPDAIKLSNACHLVFLINSTYKTNRYKLSLLDIVGVTPTGMTFLATFSYLEGECIKNVVWALKRFRGIFLKSDAIPQVIVIDRDSTLMNVVKTMFPESTNLLCRFHIDKNVKAKCKPLR

SEQ ID NO: 140489 - protein, 221 aa, Glycine max
  Coding DNA Sequence Number=SeqID_23711
MVPVELLWRGMSLVVMLAALVPFRPSTVVHVIETPHLARFLVGRQASYLTRKQPGHFLYYTGSRIGHPGPSIALIGALSWSSLALAPLTDLRPPDQVRIPILCHSRKGVGGATTARLASAAICEDPSAGGCLVPSAVVFVFAMKSTIQMDLRMRSQTALPGLTARKLPENEPGHVLPCISLEPQKVSPRSSLLWLNTSLTYAKESSSENKHPGWLSSSEAP

SEQ ID NO: 140490 - protein, 74 aa, Glycine max
  Coding DNA Sequence Number=SeqID_23712
MGDLAGKFQAQDNDFLSLWNVLGFELPGMPFLAALKPTIGAEAIESALVVWGLGSTTIDLESPIYGLLCDSIWV

SEQ ID NO: 140491 - protein, 106 aa, Glycine max
  Coding DNA Sequence Number=SeqID_23713
MALGRFENVVAVAEKASILDCSNAEGLKYDNSNYVLYCNRAISDGTEIMQYMLDSIIYQRESCQDIKQHERLLLTSIATQIQTYSSWSCVPVFDFIMGSRTLHSTE

SEQ ID NO: 140492 - protein, 73 aa, Glycine max
  Coding DNA Sequence Number=SeqID_23714
MKKRKLKEENKRKALEAESAKEELLLRKRRREERRDKYRKEDKQNKKIRRAEGCLDSYACAPLLHLIMHDVKY

SEQ ID NO: 140493 - protein, 70 aa, Glycine max
  Coding DNA Sequence Number=SeqID_23715
MWTTTAFEEVTETHGLRKNTSFRLPPHYGISRIAQACFLLISETPRDFIYCATKDAKYLKAANQRLHVIQ

SEQ ID NO: 140494 - protein, 302 aa, Glycine max
  Coding DNA Sequence Number=SeqID_23716
MDGMLSHEENCLGHADFLVFKHDRSNEFKVLILESSTQCQKPVVKMEEENEQEQAAAQHAEDCDIEEEEDSSSKDENYDDDSDDSDFDDDEESKEEFGAGFKSQSHHRRACKRETASSSNPDAEDPLPEYVFDPEMCIQRENHFFKAKLYRTRPNELHIPGNSIQEFSLTFPENYVTLICCQPCQRKDIPMNELGDYHHNLTQQTHIRKKYQEVTGRVCRWQDRICIKGWASFSKRNKIERNDTCFCEVISGEDQVNFVRRMECESSARVLEEESEQEEDLLQHSRVMEKRKADENKIKADR

SEQ ID NO: 140495 - protein, 111 aa, Glycine max
  Coding DNA Sequence Number=SeqID_23717
MAAQLIHDRVEMECLEGAWETLEGNMRCRFRGTIRFTTTLLVHPDEPARTLQRTVEWILPTPTPYRLVEPVQVIEVTSSEEDPEDVMSASEADSSEDSGPGEMAISGGSSS

SEQ ID NO: 140496 - protein, 157 aa, Glycine max
  Coding DNA Sequence Number=SeqID_23718
GEIVKTLHFMVSPVRRKRSVETRGLARRRQTVDAAPYSLPLMPKREHGMYYTPPVFTQEPSQMAPMYSYPHDFQPGYNMTGIFGSSPPSGGTPSFTQNNELSTPNAPLSGPWNVPGNIPDMDDLLGVDLRHDFSTEAGEVDERGNRRRRNPDRAARN

SEQ ID NO: 140497 - protein, 95 aa, Glycine max
  Coding DNA Sequence Number=SeqID_23719
DQGVLMNPKRLKVIPEWPTPPTPLIKLVRNHVPSWEDAQEMGFQTLPYFNIPNTTNTYVFVLFTSVEGRSPEYEEPRDLRSNPFQGGGNLMEAFL

SEQ ID NO: 140498 - protein, 1210 aa, Glycine max
  Coding DNA Sequence Number=SeqID_23720
  Gene Ontology: Mol. function=zinc ion binding; Biological process =regulation of transcription
  Homolog annotation: Hit_ID=Q7X9C0; Match level="QueryCoverage=76%, HitCoverage=98%, E-value=0.0, Identity=62%"; Hit description=NIN -like protein 2
  Pfam annotation: Domain name=PB1; Domain location=844-926; Score =88.0; E_value=2.8e-23; Accession=PF00564.15; Description=PB1 domain
  Pfam annotation: Domain name=RWP-RK; Domain location=584-629; Score =63.2; E_value=8.4e-16; Accession=PF02042.6; Description=RWP-RK domain
  Pfam module annotation: Pfam domain module=PB1::RWP-RK; Domain location=844-926::584-629
MEDHVSPEGKEVSCCTPPGAQLEEPTSVDGGMKKSASEDMFSNFSELMNFDTYAGWSNSPSMTDQSLANVFSSFSLAPYPVPDVLNLVEHGNGPFFMTEDSEIHNDMESAPSCGERIIFQQMDFQLGFLDEANDSNSLDSKQKPNGTSQEVNTTDMCNYIISSSPGRSLDDRMLRALSFFMESADGGMLAQVWVPIKHGDEFILSTSEQPYLLDPKLAGYREVSRAFTFSAEGKTQSCPGLPARVFISHVPEWTSNVGYYNKTEYLRLEHARNHEIRGSIALPISDVHSQVPCAVLELVTTKEKPNFDRELEIVSQALQCLSSNKRAALTEIIDVLRAVCHAHRLPLALTWIPCCYSEGIRNETDRIRIKEGHTSPNEKCVLCIEESACYVNDGAVEGFVHACVEHHLEEGQGIAGKALQSNHPFFYTDVKTYDIGEYPLVHHARKYNLNAAVAIRLRSTYTNDDDYILEFFLPVNMTGSSEQELLLDNLSSTMRRICKSLRTVSDAELTGIEGSQGGFPKEKVSGFFPMSRRNSQIAFISDDHDSVLKMSLKASNMRNNGIEAVHSQTMNGSRKQVEKKRSTVENNVSLSVLQQYFSGSLKDAAKSIGGETPKQHGISRWPSRKINKVNRSLKKIQTVLDSVQGVEGGLKFDPYTGGFIAGGSIMQETEAHKYLVFPEKSSVKDPKPATQKKVSVAPAPASTIENSTIKLNDDEGVCLVGNKLVHSRSIPNSNSGEGELKKDNVSSDDSKSMTMNDGSCHKACHWKKTKDCPEQTCSMSLVTDEVEVGVDRVEGADEHNHPTSSSTTNSSNGSGSMMHGSSSCSHENQKYSKVKSNCVDSGSKMIVKASYRGDTIRFKFDPSSGCFQLYKEVATRFKLQNGSFQLKYLDDEEEWVMLVNDSDLQECTEILDDIGTRCVKFLVRDVPCVLSSHGSNTPPKPWEKAASSSGPAPFKPPSAGSTSDVVEASGTAKPGEIVPASDKTATVNRNALGRPLPTRPWEQNNGSTSYGGYGSTMNYNSGYGSYGGVGGLYGGGMYGSSMYRGGYGGLYGSSGMYGGGMYNGGFGGPMGGYGMGGGGPYGAEDPNNPYGVPSSPPGFWISFMRVMQGVVNFFGRISMLIDQNTQAFHMFMTALLQLFDRSGVLYGELARFVLRLLGIRTKPKKINPPGPDGLPLPGQHNSSVNQNFIEGTKPAPSGSWDNVWENDAKK

SEQ ID NO: 140499 - protein, 622 aa, Glycine max
  Coding DNA Sequence Number=SeqID_23721
  Gene Ontology: Mol. function=RNA-directed DNA polymerase activity; Cellular component=chromatin; Biological process=RNA-dependent DNA replication
  Pfam annotation: Domain name=RnaseH; Domain location=440-568; Score= -1.9; E_value=8.7e-05; Accession=PF00075.14; Description=RNase H
MAHHRGITNKDANENLKQNKKMSPPNKSKGIFYWKTFKRLEVSSDTVQPHCGPFLGFAGEKVETRGYADLMTIFGQGQLSRSFTVKKTLNELGAIVSTLHLKMIFLTLTGQIITVKLDQKQTRQCYAKNLKMAPYPPIREPSRPHPTVGGSSQVMSVGEVSLIQTLTVYEASLGDHEGVFNIEPRDDTVDKGLKPIKELIKNANLFAWQPSDMPNIHPSILYHKLAICPQAKPVSQKKRKNGEERCKDAYPLPNIDRLVDGVSGFQVLSFLDAYSGYNQIKMHASNEEKTTFINEDVNFCNKVYVDDMVAKSYGIALHVADLEEFLPKLVEKAKSLYKLLKENEPFICDKAYKQAFLSFKKTIVTPPILSRPRPGAPLLLYLLVSNEVVSSPLVQEYMKHQLPIYFTNCILHNAEKQYQIIEKVLRKPELSLLAMTKPPPDWWNLYVDDASNMKESGVGIILEGLDNVTLEQALKLNFKVSNNQVEYEALIVGLKLANEVGAKKLRCYIDSQLVQGQVANKYQTKETVLPRYYHTAKTLIDDFDFFKMYHIPRESNTKENLLSKLASTKNIGNLKTIIQETLQALTIDTKEVMAGEEEEPDWMTPYKNFLIRGVLPPGENKA

SEQ ID NO: 140500 - protein, 499 aa, Glycine max
  Coding DNA Sequence Number=SeqID_23722
GQPATRFNPNDEVVEVSPNVPSSILAKWKHDDGARVSGYKKSRPPFNLRAMKQAGLPSAIQDTVVAHAPLTLPSLLVQEVFASPPIMVTAPVSLVGPIVAHLSTIVMTTTAPKMLPHFSSAPPVPPLVVLAFSSSRPSLSPEKSGDSRGKWTKALGGTKQVERPKVANATVAFDDIVIADLEAQLKELESRLDEYELRASKAREANKELQEELMVFKKAVVEQHKKGFYKVVKQVEFFAEDLDLGLFDSFKEVKDGELPDKEEIAIAKEDAGETNLGFNDPLEKRDSPRGDVGFYELLEKRDSPRVNLGFDKPLEKQDSPRADLGYEEPLEKRDSPRADLGFDEPLEKRPGMHPSWVLARLTNGRPWFHPHVLFVVLFLEQQPPCRQFPNFDGDYGISVTLGLVESGAQGVKDNPISCLRLTISLGVFDRGYNVLDTWHCQKFFVNFSTSLAEISCNGLVMQSYPARALARRLQVDWARDPRKGPRVLMSLRVDFEPMG

SEQ ID NO: 140501 - protein, 219 aa, Glycine max
  Coding DNA Sequence Number=SeqID_23723
MDREVIPIGGSSSEETHHGASNSESSSSERLADLRNVSGGTSHLRRRARPFAASLDREPALVTMILPPSASVGIRRSGGKDIRVSPRTRRSHNVGSPSTLPAVAGYEWVRDKVLKYRSFITFAVSVNALQGQLRLASLEESCKMVAQACGSDDFPFLRVASGKIGWVSLNKVSKKLLEFNSNVFHHFKDCIFKVLATNIVVDGLPLMFNRDRESHFLFY

SEQ ID NO: 140502 - protein, 60 aa, Glycine max
  Coding DNA Sequence Number=SeqID_23724
MNWCYSRCRHNDLHCHHCHCRHRCAGPVVEVAKMMAMTVIIAVVNDAHGGDNDNSDGGGS

SEQ ID NO: 140503 - protein, 131 aa, Glycine max
  Coding DNA Sequence Number=SeqID_23725
  Gene Ontology: Mol. function=DNA binding; Cellular component=nucleus; Biological process=DNA integration
MTSSKPVRTPLTIFILLLELNTIQSKLEKEYMSCVPYASVVGSLMYLKGTTDIELIYHGDLSCAFVGYSYSDYVANLDARRFVTGYTFTIGNSLVSWKATLQPTLALSTTEVEYMALAEANKGRNLAKGFN

SEQ ID NO: 140504 - protein, 159 aa, Glycine max
  Coding DNA Sequence Number=SeqID_23726
MSVIIKKGENVNHAEESNKVASKDKHCFKINTRLLQQTKPCFKINSRSSLASKQSVSETSKALARERYSKRTSLSNAFSTTLGQTLANLLRVHPGTSNYIIHSEGEKSFCSSQKVNCNQEIGCLLNCEFPEHKGKGFLGCSEVVKRIFTKIVENLKWVA

SEQ ID NO: 140505 - protein, 127 aa, Glycine max
  Coding DNA Sequence Number=SeqID_23727
MEDLEDVVIFTSRVQGKSKIFREMNVLVFKVVQEMPFTMTDKITHIGFYSAKQIIIKCFDQECEKYHKKGGKRVFSLVFLDPNSPRLASGLPRPPNSFTVKKSARLGELIASTLSFSSPEQAATAPK

SEQ ID NO: 140506 - protein, 204 aa, Glycine max
  Coding DNA Sequence Number=SeqID_23728
  Gene Ontology: Mol. function=DNA binding; Cellular component=nucleus; Biological process=DNA integration
  Pfam annotation: Domain name=rve; Domain location=2-136; Score=-1.6; E_value=0.0081; Accession=PF00665.16; Description=Integrase core domain
  Pfam module annotation: Pfam domain module=RVT_2::rve; Domain location=39-204::2-136
MLDYIHFDCWRPSRVPSLGGARYFPPIIDDYSRMTWVFMMKHKFEAFKTFKHWMILMKNQTVKDEDIVRPHIVCYTSQQNGVAERIDKTLLEKVFGCPKYYHVSEGKLKPRRVSLWAMEMESKDSKSGLHLKDRYIRSAYDSCVYHSKVEDGSYIYLPLYVDDMLITSQNLLVIQKLKSLLSSEFETKDMEIVEKIMGMEIKRD

SEQ ID NO: 140507 - protein, 85 aa, Glycine max
  Coding DNA Sequence Number=SeqID_23729
  Homolog annotation: Hit_ID=Q38M59; Match level="QueryCoverage=37%, HitCoverage=16%, E-value=5e-08, Identity=81%"; Hit description =NtSar1 protein-like
MMLFAKTAIAMLGDLADTLGSNTGPLIQQKAETILTQTNFVHKEFMPLQEEELSMRKIKFKAFDLGGHQIASRVWKDYFAQLTET

SEQ ID NO: 140508 - protein, 92 aa, Glycine max
  Coding DNA Sequence Number=SeqID_23730
MRLSQGDAIKISVAWGDSAQCYSDLNQGRGGACRFGSWLGGGSLVLVDLIRVVTSGMGEDGNVAHQQRWYKGEIVVCLVKMVVVCGGFGFCG

SEQ ID NO: 140509 - protein, 117 aa, Glycine max
  Coding DNA Sequence Number=SeqID_23731
MGNGNADSLLRKLLTDILAVTSVLKMKAIAKSKAKEEEKKVEAGVTFFLVQITGHFLPEEDDKFLEKVQAAVEEEEREALAAVETDAAKDAIATAEESRKAIQNQGKLSKRGNDDSE

SEQ ID NO: 140510 - protein, 124 aa, Glycine max
  Coding DNA Sequence Number=SeqID_23732
MTSTLPHSMAGLSNLLSWDFVHANMDLVNKLCDWGIWDMRNSMRGGERARSEETVADAAISPTETSDPTKTTDMGEIMEFMYFMVVVSSTGRNLGHLRDYDDTKPQTLPLNSSSNNTMLKFLRP

SEQ ID NO: 140511 - protein, 232 aa, Glycine max
  Coding DNA Sequence Number=SeqID_23733
  Gene Ontology: Mol. function=DNA binding; Cellular component=nucleus
MANPSGNHEEEQTTHVASSFNGNLAPDTSPTALAMKHNPGIALDWTLQEQTILEEGLSLFASEPNLTRYAKIAQNLNNKTVRDVALRVRWMNKKENCKRRKDDFPRKSKDKKVSDPAVRSSHFTAQPNVSPYALAMTMMDNDDGISHIAIGGPTGELLEQNAQALNIISTNLAALQFQGNVNLFSQTRDNIVKILNDMNDMQEAMKQMPPLPFKINETIFNSILSKTNQHMQ

SEQ ID NO: 140512 - protein, 120 aa, Glycine max
  Coding DNA Sequence Number=SeqID_23734
  Subcellular localization annotation: CTP_CleavageSite=53; ConfidenceScore=5.52e-01
MYSLTCTPLSSSSYSHHTTLKPNLNPLLGADATSRPCSLPLKRRTCFTTKAILSSTREDVLKHFNERRALKGGATLLDIACDPELVNLAIDLTSCPYAVRDKIIHPIKVEVRRSLNFSGK

SEQ ID NO: 140513 - protein, 46 aa, Glycine max
  Coding DNA Sequence Number=SeqID_23735
MPRYKDESPAVRVYTVYVIRGLELEAVVSLDLLADVMGKALELGSI

SEQ ID NO: 140514 - protein, 422 aa, Glycine max
  Coding DNA Sequence Number=SeqID_23736
  Gene Ontology: Mol. function=unfolded protein binding; Cellular component=endoplasmic reticulum; Biological process=protein folding
  Homolog annotation: Hit_ID=Q1S678; Match level="QueryCoverage=79%, HitCoverage=79%, E-value=0.0, Identity=85%"; Hit description =Concanavalin A-like lectin/glucanase
  Pfam annotation: Domain name=Calreticulin; Domain location=27-339; Score=493.1; E_value=3.2e-145; Accession=PF00262.8; Description =Calreticulin family
MANGNNISHFFKLLLFLLTFHSCLAEIFFQERFEDGWKSRWVLSDWKRSEGKAGTFKHTAGKWSGDPDDKGLQTYNDAKHFAISAKIPELSNKDRTLVVQYSIRFEQDIECGGGYIKLLSGYVNQKKFGGDTPYSLMFGPDLCGSQTKKLHLILSYQGQNYPIRKDLQCETDKLTHFYTFILRPDASYSILVDNRERDSGSMYMDWDILPPRKIKDVKAKKPSDWDDREYIEDPNDVKPEGYDSIPAEIPDPKAKKPVDWDDEDDGLWKPPKIPNPAYKGPWKCKKIKNPNYKGKWKIPWIDNPEFEDDPDLYVLKPIKYVGIEVWQVKAGSVYDNILICDDPQYAKQVVDEYMASNREALGIIVSAFSLCVKSQAEKEAFEEAEKERRAQEDEEARRAREEGERRRKERDHKYGKRRHRRR

SEQ ID NO: 140515 - protein, 412 aa, Glycine max
  Coding DNA Sequence Number=SeqID_23737
  Gene Ontology: Mol. function=protein binding
  Homolog annotation: Hit_ID=Q53LS9; Match level="QueryCoverage=95%, HitCoverage=80%, E-value=7e-66, Identity=40%"; Hit description =Expressed protein
  Pfam annotation: Domain name=DUF525; Domain location=255-408; Score =24.0; E_value=1.7e-08; Accession=PF04379.5; Description=Protein of unknown function (DUF525)
MEQKTLDDRHIVYAKVQMMFLECYQAWRGAFVMYPWSLVKRVKRCWDKIKTWLTNNFPEAEATLCKGATEADIQELENVLKVKLPLPSRILYRFHNGQEIAKADPETTTYGSSLGLIGGYSFYSHLVNVYLLPIRQIILETKQTRRHLSFLRRSKYVLVAASSTYSRKLFFLNCTNGQLYVGTRDLLTEGDIIPCVPHDLINLHQELNISEQQDAMLLWLEEHGRRLEHGFIKLHDKGNGKSINLFPEEPPLCSMAVTNGVKVRASALVIPELIDLQDDLEKYLFAYSIRLSLEPQGCTINGMSFSSCQLHWRHWIIRANDIVISDVNGEAVIGQVLKNLSIRVACIYQHHQVPLKVLLHLYPADTWWNLWDEMKIQWEKISDRWFRLADPKGDPFLATVARFPLQLPDYIF

SEQ ID NO: 140516 - protein, 1028 aa, Glycine max
  Coding DNA Sequence Number=SeqID_23738
  Gene Ontology: Mol. function=nucleic acid binding
  Homolog annotation: Hit_ID=Q52ZH7; Match level="QueryCoverage=61%, HitCoverage=99%, E-value=0.0, Identity=65%"; Hit description=FPA
  Pfam annotation: Domain name=RRM_1; Domain location=21-86; Score =54.2; E_value=4.2e-13; Accession=PF00076.12; Description=RNA recognition motif. (a.k.a. RRM, R
  Pfam annotation: Domain name=RRM_1; Domain location=248-314; Score =26.2; E_value=0.00011; Accession=PF00076.12; Description=RNA recognition motif. (a.k.a. RRM, R
  Pfam annotation: Domain name=RRM_1; Domain location=98-163; Score =65.5; E_value=1.7e-16; Accession=PF00076.12; Description=RNA recognition motif. (a.k.a. RRM, R
  Pfam annotation: Domain name=SPOC; Domain location=542-638; Score =81.3; E_value=3e-21; Accession=PF07744.3; Description=SPOC domain
  Pfam module annotation: Pfam domain module=RRM_1::RRM_1::RRM_1::SPOC; Domain location=21-86::248-314::98-163::542-638
MPLPAKPMRDFDESAPPSNNLWVGNLAADVTDADLMELFAKYGALDSVTSYSARSYAFVFFKRVEDAKAAKNALQGTSLRGSSLKIEFARPAKACKQLWVGGISQAVTKEDLEAEFHKFGTIEDFKFFRDRNTACVEFFNLEDACQAMKIMNGKRIGGEHIRVDFLRSQSTKRDQLLDYGQFQGKNLGPTDAYSGQKRPLVRVLCNMHLVASLSLHCLSPAHLFVIALLDHSQPPMGRKGDSQPSNILWIGYPPAVQIDEQMLHNAMILFGEIERIKSFPSRNYSIVEFRSVDEARRAKEGLQGRLFNDPRITIMYSISDLVPGSDYPGFFPGSNGPKPDVLLNDHPFRPLQMDAFGHNRPMGPNNFPGQLPPSGIMGPNIPMRPFGPHSGVESVISGPEFNEINALHKFQDGSSKSSMGPNWKRPSPPAPGMLSSPAPGARLPTRSTSGAWDVLDINHIPRDSKRSRIDGPLPVDEGPFPLRNIDDRGLALEQTYGIDPAIDGGGSGPYVNIQGKSHLGPVSSRITAGVHGVAQPDIDHIWRGVIAKGGTPVCRARCVPIGKGIGTELPDVVDCSARTGLDILTKHYADAIGFDIVFFLPDSEDDFASYTEFLRYLSAKNRAGVAKFVDNTTLFLVPPSDFLTRVLKVTGPERLYGVVLKFPPVPSSAPMQQPSHLRVPTTQYMQQIPPSQTEYGLIPVKEEHILPMDYNRPLHEDSKLPAKPVYPPTGGPPPVHSGPPDYAPNNTVAGSQAGVALTPELIATLASFLPTTTQSPATDGAKSAVGSSTMKPPFPPMTPNDGNQSHLWKQDNQIADQSTHPPQQLRSMYNIHNAHYQPYPPASAPSGNPSQVVSGSSHIQDTAASMQQQGAVSSRHMPNFMMPTQSGQVAVSPHASQNYQVEVSPSNQKGFGVVQGTDASVLYNSQAFQQPNNNSLAFQQPNNSFALSNQVNSTNASQQQTAMPYTVDQVNPDTPNQQLPMFGVSQGQTEVEADKNQRYQSTLQFAANLLLQIQQQQQQAPGGHGPGQ

SEQ ID NO: 140517 - protein, 347 aa, Glycine max
  Coding DNA Sequence Number=SeqID_23739
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=O22856; Match level="QueryCoverage=98%, HitCoverage=60%, E-value=8e-92, Identity=52%"; Hit description =Putative sterol dehydrogenase
  Pfam annotation: Domain name=3Beta_HSD; Domain location=17-288; Score= 312.8; E_value=6.1e-91; Accession=PF01073.9; Description=3-beta hydroxysteroid dehydrogenaseisomerase family
  Pfam annotation: Domain name=Epimerase; Domain location=16-252; Score= 55.6; E_value=1.6e-13; Accession=PF01370.11; Description=NAD dependent epimerasedehydratase family
  Pfam annotation: Domain name=NAD_binding_4; Domain location=18-237; Score=-42.1; E_value=6.5e-06; Accession=PF07993.2; Description=Male sterility protein
  Pfam annotation: Domain name=NmrA; Domain location=16-281; Score= -106.8; E_value=0.051; Accession=PF05368.3; Description=NmrA-like family
  Pfam annotation: Domain name=RmlD_sub_bind; Domain location=15-296; Score=-186.2; E_value=0.042; Accession=PF04321.7; Description=RmlD substrate binding domain
  Pfam annotation: Domain name=adh_short; Domain location=14-150; Score= -58.8; E_value=0.041; Accession=PF00106.15; Description=short chain dehydrogenase
  Pfam module annotation: Pfam domain module=3Beta_HSD::Epimerase::NAD _binding_4::NmrA::RmlD_sub_bind::adh_short; Domain location=17 -288::16-252::18-237::16-281::15-296::14-150
MAVVDDRFADLNPKTCVVLGGRGFLGRSLVLRLLKLGNWIVRVADSAQSLQLHHSESLLEQALSSSRASYFHVDLLDKRSIVKVLEGSSVVFYMDVAGVDVNNFYTCYKLMVQGAKNVISACRECRVRRLIYNSSADVVVGGLHDIRDGDESLAYPWKTNNTLSDLKAQAEALILSANDIDGLLTCSLRPSNVFGPGDTEFVPYFLKLARYGFSKFIIGTGDNLSDFTFSENVTHAHICAEEALNFQTVSVAGKTFFITNLEPMKFWEFLSLLLEGLEYQRPFIKLPAKLVQYILSVLKWVHEKLGSRYFSYPLLVHFFQLASYTRTFNCMAAQKDIGYSPIVSLEV

SEQ ID NO: 140518 - protein, 347 aa, Glycine max
  Coding DNA Sequence Number=SeqID_23740
  Gene Ontology: Mol. function=hydrolase activity; Cellular component =mitochondrion; Biological process=methylglyoxal catabolic process to D-lactate
  Homolog annotation: Hit_ID=Q9FSZ6; Match level="QueryCoverage=77%, HitCoverage=100%, E-value=1e-127, Identity=81%"; Hit description =Putative mitochondrial glyoxalase II
  Pfam annotation: Domain name=Lactamase_B; Domain location=104-262; Score=117.7; E_value=3.4e-32; Accession=PF00753.17; Description =Metallo-beta-lactamase superfamily
MKVVGGWRKTKAKALKGGGRGEKQNRFQAYSREERVYERSGFCVWPDARQLCLGKGLLYGFMRLFSIPLKTLRGASRSLRVNQFCSVVNLSSSLQIELVPCLRDNYAYLLHDVDTGTVGVVDPSEAAPIIDALSKKDLNLTYIMNTNHHPDHTGGNAELKERYGAKVIGSEIDKERIPGIDIYLSDGDNWMFAGHEVHILATPGHTEGHVSFYFPGSGAIFTGDTLFSLSCGKLLEGTPKQMLSSLKRIMSLPDDTSIYCGHEYTSSNSKFALSIEPENKELQSYAAHVANLRNKGLPTIPTTVKVEKACNPFLRTWSMEIRQKLNIATTADDAEALGVIQQAKDNF

SEQ ID NO: 140519 - protein, 122 aa, Glycine max
  Coding DNA Sequence Number=SeqID_23741
  Gene Ontology: Mol. function=RNA-directed DNA polymerase activity; Biological process=RNA-dependent DNA replication
MVENRLRWFGHVERRPVDSVVRRVDEMERRQTLQGRGRSKKTIREVIKKDFELNGLDRSMYYEKITSIKINLVPQEPIPIEEVFQQLKWSRAVLTSDEGANRFQVFPNKLEEKKTLGTCLIL

SEQ ID NO: 140520 - protein, 831 aa, Glycine max
  Coding DNA Sequence Number=SeqID_23742
  Gene Ontology: Mol. function=DNA-directed RNA polymerase activity; Cellular component=nucleus; Biological process=transcription
  Homolog annotation: Hit_ID=Q1SWK4; Match level="QueryCoverage=66%, HitCoverage=94%, E-value=0.0, Identity=53%"; Hit description=Zinc finger, PMZ-type
  Pfam annotation: Domain name=DUF1336; Domain location=575-760; Score =231.4; E_value=1.9e-66; Accession=PF07059.3; Description=Protein of unknown function (DUF1336)
  Pfam annotation: Domain name=FAR1; Domain location=60-242; Score =81.2; E_value=3.2e-21; Accession=PF03101.5; Description=FAR1 family
  Pfam module annotation: Pfam domain module=DUF1336::FAR1; Domain location=575-760::60-242
MEDRNNHDECWESNSVDNGAESMEEVDELDVIMHDNMNGGFEPCEPASGMSFPSKEAVKSFYRQYASRMGFGSKGTRVPNTLKTLPTIKNNCEAKITVSFKDGLWYIMKAVLDHSHELSPTKAMMLRVNKNTSMHVNRTIEINHEAKAVMNKTIQSLACDVGGYRNLSFVEGDVKNHVLKERHTIGKEGDGKALRSYFLRMQEQNCNFFYDIDLDDFFRVKNVFWADARSRATYDSFGDVVTFDTTYLTKKYDMPFVSFVGVNHHGQHVLLGCALLSSEDTESFVWLFESWLRCMSGNPPKGIVTEQSKAIQKAIQLVFPTTQHRWCLWHVMKKIPEKLKTNTEYNKNIKSAMRSVVYDTFTEAEFEDQWSHFIKGFNLQDNEWLSELYNERSRWVPIFLKKDFWAGMSTTQQGENVHPFFDGYINSTTSLQQFVQLYDIALYGKVEKEFEADLRSFSTTIHCGSNSMIEKQFQSAYTHAKFNEVQAEFRAKINCSVSLRDVEGSICTYDVLEDIIVEGQPKEAIFETFAHCICTRKGETSAVKPQMQRYDNLCKDFNEIAELAAEFEDNCSNGWASPPGAAFKVRGPEYLTTKAKIPAGDYLLNPLGFDWIKSSVKMGEILKHSNSQVRKVIDNEFPAGDKPFVWAFNIQLPTKDNYSAVAYFTNKEPITEGSLMDNFLKGDDAFRNSRLKMIANIVNENFVEEVDIDIGSSMVAAAIVHLAFGYVTTLTVDLAFLIESQTESDFPENLLGAFRFSNLNPASARQIDPSSVLSTGGLQKSLSKRLWKSIGQILLPGSKEDDSTSGSQNTKTVDHKNVRVTSRNGEFLEFL

SEQ ID NO: 140521 - protein, 71 aa, Glycine max
  Coding DNA Sequence Number=SeqID_23743
MPKDNYDNGIHLILITHAKLLRIPFESKGSLRLDKFFQDQPLPLSISGINKPVTSLYDLKLRKFHLVVYQV

SEQ ID NO: 140522 - protein, 106 aa, Glycine max
  Coding DNA Sequence Number=SeqID_23744
MIVDTLPVFYYEKMVGYTPSSFDDLVFTDERIKVGMKRGKFNHLAWTNEKTGENEKGENEGETHVVTIIPIRPSFPPTQQCHYSANNNPSPYPPPSYPQRPSLNQL

SEQ ID NO: 140523 - protein, 80 aa, Glycine max
  Coding DNA Sequence Number=SeqID_23745
MEISNMWTNPFDVSLKHGAAARTRRIHKMTHSNWGFVRKYVCGGHHHNMEFVTAPASCGFTHQYILKDTNGTTTSLPNAS

SEQ ID NO: 140524 - protein, 93 aa, Glycine max
  Coding DNA Sequence Number=SeqID_23746
  Gene Ontology: Mol. function=DNA binding; Cellular component=plasma membrane; Biological process=cell-cell signaling
  Homolog annotation: Hit_ID=Q8LC13; Match level="QueryCoverage=95%, HitCoverage=44%, E-value=5e-18, Identity=47%"; Hit description =Remorin
  Pfam annotation: Domain name=Remorin_C; Domain location=1-88; Score =76.1; E_value=1.1e-19; Accession=PF03763.4; Description=Remorin, C -terminal region
AYKRLSAVGFWEDSKKASVEAQLKKIEENLEKKKAEYVEKMKNKVAKIHLLAEEKRAVVEAQKREEFIDLEETASKFRSRGDTPRRFFACFSG

SEQ ID NO: 140525 - protein, 84 aa, Glycine max
  Coding DNA Sequence Number=SeqID_23747
  Subcellular localization annotation: CTP_CleavageSite=33; ConfidenceScore=5.19e-01
MKNERRTMKNGGKSSRNHPLKLLGSVTETPQLRFSSRKQFFSLILRENKEVVVAQASWVASTRRHRLLLEDPVRPDCYLYTPVY

SEQ ID NO: 140526 - protein, 56 aa, Glycine max
  Coding DNA Sequence Number=SeqID_23748
  Subcellular localization annotation: CTP_CleavageSite=22; ConfidenceScore=5.38e-01
MGTTMAVRTLMALTNWTTRLVRTLTKRESSSLARRRPTRKPKDTLSGRPVLSVKLA

SEQ ID NO: 140527 - protein, 287 aa, Glycine max
  Coding DNA Sequence Number=SeqID_23749
  Gene Ontology: Mol. function=sequence-specific DNA binding; Cellular component=nucleus; Biological process=regulation of transcription
  Homolog annotation: Hit_ID=Q9SV15-2; Match level="QueryCoverage=98%, HitCoverage=95%, E-value=2e-63, Identity=48%"; Hit description =Isoform 2 of Q9SV15
  Pfam annotation: Domain name=WRKY; Domain location=215-275; Score =139.1; E_value=1.2e-38; Accession=PF03106.6; Description=WRKY DNA -binding domain
MALELMGFPKLDEQKAIQEAASEGLKGMEHLIRTLSQQPLSLKHRTHRCYCFQYSSPPAPVHNANTSTSSIQLPPPPQNPNIPAPVQFPSPAPVAVHHAPVTLDFTKPHNALLSSNAKSVELEFSKETFSVSSNSSFMSSAITGDGSVSNGKIFLAPPATSARKPPAFKKRCHEHREHSGDVSGNSKCHCVKRRKNRVKNTVRVPAISSKIADIPPDEYSWRKYGQKPIKGSPYPRGYYKCSTVRGCPARKHVERAPDDPAMLIVTYEGEHRHAVQAAMQENAAGVV

SEQ ID NO: 140528 - protein, 310 aa, Glycine max
  Coding DNA Sequence Number=SeqID_23750
  Gene Ontology: Mol. function=protein transporter activity; Cellular component=nuclear pore; Biological process=protein import into nucleus, docking
  Homolog annotation: Hit_ID=Q2HVN9; Match level="QueryCoverage=64%, HitCoverage=20%, E-value=8e-92, Identity=78%"; Hit description =Armadillo-like helical
  Pfam annotation: Domain name=HEAT; Domain location=145-181; Score =14.4; E_value=0.42; Accession=PF02985.12; Description=HEAT repeat
  Pfam annotation: Domain name=HEAT; Domain location=82-117; Score =28.2; E_value=2.9e-05; Accession=PF02985.12; Description=HEAT repeat
  Pfam annotation: Domain name=HEAT_PBS; Domain location=102-127; Score= 12.4; E_value=1.7; Accession=PF03130.6; Description=PBS lyase HEAT -like repeat
  Pfam annotation: Domain name=HEAT_PBS; Domain location=166-202; Score= 5.1; E_value=20; Accession=PF03130.6; Description=PBS lyase HEAT-like repeat
  Pfam module annotation: Pfam domain module=HEAT::HEAT::HEAT_PBS::HEAT_ PBS; Domain location=145-181::82-117::102-127::166-202
  Subcellular localization annotation: CTP_CleavageSite=78; ConfidenceScore=5.14e-01
MTVEEDKEQDRGVLCQHPSPSPQFLPPSPCRHHCRLTIVCSFFCRPSRSRRHHNKLSLPTTTSTSLFEPKLEAVFLCLSLTLWYLMVLSMILNSFCDPHPRVRWAAINAIGQLSTDLGPDLQVLVAHAASAVLNFTENCTPDILTRYLDGIVSKLLVLLQNGKQMVQEGALTALASVADSSEVQFQKYYDAVMPYLKAILVNANDKSNRMLRAKAMECISLVGMAVGKEKFRDDAKQVMDVLMSLQQSQLDVDDPTASYMLQDFLPYMGFVMPPLLQSAQLKPNVTIITSADSDTEFDEDDDRCPFSYCY

SEQ ID NO: 140529 - protein, 224 aa, Glycine max
  Coding DNA Sequence Number=SeqID_23751
  Pfam annotation: Domain name=zf-BED; Domain location=168-210; Score =25.2; E_value=0.00023; Accession=PF02892.5; Description=BED zinc finger
MRSSIRVSNRARPVGPGPACSPKKLALSLKTLTLDLEPSPFSFDFEPHQPHVFDWTSRASPSVPQSLPLWRRLRVNLTLTSSLSFKTLTLDLKPSPFSFDFKPQHQPHVFDWTSSLTLSHSLPPSVAVASRQPHPHGLPSRLRVIFILPFTPNTYLRDCASLCQHLSHFPHCVCDDGKTRVACNACGKKYVIGGKTHGTSQLKRHLKKCEKSKGPDIGQMMLDM

SEQ ID NO: 140530 - protein, 129 aa, Glycine max
  Coding DNA Sequence Number=SeqID_23752
MASYGGELLLDSYSPSSGVSNHLTSFSIPLPLIFKKKRTPLMKKIQGLQAPHGATSELAYGLRANLFDEEGNDVGVWCIHGLIKMGSRYERGCQGSSIEIQQTHREFKMKKSLKISFDKNVNLQEDVLS

SEQ ID NO: 140531 - protein, 108 aa, Glycine max
  Coding DNA Sequence Number=SeqID_23753
MDRARLVYGLVTHMDMNIDTLISGQISSVAQSNSSRLRFPALITTLCRARGITSDSLTYESLSPAINLAYIKKNCWNMDYLIVNFRGARKARARPVDVPSSSTPRGIL

SEQ ID NO: 140532 - protein, 85 aa, Glycine max
  Coding DNA Sequence Number=SeqID_23754
  Gene Ontology: Mol. function=transcription regulator activity; Cellular component=nucleus; Biological process=regulation of transcription
  Homolog annotation: Hit_ID=Q1SL31; Match level="QueryCoverage=94%, HitCoverage=24%, E-value=4e-09, Identity=47%"; Hit description=Helix- loop-helix DNA-binding
MDEKFFASFVPSISDIVTEESAKLYKDVGSDKLENSQCNQMEPIVFPTKQLQLKRKLDVPAEDKINKGSENQKKKARVSKDANAN

SEQ ID NO: 140533 - protein, 78 aa, Glycine max
  Coding DNA Sequence Number=SeqID_23755
  Gene Ontology: Mol. function=transcription regulator activity; Cellular component=nucleus; Biological process=regulation of transcription
  Homolog annotation: Hit_ID=Q1SL31; Match level="QueryCoverage=100%, HitCoverage=22%, E-value=4e-22, Identity=69%"; Hit description=Helix- loop-helix DNA-binding
  Pfam annotation: Domain name=HLH; Domain location=27-74; Score=32.5; E_value=1.5e-06; Accession=PF00010.16; Description=Helix-loop-helix DNA-binding domain
  Subcellular localization annotation: CTP_CleavageSite=60; ConfidenceScore=5.16e-01
MSEDDNTSKSALNSNGKTRASRGSATDPQSLYARKRRERINERLRILQNLVPNGTKVDISTMLEEAVNYVKFLQLQIK

SEQ ID NO: 140534 - protein, 69 aa, Glycine max
  Coding DNA Sequence Number=SeqID_23756
MEHLLVGDEQKRKTKSKNAKKDDPRAANSSIPWGWLAQASPARPGELTCTHFFFGAEENINHVPSLLMD

SEQ ID NO: 140535 - protein, 237 aa, Glycine max
  Coding DNA Sequence Number=SeqID_23757
  Gene Ontology: Mol. function=chitin binding; Cellular component =extracellular region; Biological process=chitin metabolic process
  Homolog annotation: Hit_ID=UPI000044A8F0; Match level="QueryCoverage =92%, HitCoverage=100%, E-value=6e-22, Identity=27%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHVLAIRGLHALSFRGLHVLSFRGLHFLAFRGLHILTFRGLHVLTFRGLHALAFRGLDVLAVKDYTSSPSEGYMPSPSEDYTSSPLEDCTTHLQRVACPRLQRTTRLHALAFRGLHVLAFKGLHALAIRGLHGLTFRGLHVLTFRGLHTLAFRRLHALAFKGRHVLNFRGLHALAFRGLHTLAFKGRHVLNFRGLHALAFRGLRILTFIGLHIHTLREFKVLCP

SEQ ID NO: 140536 - protein, 103 aa, Glycine max
  Coding DNA Sequence Number=SeqID_23758
MKALGGLEAHLGELMLHFEVTLLAQGSCLLHPWAKLASTAKDSFNTLSTKENLAKHLHQGHALSARSVSSASLRVRLALSPNPLTRAKREGGAKRNVAISEPI

SEQ ID NO: 140537 - protein, 103 aa, Glycine max
  Coding DNA Sequence Number=SeqID_23759
VVVSLSRDHALSEYHLLREASARLVSKRNLEGNLPRQHALSASSARPTRSLSLLALSAPGSLSQNPLTRAKRENGVKRTFEVKKPFLSLKWKIRRELWENSES

SEQ ID NO: 140538 - protein, 266 aa, Glycine max
  Coding DNA Sequence Number=SeqID_23760
  Homolog annotation: Hit_ID=P00722; Match level="QueryCoverage=21%, HitCoverage=5%, E-value=2e-23, Identity=94%"; Hit description=Beta -galactosidase
MVVQAKVGGQTKFELAKTSFEVKRENEVGDGGVWHGLVHYKGGGSQCDYGVAQWCCLVDGGCKYKQLVDDGSEDGGCDFYIVVVMESVEEDSNSCSPGDPLSSRAAATAVELQFRPIVSRITIHWAVVLQRRDWENPGVTQLNRLAAHPPFASWRNSEEARTDRPSQQLRSLNGEWDAPCSGALSAAGVVVTRSVTATLASADVRRCFCRYAPPRAKEAKWRKKSLDIPPLIYPNGIVKNILRHFSQLLNVPIPDRSAGYYGLFKD

SEQ ID NO: 140539 - protein, 65 aa, Glycine max
  Coding DNA Sequence Number=SeqID_23761
MLLHHRNNPYKQGPEAPTPLYKYQVPYHPFDISFSPNSCSPSCPLNKGYFQSNVQDREDHLMMEP

SEQ ID NO: 140540 - protein, 243 aa, Glycine max
  Coding DNA Sequence Number=SeqID_23762
  Homolog annotation: Hit_ID=Q53NY5; Match level="QueryCoverage=29%, HitCoverage=39%, E-value=9e-10, Identity=43%"; Hit description =Expressed protein
MASDHTMSFHSSSLHEEDFDDDDDDHLHPHPHNLSRLSVCTSSTFGDNDHVDNLASMCVSHLSIESFDADGVLSSDSENELGSFYSLPSTPPRRRKQVKDYASDNGNETKKSDPRRRRRPSMMGFEGVEKKSKRKEEGFSGESDQSGLMLITRPKGGIRSLCMDLEEVKACRDLGFELEHERMLEIPSLLSFSNSTLDTSSGSNSPITNWRISSPGDDPRDVKARLKVWAQAVALASASKYGT

SEQ ID NO: 140541 - protein, 63 aa, Glycine max
  Coding DNA Sequence Number=SeqID_23763
  Gene Ontology: Mol. function=glutathione transferase activity
  Homolog annotation: Hit_ID=Q9FQE9; Match level="QueryCoverage=96%, HitCoverage=47%, E-value=1e-16, Identity=57%"; Hit description =Glutathione S-transferase GST 9
MADEVVLLDTWASMFGMRVRIALAEKGVKEEILRNKMQYIDEVWNDDKAPILPSDPYQRLNAN

SEQ ID NO: 140542 - protein, 488 aa, Glycine max
  Coding DNA Sequence Number=SeqID_23764
  Gene Ontology: Mol. function=binding; Cellular component =mitochondrion; Biological process=protein amino acid phosphorylation
  Homolog annotation: Hit_ID=Q8L4S1; Match level="QueryCoverage=92%, HitCoverage=68%, E-value=2e-88, Identity=27%"; Hit description=Crp1 -like protein
  Pfam annotation: Domain name=PPR; Domain location=114-148; Score =23.7; E_value=0.00066; Accession=PF01535.11; Description=PPR repeat
  Pfam annotation: Domain name=PPR; Domain location=149-183; Score =30.5; E_value=6e-06; Accession=PF01535.11; Description=PPR repeat
  Pfam annotation: Domain name=PPR; Domain location=218-252; Score=0.2; E_value=7; Accession=PF01535.11; Description=PPR repeat
  Pfam annotation: Domain name=PPR; Domain location=254-288; Score =29.3; E_value=1.4e-05; Accession=PF01535.11; Description=PPR repeat
  Pfam annotation: Domain name=PPR; Domain location=289-323; Score =33.2; E_value=9e-07; Accession=PF01535.11; Description=PPR repeat
  Pfam annotation: Domain name=PPR; Domain location=324-358; Score =42.8; E_value=1.2e-09; Accession=PF01535.11; Description=PPR repeat
  Pfam annotation: Domain name=PPR; Domain location=359-393; Score =39.8; E_value=9.1e-09; Accession=PF01535.11; Description=PPR repeat
  Pfam annotation: Domain name=PPR; Domain location=394-428; Score =24.0; E_value=0.00054; Accession=PF01535.11; Description=PPR repeat
  Pfam annotation: Domain name=PPR; Domain location=44-78; Score=42.8; E_value=1.2e-09; Accession=PF01535.11; Description=PPR repeat
  Pfam annotation: Domain name=PPR; Domain location=448-482; Score=9.1; E_value=0.62; Accession=PF01535.11; Description=PPR repeat
  Pfam annotation: Domain name=PPR; Domain location=79-113; Score=39.0; E_value=1.6e-08; Accession=PF01535.11; Description=PPR repeat
  Pfam module annotation: Pfam domain module=PPR::PPR::PPR::PPR::PPR::PP R::PPR::PPR::PPR::PPR::PPR; Domain location=114-148::149-183::218 -252::254-288::289-323::324-358::359-393::394-428::44-78::448-482::79- 113
MGISFKQFLSTELFKIGGRAPVSGEARSTNSSSLNGPQKPRLSNTYNVLIDLYGKAGRLSEAAEVFAEMLKAGVAVDVWTFNTMIFVCGSQGDLAEAEALLGMMEEKGVAPDTKTFNIFLSLYAEARDIGAAVLCYKRIREAGLCPDEVTYRALLGVLCRKNMVREVEDLIDEMERAFVSVDEHCVPGIVEMYVGEGDVDKAFDLLKKFQVNGEMSSNIRSAIMDVFAEKGLWEEAEDVFYRGRNLAGRKRDVLECNVMIKAYGKAKLYDKAISLFKGMKNHGTWPNESTYNSLVQMLSGADLVDQAMDLVDEMQEVGFKPPCQTFSAVIGCYARLGQLSDAVSVFKEMVRTGVKPNEVVYGSLINGFAEHGSLEEALKYFHMMEESGLSSNLVVLTSLLKSYCKVGNLEGAKAIYERMKNMEGDLGLVSEAKLAFENLREMGRADAISYATIMYLYKGVGLIDEAIEIAEEMKLSGTGVLCCQRAIL

SEQ ID NO: 140543 - protein, 45 aa, Glycine max
  Coding DNA Sequence Number=SeqID_23765
MYFAWWRGGGSRLCRCGKESYDLRACVTAWWRKIVRRKSILSLLQ

SEQ ID NO: 140544 - protein, 205 aa, Glycine max
  Coding DNA Sequence Number=SeqID_23766
  Homolog annotation: Hit_ID=Q0M8S4; Match level="QueryCoverage=18%, HitCoverage=24%, E-value=3e-11, Identity=71%"; Hit description =Hypothetical protein precursor
  Pfam annotation: Domain name=BA14K; Domain location=81-204; Score =172.4; E_value=1.2e-48; Accession=PF07886.2; Description=BA14K-like protein
MFRPEPTNWLSKKKKVLLFTSNGLSTVVNGGSQMRDYMKNILAVGLSAIVVAGAIVPAEAAMPLPMAPKSVETVGNDASKNIVNVQYWRDRRDWDGGRRGWYGGHRGYRDYRPGYRHHDGYWFPLAAFATGAIIGGALSQPREVYRPVPEYRPRPVYREYRPVRRGGMSQAHVNWCYGRYRSYDAYSNTFQPYHGPRQPCYSPYS
